United States Patent 8,952,217 (PROCESS FOR DECREASING VERBASCOSE IN A PLANT BY EXPRESSION OF A CHLOROPLAST-TARGETED FIMD PROTEIN) - sequence listing, part 8

SEQ ID NO: 29152 - DNA, 1467 bp, Ashbya gossypii
  CDS (1)..(1467)
atgctcagactaagcagaggttgtgtaggaagcagcgcagcgcgtaggttgatgtcgacagcaggagcgccacagcagttcagggtcgagacggacgccttcggggagatccgggtgccagcagacaagtactggggcgcgcagacacagcggtcgctggagaacttccggatcggcggagcgcgcgagcgcatgccggagccggtggtgcgcgcgttcggcgtgctcaagaagtctgcggcggtggtcaacgagcagctgggcacgctggagccgggcattgcgaaggcgatccagcaggcggcggacgaggtggcccagggccagctgatggagcacttcccgctggtggtgttccagaccgggtcgggcacgcagagcaacatgaacgccaacgaggtgatctcgaaccgcgcgattgagctgctgggcggagagctgggcagcaagcaggtgcaccccaacaaccactgcaaccaggcgcagtcgtcgaacgacacgttcccgtcggtgatgcacatcgcggcggtgacggagatcacgcgctcgctgctgccggagctggaggcgctgcgcgtgtcgttccagcgcaagacggacgagtttgcgcacatcgtcaagatcgggcgcacgcacctgcaggacgcgacgccgctgacgctgggccaggagttcagcggctacacacagcagatcgccaacggcatcgcgcgcgtcgagcacgcgcaggagagcctgcgcttcctcgcgcagggcggcaccgccgtgggcacgggcctcaacacgcgccgcggcttcgcggagcagatcgcggcccaggtgtcccgcgagaccggcctcgagttccgcaccgcgcccaacaagttcgaggcgctggccgcgcacgacgccgtcgtcgaggcctccggcgcgctcaacacgcttgcctgctcgctgttcaagatcgccaacgacatccgctacctcggctccggcccccgctgcggctacggcgagctctcgctgcccgagaacgagcccggctcctccatcatgcccggcaaggtcaacccgacccagaacgaggccctcacgcaggcctgcgtccaggtcatgggcaacaacgccgccatcaccttcgcgggcgcgtccggccagttcgagctcaacgtcttcaagcccgtcatgatcgccaacctgctcagctccgtccgcctgctcgccgacgccgcgcgctccttccgcgtccactgcgtcgacggcatccaggacaacgaggaccgcatcgccaagctgctgcacgagtcgctgatgctggtcacagctctgaaccccaagatcggctacgacgccgcctccgcggtcgccaagaacgcccacaagaagggcatcaccctccgcgcgtccgcgctcgagcttggcgtcctgaccgacgcggagttcgacgagtgggtcgtccccgagaagatgattggtccccgcgactaa

SEQ ID NO: 29153 - protein, 488 aa, Ashbya gossypii
MLRLSRGCVGSSAARRLMSTAGAPQQFRVETDAFGEIRVPADKYWGAQTQRSLENFRIGGARERMPEPVVRAFGVLKKSAAVVNEQLGTLEPGIAKAIQQAADEVAQGQLMEHFPLVVFQTGSGTQSNMNANEVISNRAIELLGGELGSKQVHPNNHCNQAQSSNDTFPSVMHIAAVTEITRSLLPELEALRVSFQRKTDEFAHIVKIGRTHLQDATPLTLGQEFSGYTQQIANGIARVEHAQESLRFLAQGGTAVGTGLNTRRGFAEQIAAQVSRETGLEFRTAPNKFEALAAHDAVVEASGALNTLACSLFKIANDIRYLGSGPRCGYGELSLPENEPGSSIMPGKVNPTQNEALTQACVQVMGNNAAITFAGASGQFELNVFKPVMIANLLSSVRLLADAARSFRVHCVDGIQDNEDRIAKLLHESLMLVTALNPKIGYDAASAVAKNAHKKGITLRASALELGVLTDAEFDEWVVPEKMIGPRD

SEQ ID NO: 29154 - DNA, 1323 bp, Anopheles gambiae str
  CDS (1)..(1323)
atgaagagcaggactgaacacgacagcttcggcgcaatcgccgtgccggccgatcggctgtggggagcccagacccagcgctccctgcagcacttcgacatctccggcgagcgccagccgatggcgctgatccacgccctggcccgcatcaagtcggcctgtgcccgggtcaaccacgccaacgggctgctgcccgcccgcacggcgcaggccatcatgagtgccgccgacgagatcctgtgcggccagcatgatgaggagttcccgctgcgggtatggcagaccggctcaggcacccagaccaacatgaacctcaacgaggtgctggccaaccgggccagcgagctgcttggcggcctgcgcggcgaggggcggctggtgcaccccaacgacgaggtgaacaagagccagtcgagcaatgacgtcttcccgagtgccatgaacctggcagccgtcacggccatcaccgggcacctgctgcccgccttgacgactctgagtaccaccctggccggcaaggcggcggctttcgacaacatcgtcaagataggccgcacccatctgcaggatgccaccccgctcaccctggggcaggagttctccggctgggtcgcccagctcgagcagggggagcgccatatccgggccgccctgccccatctgtgcgagctggccctcggcggcacagccgtcggcaccggcctcaacaccccgcccggcttcgccgaggcggtggccgccaccctggccgagcagaccggcctgccgctgacgctggctgcctccctcatgaagatcgctaacgacgtgcgctggctggcgagcggcccccgcagtgggctgggggagcttatcatcccggaaaacgagccaggctcatccatcatgcctggcaaggtcaatccgacccagtgcgaggcgctcaccatgctgtgcgcccaggtgatgggcaacgacgtggccatcaacatcggcggcgccagcggcaacttcgagctcaacgtgtttaggccgatgatcgcccacaacttcctgcagagcgtgcggctgctggcggacggcatgcagagcttccaccatcattgcgccgtcggcatcaccccgaaccggccccgcatcgacgagctgctggcccgctccctgatgctggtgacggcgctcaacccccatatcggctatgacaaggcggcagagatcgccaagcgggcccaccatgaggggctcagcctgcgggaggcggccatcgcctccggccacctgacggcgcagcagttcgatgcctgggtggtgccggccgacatggtgggtcggcgcggcggctga

SEQ ID NO: 29155 - protein, 440 aa, Anopheles gambiae str
MKSRTEHDSFGAIAVPADRLWGAQTQRSLQHFDISGERQPMALIHALARIKSACARVNHANGLLPARTAQAIMSAADEILCGQHDEEFPLRVWQTGSGTQTNMNLNEVLANRASELLGGLRGEGRLVHPNDEVNKSQSSNDVFPSAMNLAAVTAITGHLLPALTTLSTTLAGKAAAFDNIVKIGRTHLQDATPLTLGQEFSGWVAQLEQGERHIRAALPHLCELALGGTAVGTGLNTPPGFAEAVAATLAEQTGLPLTLAASLMKIANDVRWLASGPRSGLGELIIPENEPGSSIMPGKVNPTQCEALTMLCAQVMGNDVAINIGGASGNFELNVFRPMIAHNFLQSVRLLADGMQSFHHHCAVGITPNRPRIDELLARSLMLVTALNPHIGYDKAAEIAKRAHHEGLSLREAAIASGHLTAQQFDAWVVPADMVGRRGG

SEQ ID NO: 29156 - DNA, 1602 bp, Neurospora crassa
  CDS (1)..(1602)
atgcttcgatcgatgcgcactgccggccgcctggccaagcctcgggctgctgctgccgctgctagcacatgcctctctggcaccgcccgcgttgcttcaaatgccgccagctcctcctccaaggccgccgtcagcttctccgttgctcccaagaccactgctcgttacttctccagctcctccgccatggccaagaacaccagaatcgagaccgacgcctttggcgagattgaggtcgaggatgacaagtactggggcgcccagacccagcgctctctgagcaacttcaagatcaaccagccccaggaccgcatgccccctcccatcatcaaggctttcggtatcctcaagggcgctgccgccaaggttaacacgcgctacggccttgaccccaagattgccgaggccatccagcaggccgccaaggaggtcgccgacctcaagctcctcgaccacttccccctcgtcgtctggcagaccggctccggcacccagtccaacatgaacgccaacgaggtcatctccaaccgtgccattgagatcctcggcggcgtcaagggctccaagaagcctgtgcaccccaacgaccacgtcaaccgctccgcctcgtccaacgacaccttccctaccgtcatgcacatcgccgccgtcctcgaggtcgagggtgagctcctgcccgcgctcaagtccctccgcgacgccctccaggccaaggtggacgagttcgaggccaagaagatcatcaagatcggccgcacccacttgcaggacgccacccccttgactctcgcccaggagttctctggctacgttgcccagctcgacttcggcatcaagcgcgtcgaggagtccctccccgacctccgcctgctcgcccagggcggcaccgccgtcggcaccggcatcaacacgtacattggcttcgccgaggccattgccgaggaagtcaccaagatgaccggcaccgagttcaagacggcccccaacaagtttgaggctctcgccgcgcacgacgccctcgtccacgctcacggcgccctcaacaccctggctgcctctttgaccaagatcgcccaggacatccgctacctcggctccggcccgcgctgcggcctcggcgagctcaacctgcccgagaacgagcccggctcgtccatcatgccgggcaaggtcaaccccacccagtgcgaggccttgaccatggtctgcgcgcaggtgatgggcaaccacgtggccaccaccattggcggcatgaacggccagttcgagctgaacgtgtacaagcctctgatcatccgcaacttcttgcactctgtccgcctgttggccgatggcatgcgctccttcgagaagaacttggtccacggcttgacggccaacgaggagaggattgccaagatcatgaaggagagtctgatgctggttacttgcttgaaccccaagattggctacgacatggcgtccaaggtggccaagaacgcgcacaagaagggcttgacgctcaagcagtcggcgctcgagctgggtgcgttgacggaggaggagtttgatgccttggtgaagcccgagttgatgattggtcctcagccttacaagggttag

SEQ ID NO: 29157 - protein, 533 aa, Neurospora crassa
MLRSMRTAGRLAKPRAAAAAASTCLSGTARVASNAASSSSKAAVSFSVAPKTTARYFSSSSAMAKNTRIETDAFGEIEVEDDKYWGAQTQRSLSNFKINQPQDRMPPPIIKAFGILKGAAAKVNTRYGLDPKIAEAIQQAAKEVADLKLLDHFPLVVWQTGSGTQSNMNANEVISNRAIEILGGVKGSKKPVHPNDHVNRSASSNDTFPTVMHIAAVLEVEGELLPALKSLRDALQAKVDEFEAKKIIKIGRTHLQDATPLTLAQEFSGYVAQLDFGIKRVEESLPDLRLLAQGGTAVGTGINTYIGFAEAIAEEVTKMTGTEFKTAPNKFEALAAHDALVHAHGALNTLAASLTKIAQDIRYLGSGPRCGLGELNLPENEPGSSIMPGKVNPTQCEALTMVCAQVMGNHVATTIGGMNGQFELNVYKPLIIRNFLHSVRLLADGMRSFEKNLVHGLTANEERIAKIMKESLMLVTCLNPKIGYDMASKVAKNAHKKGLTLKQSALELGALTEEEFDALVKPELMIGPQPYKG

SEQ ID NO: 29158 - DNA, 1632 bp, Rhodopirellula baltica
  CDS (1)..(1632)
atgcagtctgcccacccaactttcggccgccgtgtcttgcgattcgtttcctacgattcgaccgaacgccagatagtagcagaaaccatcgcagagtttgggtttcgggcgtcgttcgcgccgtttcagtggattgctaccatgaccggcatcacggtttttgcttttgacgacccgtttttcctccttgttgatccagctatcgctatgaccgattttcgaaccgaacgcgactcgatgggcgaagtccgcgtgccgcaaaacgcttactacggtgcccagactcaacgtgcggtcgagaactttcctgtcagcggctggcaactcccgccgtcgatgatcgcggcgatgggacgcgtcaaattggcatgcgggatcgccaaccgcgatctcggaaagttgacgggttcgggcaagaacccgcttagcgatggtcaagtcgaatcgatgttgtcggcggccaaggaagtcgccgagggacagttggcggatcagttccccgtggacgtgttccagacgggcagcggcaccagcagcaacatgaacatcaacgaagtgctgtccaatcgcgcgatcgaaatcgatggcggcgaccggatggcggaggaaaagtcgatccaccccaacgatcacatcaacatggggcaatcgaccaacgacaccttcccaaccgcgattcatgttgcggccgcttacgaaatcgaaaatcgattgttgccagcattgcgacgcatgcacgaatcgctgacggaaaaagcccaggcttgggacaagatcatcaagatcggacgcactcacctgatggacgcaacgccgttgcgattgggacaggagtttggcggatttgctcgtcaaattgaattgtcgatcgcccgcgccgaagcggcccgcgacgcggtgctggaattgcccgtcggtggcacggcggttggcagcggtatcaacactcaccctgaatttggtgctcgcgtcgcggccagcttgtcagagcaaaccggcatcgctttcatcgaagcggtcaaccatttcgaaggcaacgcgaaccgcgatggtttggtggattcacacggtggattgaagtgcgtcgctcaaacgttgctcggtctggcgaacaacatccgctggctgggcagcggacctcgttgcggtttttatgaagtcaaactgccgactcgccaaccgggaagctcgatcatgcccggaaaggtcaatccggtgatgtgcgagtcgctgatgcaggtcgccgcccgcgtgatcggcaacgacacttgcatgacggtcagcggaggctgcggcggcaacttccagctcaacatcatgatgcccgtgatggctcacaccatcttggagtccatcgagttgttggccggtggtgtcaccgcgttcatcgatttctgcttggatggcatggaacccaacgaagaagcttgcgaagcctcggtggagcagagcctctccatgtgcaccagtctgaacccgttgatcggatacgaacaagccgctgcgctggccaaggaagcgttcaagtccggtcaaacgattcgcgaactgtgcaaagaaaaagggatcttggccgacgacgttctgaccgaagcgttggatccttggaaaatgaccgagccgcaagcatag

SEQ ID NO: 29159 - protein, 543 aa, Rhodopirellula baltica
MQSAHPTFGRRVLRFVSYDSTERQIVAETIAEFGFRASFAPFQWIATMTGITVFAFDDPFFLLVDPAIAMTDFRTERDSMGEVRVPQNAYYGAQTQRAVENFPVSGWQLPPSMIAAMGRVKLACGIANRDLGKLTGSGKNPLSDGQVESMLSAAKEVAEGQLADQFPVDVFQTGSGTSSNMNINEVLSNRAIEIDGGDRMAEEKSIHPNDHINMGQSTNDTFPTAIHVAAAYEIENRLLPALRRMHESLTEKAQAWDKIIKIGRTHLMDATPLRLGQEFGGFARQIELSIARAEAARDAVLELPVGGTAVGSGINTHPEFGARVAASLSEQTGIAFIEAVNHFEGNANRDGLVDSHGGLKCVAQTLLGLANNIRWLGSGPRCGFYEVKLPTRQPGSSIMPGKVNPVMCESLMQVAARVIGNDTCMTVSGGCGGNFQLNIMMPVMAHTILESIELLAGGVTAFIDFCLDGMEPNEEACEASVEQSLSMCTSLNPLIGYEQAAALAKEAFKSGQTIRELCKEKGILADDVLTEALDPWKMTEPQA

SEQ ID NO: 29160 - DNA, 1440 bp, Helicobacter hepaticus ATCC 51449; identical to SEQ ID NO: 11102
  CDS (1)..(1440)

SEQ ID NO: 29161 - protein, 479 aa, Helicobacter hepaticus ATCC 51449; identical to SEQ ID NO: 11103

SEQ ID NO: 29162 - DNA, 1422 bp, Xylella fastidiosa
  CDS (1)..(1422)
atggagatgcagatgagcaacagtgatcgttacagaattgaacacgacagtatgggtgatctacgggtgccgattgatgcgttgtggggcgcgcagacgcaacgtgctatcgagaactttccgatttccgggcggtcaatgcctcagggatttatccacgcattggggtttatcaaggcggctgcggcgaaggttaacgctgagctggggctgttaccaaagtcaatggccaaggagattgaggccgctgcattggatgtcgctgcgggccgttatgatgcggaatttccagtcgatatttaccagactggctcaggaacctcgtcgaatatgaacgctaatgaggtgattgcgacgctggccatgcgtgccaccaaggggcctatccaccccaacgaccatgtcaaccttggccaaagttctaatgatgtggttccaacagcgattcggatttccgcaacgttggcggttcagggacgattattaccagcgctcaagcatttacgcaaaatgattaacaagcgtgcccgtggtttgggcagtgtggtgaagaccggccgtacccacctgatggatgcgatgccgctgacgttcgctcaagaattcggtgcctggtcggcacaaattgtctctgcagaggcgcgcttgaatgacaccctgaaacggttgcatcggctgccattgggagggacagcaattggtaccggcatcaatacggatccacatttcggccgtaatgcggtgaaggtactgtcagcattgacagggattcactttgagagtgcgaacaataagttcgaaggattggcagcgcaagatgatttggttgagttatccggccagttcaatacgttagcagtggcgttgatgaagattgctaatgatctacgctggatgaacgctggaccgcttgctggcttgggagagattgagttgcccgcgttgcagccgggaagttcgatcatgccaggtaaggtaaacccggtgattccggaagcagtggtgatggtcgcctcgcaagtgattggccatcacactgcagtgaccgtggctgggcagagtggcaattttcagttgaatgtgacgttaccgctgattgcttacaacctattggagtctgcgacgttgcttggaaatgtggtgatgctgttggctgataaagtcatcgttggcctgaaggtgcgtcaggatcgagtgcaggaggtgctggagcggaatccgattttggtgacagcgttgaatccgatcattggctatgagaaagctgcggtgattgctaagcgtgcttataaggagcaccggccagtgcttgaggtcgcctgcgaggagagcaacctaaaccctgtggagttggcgcgcttacttgatccggctgcgttgactgagggtgggattcatgtcgtcgggggaggtggtggataa

SEQ ID NO: 29163 - protein, 473 aa, Xylella fastidiosa
MEMQMSNSDRYRIEHDSMGDLRVPIDALWGAQTQRAIENFPISGRSMPQGFIHALGFIKAAAAKVNAELGLLPKSMAKEIEAAALDVAAGRYDAEFPVDIYQTGSGTSSNMNANEVIATLAMRATKGPIHPNDHVNLGQSSNDVVPTAIRISATLAVQGRLLPALKHLRKMINKRARGLGSVVKTGRTHLMDAMPLTFAQEFGAWSAQIVSAEARLNDTLKRLHRLPLGGTAIGTGINTDPHFGRNAVKVLSALTGIHFESANNKFEGLAAQDDLVELSGQFNTLAVALMKIANDLRWMNAGPLAGLGEIELPALQPGSSIMPGKVNPVIPEAVVMVASQVIGHHTAVTVAGQSGNFQLNVTLPLIAYNLLESATLLGNVVMLLADKVIVGLKVRQDRVQEVLERNPILVTALNPIIGYEKAAVIAKRAYKEHRPVLEVACEESNLNPVELARLLDPAALTEGGIHVVGGGGG

SEQ ID NO: 29164 - DNA, 1386 bp, Vibrio parahaemolyticus
  CDS (1)..(1386)
atgaccaccgaatttcgtatcgaaaccgacagcatgggcgaagtaaaagtcccggcgaatgccttgtatcaagcgcaaactcagcgtgctatcgataacttcgcattcagccagcacaccatgccaagcggtttcatccaagctttggcccacatcaagcaaacggcagcgctgaccaacgcacaactagggttactggaaggtgatattgccaatgcgattgcagacgccgcgcaagccattattgatggccagcatctcgatcagttccctatcgacctgttccaaaccggttctgggacaagctccaacatgaacgccaatgaagtgattgccacgctcgcgtctgaattgcttggcggcaacgtcaccccgaatgaccacgttaacatgggtcaaagcagtaacgatgtggtgccgacggcgattcaagtcagctcagcacttgctattgaacacaagttgttgcctgcactggctcatcttagccaaagcctagaaaccaagaagcaagctttgcaaggtgtggtaaaaacaggccgaactcatttgatggacgccatgccaatcactttcgcgcaagagctgggcggctggcaattccagattgaacacgctaaacaagccattgaacaaacactgccgatggtgaaagcccttgctcaaggcggcactgccgttggcacagggatcaacgccgatccgcgttttgcctctctgtttgcagacaacctcactcagtccactcgagtcacctttacttcaagcgacaatttcttcttcaacctcagcagccaggatgcgatcgtcgcactgtctggacagctcaaaacagcagcagttgcgatcatgaagatcgcaaacgatcttcgctggatgaactctggcccattggctggcttgggtgaaatcgaactgcaaggcttacagccgggttcatcaatcatgccgggcaaagtaaacccggttattcctgaagccgcagccatggcgtcagcgcaagtgattggcaacgatgcaaccatcaccatcgcgggtcagtctggcaacttccagttgaatgttatgctacctgtgattgcgcataatattttggagagcattgagctcgttgcgaacagtgcgaccgcccttgccgataaggcgattgcgacctttgacgttcgacaagataacctcgatattgctttggccaagaatccgattttagtcaccgcactaaacccggtgatcgggtatttgaaagcggcagaagtcgcgaaaaaagcctacaaacaaggacgagccatcattgatgtggccgaagaggaaacggatttaaaccgcgaaacgcttgaaaggctgcttaatccagccaaattgactcaaggtggcgtggctgagtaa

SEQ ID NO: 29165 - protein, 461 aa, Vibrio parahaemolyticus
MTTEFRIETDSMGEVKVPANALYQAQTQRAIDNFAFSQHTMPSGFIQALAHIKQTAALTNAQLGLLEGDIANAIADAAQAIIDGQHLDQFPIDLFQTGSGTSSNMNANEVIATLASELLGGNVTPNDHVNMGQSSNDVVPTAIQVSSALAIEHKLLPALAHLSQSLETKKQALQGVVKTGRTHLMDAMPITFAQELGGWQFQIEHAKQAIEQTLPMVKALAQGGTAVGTGINADPRFASLFADNLTQSTRVTFTSSDNFFFNLSSQDAIVALSGQLKTAAVAIMKIANDLRWMNSGPLAGLGEIELQGLQPGSSIMPGKVNPVIPEAAAMASAQVIGNDATITIAGQSGNFQLNVMLPVIAHNILESIELVANSATALADKAIATFDVRQDNLDIALAKNPILVTALNPVIGYLKAAEVAKKAYKQGRAIIDVAEEETDLNRETLERLLNPAKLTQGGVAE

SEQ ID NO: 29166 - DNA, 1377 bp, Pseudomonas syringae pv
  CDS (1)..(1377)
atgagtaatacccgtatcgaacgcgacagcatgggccaattacaggtcccggccgaggccctttacggcgcgcagactcagcgtgcggtggaaaattttccgatcagccatcagcgtatgcccaggctgttcattcgcgcgctactgctggccaaagcggccgctgcacaggcgaaccttgagctggagcagatcagcgaagggcagagccaggcgattgtcggtgccgtgaaagagctgttggccagcgactacatgactcatttcccggtcgatatcttccagaccggttccggcaccagcaccaacatgaacgccaacgaagtgctcgcaacgctggcaacgcggttactgggcgaagaggtcaaccccaacgatcacgtcaactgcgggcaaagcagcaacgacatcatcccgaccacgattcacgtcagcgccgcgctggcactccatgaacaactgctgccagcgcttgcgcatctggtgcaggtcaccgagcacaaggccgtgcaagtccacgccttcgtcaagaccggccgcacacacctgatggacgccatgcccgtgcgcatgagccaggtgctcaatggctgggcgcagcagattcgcgccaacatcgaacatctgcagggtttgcagcccagcctgcaagcactggctcagggcggcacggcggttggcaccggaatcaatgcgcatcccgagtttgcagcacgcttcagtcgccaattgagcacattgaccggcgtgcagttcgcaccgggcaaggacctttttgcgctgatcggctcgcaagacacagcggtagcagtgtctggtcagctaaaggccacggcggtgtcgctgatgaaaattgccaacgacctgcgctggatgaactccgggccgctggcagggctgggtgagatcgagcttgaggccctgcaaccgggctcgtcgatcatgcccggcaaggtcaacccggtgatccccgaggcgactgcgatggtggccgcgcaggtcatcggcaacgacgcgaccatcaccgtggcggggcagtccggcaactttgagctgaacgtgatgctgccgatcatcgcccagaacctgctcagcagcatcgagctgttggccaacgccagccggcttctggcggacaaggcagttgccagcttcaaggtcaatgaatccaggctccaggaagcgctgtcacgtaacccgattctggtcaccgcgctcaacccgatcatcggttatcagaaggccgccgaaatcgccaaggccgcttacaagcagggtcgcccggtgattgacgtcgctctggagcacaccgatttgcagcgcagcgagctggaagtgttgctcaatcccgaaaaactcaccgctggcggcatctga

SEQ ID NO: 29167 - protein, 458 aa, Pseudomonas syringae pv
MSNTRIERDSMGQLQVPAEALYGAQTQRAVENFPISHQRMPRLFIRALLLAKAAAAQANLELEQISEGQSQAIVGAVKELLASDYMTHFPVDIFQTGSGTSTNMNANEVLATLATRLLGEEVNPNDHVNCGQSSNDIIPTTIHVSAALALHEQLLPALAHLVQVTEHKAVQVHAFVKTGRTHLMDAMPVRMSQVLNGWAQQIRANIEHLQGLQPSLQALAQGGTAVGTGINAHPEFAARFSRQLSTLTGVQFAPGKDLFALIGSQDTAVAVSGQLKATAVSLMKIANDLRWMNSGPLAGLGEIELEALQPGSSIMPGKVNPVIPEATAMVAAQVIGNDATITVAGQSGNFELNVMLPIIAQNLLSSIELLANASRLLADKAVASFKVNESRLQEALSRNPILVTALNPIIGYQKAAEIAKAAYKQGRPVIDVALEHTDLQRSELEVLLNPEKLTAGGI

SEQ ID NO: 29168 - DNA, 1380 bp, Pseudomonas putida
  CDS (1)..(1380)
atgatgagtgatacccgtatcgagcgtgacagcatgggtgagctgcaggtgccggcccaggccctctacggcgcccagacccagcgcgcggtcgacaacttcccgatcagcggccagcgtatgccggcccagttcattcgtgccttgttgctggccaaggccgctgcggccaaggccaacgtcgaactggagcaactgtctgccgggcagggccaggctatcgtcaaggctgtcgagcaattgctggccgaggacttcatccagcacttcccggtggatgtgttccagacaggctctggcaccagttcgaacatgaacgccaatgaggtgatcgccaccttggctacccatgtactgggtgaggcggtcaatgccaatgaccacgtcaactgtggccagagcagcaatgacatcattccgaccaccatccatgtcagcgccgcgttggccctgcacgagcagttgctgccagccctggcgcacctggtacaggtgatcgaggtcaagtcggcacaagtacatcaatacgtgaagaccggtcgtactcacctgatggacgcgatgcccgtgcgcatgagccaggtgctggatggctgggctgcgcagatcaatgctgccaagtcgcacatcgaaggtgtgctgccgcacttgcaggcgctggcccagggcggaaccgccgtgggtaccggcatcaacgcccatccgcagttcgctgtcggtttcgctcgccagctcagtggcctgaccaaggtcgagttcacgcccggccagaacctgttcgcactgatcggctcgcaggacactgccgtggctttgtctggccagctcaagaccaccgctgtggcgttgatgaaaatcgccaacgatctgcgctggatgaactccggcccgctggccggtctgggcgaaatcgagctgcaagctctgcagccgggctcttcgatcatgccaggcaaggtcaacccggtgatcccggaggccactgccatggtcgccgcccaagtgattggcaacgacgcgaccatcgccgtcgcaggtcaagccggtaacttcgagctgaacgtgatgctgccggtgatcgcccgcaacctgctggaaagcatcgagctgatggccaatgtcagccgcttgctggccgacaaagccatcgccagcttcaaggtcaacgaagacaaactcaaggaagccctcgcgcgcaacccgattctggtcacggcgttgaatccgatcatcggctacctcaaggccgccgaaatcgccaagaccgcctacaagcagggtcgtccaatcatcgatgtggcgctggagcacaccgacctgtcccgcgaccagcttgaagcgctgctggacccggaaaaactcaccgccggcggtatctga

SEQ ID NO: 29169 - protein, 459 aa, Pseudomonas putida
MMSDTRIERDSMGELQVPAQALYGAQTQRAVDNFPISGQRMPAQFIRALLLAKAAAAKANVELEQLSAGQGQAIVKAVEQLLAEDFIQHFPVDVFQTGSGTSSNMNANEVIATLATHVLGEAVNANDHVNCGQSSNDIIPTTIHVSAALALHEQLLPALAHLVQVIEVKSAQVHQYVKTGRTHLMDAMPVRMSQVLDGWAAQINAAKSHIEGVLPHLQALAQGGTAVGTGINAHPQFAVGFARQLSGLTKVEFTPGQNLFALIGSQDTAVALSGQLKTTAVALMKIANDLRWMNSGPLAGLGEIELQALQPGSSIMPGKVNPVIPEATAMVAAQVIGNDATIAVAGQAGNFELNVMLPVIARNLLESIELMANVSRLLADKAIASFKVNEDKLKEALARNPILVTALNPIIGYLKAAEIAKTAYKQGRPIIDVALEHTDLSRDQLEALLDPEKLTAGGI

SEQ ID NO: 29170 - DNA, 1383 bp, Lactobacillus plantarum WCFS1
  CDS (1)..(1383)
atgacagaatatcgagttgaatcagatactttaggcgaagttaaaattcctgcgaacgccttatggggtgctcagacagaacggagtcgccataactttccgactggtacgaagatgccgttggaaatgattcgggcattacttcaaattaagcgggccgcagcgattgcgaataaagaagttgaagcaatgactgctgaaaaagctgatttaatcgtggctgccattgataagttattagcgctcgacgatgaagatttgcgtaaggactttccgctggttgtttaccaaactggttcggggacgcaaacgaatatgaacgttaatgaagtggtcgcacacatggctggtaagatcaatcctgatattgaaatcttgccgaacgacgatgttaaccatggtcaaagctctaacgatatcttcccaacggcgatgaacattacggccgcagttgccgtggataagctgattgccgcagcggaacacttattagcggaattgaagatcaaacaaaagaagtactggcgggtagtaaagattggccggacccatcttcaagatgcaacgccattaacttttggccaagaagtgagtggttgggccagtgcgattgaacatgatattgcctacttaaaacagttgaatccaacgttaggcgagcttgcaatgggtgggaccgccgttgggactggtctaaatgctgcccctcattttgctgaaaatattgcggcggcgatgagcaaattgtatgggattgaatttacggctgattccaataagttctatggtttggcccatcattctggtttaaacgtggttcacggggccatcaagaccctagcagccgatttgatgaagattgccaatgatgtgcggttcttggcaagcggtccacgggccggttatgacgaattaaacattccggctaacgaacccggctcatcaatcatgcctgggaaagttaacccaacccaagctgaagccatcactatggcagcggtacgagttatggggaatgacgtggtcgtcgatttagcttctagccaaggtaattttgaaatgaacgtttacaagaccgttttgattgatgctttccttgaatctgctgaattgttagctggaacgattaccggcttcactgaccgaatgattgctggtttgacggtcaaccaagaccggatggcagagttagtcgacagttccttgatgacggttacggcattgtcaccacatattggctatcatgatagtgcgatgattgctcaagcagctgaaaaagcggggacgacattgcgtgaagcagctatcaagtctggcaaagtaaccgcggaacaattcgatgaatggatggttccactggatatgacgaatattgatgattaa

SEQ ID NO: 29171 - protein, 460 aa, Lactobacillus plantarum WCFS1
MTEYRVESDTLGEVKIPANALWGAQTERSRHNFPTGTKMPLEMIRALLQIKRAAAIANKEVEAMTAEKADLIVAAIDKLLALDDEDLRKDFPLVVYQTGSGTQTNMNVNEVVAHMAGKINPDIEILPNDDVNHGQSSNDIFPTAMNITAAVAVDKLIAAAEHLLAELKIKQKKYWRVVKIGRTHLQDATPLTFGQEVSGWASAIEHDIAYLKQLNPTLGELAMGGTAVGTGLNAAPHFAENIAAAMSKLYGIEFTADSNKFYGLAHHSGLNVVHGAIKTLAADLMKIANDVRFLASGPRAGYDELNIPANEPGSSIMPGKVNPTQAEAITMAAVRVMGNDVVVDLASSQGNFEMNVYKTVLIDAFLESAELLAGTITGFTDRMIAGLTVNQDRMAELVDSSLMTVTALSPHIGYHDSAMIAQAAEKAGTTLREAAIKSGKVTAEQFDEWMVPLDMTNIDD

SEQ ID NO: 29172 - DNA, 1642 bp, Drosophila melanogaster
  CDS (73)..(1527)
cttttcctggcctgtacttttcggcctaaatatttcatttcgtaacacatatacacattaaaattttccaaaatgtctttcgatcagaaggagattttcagtttgatgtacaaactggctcggctaatagtgccggatactcgagttgaatatgattcgatgggtgccgtgcacattcctctcgatcgaatgttcggtccgcaaaccatgagatccctgatgaaatttccaattggcggagttgaggaacgaatgccacgacccctaataaaagccctgggcatagtgaagaaatcagctgcggagacgaacaaaatccattgtctggaggagcatctatgcgatgccatttccaaggcctgcgatgatgttatatcgggcaaactctatgacgaggaacactttccgttggttatatggcaggatggaagcggcgagcacacaaacatgaacgtaaacgaggttatatgcaatcgagccatcgaaattctgggcggtcagatgggctccaaggagccggtggatcccaatgaacatgtcaacatggcgcaaagttcccatgacaccttctcgacagccgtgcgcatcgccgtggccatgcagttgcaggagacgctgtatcccagcttaaggacctttattgatttgctgggcaagaagtcgaacgattggatggatttgatcaagattggtagaacgcatctgatggacgcagttcctctgtccctcggccaggagttcagtggctatcagcagcaacttgtgaacggaaggacgcgattggactgtgccatgtgccgattgtatcagttgcccatgggcggcaccagtgtgggcaccaaagtggacaccaaggcggaatattctgcgcagtgcatcaagcgtatagccgagctaacattcctaccctttgtcgagtccccgaacttttttgaatccatctccgcctgcgattgcctggtggaactgcacggtgaactcaacacgattgcagcgagtgtgatgaagatagcgaatgatatacgattccttggatcgggaccacgttgcggatttggtgaactacatctgccggagaacgaaccaggtagttccataatgcccggcaaagtgaatcccacgcaatgcgaggccatgtccatgatctgtgcccaggtgatgggcaaccatgtggccgtctccatgggtggttcctctggccactttcagctgaacacctttatgcccatgattgcctccaatgttttgcgctcgattacacttttgggcgatggcatgaagtccttttgcaccaattgcctcgagggcatcgagcccaataggagcaagattggtagcatcgtcaaggagtccctgatgctggtcactgccctcagtccacacattggctacgaacgatccgctgcgatcgccaaggcagcgcatcacaatggaaccactttggaacaggaggccatacttgatggcattcaacgggaggacttcagggagtgggtgcagcccagcaagatgctgggtcccgaatagtcgaaatggccacaaaacagtatcataatttaaataaattgtttcaattattatgtcgagctttaaaatttaataaatgcggtcaattggctctgtaaaaaaaaaaaaaaaaaaa

SEQ ID NO: 29173 - protein, 484 aa, Drosophila melanogaster
MSFDQKEIFSLMYKLARLIVPDTRVEYDSMGAVHIPLDRMFGPQTMRSLMKFPIGGVEERMPRPLIKALGIVKKSAAETNKIHCLEEHLCDAISKACDDVISGKLYDEEHFPLVIWQDGSGEHTNMNVNEVICNRAIEILGGQMGSKEPVDPNEHVNMAQSSHDTFSTAVRIAVAMQLQETLYPSLRTFIDLLGKKSNDWMDLIKIGRTHLMDAVPLSLGQEFSGYQQQLVNGRTRLDCAMCRLYQLPMGGTSVGTKVDTKAEYSAQCIKRIAELTFLPFVESPNFFESISACDCLVELHGELNTIAASVMKIANDIRFLGSGPRCGFGELHLPENEPGSSIMPGKVNPTQCEAMSMICAQVMGNHVAVSMGGSSGHFQLNTFMPMIASNVLRSITLLGDGMKSFCTNCLEGIEPNRSKIGSIVKESLMLVTALSPHIGYERSAAIAKAAHHNGTTLEQEAILDGIQREDFREWVQPSKMLGPE

SEQ ID NO: 29174 - DNA, 1699 bp, Drosophila melanogaster
  CDS (141)..(1544)
gcctttcaatgcccgagcacgcctcagttaacatcgagcagcagccgtcgtcgagtggtcgtcctctgatttgttcactctgattgccatagtctcaatttggcttcacttacttactatctgtcatatctgcatctgaaatggcctcccaggagtttcgcgtggagagcgacacctttggcgaactgaaggtgcccgcggataagtactatggcgcccaaacgatgcgatcccagatcaatttccccatcggcggagccaccgaacggatgcccaaacccgtggtccaggccatgggcatcctgaagaaggccgccgccgaggtgaacaaggagttcggactggacagcaaggttagcgaggcgatctcgaaggcggccgacgatgtgatctctggcaagctatacgacgaccacttcccgctggtcatctggcagacgggctcgggcacgcagagcaacatgaatgtgaatgaggtgatcagcaatcgtgccattgagctgctgggcggcaaactgggctccaagacgcccgtgcatcccaacgatcatgtgaacaaatcgcagagctccaacgataccttccccaccgccattcacatctcggtggcgctggagctgaacaacaaccttaagccggcgattaagacgctgcacgatgcgctgcgtgccaagtcggaggagttcaaggacattatcaagatcggacgcacgcatacgatggatgcggtgccattgacgctgggccaagagttcagcggctatgcccagcaattggcctacgcccaggagcgcatcgatgcctgtctgccgcgcgtctatgagctggctctgggcggcactgctgtgggtacgggtctgaacacacgcaagggattcgccgagaagtgcgctgcaaagatcgccgagctgaccagcctgcccttcgttaccgcgcccaacaagttcgaggcactggctgcccgcgatgccatggtggaggtgcatggtgtgctcaacacgatcgccgttagcctgatgaagattgccaacgatattcgtttccttggctccggaccgcgttgcggtttgggtgagctctcgctaccggagaacgagccaggtagctccatcatgcccggcaaggtgaatcccacgcaatgcgagtcgctgacaatgctctccgcccaggtgatgggcaatcaggtggcggtgaccatcggtggatccaatgggcacttcgagctgaatgtattcaagcccctgatcgtgtccaatgtgctgcgctccattcggctattgtctgatggcagcaggaccttcactgccaactgtgtgaatggcatccaggcgaaccgcgagaatattgccaagatcatgaacgagtcgctcatgctggtgaccgctctgaatccgcacattggttacgacaaggctgcgaaaattgcaaagacggcgcacaagaatggcaccacactcaaggaggaggccatcaatttgggttacctgacggagcagcagttcaacgactgggtgcgacccgaacagatgctgggacccaagtgaagtggagccaagtaggccgacgacgaaatccatcattcaatcatcgctgtcatcggaatcgcagtgtgattttctagatcagatcgttttgttgtatatgaatcgctcggaaacacagaaccaataataattgaaaatgctgaagcaaaacaatg

SEQ ID NO: 29175 - protein, 467 aa, Drosophila melanogaster
MASQEFRVESDTFGELKVPADKYYGAQTMRSQINFPIGGATERMPKPVVQAMGILKKAAAEVNKEFGLDSKVSEAISKAADDVISGKLYDDHFPLVIWQTGSGTQSNMNVNEVISNRAIELLGGKLGSKTPVHPNDHVNKSQSSNDTFPTAIHISVALELNNNLKPAIKTLHDALRAKSEEFKDIIKIGRTHTMDAVPLTLGQEFSGYAQQLAYAQERIDACLPRVYELALGGTAVGTGLNTRKGFAEKCAAKIAELTSLPFVTAPNKFEALAARDAMVEVHGVLNTIAVSLMKIANDIRFLGSGPRCGLGELSLPENEPGSSIMPGKVNPTQCESLTMLSAQVMGNQVAVTIGGSNGHFELNVFKPLIVSNVLRSIRLLSDGSRTFTANCVNGIQANRENIAKIMNESLMLVTALNPHIGYDKAAKIAKTAHKNGTTLKEEAINLGYLTEQQFNDWVRPEQMLGPK

SEQ ID NO: 29176 - DNA, 1404 bp, Xanthomonas campestris
  CDS (1)..(1404)
atgagcgagagtttcaggatcgaacacgacagcatgggcgagttgcaggtgcctgccgatgcgttgtggggtgcgcagacccagcgcgctgtgcagaacttcccgatttccggccagccgatgccgcgcggtttcattcgcgcgctggggttgatcaaggccgcggccgcaggcgtcaacgccgatctcgggctgctgtccaaatcggtggccaaggtggtgcaggaagccgccttgcaggtggcgcagggcgcgcacgatgcacatttcccgatcgatgtgtatcagaccggctctggtacgtcgtcgaacatgaatgccaacgaggtgattgccacgctggccacccgcgccggcaaggacgcggtgcaccccaatgaccacgtcaatctcgggcagagttccaacgacgtggtgcccaccgccattcgcgtctcggcattgctggcggtgcaggagcagctgcagccggcgctcaagcacctgcgcaagaccatcgacaagcgcgccaagggtctggacaagatcgtcaagaccggccgcacgcatctgatggatgcgatgcccctgacctttggtcaggagttcggcgcgtggtctgcgcagctcagttcagcgcaggagcgcatcgacgacagcctgaagcggctgcgccggttgccgctgggcggcactgcgattggcaccggcatcaacgccgatccgcgcttcggcggcaaggtggccaaggccttgtccacgttgagcagcgtcaagttcgaaagtgccgagaacaagttcgaaggcctggcggcgcaggatgatgcggtggaattgtcgggccagctcaatgcgctggcggtggccttgatcaagatcgccaacgacctgcgctggatgaatgccgggccgctggcagggctgggcgagatcgaattgccggcgctgcagccaggcagttcgatcatgccgggcaaggtgaatccggtgattcccgaagcgaccgtgatggtgtgcgcgcaggtcatcgggcaccacgccgcgatcacggtggccgggcagaccggcaattttcagttgaacgtggcgttgccgctgatcgccgcgaacctgctggattcgatcaacctgctcagcaacgtctcgcgcctgctcgccgataccgccattgccggattgaaggtgcgccaggagcgcgtgcgcgaggccctggaccgcaacccgatcctggtgaccgcgctcaacccgatcatcggctacgaaaaggctgccgcgatcgccaagcgcgcctacaaggagcagcgcccggtgctggatgtggccaaggaagacagcggtctgagcgaggcagagctgcgccgtttgctggatccggcggcgttgacacgcggcggcatccaggcgggtggcggtggtggcggctga

SEQ ID NO: 29177 - protein, 467 aa, Xanthomonas campestris
MSESFRIEHDSMGELQVPADALWGAQTQRAVQNFPISGQPMPRGFIRALGLIKAAAAGVNADLGLLSKSVAKVVQEAALQVAQGAHDAHFPIDVYQTGSGTSSNMNANEVIATLATRAGKDAVHPNDHVNLGQSSNDVVPTAIRVSALLAVQEQLQPALKHLRKTIDKRAKGLDKIVKTGRTHLMDAMPLTFGQEFGAWSAQLSSAQERIDDSLKRLRRLPLGGTAIGTGINADPRFGGKVAKALSTLSSVKFESAENKFEGLAAQDDAVELSGQLNALAVALIKIANDLRWMNAGPLAGLGEIELPALQPGSSIMPGKVNPVIPEATVMVCAQVIGHHAAITVAGQTGNFQLNVALPLIAANLLDSINLLSNVSRLLADTAIAGLKVRQERVREALDRNPILVTALNPIIGYEKAAAIAKRAYKEQRPVLDVAKEDSGLSEAELRRLLDPAALTRGGIQAGGGGGG

SEQ ID NO: 29178 - DNA, 1404 bp, Xanthomonas axonopodis
  CDS (1)..(1404)
atgagcgaacgtttcaggaccgaacacgacagcatgggcgaattgcaggtgcccgccgacgcgttgtggggcgcgcagacccagcgcgcggtgcagaatttcccggtgtccgggcagccgatgccgcgcggtttcattcgcgcgctgggcttgatcaaggccgcggcagccggcgtcaacgccgagcttggattgctgccgaagtcgatcggcaagaccgtgcaggccgctgcattgcaagtggccgagggcagcttcgatgcgcagtttcccatcgatgtgtaccagaccggttcgggcacctcgtccaacatgaatgccaatgaggtgattgccaccctggccacgcgtgccggcaaggatgcggtgcatcccaacgaccacgtcaatctgggccagagttccaacgatgtggtccccaccgccattcgcgtgtcggcattgctggcggtgcaggaacatctgcaaccggcgctcaagcatctgcgcaagaccatcgacaagcgcgccaaatcgcttgataagatcgtcaagaccggtcgcacgcatttgatggacgcgatgccgctcacctttggtcaggagttcggcgcgtggtcggcgcagctgagttcggcgcaggagcgtatcgacgacgcgctcaagcgcttgcgacgcttgccgctgggcggcacggcgatcgggaccggcatcaatgccgacccgcgcttcggtggcaaggtcgccaaggccttgtccaccctgagcggagccaggttcgagagcgcggaaaacaagttcgaaggactcgccgcgcaggacgatgcggtggagttgtctggccaactcaacgcgctggcggtggcactgatcaagatcgcaaacgacttgcgctggatgaatgccggcccgttggcgggcctgggcgaaatcgaactgccggcgctgcagcctggcagctcgatcatgccaggcaaggtcaatccggtgattcccgaagccaccgtgatggcgtgcgcgcaggtgatcggccaccacactgccatcaccatcgccgggcaaaccggcaacttccagttgaacgtgacgttgccgctgatcgcctacaacctgctggattcgatcaccttgctgggcaacgtttcgcgcctgttggccgacaccgccattgccggtctgaaggtgcgtcaggagcgcgtccgcgaggcgttggaccgcaaccccatcttggtgacggcactgaaccccatcatcggttacgaaaaggccgcggcgatcgccaagcgtgcctacaaggagcagcggtcggtactggatgtggccaaggaagacagcgggctcggcgaagcggaactgcggcgattgctcgacccgacggcattgacacgcggcggtatccatgccggcggcggtagcgggggctga

SEQ ID NO: 29179 - protein, 467 aa, Xanthomonas axonopodis
MSERFRTEHDSMGELQVPADALWGAQTQRAVQNFPVSGQPMPRGFIRALGLIKAAAAGVNAELGLLPKSIGKTVQAAALQVAEGSFDAQFPIDVYQTGSGTSSNMNANEVIATLATRAGKDAVHPNDHVNLGQSSNDVVPTAIRVSALLAVQEHLQPALKHLRKTIDKRAKSLDKIVKTGRTHLMDAMPLTFGQEFGAWSAQLSSAQERIDDALKRLRRLPLGGTAIGTGINADPRFGGKVAKALSTLSGARFESAENKFEGLAAQDDAVELSGQLNALAVALIKIANDLRWMNAGPLAGLGEIELPALQPGSSIMPGKVNPVIPEATVMACAQVIGHHTAITIAGQTGNFQLNVTLPLIAYNLLDSITLLGNVSRLLADTAIAGLKVRQERVREALDRNPILVTALNPIIGYEKAAAIAKRAYKEQRSVLDVAKEDSGLGEAELRRLLDPTALTRGGIHAGGGSGG

SEQ ID NO: 29180 - DNA, 1329 bp, Pyrobaculum aerophilum
  CDS (1)..(1329)
atgtattacgtcgcaaaagccagccagctttttatagagagcgggacgaaattccaacgcgatataatatgggcaatgggcgtcatgaaattcgccgcggccagggcaaacgccgaattaggcttgttgagctgggagaaggcgtatgcaattatggatgtggcgagggagattatggaggggcttcacgacgggcgtattgtcgtagacgtcttccagacgggatctggcacggggcttaacataaatgtaaacgaggtaattgcgcagagggctttggagaaattcggcatctccctccaccccaatgacgacgtaaatctcggccagtcctcaaatgacgtagtgccaactgccataaggctcgcggtgattaaggcatggagcgataaactgaggccaaagctaattaagttaattgacgcgttaggcgccaaggcggaggagtttaagactgttgtgaaggcggggcggacgcatttaagagacgccttgcccgtcaccttcggccaagagctctcaggataccgcgacgctttcgccagaaatctcaaggcccttgagtctttgggggagtttgtaaaggaggtgccaataggcggcactgcggtgggaactggcgtgaacacgcacccctccttcggggagagggttgtggagattataaacgccgagacgggcttggcgataaagaggggaaacccctttactgaaatgaagcttttgacagatatcctcctcttctccggcggcttgagggcgctggctgtggatctgttacggctctgccaagacttaaggcttatgttctccgggccttacacaggcttgggggagatcgaactgccctcgcaagaggaggtgcccggctctagcgccatgccgggcaagactaatcccgtcacgcttgaggctacaatgcaagccgttgtttacgtgctggggcttgacgaaacagtgaaatgggccgcgtcgcttggggagttcgagctggccatggggatacctgtggccggctgggccacggtaagggaggtggaggtgctggccgaggctttggggaaaattactgatctcgtgattctgaatatgaagcctaaagtggacatcatgaagagttacgccgagagatccgcggcgctaatcactttactcgcgccgataatggggtacgacaaggccagggaggtggcggggagatcaattagagatgtgttgagagaaatgggattagacgagtcagaaattgaaaaattgcttgatcccgcgaatttgactactccaggttttaaggttaggcgacggcataaaaacggctctcagagctaa

SEQ ID NO: 29181 - protein, 442 aa, Pyrobaculum aerophilum
MYYVAKASQLFIESGTKFQRDIIWAMGVMKFAAARANAELGLLSWEKAYAIMDVAREIMEGLHDGRIVVDVFQTGSGTGLNINVNEVIAQRALEKFGISLHPNDDVNLGQSSNDVVPTAIRLAVIKAWSDKLRPKLIKLIDALGAKAEEFKTVVKAGRTHLRDALPVTFGQELSGYRDAFARNLKALESLGEFVKEVPIGGTAVGTGVNTHPSFGERVVEIINAETGLAIKRGNPFTEMKLLTDILLFSGGLRALAVDLLRLCQDLRLMFSGPYTGLGEIELPSQEEVPGSSAMPGKTNPVTLEATMQAVVYVLGLDETVKWAASLGEFELAMGIPVAGWATVREVEVLAEALGKITDLVILNMKPKVDIMKSYAERSAALITLLAPIMGYDKAREVAGRSIRDVLREMGLDESEIEKLLDPANLTTPGFKVRRRHKNGSQS

SEQ ID NO: 29182 - DNA, 1320 bp, Sulfolobus tokodaii
  CDS (1)..(1320)
atgatgaaatacactgagactgcaccaaaactttttatgaacacaggaactagatttcctagaaaaataatctgggctatgggacttataaaatacgcggcagcgaaagttaattctgatcttaaccagttagaaaaagaaatagctaaaggtattatgcaagcagcaaaagaagttatggaaggaaaacatgatgataaaatagttttagatgtatttcaaacaggctctggtactggactaaatatgaatattaatgaagtgatagcagaaagggcaactgaaatgattggaaaaaaagttcacccaaatgatcacgtaaatttagggcaatcatctaacgatactgttcctactgcaataagaatagcagcaacttcagcagttgaagaacaacttataccagcacttagtaaatttgtttctattcttaatagaaaaagtgaagaatttaaggatattgtgaaatctggaaggactcatttaagggacgcgttaccagttaccttaggtcaagagctttcagcatatgcagacgctttctaccacgatatgaccaatttacaacaagtactagaatatgttaaggagcttcctattggtggcactgcagtaggtactggattaaactcacatccagaatttcaactgagagttattcaagaggttaataatgaaactggattaggcttcaaaccagctaataagtttagaggattaaggcttttaacggacttacttagtctaagcggtattatgagaacaattgcggtagatctttacagacttggacaagatattagattaatgttttctggaccaatgactggtttcaatgaaatagatctacctactcaagaagaaatagctggaagtagtattatgccgggtaaaacaaacccagttactgtggaggcaacattattagtctcagctcaagtagtaggattagatcatgccaatcaatttgcatcaatgttaggcgagtttgagttagccatgggcgttcctttgattggatataatgtggttactcaaataaacttacttacagaggcattaaataaatttggagatttggtaattaatggtatggttcctaatatagaaagaatgaaaagatatgctgaaagcagtccttcattagttaccgtaatatcacctattattggttatgataaggctagcgaaatagggaagagattaagcaaaggaatgtctataagagaagcattaaaagagttaggctttaaggatgatgaaatagatagaatactagatttatcaaaattagttaagccaggttttcctgcaaaatga

SEQ ID NO: 29183 - protein, 439 aa, Sulfolobus tokodaii
MMKYTETAPKLFMNTGTRFPRKIIWAMGLIKYAAAKVNSDLNQLEKEIAKGIMQAAKEVMEGKHDDKIVLDVFQTGSGTGLNMNINEVIAERATEMIGKKVHPNDHVNLGQSSNDTVPTAIRIAATSAVEEQLIPALSKFVSILNRKSEEFKDIVKSGRTHLRDALPVTLGQELSAYADAFYHDMTNLQQVLEYVKELPIGGTAVGTGLNSHPEFQLRVIQEVNNETGLGFKPANKFRGLRLLTDLLSLSGIMRTIAVDLYRLGQDIRLMFSGPMTGFNEIDLPTQEEIAGSSIMPGKTNPVTVEATLLVSAQVVGLDHANQFASMLGEFELAMGVPLIGYNVVTQINLLTEALNKFGDLVINGMVPNIERMKRYAESSPSLVTVISPIIGYDKASEIGKRLSKGMSIREALKELGFKDDEIDRILDLSKLVKPGFPAK

SEQ ID NO: 29184 - DNA, 1374 bp, Thermoplasma volcanium
  CDS (1)..(1374)
atgagaactgaaagggatgtaattggagaaatacagcttgaagatactgtattttacggtataaatactgctagggccaaggaaaatttcaggataaccggcctgacctccgattctgaccacatcgtttctattgcacagataaaaaaagcagcagccatggctaatgcggaagctggtgcactggacaaggaaaaagctgaatttatagagaaagcgtgtgatgagatcataagtggaagataccacgaccaatttgttatagatgtttaccaggccggtgctggaacatctttcaacatgaacgcaaatgaggtaattgcaaacgttgcacttacattaatgggcaagaacaaaggagattactcagtaatacaccccaacgaccacgtcaacatgagccaatcaacaaatgacgtttatcctacaatgatgcggctaacggtgacgaaaaaagtgaagaaacttaaggaggccatttccgacttaatagaaagcctggaaaagaaatccaaggaacttaggggtataccaaaaccaggcaggacgcaccttcaggatgcagcacctgtaacggttggattggaattttctgcctacgcatatgcaataaaaaaggatagagatgaaattactgatgcccttgattatataatggaattaaacataggggggacggcagtcggcacgggcataaatacatcaaaaaattatcaggagaacgttgtaaagcatatagctgagataacgagggaaaatttcaggaagagcagcaatctgatgggaattatgcagtttatgactgatttttcgagagtgatgaatgctgttacgaacctagcactagatattgaaaagatagctaatgacataaggcttctctactcaggtcctgggacaggtatacatgaaataataatacccgcggtgcagcaaggttcgtccataatgcctggaaaaataaatccgtccatagcagaggcaatgaacatgatatgccattcggttataggtgcgcaacaggcagtaaacatgagcgtacaggccgggcaactggaactaaatgtaatgatgcctaatatagattacgagctaacgagatcaatcgacataatgagaaacggcctaataatgttcaaagaaaaactcatcgacgggatcaaggccaacgtaaacacatgcagagaacatctcgcaaatagctttggatccgctgcactcttgaatccataccttggctatgataatgttgcaaagatagtcagagaagccgtcgaaactggtaaatcaataaaatcattagtgttagcaactggtaaaatcacagaagagcagtatatgaaaattatggaaagtggagtcccaaaggattga

SEQ ID NO: 29185 - protein, 457 aa, Thermoplasma volcanium
MRTERDVIGEIQLEDTVFYGINTARAKENFRITGLTSDSDHIVSIAQIKKAAAMANAEAGALDKEKAEFIEKACDEIISGRYHDQFVIDVYQAGAGTSFNMNANEVIANVALTLMGKNKGDYSVIHPNDHVNMSQSTNDVYPTMMRLTVTKKVKKLKEAISDLIESLEKKSKELRGIPKPGRTHLQDAAPVTVGLEFSAYAYAIKKDRDEITDALDYIMELNIGGTAVGTGINTSKNYQENVVKHIAEITRENFRKSSNLMGIMQFMTDFSRVMNAVTNLALDIEKIANDIRLLYSGPGTGIHEIIIPAVQQGSSIMPGKINPSIAEAMNMICHSVIGAQQAVNMSVQAGQLELNVMMPNIDYELTRSIDIMRNGLIMFKEKLIDGIKANVNTCREHLANSFGSAALLNPYLGYDNVAKIVREAVETGKSIKSLVLATGKITEEQYMKIMESGVPKD

SEQ ID NO: 29186 - DNA, 1374 bp, Thermoplasma acidophilum; identical to SEQ ID NO: 11134
  CDS (1)..(1374)

SEQ ID NO: 29187 - protein, 457 aa, Thermoplasma acidophilum; identical to SEQ ID NO: 11135

SEQ ID NO: 29188 - DNA, 2112 bp, Helicobacter pylori
  CDS (658)..(2049)
tctaaatctttagccaaacccaaactaaaaagcagtaacaaggctgttaaaaggcgtattaaaacgccccccttataaaacacgcttataaaagatagcatgcacttataaatccaagcttgttttagcgcgataaactttgccttctttggatttaatatccaccctcacctgccatgtcccgttcatagaaagattggttttagcttcataaaggccgtttttttcactcacttgtgccatttctttcatcgctggcatgccgggcatttcaggcatcataaactgcaccctaacgatagctttttctaaagccttaccttttaaagtggggctgagtatgaaagtgttatcgcctttaatggggttacccacggatttgattttcacttccaagtcattggcttttagggtttgctcccatgcgtttaaactcataacccccaacacgctcattaaaaataaagcggctaactttttcatcgttttgacctttacattaagataacaagaaaattcttgttgcgaacggataataaccctcttttgtgtaaaaattgtggaaatggtttttaaaaaaatgggggttttaagtagaaggtataagagtttatgctatttttttaaggttttaaaatcaaatttcaaaggattagtatgcaatttagaatcgaacatgacacgatgggcgaaatcaaagtagatgatagccaatactggggggctcaaacgcaacgcagtcttgaaaactttaaaatcggcactgaaaaaatgcctaaagaactcattggcgcgtttgccaaactcaaaaggagtctggcggttgtcaatcaccagttagggaaattaagcttggaaaaatcgcaagccattatcaaggcgtgcgattgcattttaaaaggcgagctgtgcggcgagttccccttagcgatatggcaaacagggagcgggactcaaacgaacatgaatctcaatgaagtcattgccaataaggctaccgaaattttagggggtaattttagggagaaaaaactcatccaccctaacgatgatgtgaacatgtctcaaagctccaacgacactttccctaccgctatgcacattgtgagcgtgctagaaatcacgcataaactactgcccagtttagagaatttgttaaagacctttaaagacaaaagccaacaatttaaagagattgtcaaaatcgggcgcacgcatttacaagacgctacgcctttaactttggggcaagaatttagcgggtatgcgagcatgttagagcattctaaacaacaaattttagagagtttggagcatttaagggaattagccataggcgggacggccgtaggcacagggctaaacgctcacaaagaattgagccaaaaagtggctgaagaattgagcgagtttagcggcgtgaaattcatctctgcgcccaataaattccatgcgctcactagccatgacgctatcgcttatgcgcatggggcttttaaggctttagcggcgaatttaatgaaaatcgctaacgatattagatggcttgcgagcgggccgcgctgtggtttgggcgagcttaatatccctgaaaacgagccgggtagttctatcatgcccggtaaagtcaatcccacgcaatgcgaagcgatgaccatggtggccgtgcaagtgatggggaatgataccgctattggcattgcggccagtcagggtaattttgaattgaatgtgttcaagccggtgattatttataatttcttgcaaagtttgaggctactaagcgatagcatggaaagttttaatacccattgcgcgatcggcattgagcctaataaagaaaagattgattattacttgcaccattctttgatgctagtaaccgccctaaacccgcatgtaggctatgaaaacgccgctaaaatcgctaaaaacgcccacaaaaaaggcatttctttaaaagaaagcgcgctggaactgaagctcttgagcactgaagattttgacaaattcgtggtgcctgaaaagatgatcgggcctaaggcttgaaaaccttgggtgggcgtgcgagatgaatcctgaaaaagccactcatagcaaagagattcgtaa

SEQ ID NO: 29189 - protein, 463 aa, Helicobacter pylori
MQFRIEHDTMGEIKVDDSQYWGAQTQRSLENFKIGTEKMPKELIGAFAKLKRSLAVVNHQLGKLSLEKSQAIIKACDCILKGELCGEFPLAIWQTGSGTQTNMNLNEVIANKATEILGGNFREKKLIHPNDDVNMSQSSNDTFPTAMHIVSVLEITHKLLPSLENLLKTFKDKSQQFKEIVKIGRTHLQDATPLTLGQEFSGYASMLEHSKQQILESLEHLRELAIGGTAVGTGLNAHKELSQKVAEELSEFSGVKFISAPNKFHALTSHDAIAYAHGAFKALAANLMKIANDIRWLASGPRCGLGELNIPENEPGSSIMPGKVNPTQCEAMTMVAVQVMGNDTAIGIAASQGNFELNVFKPVIIYNFLQSLRLLSDSMESFNTHCAIGIEPNKEKIDYYLHHSLMLVTALNPHVGYENAAKIAKNAHKKGISLKESALELKLLSTEDFDKFVVPEKMIGPKA

SEQ ID NO: 29190 - DNA, 1616 bp, Drosophila melanogaster
  CDS (1)..(1413)
atgagctccaccaagaaggttgagacccgccaagagagcgacaccctgggacccatggaggtgcccatggatcgctattacggcgcccagacgatgcgctgcctcataaactttcgcattggcggcgaggaggagcgaatgccgcgccagataatccaggccatgggcatactgaagaaggcggcagccgaaacaaaccaagaattcggattggatcccaagttgagcacggccatctcgaatgcggccgacgatgtgatctccggaaagctttacgatgagggtcacttcccgctgcccatttggcagacgggttcgggcacccagagcaacatgaacagcaacgaggttatcgggaatcgtgccatcgagctgctgggcggacgtattggtaccaaggacccagtgcatcccaacgaccatgtgaacaagtcgcagagctccaacgacacctttccgtcggccattcacattgcggtggccactgcgctgaccaaggatctccgaccggcggtcaccgctctgcgggattcactgcaggccaagtcgaatgaatggaaggatatcattaagattggacgcactcacacccaggatgcagtgccgctaacgctgggccaggagttcagtggctatgcccaacagctgaccaacgggctgcagaggatcgatgcggtcctgccgcgagtttatcagctcgcactgggtggaaccgctgtgggaactggattgaatacccgccggggattcgccgagaagtgtgtcaagcggatcgcccagctcagtggattgcccttcgtggtggcgcccaattttttcgaggccctcgcctgtcgagatgccatggtggaggtgcatggagcgctcaatgtcctggctgttagcctgatgaaggtcaccaatgatatacgtttcctgggatcgggaccacgttgcggtctgggcgagctgtttctgccggagaatgagccgggcagttctattatgcccggcaaggtgaatcccacgcagtgcgaggccatgaccatgatctgcgcccaggtgatgggcaaccacgtggccgtctccgtcggcggtgccaatggacactttgagctcaacgttttcaagccactgatcgcatccaatgtgctccgctccatcaagctgctggctgatgggtgcatcagcttcaactgcaactgcgtcaagggcattaagcccaacaaggagaagctggcaaagatcgtgaatgagtcgctaatgctggtgacagccctcaatccgcacattggctatgacaagtccgcccagattgccaaggcggcccacaagaatggaactactctaaaggtggaggcattgaacgccggcatatcggagaaggatttcaacgagtgggtgcgtcccgagaagatgctgggtccttcttaggttttcctcccttgttccatgtgttacacattcataaattccatattgcaaaattttatcgttggaaatacaatcgagtgaagaaggatgtaaacagttttggtaacacaaggttgtgatgaaattcttgtggatatttttgttccaattaaatttcaaataaaaatagcaatcgccttaaaaatgtaagacgctactaaaaa

SEQ ID NO: 29191 - protein, 470 aa, Drosophila melanogaster
MSSTKKVETRQESDTLGPMEVPMDRYYGAQTMRCLINFRIGGEEERMPRQIIQAMGILKKAAAETNQEFGLDPKLSTAISNAADDVISGKLYDEGHFPLPIWQTGSGTQSNMNSNEVIGNRAIELLGGRIGTKDPVHPNDHVNKSQSSNDTFPSAIHIAVATALTKDLRPAVTALRDSLQAKSNEWKDIIKIGRTHTQDAVPLTLGQEFSGYAQQLTNGLQRIDAVLPRVYQLALGGTAVGTGLNTRRGFAEKCVKRIAQLSGLPFVVAPNFFEALACRDAMVEVHGALNVLAVSLMKVTNDIRFLGSGPRCGLGELFLPENEPGSSIMPGKVNPTQCEAMTMICAQVMGNHVAVSVGGANGHFELNVFKPLIASNVLRSIKLLADGCISFNCNCVKGIKPNKEKLAKIVNESLMLVTALNPHIGYDKSAQIAKAAHKNGTTLKVEALNAGISEKDFNEWVRPEKMLGPS

SEQ ID NO: 29192 - DNA, 1572 bp, Drosophila melanogaster
  CDS (1)..(1572)
atgctgaagcaaaacaatggtctgcatctggctaggcgcaatctctgggtggtttgcagtggcctccgtgccaaggattgcgacagtggcggtaagggcggcaagggcaaggagaatggcaagtttcgtacggagaaggacaccttcggggagctaaaggtgccggcggacaagctgtacggcgcacagacgatgcgctccaaattgaattttcccattggcgacataggcgaacgtatgccgatgccggtgatccaggccatgggcatactgaagaaggcatgtgccgaggtcaacaaggattacggactagatggcaaggtgtcggatgccgtatcctgcgcctgcgacgatgtcatttccggcaagctatacaaacagggtcacttcccattggtcatctggcaaaccggttcgggcacccagaccaatatgaacaccaacgaggtgatcagcaatgcggccattaagatgatgggcggcgaactgggcagcaagaagccggtgcatcccaacgatcatgtgaacaagtcgcagagctccaacgacaccttccccacggccattcacatttcggtgggcatggagctgaacgagcggcttgttccggcggttacacacttgagggatgccctcaagtccaagtcggatgagttcaaggacatcatcaagatcggacgcacccacttgatggacgcagttccgctgactttgggccaggaattcagcggttatacacagcagttgaccaacggtctggaaaggatcaagggctgtctgccgcgcgtctatgagctggctctgggcggcactgctgtgggtacgggtctgaacacacgcaagggattcgccgagaaggtggccaagcgcatttcggagctaacctgcttgcccttcgtgtcggcgcccaacaagttcgaggcactggctgcccgcgatgccatggtggaggtgcatggtgtgctcaacacgatcgccgtcagcctgatgaagatcgccaacgatatccgattgctgggatcgggtccgcgttgcggtctgggcgaactaatgctgccggagaacgagcccggtagctccatcatgcccggcaaggtgaatcccacgcaatgcgaatcaatgaccatgctgtgtgcccaggtgatgggcaatcaggtggcggtgaccatcggcggctccaacgggcacttcgagctaaatgtattcaaacccctggtcgtgtccaatgtgctgcgctccattcgcttgttgggtgagtcggaaatgtgttttccaagtggaaaaacatgcatacataaccttctcctcccagctgatggcagcatgaccttcagcaagaactgcgtggagggactgcaggccaacaaggagaggatcgacaagatcatgaacgagtccttgatgctggtgaccgcgctgaatccgcacattggctatgacaaggccgccctgatcgccaagacggcgcacaagaataagacgaccttgaaggaggaggcactgaagaccggaattaccgaagagcagttcaaggagtgggtcaatcccaaggagatgctgggaccgaagtga

SEQ ID NO: 29193 - protein, 523 aa, Drosophila melanogaster
MLKQNNGLHLARRNLWVVCSGLRAKDCDSGGKGGKGKENGKFRTEKDTFGELKVPADKLYGAQTMRSKLNFPIGDIGERMPMPVIQAMGILKKACAEVNKDYGLDGKVSDAVSCACDDVISGKLYKQGHFPLVIWQTGSGTQTNMNTNEVISNAAIKMMGGELGSKKPVHPNDHVNKSQSSNDTFPTAIHISVGMELNERLVPAVTHLRDALKSKSDEFKDIIKIGRTHLMDAVPLTLGQEFSGYTQQLTNGLERIKGCLPRVYELALGGTAVGTGLNTRKGFAEKVAKRISELTCLPFVSAPNKFEALAARDAMVEVHGVLNTIAVSLMKIANDIRLLGSGPRCGLGELMLPENEPGSSIMPGKVNPTQCESMTMLCAQVMGNQVAVTIGGSNGHFELNVFKPLVVSNVLRSIRLLGESEMCFPSGKTCIHNLLLPADGSMTFSKNCVEGLQANKERIDKIMNESLMLVTALNPHIGYDKAALIAKTAHKNKTTLKEEALKTGITEEQFKEWVNPKEMLGPK

SEQ ID NO: 29194 - DNA, 1392 bp, Agrobacterium tumefaciens
  CDS (1)..(1392)
atgacagccacacggacagaaaccgatacatttggccctattgaagttcaggccgatcgctactggggcgcgcaggcgcagcgctcgctcggcaacttcaagatcggctgggaaaagcagcccgcctctgtcgttcgtgcgctcggcatcgtcaagcaggccgctgcccgcgccaacatggcgcttgcaggtctcgaccccaaggtgggagatgccatcatcgccgccgcgcaggaagtcatcgacggcaagctgaccgagcatttcccgctcgtcgtctggcagaccggctccggcacccagtccaacatgaatgccaacgaggtgatttccaaccgcgcgatcgaaatgctcggcggcgaaatgggcaccaagaagcctgttcacccgaatgaccacgtcaatatgagccagtcctcgaacgacacctacccgacggcgatgcacatcgcctgcgtggaagagatcgttcaccacctgttgccggccctcaagcacctgcacacggcgctggaagccaaggtcaagcagttcgaaaagatcatcaagatcggccgtacccacacgcaggacgcgaccccgctgacgctcggccaggaattctccggttacgccgctcaggtcgcctcggcgatcgccaatatcgaactcacactgcccgcactgtcgaagctcgcccagggcggtacggcggttggcacgggcctcaatgcccctgttggttttgccgaaaaggtcgccgaggaaatctctgagattaccggcctttccttcgtcaccgcgccgaacaagttcgaagcgcttgcctcgcatgattccatggtcttctcgcacggcgcgatcaacgccgctgccgctgcactcttcaagatcgccaacgacatccgcttcctcggttccggcccgcgcgccggtctcggcgaattgtcgctgccggaaaacgagcccggctcgtcgatcatgccgggcaaggtcaacccgacgcagtcggaggcactgacgcaggtttgcgcccatatcttcggcaacaatgcagcgctttccttcgcaggctcgcagggccacttcgaactcaacgtctataatccgatgatggcctacaactttctgcagtcggtccagcttctgggcgatgcggccgtgtccttcaccgacaactgcgtcgtcggcatcgaggcgcgcgaagacaatatccggaagggcgtcgagaactcgctgatgctcgtcacggcgctcaacggcaagctcggctacgacatctgcgccaagatcgccaagaccgcccacaagaacggcacgacgctgcgcgaagaagccgttggtggtggatacctcaccaacgaggaattcgaccagtatgtgcgccccgaaaacatgatcggcccgaagtaa

SEQ ID NO: 29195 - protein, 463 aa, Agrobacterium tumefaciens
MTATRTETDTFGPIEVQADRYWGAQAQRSLGNFKIGWEKQPASVVRALGIVKQAAARANMALAGLDPKVGDAIIAAAQEVIDGKLTEHFPLVVWQTGSGTQSNMNANEVISNRAIEMLGGEMGTKKPVHPNDHVNMSQSSNDTYPTAMHIACVEEIVHHLLPALKHLHTALEAKVKQFEKIIKIGRTHTQDATPLTLGQEFSGYAAQVASAIANIELTLPALSKLAQGGTAVGTGLNAPVGFAEKVAEEISEITGLSFVTAPNKFEALASHDSMVFSHGAINAAAAALFKIANDIRFLGSGPRAGLGELSLPENEPGSSIMPGKVNPTQSEALTQVCAHIFGNNAALSFAGSQGHFELNVYNPMMAYNFLQSVQLLGDAAVSFTDNCVVGIEAREDNIRKGVENSLMLVTALNGKLGYDICAKIAKTAHKNGTTLREEAVGGGYLTNEEFDQYVRPENMIGPK

SEQ ID NO: 29196 - DNA, 1389 bp, Bacillus anthracis
  CDS (1)..(1389)
atggagtacagaattgaaagagatacattaggagaaataaaagttccagctgataaattatgggcagcacaaacacaacgtagtaaagaaaacttcccgattggaacagagcaaatgccgcttgaaattgtaaaagcatttgcaattttaaagaagagtgcagcgcttagcaatcaaaaattaggaaagctatcagaagaaaaagcagaagcaattgtggtagctgctgacgaaatcattgcagggaaatggaatgaacattttccgcttgtcgtgtggcaaacaggtagtggtacacaatcaaacatgaatgtgaatgaagtaattgcaaatcgtgggaatcaaattttgaaagaaaagggatctgacgtacatattcatccgaatgatgatgtgaacatgtcccaaagttcaaatgatacatttccaacagcgcttcatgtagcatgtgtactcgcagtagaaaatcacgtattaccagctattacgaaattaaaagaaacgttagcagaaaaagtaactgcatttgaacatattataaaaattggtcgtacacatttacaagatgcgacaccgttaacattaggacaagaaattagtggatggcaccgtatgcttgaaaaaacagagcgtatgattgcagagagcaatacatatatgaaagagcttgcgattggtggtacagcagttggaacaggtattaacgctcatcctaaatttggtgagatggtatcagaggaaattagccaatttacaggtaaacaatttatttctgcaccaaataagttccatgcattaacgagccatgatgaagttgtatatactcacggtgcattaaaagcattagctgcggatttaatgaaaatcgctaacgatgtacgttggctggcaagtggtccacgtagtggtttaggagaaattattattccggcgaatgagccaggaagctctattatgccaggtaaagtaaatccaacgcaaagtgaagcgttaacgatggttgtagcgcaagtgatgggaaatgacgcaacaatcggatttgctgcgagtcaaggtaattttgagttaaacgtatttaaacctgttattgcgtataacttcttacaatccgctcacttattagcagatgcaattgtttcatttaatgataattgtgcagttggtattgaagctgatgaagaaatcattaaagagaatgtgaatcgttcattaatgcttgttacagcattaaacccgcatatcggatatgaaaatgcagcaaaaattgcgaagcatgctcataaagaagggttaactttaaaagaagcagcattgcaatctggactactaacagaagagcaatttaatgaaattgtcgatccgaaaaaaatgattgctccgaaagagtaa

SEQ ID NO: 29197 - protein, 462 aa, Bacillus anthracis
MEYRIERDTLGEIKVPADKLWAAQTQRSKENFPIGTEQMPLEIVKAFAILKKSAALSNQKLGKLSEEKAEAIVVAADEIIAGKWNEHFPLVVWQTGSGTQSNMNVNEVIANRGNQILKEKGSDVHIHPNDDVNMSQSSNDTFPTALHVACVLAVENHVLPAITKLKETLAEKVTAFEHIIKIGRTHLQDATPLTLGQEISGWHRMLEKTERMIAESNTYMKELAIGGTAVGTGINAHPKFGEMVSEEISQFTGKQFISAPNKFHALTSHDEVVYTHGALKALAADLMKIANDVRWLASGPRSGLGEIIIPANEPGSSIMPGKVNPTQSEALTMVVAQVMGNDATIGFAASQGNFELNVFKPVIAYNFLQSAHLLADAIVSFNDNCAVGIEADEEIIKENVNRSLMLVTALNPHIGYENAAKIAKHAHKEGLTLKEAALQSGLLTEEQFNEIVDPKKMIAPKE

SEQ ID NO: 29198 - DNA, 1389 bp, Bacillus subtilis
  CDS (1)..(1389)
atggaatacagaattgaacgagacaccatgggagaagtaaaagttcctgctgataaattttggggcgcccaaacacagcgaagcaaggagaactttaagatcggttctgaaaaaatgccgatgcgtgttgtgaaggcgtttgcaattttaaaacgaagcactgctctagctaataaacgcctcggcaatctggacgctgaaaaagcagaagcgattgcagcggtttgtgatgatgtgctcaaaggcaagtacgatgacaacttcccgcttgtcgtatggcagaccggaagcggcacacaaagcaatatgaacatgaacgaagtggtagccaaccgtgcgactgctttattaaaagagaagaactctgatcaaacgattcatccaaatgatgacgtgaaccgaagccaaagctcaaacgacacattcccgactgcgatgcatgttgccgctgttttggctgtttacgagcagcttgtgccggcgcttgatcagcttcgcaatacactggatgaaaaagcaaaagcatacaatgatattgtcaaaatcggacgcacgcatcttcaggatgctacgccactgaccctcggacaggaaatcagcggatgggttcacatgctggaccgttcgaaggaaatgattttggaagcgacagataaaatgcgtgcgcttgcaattggtggaacggctgtcggaacgggtatcaacgcccacccagagtttggagagcttgtctcagaagagatcactaagctgaccggccaaacgttcagcagctcgccgaataaattccacgcgctgacaagccatgacgaaatcacttatgcgcatggcgcattaaaagcgcttgcggctgacttaatgaaaatcgcgaacgatgtcagatggctcgcaagcggaccccgctgcggcatcggggagatcgtcattcctgaaaatgagccgggaagctctattatgcctggtaaagtcaatccgacacaaagcgaagcgttaacaatgatcgcagcgcaaatcatggggaacgatgcgacaatcggctttgcggcgagtcaggggaactttgaactgaacgtgtttaagcctgttattatttacaacttcctgcaatctgtgcagctgctcagtgacggcatgaattcattccatgataaatgtgctgtcggtattgagcctaataaagaaaccattcaggaaaacctgtcaaattcattaatgcttgttacggcgctgaacccgcatatcggttatgaaaacgcggcgaaaatcgccaagcttgcccataaagagggattgacgctcaaagaagcagctttgaagcttgaattgctgacagaggagcaatttaacgaaatggttaagccggaagacatggtaaaaccaaaggcgtaa

SEQ ID NO: 29199 - protein, 462 aa, Bacillus subtilis
MEYRIERDTMGEVKVPADKFWGAQTQRSKENFKIGSEKMPMRVVKAFAILKRSTALANKRLGNLDAEKAEAIAAVCDDVLKGKYDDNFPLVVWQTGSGTQSNMNMNEVVANRATALLKEKNSDQTIHPNDDVNRSQSSNDTFPTAMHVAAVLAVYEQLVPALDQLRNTLDEKAKAYNDIVKIGRTHLQDATPLTLGQEISGWVHMLDRSKEMILEATDKMRALAIGGTAVGTGINAHPEFGELVSEEITKLTGQTFSSSPNKFHALTSHDEITYAHGALKALAADLMKIANDVRWLASGPRCGIGEIVIPENEPGSSIMPGKVNPTQSEALTMIAAQIMGNDATIGFAASQGNFELNVFKPVIIYNFLQSVQLLSDGMNSFHDKCAVGIEPNKETIQENLSNSLMLVTALNPHIGYENAAKIAKLAHKEGLTLKEAALKLELLTEEQFNEMVKPEDMVKPKA

SEQ ID NO: 29200 - DNA, 1392 bp, Bordetella pertussis
  CDS (1)..(1392)
atgaaaacccgcaccgaaaaagacactttcggcccgatcgaggtgcccgagcagcacctgtggggcgcgcagacccagcgctcgctgcatttcttcgcgatctcgaccgagaagatgccggtgccgctggtcgccgccatggcacgcctgaagcgcgccgccgccaaggtcaacgccgagctgggcgagctggatccgcaggtcgcagacgccatcatgcgggccgccgatgaggtgatcgccggcaagtggcccgacgagtttccgctgtcggtctggcagaccggctcgggcacgcagagcaacatgaacatgaacgaggtgctggccaaccgcgcctccgagctgctgggcggcgagcgcggcgaaggccgcaaggtgcaccccaacgaccacgtgaaccggggccagtcgtccaacgatacctttccgaccgccatgcacgtggccgccgcggtcgaggtcgagcaccgcgtgctgcccgccctgaaggcgttgcgcggcacgctggccgccaagagcgcggcgttctacgacatcgtcaagatcggtcgcacccatttgcaggacgccaccccgttgacgctgggccaggagatctccggctacgtggcgcagctggacctggccgagcagcagatccgcgcgacgctggccggcctgcaccagctggccatcggcggcacggcggtgggcaccggcctgaacgcgcatccgcagttcagcgccaaggtatcggccgaactggcccatgacacgggcagcgcgttcgtgtcggcgcccaacaagttccaggcgctggcttcgcacgaggcgctgctgttcgcgcacggcgccttgaagacgctggccgccggcctgatgaagatcgccaacgatgtgcgctggctggccagcggcccgcgctcggggctgggcgaaatcagcattcccgagaacgagccgggcagctccatcatgccgggcaaggtcaacccgacccagtgcgaagccgtcacgatgctggccgcgcaggtcatgggcaacgacgtggccatcaatgtcggcggggccagcggcaacttcgagctgaacgtcttcaagccgctggtgatccacaatttcctgcagtcggtgcgcctgctggccgacggcatggtcagcttcgacaagcactgcgcggccggcatcgagcccaaccgcgagcgcatcaccgagctggtcgagcgttcgctgatgctggtgactgcgctcaacccgcacatcggctacgacaaggccgcgcagatcgccaagaaggcgcacaaggaaaacctgtcgctgaaagaggcggcgctggcgctggggcacctgaccgaggcgcagttcgccgagtgggtggtgccgggcgacatgaccaacgcgcgccgctag

SEQ ID NO: 29201 - protein, 463 aa, Bordetella pertussis
MKTRTEKDTFGPIEVPEQHLWGAQTQRSLHFFAISTEKMPVPLVAAMARLKRAAAKVNAELGELDPQVADAIMRAADEVIAGKWPDEFPLSVWQTGSGTQSNMNMNEVLANRASELLGGERGEGRKVHPNDHVNRGQSSNDTFPTAMHVAAAVEVEHRVLPALKALRGTLAAKSAAFYDIVKIGRTHLQDATPLTLGQEISGYVAQLDLAEQQIRATLAGLHQLAIGGTAVGTGLNAHPQFSAKVSAELAHDTGSAFVSAPNKFQALASHEALLFAHGALKTLAAGLMKIANDVRWLASGPRSGLGEISIPENEPGSSIMPGKVNPTQCEAVTMLAAQVMGNDVAINVGGASGNFELNVFKPLVIHNFLQSVRLLADGMVSFDKHCAAGIEPNRERITELVERSLMLVTALNPHIGYDKAAQIAKKAHKENLSLKEAALALGHLTEAQFAEWVVPGDMTNARR

SEQ ID NO: 29202 - DNA, 1392 bp, Brucella melitensis
  CDS (1)..(1392)
atggccgccacgcgtaccgaaacagacactttcggaccgatcgatgttcccgcagaccgttattggggcgcacagacacagcgttccctgcaaaatttcaggatcggcggcgagcgcatgcccctgcccctggttcacgcgctgggcgtggtaaagcgcgcggcggcggaaaccaatatcgcgctcggcaagcttgatcccgtcctgggtcaggtgattgcggttgccgcttccgaagtcattgagggcaagctcgacgaccatttcccgctcgtagtctggcagacaggctccggcacgcaatcgaacatgaatgccaatgaagtgatctcgaaccgggctatcgagttgctcggcggggaaatgggctccaaaaagccgatccacccgaacgaccatgtcaatatgagccagtcttccaatgacagtttcccgacggcgatccacatcgccacggcggtcgaaaccgtcaaccggctctatcccgcgctcgaacacctcaccaaagccctgaaggtcaaggaagaagcattcaaggacatcatcaagattggccgcacccacacgcaggacgcaacacctgtgacgctggggcaggaattttcgggctaccgcgcggcacttgaatatgcccgccatcggctcgaacaatcgcttgccgacgtcttcctgctggcgcagggcggcacggctgtcggcaccggtctcaacgcacctgtcggtttcgacaagggctttgccgaagcggtgagcgagattaccgggctttccttcaagaccgcgccaaacaagttcgaggcgctggcaagccacggcgccgttctcaacttccacggcagcctgaatgcgcttgcagccgatctcttcaagatcgccaacgatatccggtttctcggttccggcccgcgttccggccttggcgagctttctctgccggaaaacgaacccggctcctccatcatgccgggcaaggtcaaccccacacaggccgaagccatgaccatggtggcaacccaggttttcggcaaccagaccgccgtaaccgtcgccgccagccaggggcatttcgagctgaacgtcttcaaaccggtcattgcctataatgtgctgcaatcgatccggcttttgagcgacaccatggtttcctttgccgatcattgcgtcgaggggattgaacccaatacggcccgcatcaaggaattgctggaacgctcgctcatgctcgtcacggcgcttgcgcctgccatcggctatgacaatgcggccaggatcgccaaaaccgcccataagaacggcaccacgcttcgcgaggaagcattggcaagcggcctcgtatcggaagaagattatgaccggctggtgcgcgccgagcggatgatcgccccacaatga

SEQ ID NO: 29203 - protein, 463 aa, Brucella melitensis
MAATRTETDTFGPIDVPADRYWGAQTQRSLQNFRIGGERMPLPLVHALGVVKRAAAETNIALGKLDPVLGQVIAVAASEVIEGKLDDHFPLVVWQTGSGTQSNMNANEVISNRAIELLGGEMGSKKPIHPNDHVNMSQSSNDSFPTAIHIATAVETVNRLYPALEHLTKALKVKEEAFKDIIKIGRTHTQDATPVTLGQEFSGYRAALEYARHRLEQSLADVFLLAQGGTAVGTGLNAPVGFDKGFAEAVSEITGLSFKTAPNKFEALASHGAVLNFHGSLNALAADLFKIANDIRFLGSGPRSGLGELSLPENEPGSSIMPGKVNPTQAEAMTMVATQVFGNQTAVTVAASQGHFELNVFKPVIAYNVLQSIRLLSDTMVSFADHCVEGIEPNTARIKELLERSLMLVTALAPAIGYDNAARIAKTAHKNGTTLREEALASGLVSEEDYDRLVRAERMIAPQ

SEQ ID NO: 29204 - DNA, 1347 bp, Candidatus Blochmannia floridanus
  CDS (1)..(1347)
atgatatgtaatagattatggggagatcaaacagaatcttctttaaaattttttaatatttctacagaaaaaatgccttgggaattaattaaagcattagctcaaataaaacgagtatcagctcaagtaaattatgatttaaaattacttgattatgaacgttctcaagctattattgcagcagtagatgaaatattatctggcaatcataaaaatgaatttccattatcagtgtggcaaactggatctggtactcaaagcaatatgaatatgaatgaagttttggcaaatagggcaaatgaattattaagaaaaaatcagataaatatagtcgtacatccaaacgatcatgtcaataaaagtcaaagttcaaatgatgtttttcctagtgcaatgcacattgcagcagtagttaatttaaaaacaaaactaatacctgtaattaaattattacaaaaaacttttttaaaaaaatctattgaatttcgtaatattataaaaattggacgtactcatttgcaggatgctattccattgactttagggcaagaaatttccggatgggattttatgttaaaaaataatacaaatcatattcaatcaactattcttgatttaagtgcattggcattaggaggaacggcagtagggacaggatttagcgctcatgtagaatatgcagaacgtgttgtattaggcttgtctaaactaattcatcactctttttttagcgctcctaataaatttgaatctttatctacgtgtgatgctatagtttatagtcatgggactttgaagggattagctatatccatgatgaagattgcaaacgatatacgtttgttatcatctggtcctcagtgtggtctgggagagttgattattcctgctaatgaacctggaagttctattatgcctggtaaagttaatcctacgcaatgtgagtctatgactatgtcatgttgccaagttatgggtaatgatttaagcattagtttgggaggttcatctggacagttacaattaaatacatataggcctttaattatttacaattttttacaatcaatacgattacttacagatagtataaaaaattttcatgattattgtattgtgggtatcagaccaaaattcaaaagaattgaaaaattgttaaacaaatctttaatgttagtaacagcattaagttctcatataggatatgataaatcagcacaaattgctcaaacagcttatttaaatggaattactttaaaagctgcatcgatacaatcgggttacgtaactgaaaaacagtttgatgattgggtttgtccagaaaatatgatttatcctgatatgtag

SEQ ID NO: 29205 - protein, 448 aa, Candidatus Blochmannia floridanus
MICNRLWGDQTESSLKFFNISTEKMPWELIKALAQIKRVSAQVNYDLKLLDYERSQAIIAAVDEILSGNHKNEFPLSVWQTGSGTQSNMNMNEVLANRANELLRKNQINIVVHPNDHVNKSQSSNDVFPSAMHIAAVVNLKTKLIPVIKLLQKTFLKKSIEFRNIIKIGRTHLQDAIPLTLGQEISGWDFMLKNNTNHIQSTILDLSALALGGTAVGTGFSAHVEYAERVVLGLSKLIHHSFFSAPNKFESLSTCDAIVYSHGTLKGLAISMMKIANDIRLLSSGPQCGLGELIIPANEPGSSIMPGKVNPTQCESMTMSCCQVMGNDLSISLGGSSGQLQLNTYRPLIIYNFLQSIRLLTDSIKNFHDYCIVGIRPKFKRIEKLLNKSLMLVTALSSHIGYDKSAQIAQTAYLNGITLKAASIQSGYVTEKQFDDWVCPENMIYPDM

SEQ ID NO: 29206 - DNA, 1386 bp, Chromobacterium violaceum
  CDS (1)..(1386)
atgacgaaaaccgtacgcagcgaaaccgacaccttcggtccgatcgacgtccccgccgctgcgctgtggggggcgcagacccagcgctcgctggcgcatttccgcatttccagcgagaagatgccgccggagctgatcctggcgctggctcgggtcaagcgcgcctgcgccgaggccaaccgcgggctgggcaagctggacgacgccaaggccgccgccatcgccggcgcggccgacgaggtgctggcgggccgacacgacggcgagtttccgctgtcggtgtggcagaccggctccggcacccagagcaatatgaatatgaacgaggtgctggccaaccgcgcgtcggagctgctgggcggccggcgcgggccgggccggctggtccatcccaacgacgacgtcaatctcggccagtcgtccaacgacatcttccccaccgcgatgcacgtcgccgccgccacgcaggtcaaggaacggctgctgccgtcgctggatctgctgcgccacgcgctcgaatccaaagccgaagccttcgccgacgtcgtcaagataggccgcacccatctgcaggacgccacgccgctgacgctgggccaggagatctccggctgggcggcgcaactggcgctgtccgaacaggcggtgcgcgcggcgctgcccatgctgtgccagctggcggtcggcggcaccgcggtgggcaccggcctcaacaccgatccaagcttcggcgccgcggtggcggcgcgcctggccgagcaaagcggcctgccattcgaaagcgccggcaacaaattcgccgcgctggccggccacgagccgctcgtgttcgcccacggcgcgctgaaaacgctggccgccgcgctgatgaagatcgccaacgacatccgctggctggcttccggcccgcgcagcggcctgggcgagctgtcgctgccggagaacgagccgggcagctccatcatgccgggcaaggtcaaccccacccagtgcgaagcgatgaccatgctgtgctgccaggtgctgggcaacgacgcggcgctggccatcggcgccgcgtccggcaatttcgaactgaacgtgttcaagccgctgatcgcgcacaacttcctgcaaagcgcgcggctgctggcagacggcatggacagcctgcgcgagcactgcgtggacggcatggaagccaaccgcgcgcgcatcgccgaactgatggcgcgctcgctgatgctggtcaccgcgctgaacccgcacatcggctacgacaaggcggccgccatcgccaaacacgcccatcgccacggcaccacgctgcgcgaggcggcgctggcgctgggccacctgagcgccgagcagttcgacgcctgggtgcggccggaagacatggtgtga

SEQ ID NO: 29207 - protein, 461 aa, Chromobacterium violaceum
MTKTVRSETDTFGPIDVPAAALWGAQTQRSLAHFRISSEKMPPELILALARVKRACAEANRGLGKLDDAKAAAIAGAADEVLAGRHDGEFPLSVWQTGSGTQSNMNMNEVLANRASELLGGRRGPGRLVHPNDDVNLGQSSNDIFPTAMHVAAATQVKERLLPSLDLLRHALESKAEAFADVVKIGRTHLQDATPLTLGQEISGWAAQLALSEQAVRAALPMLCQLAVGGTAVGTGLNTDPSFGAAVAARLAEQSGLPFESAGNKFAALAGHEPLVFAHGALKTLAAALMKIANDIRWLASGPRSGLGELSLPENEPGSSIMPGKVNPTQCEAMTMLCCQVLGNDAALAIGAASGNFELNVFKPLIAHNFLQSARLLADGMDSLREHCVDGMEANRARIAELMARSLMLVTALNPHIGYDKAAAIAKHAHRHGTTLREAALALGHLSAEQFDAWVRPEDMV

SEQ ID NO: 29208 - DNA, 1422 bp, Corynebacterium efficiens
  CDS (1)..(1422)
atgagtgatttcatgaccgagcaggaattccgtattgaacacgacaccatgggtgaagtgaaggtccccgcacaggctctgtggcgtgcacagacccagcgtgccgtggagaacttccccatctctggccgtggtctggaatccgcacagatccgcgcgatgggcctgctgaaggcagcctgcgcgcaggtgaacaaggactccggtgccctggatgccgccaaggccgacgccatcatcgccgccggcaaggagatcgccaccggcaagcatgatgccgagttcccgatcgacgtcttccagaccggttccggcacctcctccaacatgaacaccaacgaggtcatcgcctccatcgcgaaggccaacggcaccgaggtccaccctaacgacgatgtcaacatgggccagtcctccaatgacaccttccccaccgcgacccacgtcgccgccaccgaggcagccgtcaatgacctgatcccgggcctgaaggtgctgcacgagtccctggccaagaaggccaacgagtgggattccgtggtcaagtccggccgcacccacctcatggacgccgtcccggtcaccctgggccaggagttcggcggctacgcacgccagatccagctcggcatcgagcgcatcgaggccaccctgccacgtctgggtgagctggccatcggtggtaccgccgtcggcaccggcatcaacacctccgccgacttcggtggcaaggttgtcgccgagctcgtcgagctcaccggcgtcacccagctgcaggaggcagccaaccacttcgaggcacaggccaaccgcgacgccctcgtcgagttctccggcgcgatgcgcgttgtcgccgtctccctctacaagatcgccaacgacatccgcctcatgggctccggcccgctgaccggcctcggcgagatccagctgcccgacctgcagccgggttcctccatcatgccgggcaaggtcaaccccgtcctgtgcgagaccgccacccaggtctccgcccaggtcatcggcaacgacgccgctgtcgccttcgccggcagccagggccagttcgagctcaacgtgttcatccccgtgatggcccgcaacgtccttgagtccgcccgcctgctggccaacaccgcgcgcgtgttcgccacccgcctggttgacggcattgttcccaacgaggagcacatgaagcagctggccgagtcctccccgtccattgtcactccgctgaactccgcaatcggctacgaagccgccgcgaaggtcgccaaggctgcgctggcagagggcaagaccatccgccagaccgtcatcgacatgggctttgtcgacggtgagaagctgaccgaggaggagctggacaagcgtctggacgttctcgcgatggccaacaccgaccgcaagcagaagttctaa

SEQ ID NO: 29209 - protein, 473 aa, Corynebacterium efficiens
MSDFMTEQEFRIEHDTMGEVKVPAQALWRAQTQRAVENFPISGRGLESAQIRAMGLLKAACAQVNKDSGALDAAKADAIIAAGKEIATGKHDAEFPIDVFQTGSGTSSNMNTNEVIASIAKANGTEVHPNDDVNMGQSSNDTFPTATHVAATEAAVNDLIPGLKVLHESLAKKANEWDSVVKSGRTHLMDAVPVTLGQEFGGYARQIQLGIERIEATLPRLGELAIGGTAVGTGINTSADFGGKVVAELVELTGVTQLQEAANHFEAQANRDALVEFSGAMRVVAVSLYKIANDIRLMGSGPLTGLGEIQLPDLQPGSSIMPGKVNPVLCETATQVSAQVIGNDAAVAFAGSQGQFELNVFIPVMARNVLESARLLANTARVFATRLVDGIVPNEEHMKQLAESSPSIVTPLNSAIGYEAAAKVAKAALAEGKTIRQTVIDMGFVDGEKLTEEELDKRLDVLAMANTDRKQKF

SEQ ID NO: 29210 - DNA, 1529 bp, Corynebacterium glutamicum
  CDS (37)..(1458)
aagcttgtgacagccgtatttaattctcagtaagaaatgagtgatttcatgaccgagcaggaattccgtattgagcacgacaccatgggtgaagtgaaggttccagcaaaggctctgtggcaggcacagacccagcgcgctgttgagaacttccctatctctggtcgtggtctggaatccgcacagatccgcgcaatgggtctgctgaaggcagcttgtgcgcaggtaaacaaggactccggtgcgctggatgcagagaaggcagatgccatcattgcagctggtaaggagatcgcgtccggtaagcatgacgctgagttcccaattgatgtgttccagactggttccggtacttcctccaacatgaacaccaatgaggttatcgcttccatcgcgaaggctaacggcgttgaggttcacccaaatgaccacgtcaacatgggtcagtcctccaatgacaccttccctactgcaactcacgttgctgcaaccgaagctgctgtcaatgacctcatcccaggcctgaaggttctgcacgagtctttggcgaagaaggctaacgagtggtctgaggttgttaagtccggccgcacccacctgatggacgctgttccagtaaccctgggccaggagttcggtggctacgctcgccagatccagctcggcatcgagcgcgttgaggctactcttcctcgccttggtgagctggctattggtggcaccgctgctggtaccggtatcaacacctccgctgatttcggtggcaaggttgttgctgaactgatcaacctgaccgacgtcaaggagctcaaggaagctgagaaccacttcgaggctcaggctgcacgcgacgctcttgttgagttctccggcgcaatgcgcgttatcgctgtctccttgtacaagatcgctaacgatatccgcctcatgggctccggcccactgaccggtcttggcgagatccgtctcccagacctgcagccaggttcctccatcatgccaggcaaggtcaacccagttctctgtgagaccgctacccaggtttccgctcaggttatcggcaatgacgcagctgttgcgttctccggcacccagggccagttcgagctcaatgtgttcatcccagtgatggctcgcaacgtgcttgagtccgctcgcctgctggctaacacttcccgcgtgttcgcgacccgtctcgttgatggcattgagccaaacgaggcacacatgaaggagctcgctgagtcttcaccttccatcgttaccccactgaactctgcaatcggctacgaagctgctgcaaaggtggctaagactgctttggctgagggcaagaccatccgccagactgtcatcgatttgggcttggttgatggcgagaagctcaccgaggaagagctggacaagcgcctcgacgttcttgctatggctcacaccgagcgcgagaacaagttctaaaactagaacccgataaataaggaccttcacttcttaagaagtgaaggtccctttttcgctacatatctaga

SEQ ID NO: 29211 - protein, 473 aa, Corynebacterium glutamicum
MSDFMTEQEFRIEHDTMGEVKVPAKALWQAQTQRAVENFPISGRGLESAQIRAMGLLKAACAQVNKDSGALDAEKADAIIAAGKEIASGKHDAEFPIDVFQTGSGTSSNMNTNEVIASIAKANGVEVHPNDHVNMGQSSNDTFPTATHVAATEAAVNDLIPGLKVLHESLAKKANEWSEVVKSGRTHLMDAVPVTLGQEFGGYARQIQLGIERVEATLPRLGELAIGGTAAGTGINTSADFGGKVVAELINLTDVKELKEAENHFEAQAARDALVEFSGAMRVIAVSLYKIANDIRLMGSGPLTGLGEIRLPDLQPGSSIMPGKVNPVLCETATQVSAQVIGNDAAVAFSGTQGQFELNVFIPVMARNVLESARLLANTSRVFATRLVDGIEPNEAHMKELAESSPSIVTPLNSAIGYEAAAKVAKTALAEGKTIRQTVIDLGLVDGEKLTEEELDKRLDVLAMAHTERENKF

SEQ ID NO: 29212 - DNA, 1380 bp, Coxiella burnetii
  CDS (1)..(1380)
atgcgaaaagagtccgacagcatgggtacgattgaagtgcccagtgaaaagtattatggcgcgcaatcacagcgctcattaattaattttgccattgggcgtgaaacgatgccgcctgagctcattcgcgcttttggcgttttgaaaaaagcggctgtgctcaccaatgttgaattgggcaaggtgtctcaagaaaaagctaactttattcttaaagcctgcgaagagctgatcgctggaaaactaaacgatcattttcccttgaaaatttggcaaaccggcagcggcacgcagaccaacatgaatgtgaacgaggttatcagtaatcgcgcgattgagttagctggtggaaagttaggaagcaaagaaccggttcatccgaacgatcacgttaatatgtcgcaatcttcaaatgatacttttccaacggccatgcacattactgctgccgaaatgataacgcatcagcttattcctaatctcactgtcttacgcgataccttggaaaaaaaatccaaggaattttccgaaatcattaaaatcggtcgaacgcatttgcaagacgctgtgccattaacgttgggtcaagaattttcaggttatgtcgctcaactcaaccataacttggaagccattaatgatgtacttccaacgctctatcgtcttgcgctcggcgggacggcggtaggcacggggctaaatacccacccgcaatttgccaaaaaagcggctgaccacattgccgaactgacgggaatacccttttactcggcgtctaataaatttgccgctctggctgccaacgacgaaattgttttagtcagcggcgttctcaaaacccttgcctgttcgttgatgaaaattgcaaacgatattcgttggttggcttccggcccgcgttgcggcatcggggaaattgttatcccagaaaacgagccaggttcttcgattatgccgggtaaagtaaatccaacgcaatccgaagcgatgacgatggtgtgtgttcaggtgataggaaacgatacgaccattaccatcgcgggatcgcaagggaattttgaattgaatgtttacaagcccgtgatggcttataatttaattcaatctatttatttattgtccgatgcttgtcgctcctttaatgatcattgcgccgttggcatcaaacccaatcaagaaaaaattaatgactatctgaataattctctaatgctggtcactgcattaaaccaaatcatcggttacgacaaagcctcagaaattgctaaaaaagcttacaaagaaggcacgacgcttaaagaagcggctcttcaattaggttatttaaccgcaagcgaattcgataaagccgtagaccccaaaaaaatggtcgctatttga

SEQ ID NO: 29213 - protein, 459 aa, Coxiella burnetii
MRKESDSMGTIEVPSEKYYGAQSQRSLINFAIGRETMPPELIRAFGVLKKAAVLTNVELGKVSQEKANFILKACEELIAGKLNDHFPLKIWQTGSGTQTNMNVNEVISNRAIELAGGKLGSKEPVHPNDHVNMSQSSNDTFPTAMHITAAEMITHQLIPNLTVLRDTLEKKSKEFSEIIKIGRTHLQDAVPLTLGQEFSGYVAQLNHNLEAINDVLPTLYRLALGGTAVGTGLNTHPQFAKKAADHIAELTGIPFYSASNKFAALAANDEIVLVSGVLKTLACSLMKIANDIRWLASGPRCGIGEIVIPENEPGSSIMPGKVNPTQSEAMTMVCVQVIGNDTTITIAGSQGNFELNVYKPVMAYNLIQSIYLLSDACRSFNDHCAVGIKPNQEKINDYLNNSLMLVTALNQIIGYDKASEIAKKAYKEGTTLKEAALQLGYLTASEFDKAVDPKKMVAI

SEQ ID NO: 29214 - DNA, 1395 bp, Haemophilus ducreyi
  CDS (1)..(1395)
atggaataccgtatcgaaaaagatactatgggcgaagtgaaagtaccggctgatcgttattgggcagcacaaacagaacgttcgcgtaataatttcaggattgggcctgaagcttctatgccggtcgaaattattgaagcatttgcttatttaaaaaaagccgctgcatttgctaatgctgaactaggtgcactcaccactgaaaaacgtgacttaatcgcgatggtttgtgatgaaatcttagcaaataaattagcggacgaatttccgttagtgatttggcaaacaggttctggtacacaatcaaatatgaatcttaatgaagtgattgccaaccgtgcccacgtattacaagggggggcattaggtgaaaaatcgattattcatccaaatgatgatgtcaataaatcgcaatcttcaaacgatacctatccaacggctatgcatattgctgcctataaaaaagtcgttgaagtaaccattccagcaatagaacgcttacaaaaaacatttgccataaaatctgaagcatttaaagatgtggttaaaattggtcgaactcatttaatggatgccaccccgcttacattaggccaagaattctctgcctatgcggcacaattacaatttggtttgttagcccttaaaaataccttgccccatttggcgcagttagcattaggtggcacagctgttggcacaggcttaaatacgcctaaaggttatgatgttaaagtagcagaatatatcgcacaatttactcaacttccttttattactgcggaaaataaatttgaagcattagccactcacgatgcaattattgaaacacacggtgcgctcaaacaaattgctatgtcattattcaaaattgccaatgatattcgtttattagcatcaggtcctcgctctggtattggcgaaattctaattcctgaaaatgaacccggctcctcaattatgcccggtaaagtcaatcctactcaatgtgaggcaatgactatggttgcagcgcaagtgttgggaaatgatactacgatttcatttgcgggtagccaaggccattttcagttaaatgttttcaaacctgttatggcagcaaatttcttacaatcggcacaattacttgctgatgtatgtatttcatttgatgagcattgtgcaagcggtattgaacctaattatccaagaattcaacaacaattagaaaactctttaatgttagtgaccgctttaaatacccatattggttatgaaaatgcggctaaaattgctaaaactgcgcacaaaaatggaacaacactcaaagaagaagcaattaacttaggtctagtcactgctgaacagtttgatcaatgggtacgccctcaaaatatggtcggtagtttaaaataa

SEQ ID NO: 29215 - protein, 464 aa, Haemophilus ducreyi
MEYRIEKDTMGEVKVPADRYWAAQTERSRNNFRIGPEASMPVEIIEAFAYLKKAAAFANAELGALTTEKRDLIAMVCDEILANKLADEFPLVIWQTGSGTQSNMNLNEVIANRAHVLQGGALGEKSIIHPNDDVNKSQSSNDTYPTAMHIAAYKKVVEVTIPAIERLQKTFAIKSEAFKDVVKIGRTHLMDATPLTLGQEFSAYAAQLQFGLLALKNTLPHLAQLALGGTAVGTGLNTPKGYDVKVAEYIAQFTQLPFITAENKFEALATHDAIIETHGALKQIAMSLFKIANDIRLLASGPRSGIGEILIPENEPGSSIMPGKVNPTQCEAMTMVAAQVLGNDTTISFAGSQGHFQLNVFKPVMAANFLQSAQLLADVCISFDEHCASGIEPNYPRIQQQLENSLMLVTALNTHIGYENAAKIAKTAHKNGTTLKEEAINLGLVTAEQFDQWVRPQNMVGSLK

SEQ ID NO: 29216 - DNA, 1395 bp, Haemophilus influenzae
  CDS (1)..(1395): n means a or g or c or t/u, s means g or c
atggcatttcgtattgaaaaagacacaatgggtgaagttcaagttctagcagataaatactgggctgcacaaactgaacgttcacgcaataactttaaaattggcccagccgcatcaatgccacatgaaattatcgaagcttttggctatttgaaaaaagcagccgcatttgctaatcatgatttgggtgtattacctcttgaaaaacgtgatttaattgctctggcttgtgacgaaattttagcaaataaattagatgatcaattcccacttgttatttggcaaactggttctggtacacaatctaatatgaatgtgaacgaagtagttgccaatcgtgctcatgtgttaaacggtggaaaattaggtgaaaaatctattattcacccaaatgatgatgtgaacaaatcacaatcttcaaatgatactttcccaacggcaatgcacattgcggcatataaaaaagtagttgagcacaccattccttgtgttgaacgtttacaaaaaacttttgcggcaaaatctgaagccttcaaaaacgtggtaaaaattggccgcactcacttaatggatgcaacgccactcacattaggtcaagaattttcggcttatgcagctcaattagatttcggcttaaaagcattaaaaaataccctcccacatttaagccaattagcattgggtggaactgcggttggcacaggtttgaacacgccgaaaggctatgatttgaaagtggtagattacattgcaaaattcaccgcacttccgtttgtcacagcagataataaatttgaagcattagccgctcatgatgcgattgttgaaactcacggtgcattacgtcaattagcaatgagtttatttaaaattgcgaacgatattcgtctattagcatctggccctcgttcgggaattggcgaaattttaattcctgaaaatgaaccaggttcttcaattatgccaggtaaagtaaacccaactcaatgcgaassgatgacaatggtctgtgcacaagtatttggtaacgacaccaccatcgcatttgtgggttcacaaggtcacttccaattaaatgtgttcaaccctgtgatgattgcaaacttcttacaatctgctcaattattgggcgatgcttgcgtatctttcgatgaacactgtgcagtgggtattgagccaaactatccacgcattaaacaacaacttgaaaattcattgatgttggtgaccgcacttaatacgcatatcggttatgaaaatgcagctaaaattgcaaaaaccgcacataaaaatggcaccacattacgtgaagaagcgattaatttaggtttagtgtctgccgaagattttgataaatgggttcgcccagaagatatggtgggtagcttaaaataa

SEQ ID NO: 29217 - protein, 464 aa, Haemophilus influenzae
  Xaa in position 332 is unknown
MAFRIEKDTMGEVQVLADKYWAAQTERSRNNFKIGPAASMPHEIIEAFGYLKKAAAFANHDLGVLPLEKRDLIALACDEILANKLDDQFPLVIWQTGSGTQSNMNVNEVVANRAHVLNGGKLGEKSIIHPNDDVNKSQSSNDTFPTAMHIAAYKKVVEHTIPCVERLQKTFAAKSEAFKNVVKIGRTHLMDATPLTLGQEFSAYAAQLDFGLKALKNTLPHLSQLALGGTAVGTGLNTPKGYDLKVVDYIAKFTALPFVTADNKFEALAAHDAIVETHGALRQLAMSLFKIANDIRLLASGPRSGIGEILIPENEPGSSIMPGKVNPTQCEXMTMVCAQVFGNDTTIAFVGSQGHFQLNVFNPVMIANFLQSAQLLGDACVSFDEHCAVGIEPNYPRIKQQLENSLMLVTALNTHIGYENAAKIAKTAHKNGTTLREEAINLGLVSAEDFDKWVRPEDMVGSLK

SEQ ID NO: 29218 - DNA, 1395 bp, Leptospira interrogans
  CDS (1)..(1395)
atgaaaaccagaatcgaaacggattcgatgggcgaaattgcagtagacgattccaaatattggggcgcacaaacagaacgttccttacatcattttcatatcggaaacgatcgatttccaagagaaatgattcgtgctttaggaattttaaagaaatctgcagcggttgttaatgcggaacttggtcttttaagcgaagataaaaagaaactgattgttcaagccgccgacgaagtgatttccggaaaattggatgagcattttccgctttcggtttggcagaccggctccggaactcagactaacatgaattctaatgaagtgatttcgaaccgtgcgatcgaaattgcaggtggggtgaagggctctaaaaaaccgattcatccaaatgacgatgttaacaaggctcaatcctcaaacgatacgtttcctacagccatgcatatcgctgcggcggaacagttaaaccaaaagttgattcctgctctgatacaactcaaagaaacgttcaagaaaaaaacagatgaatttcagaatattataaaaatcggtagaactcatcttcaagacgcgactcctctgactttaggccaagaattttctggctatgttcaacaattggaatacaatattgcaagggtaaaggcagttttaccttccgtttatagacttgcgttaggcggaacagctgtcggaaccggattaaatactcaccctcagtttgcggtaaaagcagcggctcaaatcgctaaagaaactggacttccttttgtaagcgcggaaaataagttcgaggcactcgcggctcacgattctcttgtagaaacgagcggtgtgttgaaaacgatcgctgcttctttaatgaaaattgcaaacgatatacgttggctttcttctggtcctcgttgtggaattggtgaaattagtattccggaaaatgaaccaggttcttctatcatgccgggtaaagtgaatccaacacaatcagagcagatgacgatggtcgcggctcaagtaattgcaaatgacgttgcagtaaatataggcggtgcttctggaaatttcgagttgaacgtttttaaacctttgattatccacaacgttttgaattcgattcgattactttctgattcttgtgtttcttttgaagaacattgtgctcgtggaattattccgaataaggaaaagttaaacgaacacttaaataattctttgatgcttgtgaccgctttgaatcctcatataggttatgataacgctgctaaaattgccaagaacgcgcataaaaaaggaacaactctgaaagagtccggaattgaattgggacttttaacaagtgaacaatttgatcagtgggttcttcccgaaaagatgatccatccttcggtggattaa

SEQ ID NO: 29219 - protein, 464 aa, Leptospira interrogans
MKTRIETDSMGEIAVDDSKYWGAQTERSLHHFHIGNDRFPREMIRALGILKKSAAVVNAELGLLSEDKKKLIVQAADEVISGKLDEHFPLSVWQTGSGTQTNMNSNEVISNRAIEIAGGVKGSKKPIHPNDDVNKAQSSNDTFPTAMHIAAAEQLNQKLIPALIQLKETFKKKTDEFQNIIKIGRTHLQDATPLTLGQEFSGYVQQLEYNIARVKAVLPSVYRLALGGTAVGTGLNTHPQFAVKAAAQIAKETGLPFVSAENKFEALAAHDSLVETSGVLKTIAASLMKIANDIRWLSSGPRCGIGEISIPENEPGSSIMPGKVNPTQSEQMTMVAAQVIANDVAVNIGGASGNFELNVFKPLIIHNVLNSIRLLSDSCVSFEEHCARGIIPNKEKLNEHLNNSLMLVTALNPHIGYDNAAKIAKNAHKKGTTLKESGIELGLLTSEQFDQWVLPEKMIHPSVD

SEQ ID NO: 29220 - DNA, 1455 bp, Methanosarcina acetivorans
  CDS (1)..(1455)
atgccttcaatcctcgacctgcctatcggtactggagcgactggcaaacgaaaagaaagcgattctttgggggaggttgaggttccagccgaccattactggggggctcagacccagaggtctctgattcacttttccatcggcgacgactacatgccaaaggaggtctatcatgcttatgggtacgtgaaaaaggcagctgctctggtcaacgaagccgccggaataataccgccgtggaaagctgaattgatagcaagggttgcagatgaagttatcgccggtaaactcgacagcgaattcccgctctatgtctggcagactggctcaggcactcagtcgaacatgaacgtgaatgaagtcatcagcaatcgcgccatccagctcgtgggcggaagcctcggcagtaagcaccctgtccatcctaatgacgatgttaatatgagtcagtcgtccaacgacacctttccaacggccatgcacattgcaactgtgctcgaattcagcaaccgcctcattcccgcagttaccgttcttgaagagtccatatgggccaaagcacgggaatgggtggatatcgtcaagataggccgaacacatcttcaggacgcaaccccacttacagtgggccaggagtggtctggctacgccacacagctcgatgacgcgttggcgtttgtcaagcattctctccggggattatatcggttggccatcggaggcactgcggtcgggaccggcatcaataccccaccagacttcggtgaaaaggttgcagatgagattgccaggctcacaggtcatccatttgtcacagctccaaataaattcgcagctcagggctcccttgatgcaatggtaacctcaagcgcggcactgcgtacattagcagtcgcactgatgaagattgcaaatgacctgcaatggcttggttcgggaccgaggtcgggtctccacgagcttatcctcccaagtgacgagccgggaagctcaatcatgcctgggaaagtcaatccgactcaggaggaagccatgttaatggtttgcatccaggtgattggggaagataatgccgtcgcatttgccgggtcacagggaaacttcgagcttaacgcaatgtgcccgataatcataaataatgtcttacattctgcgcgcactctcggcgatgcttgcgtaaagttccgtgagtacggaatcaatggaatcatgctcgacaggagtcgtatcgacaaatttgtgggcacctccctcatgttagtgacagcgcttagccctgtcataggctacgacaaggcttccgcaattgtccagcgagcactggacgagaatacgacactgagggaagctgcagtgaaaggaggtttcatcagcgcggaggattttgacaggattgtggatccgaagaagatggttggggatccgcgacacgacctgaagctggcttcagagtag

SEQ ID NO: 29221 - protein, 484 aa, Methanosarcina acetivorans
MPSILDLPIGTGATGKRKESDSLGEVEVPADHYWGAQTQRSLIHFSIGDDYMPKEVYHAYGYVKKAAALVNEAAGIIPPWKAELIARVADEVIAGKLDSEFPLYVWQTGSGTQSNMNVNEVISNRAIQLVGGSLGSKHPVHPNDDVNMSQSSNDTFPTAMHIATVLEFSNRLIPAVTVLEESIWAKAREWVDIVKIGRTHLQDATPLTVGQEWSGYATQLDDALAFVKHSLRGLYRLAIGGTAVGTGINTPPDFGEKVADEIARLTGHPFVTAPNKFAAQGSLDAMVTSSAALRTLAVALMKIANDLQWLGSGPRSGLHELILPSDEPGSSIMPGKVNPTQEEAMLMVCIQVIGEDNAVAFAGSQGNFELNAMCPIIINNVLHSARTLGDACVKFREYGINGIMLDRSRIDKFVGTSLMLVTALSPVIGYDKASAIVQRALDENTTLREAAVKGGFISAEDFDRIVDPKKMVGDPRHDLKLASE

SEQ ID NO: 29222 - DNA, 1419 bp, Methylobacterium extorquens
  CDS (1)..(1419)
atgtcgccgcacgagaacccttccgtcgagacgcgtaccgagtccgacaccttcggcccgatcgaagtgcccgcccaccgctactggggcgcccagacgcagcgctcgatccagaacttcaagatcggcaccgagcgccagccggcgccgctcgtccatgcgctcggcatcgtcaagcaggccgccgcgctggtgaacaaggatctcggcggcctcgatccgaagatcgccgacgcgatcgccgaatccgctgccgaagtggtcgccggaaagcacgacgacgagttcccgctggtggtgtggcagacgggctcgggcacgcagtccaacatgaacgccaacgaggtgatcgcgagcctcgcaaacgagcggctcgggggcaagcgcggcggcaagtcgccggtccaccccaacgatcattgcaaccgcggccagtcctcgaacgacaccttccccaccgccatgcacatcgcggtcgcccgcgaggttcaggagcggctgctgccggcgctctcccacctgcacaccgcgctcgatgccaaggcgaaggagttcgagagcatcgtcaagatcggccgcacgcacttgcaggatgcgacgccggtctcgctcggccaggaattctccggttacgccgcgcaggtcgcgctcggtggcgcgcgcatcgccgccacgctccccggcgtgctggcgctggcgcagggcggcaccgccgtcggcaccggcctcaatgcgcatccggaattcgcggagcggtttgcggccaaggtcgcggagctgaccgggctgccctttacctcggccgagaacaagttcgaggcgctggccacccacgacgccctcgtcttccttcagggcgcgctgacggctttggcatcgggcctcttcaagatcgccaacgacatccgcctgctcggctccggcccgcgctcgggcctcggcgaattgtcgctgccggagaacgagcccggctcgtcgatcatgccgggcaaggtcaacccgacccagtgcgaggcgctgacgatggtctgcgcgcaggtggtcggcaacggcaccacggtgagctttgccggctcacagggtcatttcgagctcaacgtgttcaagccggtgatcgccaacgcggtgctgcaatcggtgcggattctggccgacgcctcagtcagcttcaccgacaattgcgtcgtcggcatcaaggccaacaccgaccggatcagcgacctgatgagccgctcgctcatgctggtgaccgcgctcgcgccctcgatcggctacgacaaggccgccgagatcgccaagaccgcgcacaagaacggcaccaccctgaaggaagaggcgctgcggctcggctacgtcacggacgaggagttcgagcgggtcgtacgccccgaaaccatgctggcgccgagcgcggaataa

SEQ ID NO: 29223 - protein, 472 aa, Methylobacterium extorquens
MSPHENPSVETRTESDTFGPIEVPAHRYWGAQTQRSIQNFKIGTERQPAPLVHALGIVKQAAALVNKDLGGLDPKIADAIAESAAEVVAGKHDDEFPLVVWQTGSGTQSNMNANEVIASLANERLGGKRGGKSPVHPNDHCNRGQSSNDTFPTAMHIAVAREVQERLLPALSHLHTALDAKAKEFESIVKIGRTHLQDATPVSLGQEFSGYAAQVALGGARIAATLPGVLALAQGGTAVGTGLNAHPEFAERFAAKVAELTGLPFTSAENKFEALATHDALVFLQGALTALASGLFKIANDIRLLGSGPRSGLGELSLPENEPGSSIMPGKVNPTQCEALTMVCAQVVGNGTTVSFAGSQGHFELNVFKPVIANAVLQSVRILADASVSFTDNCVVGIKANTDRISDLMSRSLMLVTALAPSIGYDKAAEIAKTAHKNGTTLKEEALRLGYVTDEEFERVVRPETMLAPSAE

SEQ ID NO: 29224 - DNA, 1401 bp, Myxococcus xanthus
  CDS (1)..(1401)
atgagcacgaagaacgtccgtaccgagaaagacaccttcggtcccatcgacgtccccgccgaccggctgtggggcgcgcagacgcagcgcagcctccagaacttcgccatctccaccgagcgcatgccgctggccctcatccgcgccctggtgctggtgaagaaggccgccgcgcgggtgaacgtggagaacggctcgctggcgaaggagaagggcgaggccatcatccgggccgcggacgaggtgctggccggccagcacgacgcggagttccccttgagcgtctggcagacgggcagcgggacgcagacgaacatgaacacgaacgaggtgctcgccaaccgcgcctcggagctgctgggcggcgagcgcggcgagcgccgcaaggtccaccccaacgacgacgtcaacaaggggcagagctccaacgacgtcttccccaccgcgatgagcgtggccgccgtggccgccatcaccgagcacgtgctgccggagctgaaggcgctgcgcgacgtgctcgcgcagaaggcccgcgccttccatgacgtggtgaaggtgggccgcacccacctgcaggacgccacgcccctgacgctggggcaggaggtcggcggcttcgtggcgcagttggaccacgcgaagggccacctggagcgcaccctgccgcatcttctggagctggccctgggcggcacggcggtgggcaccggcctcaacgcccccaagggctatgccgagcgggtggcgcaggagctggcccagctcaccggccaccccttcgtcaccgcgcccaacaagttcgaggcgctggccgccaacgacgcgctggtgcaggcgcacggggcgctgaaggggctggcggcggtgctcttcaaggtggccaacgacgtgcgctggctgtcctcggggccgcgctcggggctggcggaaatcaccatcccggagaacgagccgggcagctccatcatgccgggcaaggtgaaccccacccagagcgaggcgctcaccatgctgtgcgcccaggtgatggggaacgacgtcgccgtcaccgtgggtggggcgtccggcaacttccagctcaacgtcttcaagccgctcatcgcccacaacctgctccagagctgccggttgctggcggatggcatgcgcagcttccgcctgcactgcgcggtgggcatcgagcccaaccggccccgcatccaggagaacctggagcgcagcctgatgctcgtcacggcgctcaacccccacatcggctacgacaacgcggcgaaaatcgccaagacggcccacagggacggcacgacgctcaaggagacggccgtggcgctggggctcgtcacccccgagcagttcgaccagtgggtccgcccggaggacatgacgggccacaaggggtag

SEQ ID NO: 29225 - protein, 466 aa, Myxococcus xanthus
MSTKNVRTEKDTFGPIDVPADRLWGAQTQRSLQNFAISTERMPLALIRALVLVKKAAARVNVENGSLAKEKGEAIIRAADEVLAGQHDAEFPLSVWQTGSGTQTNMNTNEVLANRASELLGGERGERRKVHPNDDVNKGQSSNDVFPTAMSVAAVAAITEHVLPELKALRDVLAQKARAFHDVVKVGRTHLQDATPLTLGQEVGGFVAQLDHAKGHLERTLPHLLELALGGTAVGTGLNAPKGYAERVAQELAQLTGHPFVTAPNKFEALAANDALVQAHGALKGLAAVLFKVANDVRWLSSGPRSGLAEITIPENEPGSSIMPGKVNPTQSEALTMLCAQVMGNDVAVTVGGASGNFQLNVFKPLIAHNLLQSCRLLADGMRSFRLHCAVGIEPNRPRIQENLERSLMLVTALNPHIGYDNAAKIAKTAHRDGTTLKETAVALGLVTPEQFDQWVRPEDMTGHKG

SEQ ID NO: 29226 - DNA, 1389 bp, Nitrosomonas europaea
  CDS (1)..(1389)
atggaccagtatcgcgaagaacatgatgcaataggcacagtacaggtgcctgccagcgccctctggggtgcgcagacacaacgatcgctcaacaacttcaatatctcgggcgaacgcatgccgtcagccctgatccacgcactggcgctggtcaaacgcgccgctgccagtgtcaatcatgatctgggattactggacgagaacatcgcccgggcaatcatcaccgctgccgatgaagtgctggcaggagaacacgccggcgaatttccgttggtagtttggcaaaccggttccggcacacaaaccaatatgaacatgaacgaggtgctggccaaccgcgcttcggaaattctgggcggtacacggggcaaaggtcgcaaggtgcaccctaacgaccatgtcaacaaaggacaatcttccaatgacgtttttcccactgccatgcacattgctgccgtggaagccatccgcaaccggttgattccggcactggaagcactacgtaaaacattatcttccaaatcggcagcattttcggatatcgtcaagatcggccgcacacatttgcaggatgccaccccgcttacactggggcaggaattttcaggctatgtttcacagctcgatcatggcctggctcatctcgaatctgcgctgccgcatctgctcgaactggcgctgggggggacagccgtaggtaccggtctcaacacccatccggaatttgcacgccgtgtcgcggcagaaattgcacgcctcagcggctatccttttataacagctgccaataaatttgaggcactggccgcgcatgatgcactggtccatgcgcatggggtgctgaaaacactagcagctatactgatcaaaattgccaatgacgtccgctggctggcatccggcccgcgttgcggtattggtgaaatccttatcccggagaacgaacccggcagttcgatcatgcccggaaaagtcaatcctacccaatcggaagcagttgtcatgcttgcctgtcaggtcatgggcaatgatgttgcaatcaatctgggaggcgccatgggaaatttcgaactcaataccatgaaaccactgatcattcacaattttttacaaagtacacgtttgctcgcagatggtgcagaaagcttcaacacccattgcgcagccggtattacggccaatacagtacgaatcaagcagcatttacaggagtctctgatgctggtaaccgcgctcaatcctcacattggttacgacaaagcagcagaaatagccaaaaaagcccatcatgaaatgctgacattaaaagaagccgcaatcaggctgggttatgtcaccgcagaacaattcgatgtatgggttgacccacaaaaaatgacagaggtgtga

SEQ ID NO: 29227 - protein, 462 aa, Nitrosomonas europaea
MDQYREEHDAIGTVQVPASALWGAQTQRSLNNFNISGERMPSALIHALALVKRAAASVNHDLGLLDENIARAIITAADEVLAGEHAGEFPLVVWQTGSGTQTNMNMNEVLANRASEILGGTRGKGRKVHPNDHVNKGQSSNDVFPTAMHIAAVEAIRNRLIPALEALRKTLSSKSAAFSDIVKIGRTHLQDATPLTLGQEFSGYVSQLDHGLAHLESALPHLLELALGGTAVGTGLNTHPEFARRVAAEIARLSGYPFITAANKFEALAAHDALVHAHGVLKTLAAILIKIANDVRWLASGPRCGIGEILIPENEPGSSIMPGKVNPTQSEAVVMLACQVMGNDVAINLGGAMGNFELNTMKPLIIHNFLQSTRLLADGAESFNTHCAAGITANTVRIKQHLQESLMLVTALNPHIGYDKAAEIAKKAHHEMLTLKEAAIRLGYVTAEQFDVWVDPQKMTEV

SEQ ID NO: 29228 - DNA, 1386 bp, Oceanobacillus iheyensis
  CDS (1)..(1386)
atggattatcgtgttgaaaaagatacaattggggaaattcaagttcctgctgataaatactggggggcgcaaacacagcgtagtaagcaaaattttccaattggaaatgaaaaaatgccagtcgaaattattaaagcgtttgcaattctaaaacgaagtactgctgaagctaattttgaattaggcttaatggaacgagataaaatggaagcaattcaatatgctgctgatcaggtattaaacgattctctaacagatcatttcccactagtcgtttggcaaactggtagtggtacgcaaagtaatatgaatgtaaacgaagtattagcttttgtaggtaataaatggttacaagaacagggaagcgatttaaaattacatcccaatgatgatgtaaataaatctcaaagttcgaacgatacatatccaacggcaatgcatattgcagccgtattgaaattagaagatacggtattaccagctttgagtcagttgaaaaatacttttgcagaaaagcaaagtgcttttgaaaatatcgtgaaaattggtcgtacacatttacaggatgcgactcctctaacactaggccaggaaatcagtgggtggcatcgtatgttagagaaatctgaaacgatgatttcagagagtttagagcatcttcgtgaattagcaataggtggaacagctgtaggcacaggcttaaatgcacatccagatttttcagagaaagtttgtaaggcaattagtacattcacaaacaaaaaattcatatctgcaaaaaataaatttcattcattaacaagtcatgacgaaactgtatatgcacatggtgcactaaagggactagcagcagatttaatgaaaattgcaaatgatgttcgttggttagcaagcggtccacgctgtggcattggagaaattacgattccggcgaatgaaccaggaagttcaattatgccagggaaggtaaatccgactcaaagtgaagctgtaacaatggtagtaactcaagtaatggggaatgatgctgctattggttttgccgctagtcaggggaatttcgaattgaatgtatttaagccagtaattgcatataatttcttacaatcaagtcaattattagcagatagtataatttccttcgatgagcgctgtgcggttggaatcgaaccaaaccacgagcaaatcgaaaagaatcttaatgattctttaatgttggttaccgcattaaatccgcatataggatacgaaaatgcagcaaaaattgctaaaaaagcatttgcagataattcaactttaaaagaaacagctgtagaattaggactattaacagaagaacagtttgatgagtatgttaatccagaggaaatgacatatcctaaataa

SEQ ID NO: 29229 - protein, 461 aa, Oceanobacillus iheyensis
MDYRVEKDTIGEIQVPADKYWGAQTQRSKQNFPIGNEKMPVEIIKAFAILKRSTAEANFELGLMERDKMEAIQYAADQVLNDSLTDHFPLVVWQTGSGTQSNMNVNEVLAFVGNKWLQEQGSDLKLHPNDDVNKSQSSNDTYPTAMHIAAVLKLEDTVLPALSQLKNTFAEKQSAFENIVKIGRTHLQDATPLTLGQEISGWHRMLEKSETMISESLEHLRELAIGGTAVGTGLNAHPDFSEKVCKAISTFTNKKFISAKNKFHSLTSHDETVYAHGALKGLAADLMKIANDVRWLASGPRCGIGEITIPANEPGSSIMPGKVNPTQSEAVTMVVTQVMGNDAAIGFAASQGNFELNVFKPVIAYNFLQSSQLLADSIISFDERCAVGIEPNHEQIEKNLNDSLMLVTALNPHIGYENAAKIAKKAFADNSTLKETAVELGLLTEEQFDEYVNPEEMTYPK

SEQ ID NO: 29230 - DNA, 1395 bp, Pasteurella multocida
  CDS (1)..(1395)
atgacatttcgtatcgaaaaagacactatgggtgaagtacaagttcctgccgataaatattgggcagcacagactgaacgctcacgcaataatttcaaaattggacctgaagcctctatgccaaaagagattattgaagcctttggttatttaaaaaaagcagccgcttatgctaaccatgatttaggtgtattaccagtggaaaaacgggatttaattgcacaggcttgtgatgagatcctcgctaataaattagatgatcaatttcctctcgtcatttggcaaaccggttccggtacacaatccaatatgaaccttaacgaagtcatttcaaaccgtgcccatgttttaaatggtggtaaattaggtgaaaaatccattatccatccaaatgacgatgtgaacaaatctcaatcttcaaacgatacttacccaacagcaatgcacatcgcggcgtataaaaaagtcgttgaagtcactattccttgtgtagaacgtttacaaaaaaccttagcgcaaaaagcagacgcctttaaagatgtggtgaaaattgggcgtactcacttaatggatgcgacaccattaaccttaggtcaagaattctctgcttatgctgcccaattagattttggcttacgcgcattgaaaaacacgctgccacatttagcacaattagcgctaggcggtactgcagtgggtacaggtttaaatacaccgaaaggttatgatgtgaaagtggcagactacattgcaaaatttacaggcttgccatttatcaccgctgaaaataaatttgaagcgttagccacccatgatgccgttgtggaaacgcacggcgcattaaaacaattagcggtatccttatacaaaatcgcaaatgatatccgtttattagcctctggaccacgttctggtattggtgaaattttaattcctgaaaatgagccgggctcttctatcatgccaggtaaagttaacccaacccaatgtgaagccatgacgatggtatgcgcgcaagtactcggtaatgacaccaccatttcctttgcaggtacacaaggtcatttccaattgaacgtatttaaaccagtgatggcggctaacttcttacaatctgctcaattattggcggatgcttgtgtgtccttcgatgaacattgtgcagtcggtattgaaccaaacttccctcgcatcaaaaaacaacttgatgactcattaatgttagtgaccgccttaaatacacatatcggttacgaaaatgcggcgaaaatcgcgaaaaccgcacacaaaaatgggacaacattaaaagaagaagcaatcaacttaggcttagttacagctgaacaatttgatgaatgggtacgtccagaagatatggtcggtagcttaaagtaa

SEQ ID NO: 29231 - protein, 464 aa, Pasteurella multocida
MTFRIEKDTMGEVQVPADKYWAAQTERSRNNFKIGPEASMPKEIIEAFGYLKKAAAYANHDLGVLPVEKRDLIAQACDEILANKLDDQFPLVIWQTGSGTQSNMNLNEVISNRAHVLNGGKLGEKSIIHPNDDVNKSQSSNDTYPTAMHIAAYKKVVEVTIPCVERLQKTLAQKADAFKDVVKIGRTHLMDATPLTLGQEFSAYAAQLDFGLRALKNTLPHLAQLALGGTAVGTGLNTPKGYDVKVADYIAKFTGLPFITAENKFEALATHDAVVETHGALKQLAVSLYKIANDIRLLASGPRSGIGEILIPENEPGSSIMPGKVNPTQCEAMTMVCAQVLGNDTTISFAGTQGHFQLNVFKPVMAANFLQSAQLLADACVSFDEHCAVGIEPNFPRIKKQLDDSLMLVTALNTHIGYENAAKIAKTAHKNGTTLKEEAINLGLVTAEQFDEWVRPEDMVGSLK

SEQ ID NO: 29232 - DNA, 1395 bp, Photorhabdus luminescens
  CDS (1)..(1395)
atggcagccactcgcattgaaaaagactcaatggggcccatcgaagtacctgctgaccaattgtggggagcgcaaactcaacgttcacttgagcattttcgcatttcgcaggagaaaatgccggttgcattaattcatgctctggcattgactaaacaggctgcggccagtgtcaatatggatttgggtcttctgccgcaagaacgtggtgaagcaattattgctgctgcgaaagaggtgctggaaggtaaacatccgacagaatttcctcttgctatctggcagaccggttcaggaacacaaagtaacatgaacatgaacgaagtgttggcgaaccgtggtagcgagatccttggcggggtgagggggagtgaacgccttatccatcctaacgatgatgtcaataaaagtcagagttctaacgatgttttcccaacagcaatgcatgttgctgcggttattgcgctgagtgagcatcttattcctgagctgaaaatattacaaaaaacattggctgataaagctgaagcttataaggatatcgttaaaattggccgtacacacttgcaagatgcgacgccattgacccttggtcaggaaatttctggctgggcggcaatgttaacgcataacctgaaacacattgaagacagtattccccatgtttgtgaattggcactagggggaactgcggttggcaccggtttaaatactcatcctgaatatgctgttcgtgttgctaagaaattggctgaactgaccaaccattcgtttgttactgccccaaataaatttgaagccctggcgacttgtgatgctctggttcattctcatggggcattaaaaggtctggctgcatccataatgaaaattgcaaacgatgttcgttggttggcttccggccctcgctgtggtatcggtgaaatttcaattcctgaaaatgaaccgggtagctcaatcatgccaggtaaagttaacccaactcagtgtgaagcagtgacgatgctttgtgcacaggtgatgggcaatgatgttgctattaatattggtggggcatcaggcaactttgagctaaatgtgtttcgcccaatggtgattaataacttcctgcaatctgttcgcttgttggctgatggtatgcgtagcttcaatgaacattgtgcagtcggtatcgaacccaaccgtgatcgcattactcagttgctgaatgaatctctgatgttagtaacggcgctgaatacacatattggttatgacaaagctgcagaaattgctaagaaagcccataaagaagggctgacattaaaacaatcggcgatgaaactgggttatctgacagaagctgagtttgatgagtgggttcgtccagaagatatggttggcagcttgaagtag

SEQ ID NO: 29233 - protein, 464 aa, Photorhabdus luminescens
MAATRIEKDSMGPIEVPADQLWGAQTQRSLEHFRISQEKMPVALIHALALTKQAAASVNMDLGLLPQERGEAIIAAAKEVLEGKHPTEFPLAIWQTGSGTQSNMNMNEVLANRGSEILGGVRGSERLIHPNDDVNKSQSSNDVFPTAMHVAAVIALSEHLIPELKILQKTLADKAEAYKDIVKIGRTHLQDATPLTLGQEISGWAAMLTHNLKHIEDSIPHVCELALGGTAVGTGLNTHPEYAVRVAKKLAELTNHSFVTAPNKFEALATCDALVHSHGALKGLAASIMKIANDVRWLASGPRCGIGEISIPENEPGSSIMPGKVNPTQCEAVTMLCAQVMGNDVAINIGGASGNFELNVFRPMVINNFLQSVRLLADGMRSFNEHCAVGIEPNRDRITQLLNESLMLVTALNTHIGYDKAAEIAKKAHKEGLTLKQSAMKLGYLTEAEFDEWVRPEDMVGSLK

SEQ ID NO: 29234 - DNA, 1401 bp, Prochlorococcus marinus
  CDS (1)..(1401)
atgatggctgacctgatgcgtatcgaacacgacagcatgggcactattgaggtgcccgctggggttctctggggtgcacaaacccagcgatcgctccttaacttcgccatcagcacagaccgcatgccagtcgaactgatccatgccttggcattgatcaaacaggctgccgccagcgtgaactgtcgcctgggtgtgctcgatgaagtccagcgggatcaaattatcaaggctgcctctgctgttgcatccggtcttcacgacgatcagtttccactgagggtgtggcaaaccggtagcggtacccacacaaacatgaatgtcaacgaggtgattagcaacctggcgtctcaggcaaacgacgaacccctaggtagccataggccggtgcatccaaacgatcatgtcaatcgatcccagtccaccaatgacgccttccctacagctatacatatcgccgcagtccaggggatcaccaacaacttgctgcctgaactggagcaattgatcgcagcctttgcccgaaaaagcgatgcctggagtgacatcatcaaaatcggtcgcactcatctacaggatgccgtacctctcacccttggtcaggaggcctctgcgtggcgggatcaaattgcctcagcccatagtcgtattcagtcaagcctgatagagctctaccccctgccgcttggaggcaccgccgtgggaacaggcctcaacgccccagctcgcttcggtcaagaaacagctgcgcaacttgccagcatcacaggcctgccattcagctcagcgaaaaacaagttcgccgtgatggcgagccatgacgggttagtgaatgcaatggctcagttgcgcatgttggcggttgcccttttcaagatctccaatgatctgcgcctactggcctgtggcccaagggccggcctggcagagctgcatctacctgagaatgagccgggaagctcgatcatgcctgggaaagtcaacccctctcaatgcgaggccatggccatggtctgtttacaggtcatcgggcttgattcagccgtgaccatggcaggtgggagtggtcatctccaaatgaacgtctacaaacccctgattggcttcaacctgcttcacagcattgaattgctacatgacgcctgccgcaagtaccggctggcaatggtgcaagggattgaaccaaaccgaatcaagatccagcatgatctagagcaatcgctgatgctagtgactgctttagccccagaaatcggttacgacaaagccagtgagattgcccacctcgcccatgagaagggattcagcctgcgtgaagcagcactaaaactcggctatgtgagcaaagaagacttcgatcgcattgttaatccggcattgatgacatctgctcggctgtga

SEQ ID NO: 29235 - protein, 466 aa, Prochlorococcus marinus
MMADLMRIEHDSMGTIEVPAGVLWGAQTQRSLLNFAISTDRMPVELIHALALIKQAAASVNCRLGVLDEVQRDQIIKAASAVASGLHDDQFPLRVWQTGSGTHTNMNVNEVISNLASQANDEPLGSHRPVHPNDHVNRSQSTNDAFPTAIHIAAVQGITNNLLPELEQLIAAFARKSDAWSDIIKIGRTHLQDAVPLTLGQEASAWRDQIASAHSRIQSSLIELYPLPLGGTAVGTGLNAPARFGQETAAQLASITGLPFSSAKNKFAVMASHDGLVNAMAQLRMLAVALFKISNDLRLLACGPRAGLAELHLPENEPGSSIMPGKVNPSQCEAMAMVCLQVIGLDSAVTMAGGSGHLQMNVYKPLIGFNLLHSIELLHDACRKYRLAMVQGIEPNRIKIQHDLEQSLMLVTALAPEIGYDKASEIAHLAHEKGFSLREAALKLGYVSKEDFDRIVNPALMTSARL

SEQ ID NO: 29236 - DNA, 1386 bp, Prochlorococcus marinus subsp
  CDS (1)..(1386)
atgaccaagaactttagatttgaaaaagatagtatgggacagataaaagttccttcagaggctttgtggggagcccaaacgcagagatcaattataaatttttctattggtgaggagttaattccaattgaattaatttattcacttacggttataaaaagagcagccgcaatttctaatttcaaattgggtttaataaataatgtaaaaaaagatctcattattgaagcctgtacagaaatccttgatgggaaacatgattctcaattccccttaaaaatatggcaaacaggtagtggtacacaaacaaatatgaatatcaatgaagtcatatctaatattgctgcgttaaaaacaaattcaggacttggaagtcatcatcctattcatccaaatgatgatgttaataaatcgcagtctacaaatgatacttttcctgcggctattcagatatctgttgttactcaaataattaaaaaattagttccatcaataaaggaacttactaaggttcttgatagtaagagtaataaatggaaagatcttataaaaataggtagaactcattttcaagatgcagtgccaatttcccttggtcaagaagtttctgcatggtcaaaacaactaaaggacgctgaagatgctctgataattagtcttaatgaattatgtttcttaccactaggtggtacggcagttggtacaggtattaattgtccaaaagatttttcaaaagaatctataaaatcaatttcagaatatactggtttatttttttataagtcaaagaatcatttctctttaatggcatctcatgatcgattagcccaagtaatgggtcaaataaaaatcctagcaagtgcattatttaagatttctaatgatattaaaatattgtcctcaggacctagatctggcatttatgaattaataattcccaaaaatgaaccagggagctcaatcatgcctgggaaagttaatccaacccaatgtgaagcattatcaatggtatgcactcaagtaatgggttttgaatacgcagtatcaatagctaatgccagcggcactttacaaatgaatgaatataagccactaattggatttaatattctcacgagtataaaattactgaatcatgcgataagtaacttcagactaaaattagttgaagggatacaaccaaacccaaaaactataaaagctaatcttgaaaattcactaatgcttgtaactgcattggttcccaaaataggttatgaaaaagcagcagaaattgcgaatcttgcttttaatgaatcaatcaacttaaaagaagcaacaataaaattaggttacttaactgctaatgaatttgaggatgctataaatactaataaaatgatttaa

SEQ ID NO: 29237 - protein, 461 aa, Prochlorococcus marinus subsp
MTKNFRFEKDSMGQIKVPSEALWGAQTQRSIINFSIGEELIPIELIYSLTVIKRAAAISNFKLGLINNVKKDLIIEACTEILDGKHDSQFPLKIWQTGSGTQTNMNINEVISNIAALKTNSGLGSHHPIHPNDDVNKSQSTNDTFPAAIQISVVTQIIKKLVPSIKELTKVLDSKSNKWKDLIKIGRTHFQDAVPISLGQEVSAWSKQLKDAEDALIISLNELCFLPLGGTAVGTGINCPKDFSKESIKSISEYTGLFFYKSKNHFSLMASHDRLAQVMGQIKILASALFKISNDIKILSSGPRSGIYELIIPKNEPGSSIMPGKVNPTQCEALSMVCTQVMGFEYAVSIANASGTLQMNEYKPLIGFNILTSIKLLNHAISNFRLKLVEGIQPNPKTIKANLENSLMLVTALVPKIGYEKAAEIANLAFNESINLKEATIKLGYLTANEFEDAINTNKMI

SEQ ID NO: 29238 - DNA, 1395 bp, Pseudomonas putida
  CDS (1)..(1395)
atgagccgtatcgagacagacagcctgggcccggtcgaagttccggaggacgcctactggggtgcgcagacccagcgttcgctgatcaacttcgccattggcaaggaacgcatgcccctcgcggtattgcacgccctggcactgatcaagaaggccgcggcgcgcgtcaacgaccgcaatggcgacctgccggccgacatcgcccggttgatcgaacaggccgccgatgaagtgctggatggccagcacgacgatcagttcccgctcgtcgtctggcagacgggcagtggcacccaaagcaacatgaacgtcaacgaggtgatcgccggacgcgccaacgaactggccggcaaaggccgtggcggcaaggcgccagtacaccccaatgaccacgtcaaccgctcgcagagctccaacgactgcttccccaccgccatgcacattgccgcagcccaggcggtgcatgaaaagctgctgccggccgtcactgaactgtcttcggggctggccgagctgtcgatgcgccaccacaagctggtaaaaaccggccgcacgcacatgatggacgccacgccgattaccttcggccaggaagtgtcggctttcgtcgcccagctcgattacgcccagcgcgctatccgcgccaccctgccggcggtgtgcgaactggcccagggcggcactgccgtgggtaccgggctgaacgctccgcagggttttgccgaggccatcgcggccgagctggcggcgctgtccggcctgccgttcatcactgcacccaacaagttcgccgccctcgccggccacgaaccgctgaccagcctggcgggagccctgaagaccctggccgtggccctgatgaaaatcgccaacgacctgcgcctgctggggtccggccctcgcgccgggcttgccgaggtgcgcctgccagccaacgagccgggcagctcgatcatgccgggcaaggtcaaccccacccagtgcgaggcgctgtcgatgctggcctgccaggtactgggcaacgacgcggccatcggctttgccgccagccaggggcatttgcagttgaatgtgttcaagccggtgatcattcataacctgctgcaatccatcgagttgctggccgatggttgccgcaacttccagcagcattgcgtggcgggtatcgagccggatgccgagcagatggccgcgcacctggagcgtgggttgatgctggtgacggcgctgaacccgcatattggctatgacaaggcggcagaaattgccaagaaggcttacagcgagggcacgaccttgcgcgaggcggcattggcgttgaagtacctgaccaatgaacagttcgaccagtgggtgcggccggagaacatgctggcgcctgggggcaaaggctag

SEQ ID NO: 29239 - protein, 464 aa, Pseudomonas putida
MSRIETDSLGPVEVPEDAYWGAQTQRSLINFAIGKERMPLAVLHALALIKKAAARVNDRNGDLPADIARLIEQAADEVLDGQHDDQFPLVVWQTGSGTQSNMNVNEVIAGRANELAGKGRGGKAPVHPNDHVNRSQSSNDCFPTAMHIAAAQAVHEKLLPAVTELSSGLAELSMRHHKLVKTGRTHMMDATPITFGQEVSAFVAQLDYAQRAIRATLPAVCELAQGGTAVGTGLNAPQGFAEAIAAELAALSGLPFITAPNKFAALAGHEPLTSLAGALKTLAVALMKIANDLRLLGSGPRAGLAEVRLPANEPGSSIMPGKVNPTQCEALSMLACQVLGNDAAIGFAASQGHLQLNVFKPVIIHNLLQSIELLADGCRNFQQHCVAGIEPDAEQMAAHLERGLMLVTALNPHIGYDKAAEIAKKAYSEGTTLREAALALKYLTNEQFDQWVRPENMLAPGGKG

SEQ ID NO: 29240 - DNA, 1395 bp, Pseudomonas syringae
  CDS (1)..(1395)
atgagccgcaccgaaaccgacagcatcggcccgatcgaagtccctgaagatgcctattggggcgcgcagacccaacgctcactgatcaactttgcgattggcgaccagcgtatgccgttggccgttctgcatgcgttgaccttgatcaagaaagccgccgcacgcgtcaacgaccgcaacggcgacctgccggccgatatcgcccggctgatcgaacaggctgccgacgaggtgctcgacggtcagcacgacgcgcagtttccgctggtggtctggcagaccggcagtggcacgcagagcaacatgaacgtcaacgaagtgatcgccggccgcgccaacgaactggccggccagggccgtggcggcaaatcgccggtccaccccaacgatcacgtcaatcgctcgcaaagctccaacgactgctttccgacagccatgcacattgccactgcgcaagcggtcaaggaacagctgctgccggcgattgccgagctgtccagcgggctggccgaacaggccgcgcgtcacatgaagctggtcaagaccgggcgcacgcacatgatggacgccacgccgatcacctttggccaggagctttcggggttcgtcgcgcaactggattacgcagaaaaagccattcgcgccgccctgcccgccgtctatgaactggcgcaaggtggcaccgcagtcggcaccgggctcaacgcgccgaaaggcttcgctgaagccatcgcggcagaactggctgcactgtcgggcttgccgttcgtcaccgcgccgaacaaattcgccgcactggcgggccacgagccgctggctgcgctttccggcgcattgaaaacgctggccggcaccctgatgaagatcgccaacgacctgcgcttgctgggttccggcccgcgtgccgggttggcggaagtcaggttgccagccaacgagcccggcagctcgatcatgcccggcaaggttaacccgactcagtgcgaggccctgtcgatgctggcctgccaggttatgggcaacgatgtgaccatcggttttgccgccagccagggccatttgcaactgaacgtctataagccggtgatcattcacaacgtattgcagtcgatccgactgctggccgacggttgcagcaatttcaatgaacactgcgtcgccggcatggagccagacgccgaaaaaatggctgagcaccttgaacgcggcctgatgctggtcaccgcgctcaacccgcacatcggctatgacaagtcggcgcacattgccaaaaaagcctacaccgaaggcctgaccctgcgtgaagcagcgctggcgctgggttacctgaccgacgaggagttcgacgcctgggtgcgcccggacaagatgctggaggcgggcagcaatggttga

SEQ ID NO: 29241 - protein, 464 aa, Pseudomonas syringae
MSRTETDSIGPIEVPEDAYWGAQTQRSLINFAIGDQRMPLAVLHALTLIKKAAARVNDRNGDLPADIARLIEQAADEVLDGQHDAQFPLVVWQTGSGTQSNMNVNEVIAGRANELAGQGRGGKSPVHPNDHVNRSQSSNDCFPTAMHIATAQAVKEQLLPAIAELSSGLAEQAARHMKLVKTGRTHMMDATPITFGQELSGFVAQLDYAEKAIRAALPAVYELAQGGTAVGTGLNAPKGFAEAIAAELAALSGLPFVTAPNKFAALAGHEPLAALSGALKTLAGTLMKIANDLRLLGSGPRAGLAEVRLPANEPGSSIMPGKVNPTQCEALSMLACQVMGNDVTIGFAASQGHLQLNVYKPVIIHNVLQSIRLLADGCSNFNEHCVAGMEPDAEKMAEHLERGLMLVTALNPHIGYDKSAHIAKKAYTEGLTLREAALALGYLTDEEFDAWVRPDKMLEAGSNG

SEQ ID NO: 29242 - DNA, 1386 bp, Ralstonia solanacearum
  CDS (1)..(1386)
atgacgacccgtaccgaacgcgatacctttggcccgatcgaagtccccgccgaccgcctgtggggcgcgcagacgcagcgctcgctgcagaacttcgacatcgccggcgaccgcatgccgcgcgagctgatcgacgcgctggcccgcatcaagcgcgccagcgccgccgtcaaccagcgcctgggcctgctgccggccgacaaggcgaacgcggtcatcgccgcggccgacgaggtcatcgccggcaagcatccgggcgagttcccgctggtggtctggcagaccggctccggcacgcagagcaacatgaacatgaacgaggtgctcgccaaccgcgccagcgaactgctgggcggcgagcgcggcgaagcccgcctggtgcaccccaacgacgacgtgaaccgcagccagtcgtccaacgacgtgttcccgacggcgatgcacgtggcggccgtcaccgccatcacgcggcacctgctgccgtcgctgcgcgcgctgcgcgagacgctggcgcgcaaggccatcgacttcgacgacatcatcaagatcggccgcacccacctgcaggacgccacgccgctcacgctcggccaggagttctccggctacgcggcccagctgcagcacagcgagacgcacctgaacgccgcgctgccgcacctgtgcgagctggcgctgggcggcacggcggtcggcaccggcctgaatgcgccggccggctatgccgaacaggtggccgccgaactcgccgcgctgaccggcctgcccttcgtcacctcgcccaacaagttcgagaccatggcctcggccgacggcctggtgcacgcgcacggcgccctgaagacgctggccgccagcctgaccaagatcgccaacgacatccgctggctggccagcggcccgcgcagcggcctgggcgagctgtccattcccgagaacgagccgggctcgtccatcatgccgggcaaggtcaacccgacccagagcgaggcgatgacgatgctgtgcgcgcaggtgttcggcaacgatgtcgccgtcaacatcggcggggcctcgggcaacttcgagctgaacgtgttccggccgatgatcgcctacaacttcctgcacagcgcgcgcctgctggccgacggcatgcgcagcttcaacgaccactgcgcggtcggcatcgagcccaaccgcgagcgcatcgccgagctggtgcagcgctcgctgatgctggtgaccgcgctcaacccgcacatcggctacgacaaatcggcgcagatcgccaagaaggcgcacaaggaaggcaccagcctgcgcgaggcggcgctggcgctggggtatgtgacggccgagcagttcgatgcgtgggtgcggccggagcagatggtgggacgctga

SEQ ID NO: 29243 - protein, 461 aa, Ralstonia solanacearum
MTTRTERDTFGPIEVPADRLWGAQTQRSLQNFDIAGDRMPRELIDALARIKRASAAVNQRLGLLPADKANAVIAAADEVIAGKHPGEFPLVVWQTGSGTQSNMNMNEVLANRASELLGGERGEARLVHPNDDVNRSQSSNDVFPTAMHVAAVTAITRHLLPSLRALRETLARKAIDFDDIIKIGRTHLQDATPLTLGQEFSGYAAQLQHSETHLNAALPHLCELALGGTAVGTGLNAPAGYAEQVAAELAALTGLPFVTSPNKFETMASADGLVHAHGALKTLAASLTKIANDIRWLASGPRSGLGELSIPENEPGSSIMPGKVNPTQSEAMTMLCAQVFGNDVAVNIGGASGNFELNVFRPMIAYNFLHSARLLADGMRSFNDHCAVGIEPNRERIAELVQRSLMLVTALNPHIGYDKSAQIAKKAHKEGTSLREAALALGYVTAEQFDAWVRPEQMVGR

SEQ ID NO: 29244 - DNA, 1392 bp, Rhizobium meliloti
  CDS (1)..(1392)
atgacatcgacccgcacggaaacagatacgttcggccccatcgaagtggcgagcgaccgctattggggcgcccaggcgcagcgatcgctgggcaatttcaaaatcggctgggaaaagcagcctctggcaatcgtgcgcgcactcggcatcgtcaaacaggcggctgcccgcgccaacatggcgctcggccgcctcgacccggcgatcggcgacgccatcgtcaaggccgcacaggaggtgatcgacggcaagcttgacgagcacttccctctcgtcgtgtggcagacgggctccggaacccagtcgaacatgaatgcgaacgaggtcgtttccaaccgtgcgatcgagctgctcggcggcgtcatgggttcgaagaagccggttcacccgaacgatcacgtcaatatgagccagtcgtcgaacgacacctatcccacggccatgcacatcgcctgtgcggagcgcgtgatccacgatctgctgccggcgctcaagcacctgcacaaggcgctcgaagagaaggtgaaggctttcgatcacatcatcaagatcggccgcacccacacgcaggacgcaacgcccctgacgctggggcaggagttttccggctatgcggcgcaggtcgcctcctcgatcaaacggatcgagatgacgctccccggcctttgcgagctcgcccagggggggaccgcggtcggcaccgggctcaatgcgccggtcggatttgccgagaaggtcgccgaggaaatcgctgccatcaccggcatcggcttcacttccgcgccgaacaagttcgaagcgctggccgcccacgactcgatggtcttcagccacggggcaatcaacgccaccgccgccgcgctcttcaagatcgccaacgacatccgcttcctcggctccggcccccgctccggcctcggcgagctttcactgccggaaaacgagccgggctcgtccatcatgccgggcaaggtcaacccgactcagtgcgaggcgctcacccaggtctgcgtccaggtcttcggcaatcatgcggcgctgacctttgccggcagccagggccacttcgagctcaacgtctacaatccgctgatggcgtacaacttcctgcagtcggtgcaactgctcgccgatgcggctatctccttcaccgacaattgcgtcgtcgggatcgaggcgcgggaggacaacatcaaggcggcgctcgaccgttcgctcatgctggtgactgcgcttgcgccgaagatcggctacgacaacgcggccaagatcgccaagaccgcccacaagaacggtaccacgcttcgcgaggaggccgtcggcggcggttacgtcacggacgaggagttcgacgccgtcgtccgccccgaaaccatgatcggcccggcctga

SEQ ID NO: 29245 - protein, 463 aa, Rhizobium meliloti
MTSTRTETDTFGPIEVASDRYWGAQAQRSLGNFKIGWEKQPLAIVRALGIVKQAAARANMALGRLDPAIGDAIVKAAQEVIDGKLDEHFPLVVWQTGSGTQSNMNANEVVSNRAIELLGGVMGSKKPVHPNDHVNMSQSSNDTYPTAMHIACAERVIHDLLPALKHLHKALEEKVKAFDHIIKIGRTHTQDATPLTLGQEFSGYAAQVASSIKRIEMTLPGLCELAQGGTAVGTGLNAPVGFAEKVAEEIAAITGIGFTSAPNKFEALAAHDSMVFSHGAINATAAALFKIANDIRFLGSGPRSGLGELSLPENEPGSSIMPGKVNPTQCEALTQVCVQVFGNHAALTFAGSQGHFELNVYNPLMAYNFLQSVQLLADAAISFTDNCVVGIEAREDNIKAALDRSLMLVTALAPKIGYDNAAKIAKTAHKNGTTLREEAVGGGYVTDEEFDAVVRPETMIGPA

SEQ ID NO: 29246 - DNA, 1404 bp, Salmonella typhimurium
  CDS (1)..(1404)
atggtaacggtacgccgcgagaaagattcaatgggcgcgattgaagtcccggcagataaactgtggggggcgcagactcaacgttcgctggagcattttcggatttccacggagaaaatgcccgtctcgctcattcacgctctggcgttgaccaagcgcgccgctgcgaaggtcaaccaggacttagggttgttggcggcggaaaaagccagcgcgattatccaggcggctgatgaagtgctggcgggaaaacatgctgatgagtttccgctggcgatttggcagaccgggtccggtacgcaaagcaacatgaatatgaatgaagtgttagcgaaccgcgccagtgaaattttgggcggcgttcgcggtatggaacgcaaggtgcatcccaatgatgacgtcaataagagtcaaagctcaaacgatgttttcccaaccgccatgcacgtggcggcgttactggcgttacgcgaacaccttatcccgcaattatccgcattaacggatacgcttcgcgataaatcccacgctttcgccgatattgtcaaaattggccgtactcacctgcaggacgcgacgccgctcaccttaggccaggagatttccggttgggtagccatgctggaacataacctcagacacattgagcacagtttaccgcacgtcgcggaactggcgctcggcggaaccgcagtagggacagggcttaatacccatccggaatatgcccggcgcgtggccgaggaactggcgacgattaccgcggcgccgtttgttaccgcccccaataaattcgaagcgctggcgacctgtgacgcgttggtacaggcgcatggcgcattaaaaggactggcggcctcgctgatgaaaatcgccaacgatgttcgctggctggcgtccggcccgcgttgcggcattggcgagattgctatcccggagaatgagccaggcagttccattatgcctggtaaagtgaacccgacccagtgtgaagcggtaacgatgctatgttgccaggtgatgggtaacgatgtggccatcaatatggggggcgcatcgggcaactttgagctcaacgtctatcgtccgatggttattcataattttctgcaaacggtgcgcctgctggccgatggcatggagagttttaataaacactgtgcgtcaggaatcgagccaaaccgcgagcgtattacgcagttgctgaatgagtcgctgatgctggtcactgcgctgaatacgcacatcggttacgataaagcggcggagattgcgaagaaggcgcataaagaagggctgacgctcaaagcctcagccgtggcattaggataccttagcgacgaggagttcgacgcctgggtacgtccggagttgatggttggcagtatgacgccgggacgttaa

SEQ ID NO: 29247 - protein, 467 aa, Salmonella typhimurium
MVTVRREKDSMGAIEVPADKLWGAQTQRSLEHFRISTEKMPVSLIHALALTKRAAAKVNQDLGLLAAEKASAIIQAADEVLAGKHADEFPLAIWQTGSGTQSNMNMNEVLANRASEILGGVRGMERKVHPNDDVNKSQSSNDVFPTAMHVAALLALREHLIPQLSALTDTLRDKSHAFADIVKIGRTHLQDATPLTLGQEISGWVAMLEHNLRHIEHSLPHVAELALGGTAVGTGLNTHPEYARRVAEELATITAAPFVTAPNKFEALATCDALVQAHGALKGLAASLMKIANDVRWLASGPRCGIGEIAIPENEPGSSIMPGKVNPTQCEAVTMLCCQVMGNDVAINMGGASGNFELNVYRPMVIHNFLQTVRLLADGMESFNKHCASGIEPNRERITQLLNESLMLVTALNTHIGYDKAAEIAKKAHKEGLTLKASAVALGYLSDEEFDAWVRPELMVGSMTPGR

SEQ ID NO: 29248 - DNA, 1386 bp, Staphylococcus aureus
  CDS (1)..(1386)
atgtcagtaagaattgaacatgatacttttggagaaatagaagtacctgcagataaatattggggtgctcaaacagaaagaagtaaacgcaatttcccagttggtaaagagcgtatgccaatcgaagtagtttatggttttgcacaactaaagcgtgcagcagcattagctaattttgatttaggaaaattaagcgaggcaaagaaagatgccattgtatacgcatgtgatcaaattttatcaggtgaattagatgaacacttcccactagttgtatggcaaacaggaagcggtacacaaagtaatatgaatgtgaacgaagtagtaagttatgttgctaatatgtatttaaaagatcatcaaattgatgaaagtatccacccaaatgatgatgtaaataaatcacaaagttcgaatgatacattcccaactgctatgcacgttgcattatatcaagaggttgaaacaaaattagaacctgcattaaaacttttaagaaatactttgaaagaaaaagaagacaaatttgattcaattattaaaattggtcgtacacatttacaagatgcaacgccgatcaaactaggacaagagattagtggctggcgttatatgcttgaccgttgcgaaataatgttatctgaatctaagaagcacattttaaatcttgccatcggtggtacggctgttggtactggtattaatgcgcatcctgaatttggtgataaagtggcacattatatttcagaaaatacgggttatccatttgtatcttctgaaaataaattccatgcattaacagcacatgatgaagtagtacaactacatggaacattgaaggcgctagcaggagacttaatgaaaattgctaatgatgtgagatggttggcttcagggccacgagctggtttggcagaaatttctatccctgaaaatgaaccaggttcatcaattatgcctggtaaagttaatcctacacaatgtgaaatgttaacaatggttgcagtccaagtaatgggtaatgatacagttgttggcttcgcaagttcacaaggtaactttgaattgaatgtttataaaccagttattatgcataatacactacaatcaatttaccttttagctgatggtatggaaacatttaataacaattgcgcagtgggcattgaaccaatcgaagagaatattgataattatttaaatcaatcattaatgttagttactgcattaaatccacatattggttatgaaaaagcagctcaaattgctaagaaagcccataaagaaggtttaactttaaaagaatctgcaattcaaactggatatgttacagaagaacaatttgaagcatggattaaaccagaagatatggtagatcctcattaa

SEQ ID NO: 29249 - protein, 461 aa, Staphylococcus aureus
MSVRIEHDTFGEIEVPADKYWGAQTERSKRNFPVGKERMPIEVVYGFAQLKRAAALANFDLGKLSEAKKDAIVYACDQILSGELDEHFPLVVWQTGSGTQSNMNVNEVVSYVANMYLKDHQIDESIHPNDDVNKSQSSNDTFPTAMHVALYQEVETKLEPALKLLRNTLKEKEDKFDSIIKIGRTHLQDATPIKLGQEISGWRYMLDRCEIMLSESKKHILNLAIGGTAVGTGINAHPEFGDKVAHYISENTGYPFVSSENKFHALTAHDEVVQLHGTLKALAGDLMKIANDVRWLASGPRAGLAEISIPENEPGSSIMPGKVNPTQCEMLTMVAVQVMGNDTVVGFASSQGNFELNVYKPVIMHNTLQSIYLLADGMETFNNNCAVGIEPIEENIDNYLNQSLMLVTALNPHIGYEKAAQIAKKAHKEGLTLKESAIQTGYVTEEQFEAWIKPEDMVDPH

SEQ ID NO: 29250 - DNA, 1386 bp, Staphylococcus epidermidis
  CDS (1)..(1386)
atgtcagtcagaattgaacatgatacatttggagaaattgaagtaccagaagacaaatattggggtgcacagactgaaagaagtaaacgaaattttccagtcggcaaagagcatatgcctatacaagtcatttacggatttgctcaactaaaaagaggtgcagccttagcaaatcatgaattaggaaaattgagtgatgaaaaaaagaacgccatcgtttatgcttgtgatcgtattttaaatggagaactagataatcattttccacttgtgatttggcaaacaggtagtggtactcaaagcaatatgaatgtaaatgaagtcgtaagctatgtagctaatgaataccttaagaaacatggaagtaaggaaactatccatccaaatgatgatgtaaataaatctcaaagttcaaatgatacatttcctacagctatgcatgtcgcattgttccatgaagttgaaactaagttagagccagcacttaaccatttacgtcaaacttttaaagaaaaagaagaccaatatcaatcaatcattaaaattggacgcacacatttgcaagatgcaacgcctattaaactaggtcaagagataagtggttggcgctatatgttagaaaaatgtgagcaattactatcagaatcaaaaaagcatattttaaatttagcaattggtggaactgcagtaggaacgggaattaatgctcatccagaatttggtcataaagtagccaaatatatttcccaaaacacagggtatgctttcgtatcatctgaaaacaaatttcatgctttaacttctcatgatgaaattgtacaattacatggaacattaaaagcgctagcgacagatttaatgaaaattgcaaatgatattagatggctagcctctggaccgcgtgcaggtcttgctgagatttcaattccagaaaatgaacctggatcttctattatgccaggaaaagtaaatccaacacaatgtgaaatgttaactatggtagcagtacaagtcatggggaatgatacgacggtaggtatcgcaagttctcaaggtaattttgaactaaatgtatttaaaccggtaattatgcataacactttacaatctatttacttattagcagatggaatgaatacctttaataaaaactgtgcaattggtattcaaccgatagaagaaaatattaataattatttaaatcaatcattaatgctagttacggcactgaaccctcatattggatatgagaaagcagctcaaatagctaaaaaggcacacaaagaaggacttactttaaaagaatctgcaatagaaagtggatatgtaactgaatcacaatttgaagagtggataaaaccagaagatatggtagacccacattga

SEQ ID NO: 29251 - protein, 461 aa, Staphylococcus epidermidis
MSVRIEHDTFGEIEVPEDKYWGAQTERSKRNFPVGKEHMPIQVIYGFAQLKRGAALANHELGKLSDEKKNAIVYACDRILNGELDNHFPLVIWQTGSGTQSNMNVNEVVSYVANEYLKKHGSKETIHPNDDVNKSQSSNDTFPTAMHVALFHEVETKLEPALNHLRQTFKEKEDQYQSIIKIGRTHLQDATPIKLGQEISGWRYMLEKCEQLLSESKKHILNLAIGGTAVGTGINAHPEFGHKVAKYISQNTGYAFVSSENKFHALTSHDEIVQLHGTLKALATDLMKIANDIRWLASGPRAGLAEISIPENEPGSSIMPGKVNPTQCEMLTMVAVQVMGNDTTVGIASSQGNFELNVFKPVIMHNTLQSIYLLADGMNTFNKNCAIGIQPIEENINNYLNQSLMLVTALNPHIGYEKAAQIAKKAHKEGLTLKESAIESGYVTESQFEEWIKPEDMVDPH

SEQ ID NO: 29252 - DNA, 1404 bp, Streptomyces avermitilis
  CDS (1)..(1404)
atgaccgacgaggacgacaagcagaactaccgtgtcgagcacgactccatgggtgaggtccgtgtccccgcggacgccaagtggcgggcccagacccagcgtgccgtggagaacttccccatctccgggcagcggctcgagcgggcgcacatcgaggccctcgcccggatcaagggagccgccgccaaggtgaacgccgagttgggcgtgctcgacaaggacgtcgccgaggccattcaggaggcggccgccgaggtcgcggaggggcgttgggacgagcacttccccgtggacgtgttccagaccggctccgggacctcgtccaacatgaacgccaacgaggtcatcgccacgctcgcgaccgaacggctcggcagggacgtacaccccaatgaccacgtgaacgcgtcgcagtcgtcgaacgacgtgttcccgtccagcattcacatcgcggccaccgccgccgtcacccgcgatctggtacccgccctggagcacctggccgccgcgctgggccgcaagtccgaggagttcgcggacgtcgtgaaggccgggcgtacgcatctcatggacgcgacgcccgtgaccctggggcaggagttcggcggatacgcggcccaggtgcggtacggcgtcgagcggctggccgcctccctgccgcggctcgccgaactgcccctcgggggcaccgcggtcgggaccgggatcaacaccccgccgggcttctccgccgccgtcatcgccgaggtcgcccgcgtcaccgggctgccgctcaccgaggcgcgcgaccacttcgaggcgcagggtgcgcgggacgggatcgtcgagaccagcgggcagttgcggaccatcgccgtaggactgacgaagatcgcgaacgatctgcggtggatggcttcggggccgcgtaccgggctctccgagatcagcctgcccgaccttcagccggggtcctcgatcatgcccggcaaggtgaatcccgtgattcccgaggccgtgctgatggtcgccgcacaggtgacgggcaacgacgcgaccgtcgccgccgccggagccgccggcaacttcgaactcaatgtgatgctgcccgtcatcgcgaagaacgtgctggagtccgtccggctgctcgcccatgtctcccggctgctggccgaccgcaccgtcgacgggatcgtcgcccatcgcgaccgggcccgtgagtacgccgagtcgtcaccgtccgtcgtcaccccgctgaacaagtacatcgggtacgaggaggccgcgaaggtcgccaagaaggccctcgccgagcggcagacgatccgtcaggtcgtcctggagagcggatacgtggaccgtggcgacctcaccctggagcagctcgacgaggcgctcgacgtcctgcggatgacgcacccctga

SEQ ID NO: 29253 - protein, 467 aa, Streptomyces avermitilis
MTDEDDKQNYRVEHDSMGEVRVPADAKWRAQTQRAVENFPISGQRLERAHIEALARIKGAAAKVNAELGVLDKDVAEAIQEAAAEVAEGRWDEHFPVDVFQTGSGTSSNMNANEVIATLATERLGRDVHPNDHVNASQSSNDVFPSSIHIAATAAVTRDLVPALEHLAAALGRKSEEFADVVKAGRTHLMDATPVTLGQEFGGYAAQVRYGVERLAASLPRLAELPLGGTAVGTGINTPPGFSAAVIAEVARVTGLPLTEARDHFEAQGARDGIVETSGQLRTIAVGLTKIANDLRWMASGPRTGLSEISLPDLQPGSSIMPGKVNPVIPEAVLMVAAQVTGNDATVAAAGAAGNFELNVMLPVIAKNVLESVRLLAHVSRLLADRTVDGIVAHRDRAREYAESSPSVVTPLNKYIGYEEAAKVAKKALAERQTIRQVVLESGYVDRGDLTLEQLDEALDVLRMTHP

SEQ ID NO: 29254 - DNA, 1386 bp, Streptomyces coelicolor
  CDS (1)..(1386)
atgagcgaataccgcatcgagcacgactccatgggcgaggtccgcgtccccgcggacgccaagtggcgcgcccagacccagcgcgccgtcgagaacttccccgtctccgggcagcgcatcgagcgcgcgcacatcgaggcgctggcgcggatcaagagcgcggcggcgaaggtcaacgccgagctgggagtgctcgacgaggacgtcgccggcgcgatccaggaggcggccggtgaggtggccgaggggaagtgggacgagcacttccccgtcgacgtgttccagaccgggtccgggacctcgtccaacatgaacaccaacgaggtcgtcgccaccctggcgactgaacggctcggccgcgacgtgcatcccaacgaccacgtcaacgcctcccagtcgtccaacgacgtcttcccgtcctcgatccacatcgccgccaccgccgccgtcacccgcgacctgatcccggccctggaccatctcgccggcgccctggagcgcaaggccggggagttcgccgacgtggtgaagtccgggcgtacgcacctcatggacgccacgcccgtcaccctgggccaggagttcggcggttacgcggcccaggtgcggtacggcatcgagcggcttcaggcctcactgccccggctcgccgagctgccgctgggcggcaccgcggtcggcaccggcatcaacaccccgcccggcttctccgccgccgtcatcgaggaggtggcccgcgcgacggggctgccgctgaccgaggcgcgcgaccacttcgaggcgcagggcgcccgggacggcatcgtcgagaccagcgggcagctgcggaccatcggcgtcgggctcacgaagatcgccaacgacctgcgctggatggcgtccggtccgcgcaccgggctcgcggagatctcgctgcccgacctccagcccgggtcgtccatcatgcccggcaaggtcaacccggtgatccccgaggcggtcctcatggtcgccgcccaggtcaccggcaacgacgcgacggtcgccgcggcgggcgcggccggcaacttcgagctgaacgtgatgctgccggtcatcgccaagaacgtgctggagtcggtgcggctgctcgccaacgtctcccggctgctcgccgaccgcaccgtggacgggatcgtggcgcaccccgagcgggcccgcgagtacgccgagtcctcgccctccgtggtcacgccgctcaacaagtacctcgggtacgaggaggccgccaaggtcgccaagagggcgctggccgagcggaagacgatccggcagaccgtgctggagggcggctacgtggaacgcggcgacctcacgcgggagcaactggaccaggccctggacgtgctgcggatgacccgcccgtga

SEQ ID NO: 29255 - protein, 461 aa, Streptomyces coelicolor
MSEYRIEHDSMGEVRVPADAKWRAQTQRAVENFPVSGQRIERAHIEALARIKSAAAKVNAELGVLDEDVAGAIQEAAGEVAEGKWDEHFPVDVFQTGSGTSSNMNTNEVVATLATERLGRDVHPNDHVNASQSSNDVFPSSIHIAATAAVTRDLIPALDHLAGALERKAGEFADVVKSGRTHLMDATPVTLGQEFGGYAAQVRYGIERLQASLPRLAELPLGGTAVGTGINTPPGFSAAVIEEVARATGLPLTEARDHFEAQGARDGIVETSGQLRTIGVGLTKIANDLRWMASGPRTGLAEISLPDLQPGSSIMPGKVNPVIPEAVLMVAAQVTGNDATVAAAGAAGNFELNVMLPVIAKNVLESVRLLANVSRLLADRTVDGIVAHPERAREYAESSPSVVTPLNKYLGYEEAAKVAKRALAERKTIRQTVLEGGYVERGDLTREQLDQALDVLRMTRP

SEQ ID NO: 29256 - DNA, 1404 bp, Synechococcus elongatus
  CDS (1)..(1404)
atgacaactgacactcgcctagaatacgattccctcggtgccgttgaggtgcctgcggactgctattggggtgctcagacggcgcgttccctcaagcactttgccattggcagtcagcgaatgcccctagcggtgatccatgccatggcacggctcaaaaaggcggcggcgatcgccaaccgtgatttaggagttttagaccctgagaaagccaaatggatcattcaagccgccgatgaagttattgccggacagtgggatgatcagtttcccctcgccatctggcagacgggtagcggcacccaaacgaatatgaatgtcaatgaggtcattgctaaccgtgccattgagctggcgggaggcgttaaggggagcaaaagccccatccatcccaacgatcatgtgaattgtagccagtcctccaatgacacctttcccacggccatgcatgttgccacagtccttgccctacaggagcgcctgctgccaacgctacgccatctcttgacggtcttgcaggaaaaagcggctgcctttgcagagattatcaaaattggccgtacccatttaatggatgccgttcccttgaccctaggccaggaattcagcggttacgccagtcaaattgcggccgctcaagcccatattgaatatgccctgcagcatctgtatccccttgccattggcgctacagcggtggggacggggttgaatgcacccgctggttttggcgatcgcgtggcagcagaattagcgcaaatgacggggtatccctttcgtaaagctgaaaacccctttgccgccttggcagcccacgatcccctagtgatgctcagtggtgctctaaaaaccctggctgccgccctgatgaaaatcgccaacgatattcgttggttgggatcgggaccgcgttgtggtctgggggaattgaggttacccgccaatgaaccggggtcatcaattatgcccggcaaggtgaaccccacccaatgcgaagccttaacgatggtgtgtgtgcaggtgatgggcaacgatgcagccgtgggaatagcgggcagtcaaggaaattttgagttaaatgtctataagcccttgatcatttacaatgtgctgcaatctattgcccttctgagtgatgcagctcaatcgtttaccgaccattgcttagtgggagttgagcccaatcggcagcaaattcaagcctatgtggagcgatcgctcatgttggtgacggctctcaatccccacataggctacgacaaggcggcggcagtcgcgaaaaaggcctacagtgagggtaaaaccctcaaggaagcagctgtggaattgggctatctcactgctgaggagtttgaccgctgggtacgactagagctgatgcttggcgaaaagggcaccagttga

SEQ ID NO: 29257 - protein, 467 aa, Synechococcus elongatus
MTTDTRLEYDSLGAVEVPADCYWGAQTARSLKHFAIGSQRMPLAVIHAMARLKKAAAIANRDLGVLDPEKAKWIIQAADEVIAGQWDDQFPLAIWQTGSGTQTNMNVNEVIANRAIELAGGVKGSKSPIHPNDHVNCSQSSNDTFPTAMHVATVLALQERLLPTLRHLLTVLQEKAAAFAEIIKIGRTHLMDAVPLTLGQEFSGYASQIAAAQAHIEYALQHLYPLAIGATAVGTGLNAPAGFGDRVAAELAQMTGYPFRKAENPFAALAAHDPLVMLSGALKTLAAALMKIANDIRWLGSGPRCGLGELRLPANEPGSSIMPGKVNPTQCEALTMVCVQVMGNDAAVGIAGSQGNFELNVYKPLIIYNVLQSIALLSDAAQSFTDHCLVGVEPNRQQIQAYVERSLMLVTALNPHIGYDKAAAVAKKAYSEGKTLKEAAVELGYLTAEEFDRWVRLELMLGEKGTS

SEQ ID NO: 29258 - DNA, 1398 bp, Synechococcus sp
  CDS (1)..(1398)
atgggccaaccgatgaggcaggagcacgacagcattggaggtgtcgacgtccccgctgcagcgctctggggagcccaaacccagcgatctctcaacaacttcgccattggtcatcaaaagattccagcggagctgattcatgccctggcacggatcaaacagtgctgcgccgcggtgaacggtcgccatggtctgttgaacgaccaacaggtggccttgatcgaacgggcgggccaggcaatccaaacaggccagcaagatgatcactttcctctgagtgtctggcaaaccggcagcggcacgcagacgaacatgaacgtgaatgaggtgatcagcaacctcgctgctcaggaatccggagagaacctcggctcgcaccgtcccctccaccccaacgaccacatcaaccggtctcagtccacaaatgacgttttcccggcagcgatccatgtagctgcggctctgcagctgcagcaggagctgctgccagagctgaagcggctgatcgcgagtctcgatgccaaggccgttgcctggcaggacatcatcaagatcgggcggacccatctgcaggacgcagtgccgcttcgccttggagatgaagtcagcgcctggcgcgaccgactcagcgacggcgcccattggctgaccacagcccatcaagacctactggctctgccgctcggaggcacagccgtcggcagtggattgaacacgccggaccgatttgcccacgaggtttgtgctgaactcgccagccgaacgggatccgactttcagccggcggacaacctgtttgctgtcatggcgggccatgactccctggtgcagaccatggctcagctgcggcgcctggccgtgacgctgctcaccatcgctaatgacatccgcctgctggcttgcggacccagggctgggctgggggaactgctgttgccggccaatgaaccgggcagctcgatcatgccaggaaaggtgaatcccacccagtgcgaggccatggcgatggtctgcacccaggtgatcggcatggatgcagccgtcgcggcagctggtgctggggggcatctccagatgaacgtgtataaacccctgatcggctacaacctgatcgagggcatccgtctgctgcaagacgcctgccgctgtttccggctgaatctgttgaccgggatggaagcagaccgtgaccggatcgcattttacgtggagcgatccctgatgctggtgacggctttgacgccggagatcggctacgaaaaagcctgtgcgatcgcccagcacgcccaccgagacggactgacgcttcgagaggccgccatgcaatccggagcgatcacagacgaacgctttgaccagttgatcgatccagccgcgatggcctcaccccaccgctga

SEQ ID NO: 29259 - protein, 465 aa, Synechococcus sp
MGQPMRQEHDSIGGVDVPAAALWGAQTQRSLNNFAIGHQKIPAELIHALARIKQCCAAVNGRHGLLNDQQVALIERAGQAIQTGQQDDHFPLSVWQTGSGTQTNMNVNEVISNLAAQESGENLGSHRPLHPNDHINRSQSTNDVFPAAIHVAAALQLQQELLPELKRLIASLDAKAVAWQDIIKIGRTHLQDAVPLRLGDEVSAWRDRLSDGAHWLTTAHQDLLALPLGGTAVGSGLNTPDRFAHEVCAELASRTGSDFQPADNLFAVMAGHDSLVQTMAQLRRLAVTLLTIANDIRLLACGPRAGLGELLLPANEPGSSIMPGKVNPTQCEAMAMVCTQVIGMDAAVAAAGAGGHLQMNVYKPLIGYNLIEGIRLLQDACRCFRLNLLTGMEADRDRIAFYVERSLMLVTALTPEIGYEKACAIAQHAHRDGLTLREAAMQSGAITDERFDQLIDPAAMASPHR

SEQ ID NO: 29260 - DNA, 1401 bp, Thermus thermophilus
  CDS (1)..(1401)
atggaataccggattgagcgggacaccatgggcgaggtgcgggtgccggcggacaagtactggggcgcgcagacccagcgctccctggagaacttcaggatcgggaccgaccgcttccgcatgcccctggagatcatccgggcctacgggatgctgaagaaggcggccgcgagagccaacctggagctcggggagctccccgaggagatcgccaaggccatcatccaggcggcggaggaggtggtccaggggaagtgggacgaccacttcccccttgtggtcttccagacgggcagcggcacccagaccaacatgaacgtcaacgaggtcatcgccaaccgggcctcggagatcctggggaagcctctggggagcaagtacgtccaccccaacgaccacgtgaaccgggggcagagctccaacgacaccttccccaccgccatgtacgtggccgtggccctggcgctccaccagaggctctatcccgcggtggaaggcctgatccggacctttacggccaaggcccaggcctttgaccagatcgtcaaggtggggcggacccacctgatggacgccgtgcccatcaccctgggacaggagatcggcagctgggccgcccagctcaagaccaccctcgccgccgtcaaggaaatggaaaagggcctctacaacctcgccatcggcgggacggcggtgggcacgggcctcaacgcccacccccgctttggggagctcgtggccaagtacctcgcggaggagacggggctccccttccgggtggcggagaaccgcttcgccgccctggccgcccacgacgagctggtcaacgtcatgggggccatccgcaccctggccggggccctgatgaagatcggcaacgacgtccgctggctcgcctccggcccctacgcgggcattggggagatcaccatccccgccaacgagcccgggtcctccatcatgccggggaaggtcaaccccacccaggtggaggccctcaccatggtggtggtccgggtctacggcaacgaccacaccgtggccttcgcgggaagccaggggaacttccagctcaacgtctacaagccggtgatggcctacagcaccctggagagcatcaacctcctcgcggacgccgtggcctcctttgacgcccacctggcccaggggattgagcccaatctggagcgcattgaggagcacctgcagaagaaccccatgctggccaccgccctcaacaaggccatcggctacgacaaggcggcggagatcgtcaagaaggccctcaaggagaagaagaccctgaagcaggcggccctcgagctcggctacctcacggaggaggagtttgaccgcatcgtggtccccatgaggctcgccaagccccacgagggggcgtag

SEQ ID NO: 29261 - protein, 466 aa, Thermus thermophilus
MEYRIERDTMGEVRVPADKYWGAQTQRSLENFRIGTDRFRMPLEIIRAYGMLKKAAARANLELGELPEEIAKAIIQAAEEVVQGKWDDHFPLVVFQTGSGTQTNMNVNEVIANRASEILGKPLGSKYVHPNDHVNRGQSSNDTFPTAMYVAVALALHQRLYPAVEGLIRTFTAKAQAFDQIVKVGRTHLMDAVPITLGQEIGSWAAQLKTTLAAVKEMEKGLYNLAIGGTAVGTGLNAHPRFGELVAKYLAEETGLPFRVAENRFAALAAHDELVNVMGAIRTLAGALMKIGNDVRWLASGPYAGIGEITIPANEPGSSIMPGKVNPTQVEALTMVVVRVYGNDHTVAFAGSQGNFQLNVYKPVMAYSTLESINLLADAVASFDAHLAQGIEPNLERIEEHLQKNPMLATALNKAIGYDKAAEIVKKALKEKKTLKQAALELGYLTEEEFDRIVVPMRLAKPHEGA

SEQ ID NO: 29262 - DNA, 1395 bp, Wigglesworthia glossinidia brevipalpis
  CDS (1)..(1395)
atgttaattaatagaatagaaaaagatactattggcgaagttgaattgccaaaaaaatgtttgtggggatcccaaactcaaagatctatttataattttaatatctctacagagaaaatgccttatgagcttattcacgctttagttcaaataaaacttgtagcagcaaaagttaataaagatctaaaattattagaagaaaaaaaagctgatgctataattaaagcttctgaagagatattatctggaaaatacaaagatagttttcctttggtaatttggcaaactggatctggaactcaaacaaacatgaacgtaaatgaagtaatagctaatattgcaataaaattattaggaggaaagtatggagactattcaataatacatcctaacgatcatgtaaataaaagtcaaagttctaatgatgtatttcctacagcaatgcatatatctgcagttttgtctttaaagaaaaatttattaccgaatttaattaaattaaaaaaatcattttatgataaatctatattatttaaagatattattaaaattggaagaactcacctgcaagatgcaactccattgactttaggccaagaagtttcttcttggtattgtatgttgaaaaaaaacattaaatatataaaaaatagcatactttgtatttctgaaatagctttaggtggtacagccgtaggaactgggttaaatgctcacgaaaaatattcattaaaagcatctaaattattgtcagaaataaataaacataattttattagttctacaaataaatttgaatctttaagtacatgtgatgcaatagtaaaagttcatagcactttaaaaaatttatctatttcaattatgaaaatatcaaatgatatacgttggttatcttctggcccaagatgtggaataggagaattaattattccagaaaatgaaccaggaagttctataatgcccggtaaagttaatccaactcaatgcgaatctatatctatgatatgctgtcaagtaataggaaacgactccgccataggaataggaggattgtctggaaattttcaattgaatgtatttcgacctatgattatttataattttttacaatccgtaagaatattatctgatggaataaaaagctttaacaaaaaatgtgttattggtattaaaccaaatattaaaagaataaaaaaatttcttaaagaatctttgatgctagttacatcattaactcctcatataggatatgataaatctgcaaaaatagcaaaattagctcacaatgaaaatattactttaaaagaagcttgtttgaaattgaattatatttcagagagtcaatttgatattttagttcgtccagaaaacatgattggaaataaaaattaa

SEQ ID NO: 29263 - protein, 464 aa, Wigglesworthia glossinidia brevipalpis
MLINRIEKDTIGEVELPKKCLWGSQTQRSIYNFNISTEKMPYELIHALVQIKLVAAKVNKDLKLLEEKKADAIIKASEEILSGKYKDSFPLVIWQTGSGTQTNMNVNEVIANIAIKLLGGKYGDYSIIHPNDHVNKSQSSNDVFPTAMHISAVLSLKKNLLPNLIKLKKSFYDKSILFKDIIKIGRTHLQDATPLTLGQEVSSWYCMLKKNIKYIKNSILCISEIALGGTAVGTGLNAHEKYSLKASKLLSEINKHNFISSTNKFESLSTCDAIVKVHSTLKNLSISIMKISNDIRWLSSGPRCGIGELIIPENEPGSSIMPGKVNPTQCESISMICCQVIGNDSAIGIGGLSGNFQLNVFRPMIIYNFLQSVRILSDGIKSFNKKCVIGIKPNIKRIKKFLKESLMLVTSLTPHIGYDKSAKIAKLAHNENITLKEACLKLNYISESQFDILVRPENMIGNKN

SEQ ID NO: 29264 - DNA, 1760 bp, Brachydanio rerio
  CDS (19)..(1548)
gttccgcccccggtcgccatgtaccgctccgctcgctccctgcatcgcttcagcgcgagtttgtcagatctgcgggccgctcagagatccatcaaagctcgcaacgtctgtccagcacccgggctccggcaccagaccgtcagaatggccagttcagaggcatttcggattgagagggacacatttggagagcttaaagtcccctctgataaatactatggagctcagactgtcagatccaccatgaacttcaggatcggaggagtcacggagaggatgccgattcaggtgatcagagctttcggtatcctgaagaaagctgctgcagaagtcaataaagattacggtttggacccaaagatcgcagacgccatcatgaaagctgctgatgaggtggagtctgggaagctggatgatcatttcccgctggttgtttggcaaacaggatccggaactcagactaacatgaacgtcaatgaggtgatcagtaacagagccatcgagatgctgggaggaaaactgggcagcaaagaccccgttcatcccaatgaccacgtcaacaagagccagagctccaatgacacgttccccacagccatgcacatcgctgctgctaaagaggttcacgaggttctcctgccgggccttcagacgcttcatgatgctctcgctgccaaagctgaacagttcaaagacatcataaagatcggccgcacacacacacaggacgccgtgccgctctcgctcggacaggagtttggcgggtacgtgcagcaggtgaagtacagtattgcgcgcgtgaaagcgtctctgccgcgtgtgtatgagctggcagcaggaggaaccgcagtcggcactggactcaacacacgcatcggctttgcagagaaggtggcagataaagtgtctgcacttacaggtcttccgttcgtgaccgcagccaataagttcgaggctctggcggctcatgatgctctggtggagctgagtggcgctctgaacactgtggccgtgagcatgatgaagatcgccaatgatatccgcttcctcggctctgggcctcgttcgggtctcggagaactcatcctgccagagaacgaacccggatccagcatcatgcccggtaaggtgaacccgacgcagtgtgaggccatgactatggtggccgctcaggtgatggggaatcatgtggccgttactgtcggaggaagcaatggacacttcgagctcaatgtgttcaagcccatgatcattaagaacgtgctgaactcggccaggctgctgggcgatgcttcggtctccttcactaataactgcgtggtcggcatcgaggcgaacaccgagaggatcaacaagctgatgagcgagtctctgatgctggtcaccgccctcaatccacatataggttatgataaagccgcaaaaattgcgaaaaccgctcataaagacggttcgactctgaaagaggcggcgctgaagctgggattcctgaacgagcagcagtttgaggagtgggttcgacctcatgacatgctgggcccaaagtaaaggagaacagagctgaaacacacgcacaccagtaaaacacttgtggatcaccgttcacagacggggtttgtgctggaggtattattcttcagagtctgtgtgttccctgtgaatgcatgactgtgtttctttttcatcccaaaatctgaggaataaaataaccgggggagaaaaaaaaaaaaaaaaaaaaaaaaaaaaaaaaaaaaaaaaaa

SEQ ID NO: 29265 - protein, 509 aa, Brachydanio rerio
MYRSARSLHRFSASLSDLRAAQRSIKARNVCPAPGLRHQTVRMASSEAFRIERDTFGELKVPSDKYYGAQTVRSTMNFRIGGVTERMPIQVIRAFGILKKAAAEVNKDYGLDPKIADAIMKAADEVESGKLDDHFPLVVWQTGSGTQTNMNVNEVISNRAIEMLGGKLGSKDPVHPNDHVNKSQSSNDTFPTAMHIAAAKEVHEVLLPGLQTLHDALAAKAEQFKDIIKIGRTHTQDAVPLSLGQEFGGYVQQVKYSIARVKASLPRVYELAAGGTAVGTGLNTRIGFAEKVADKVSALTGLPFVTAANKFEALAAHDALVELSGALNTVAVSMMKIANDIRFLGSGPRSGLGELILPENEPGSSIMPGKVNPTQCEAMTMVAAQVMGNHVAVTVGGSNGHFELNVFKPMIIKNVLNSARLLGDASVSFTNNCVVGIEANTERINKLMSESLMLVTALNPHIGYDKAAKIAKTAHKDGSTLKEAALKLGFLNEQQFEEWVRPHDMLGPK

SEQ ID NO: 29266 - DNA, 1588 bp, Mus musculus
  CDS (6)..(1529)
gcaccatgtaccgcgcactccgtctcctcgcgcgctcgcgtcgcctcctgcgggttccgtccgccggtgctgcagtgtctggggaagcgaccaccctcccgcggtgtgctccgaacgtcgcgcgaatggcaagccaaaattccttccgtgtagagttcgacacctttggtgaattgaaggttccaaccgataagtattatggtgctcagaccgtaagatctacgatgaactttaagattggaggtgctacagaacgtatgccaatcccagtcattcaagctttcggcatcttgaagcgagctgctgctgaagtaaaccaggagtatggtctcgatccaaagattgctagtgcaataatgaaggccgcagatgaggtagctgaaggtaaattaaatgatcactttcctctggtggtttggcagactggatcaggaacccagacaaacatgaatgtaaatgaagtcattagcaacagagcaattgaaatgttaggaggtgaacttggcagcaagaagcctgtgcaccccaatgatcatgttaacaaaagccagagctcgaatgacacctttcccacagcaatgcatattgctgctgcagtggaagttcacaaggtcctgttgccagggttacagaagctccatgatgctctcagtgcaaaatccaaagagtttgcgcaggtcatcaaaattgggcgaactcacacgcaggacgctgtccctcttactcttggacaggaattcagtggttacgttcagcaagtccagtatgcgatggtgagaataaaagccgccatgccaagaatctacgagctcgctgctggaggcactgctgtggggacggggttaaacaccaggatcggcttcgcagaaaaggtggccgcaaaagtagcagcactcacaggtttgccttttgtcactgccccgaataaatttgaagctctagctgctcatgatgctctggttgagcttagtggagccatgaacactgccgcctgcagtctaatgaagatagcgaatgatattcgcttcctgggttctggtcctcggtcaggtttgggagagctgatcttgcctgaaaacgagccagggagcagcatcatgccaggaaaggtgaaccctactcagtgtgaagcgatgaccatggttgcagcccaagtcatggggaatcacgttgctgttactgttggaggcagcaatggacattttgaactgaatgtgtttaaaccaatgatgattaagaatgtgttgcactcagcgaggctactgggagatgcttcagtgtccttcacagaaaactgtgtggtcgggatccaggccaacacagagcggatcaacaagctaatgaatgagtctttaatgttggtcacagctcttaatccacatatagggtatgacaaagcagcaaagattgccaagactgcgcacaagaacggatcaaccttaaaggaaacggctattgaacttggctatctcacagcagagcagtttgatgagtgggtgaaacccaaggacatgctgggtccaaagtgacttcaataaatttatattaaaataaacttaagaaatttacaaacaaaaaaaaaaaaaaa

SEQ ID NO: 29267 - protein, 507 aa, Mus musculus
MYRALRLLARSRRLLRVPSAGAAVSGEATTLPRCAPNVARMASQNSFRVEFDTFGELKVPTDKYYGAQTVRSTMNFKIGGATERMPIPVIQAFGILKRAAAEVNQEYGLDPKIASAIMKAADEVAEGKLNDHFPLVVWQTGSGTQTNMNVNEVISNRAIEMLGGELGSKKPVHPNDHVNKSQSSNDTFPTAMHIAAAVEVHKVLLPGLQKLHDALSAKSKEFAQVIKIGRTHTQDAVPLTLGQEFSGYVQQVQYAMVRIKAAMPRIYELAAGGTAVGTGLNTRIGFAEKVAAKVAALTGLPFVTAPNKFEALAAHDALVELSGAMNTAACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 29268 - DNA, 1485 bp, Rhizopus oryzae
  CDS (1)..(1485)
atgttgcgagcttctgctaccagattcttaagtcaagctaaaaacatgaacaactctcctcgtcttttcagtagtgcctctgctgctttgcaaaaattccgtgctgagcgcgatacttttggtgatctccaagttcctgctgatagatattggggtgctcaaacccaaaggtctcttcaaaattttgacattggtggccctactgaacgtatgcccgaacctttgatccgtgcctttggtgtcctcaaaaaggctgctgctactgtcaacatgacttatggcttggatcctaaagttggtgaagctattcaaaaggctgctgacgaggtcattgatggaagcttgattgatcatttccctcttgttgtctggcaaactggttccggtactcaaaccaagatgaacgttaacgaagttatctccaaccgtgctattgaacttttgggtggtgagcttggtagtaaggctcctgttcatcccaacgatcatgtcaacatgagtcaatcatccaatgacacgttccctactgccatgcacgttgctgctgttgttgaaattcacggtcgacttattcctgctttgaccactttgcgtgatgcccttcaagccaaatccgctgagtttgaacacatcatcaagatcggtcgtactcacttgcaagatgcaactcctttgactctcggtcaagaattctctggttatactcaacaattgacttacggtattgctcgtgtacaaggtaccttggagcgcctctataaccttgctcaaggtggtactgctgttggtactggtcttaacaccagaaaaggtttcgatgccaaggtagctgaagctattgcttctattaccggtcttcctttcaagaccgcccctaataagtttgaagcccttgctgctcacgatgctctcgttgaagctcacggagctctcaataccgttgcttgttctcttatgaagatcgccaacgatatccgttatcttggttctggacctcgctgtggtcttggtgaactttccttgcctgaaaacgaacccggatcttctatcatgcccggtaaggttaatcctactcaatgtgaagctatgaccatggtctgtgctcaagtcatgggtaacaacactgctatttctgttgctggttccaatggtcaattcgagcttaatgtcttcaaacccgtcatgatcaagaacttgatccaatccattcgtcttatttctgatgcctctatttcattcaccaaaaactgtgttgttggtattgaagccaatgaaaagaagattagcagcattatgaatgagtcattgatgttggtcactgctcttaaccctcatattggttacgataaagctgctaaatgtgccaagaaggcccacaaggaaggcaccaccttgaaggaagctgccctttctcttggttacttgacttctgaagaattcgaccagtgggttagacccgaagatatgatctctgccaaggattaa

SEQ ID NO: 29269 - protein, 494 aa, Rhizopus oryzae [sequence omitted]

SEQ ID NO: 29270 - DNA, 23 bp, Artificial sequence
  (1)..(23): primer
atgaatacagtacgcagcgaaaa

SEQ ID NO: 29271 - DNA, 23 bp, Artificial sequence
  (1)..(23): primer
ttaacgcccggctttcatactgc

SEQ ID NO: 29272 - protein, 500 aa, Artificial sequence
  Variant (2)..(2): xaa in position 2 is any amino acid
  Variant (4)..(4): xaa in position 4 is any amino acid
  Variant (6)..(7): xaa in position 6 to 7 is any amino acid
  Variant (9)..(11): xaa in position 9 to 11 is any amino acid
  Variant (13)..(18): xaa in position 13 to 18 is any amino acid
  Variant (23)..(23): xaa in position 23 is any amino acid
  Variant (25)..(27): xaa in position 25 to 27 is any amino acid
  Variant (30)..(30): xaa in position 30 is any amino acid
  Variant (32)..(38): xaa in position 32 to 38 is any amino acid
  Variant (40)..(44): xaa in position 40 to 44 is any amino acid
  Variant (46)..(49): xaa in position 46 to 49 is any amino acid
  Variant (51)..(52): xaa in position 51 to 52 is any amino acid
  Variant (55)..(56): xaa in position 55 to 56 is any amino acid
  Variant (58)..(60): xaa in position 58 to 60 is any amino acid
  Variant (62)..(62): xaa in position 62 is any amino acid
  Variant (64)..(78): xaa in position 64 to 78 is any amino acid
  Variant (80)..(81): xaa in position 80 to 81 is any amino acid
  Variant (83)..(88): xaa in position 83 to 88 is any amino acid
  Variant (90)..(97): xaa in position 90 to 97 is any amino acid
  Variant (100)..(103): xaa in position 100 to 103 is any amino acid
  Variant (110)..(111): xaa in position 110 to 111 is any amino acid
  Variant (115)..(115): xaa in position 115 is any amino acid
  Variant (119)..(122): xaa in position 119 to 122 is any amino acid
  Variant (124)..(138): xaa in position 124 to 138 is any amino acid
  Variant (143)..(143): xaa in position 143 is any amino acid
  Variant (146)..(147): xaa in position 146 to 147 is any amino acid
  Variant (153)..(154): xaa in position 153 to 154 is any amino acid
  Variant (158)..(169): xaa in position 158 to 169 is any amino acid
  Variant (171)..(171): xaa in position 171 is any amino acid
  Variant (173)..(176): xaa in position 173 to 176 is any amino acid
  Variant (178)..(183): xaa in position 178 to 183 is any amino acid
  Variant (185)..(194): xaa in position 185 to 194 is any amino acid
  Variant (196)..(196): xaa in position 196 is any amino acid
  Variant (202)..(202): xaa in position 202 is any amino acid
  Variant (205)..(205): xaa in position 205 is any amino acid
  Variant (207)..(207): xaa in position 207 is any amino acid
  Variant (213)..(236): xaa in position 213 to 236 is any amino acid
  Variant (238)..(239): xaa in position 238 to 239 is any amino acid
  Variant (248)..(248): xaa in position 248 is any amino acid
  Variant (250)..(265): xaa in position 250 to 265 is any amino acid
  Variant (267)..(269): xaa in position 267 to 269 is any amino acid
  Variant (271)..(275): xaa in position 271 to 275 is any amino acid
  Variant (277)..(277): xaa in position 277 is any amino acid
  Variant (279)..(291): xaa in position 279 to 291 is any amino acid
  Variant (293)..(297): xaa in position 293 to 297 is any amino acid
  Variant (299)..(300): xaa in position 299 to 300 is any amino acid
  Variant (302)..(302): xaa in position 302 is any amino acid
  Variant (308)..(308): xaa in position 308 is any amino acid
  Variant (310)..(312): xaa in position 310 to 312 is any amino acid
  Variant (316)..(317): xaa in position 316 to 317 is any amino acid
  Variant (319)..(320): xaa in position 319 to 320 is any amino acid
  Variant (322)..(324): xaa in position 322 to 324 is any amino acid
  Variant (326)..(330): xaa in position 326 to 330 is any amino acid
  Variant (343)..(345): xaa in position 343 to 345 is any amino acid
  Variant (348)..(349): xaa in position 348 to 349 is any amino acid
  Variant (351)..(353): xaa in position 351 to 353 is any amino acid
  Variant (356)..(356): xaa in position 356 is any amino acid
  Variant (359)..(369): xaa in position 359 to 369 is any amino acid
  Variant (371)..(371): xaa in position 371 is any amino acid
  Variant (373)..(373): xaa in position 373 is any amino acid
  Variant (377)..(378): xaa in position 377 to 378 is any amino acid
  Variant (380)..(383): xaa in position 380 to 383 is any amino acid
  Variant (385)..(385): xaa in position 385 is any amino acid
  Variant (387)..(387): xaa in position 387 is any amino acid
  Variant (389)..(390): xaa in position 389 to 390 is any amino acid
  Variant (393)..(418): xaa in position 393 to 418 is any amino acid
  Variant (420)..(425): xaa in position 420 to 425 is any amino acid
  Variant (427)..(440): xaa in position 427 to 440 is any amino acid
  Variant (442)..(443): xaa in position 442 to 443 is any amino acid
  Variant (447)..(447): xaa in position 447 is any amino acid
  Variant (449)..(451): xaa in position 449 to 451 is any amino acid
  Variant (455)..(456): xaa in position 455 to 456 is any amino acid
  Variant (459)..(460): xaa in position 459 to 460 is any amino acid
  Variant (463)..(463): xaa in position 463 is any amino acid
  Variant (465)..(496): xaa in position 465 to 496 is any amino acid
  Variant (498)..(499): xaa in position 498 to 499 is any amino acid
RXEXDXXGXXXVXXXXXXGAQTXRXXXNFXIXXXXXXXPXXXXXAXXXXKXXAAXXNXXXGXLXXXXXXXXXXXXXXXIXXAXXXXXXGXXXXXXXXFPXXXXQTGSGTXXNMNXNEVXXXXAXXXXXXXXXXXXXXXHPNDXVNXXQSSNDXXPTAXXXXXXXXXXXXLXPXXXXLXXXXXXKXXXXXXXXXXKXGRTHLXDAXPXTLGQEXXXXXXXXXXXXXXXXXXXXXXXXLXXGGTAVGTGXNXXXXXXXXXXXXXXXXTXXXFXXXXXNXFXXXXXXXXXXXXXGXXXXXAXXLXKIANDXRXXXSGPXXGXXEXXXPXXXXXPGSSIMPGKVNPXXXEAXXMXXXQVXGNXXXXXXXXXXXGXFXLNVXXPXXXXNXLXSXXLLXXXXXXXXXXXXXXXXXXXXXXXXXXFXXXXXXGXXXXXXXXXXXXXXSXXLVTXLXXXIGYXXAAXXAKXAXXXXXXXXXXXXXXXXXXXXXXXXXXXXXXXXPXXM

SEQ ID NO: 29273 - protein, 64 aa, Artificial sequence
  Variant (1)..(1): xaa in position 1 is Phe, Ile, Tyr or Val
  Variant (2)..(2): xaa in position 2 is Pro, Val or Tyr
  Variant (3)..(3): xaa in position 3 is Leu, Val or Ile
  Variant (4)..(4): xaa in position 4 is any amino acid
  Variant (5)..(5): xaa in position 5 is Val, Ile, Met, Thr or Leu
  Variant (6)..(6): xaa in position 6 is Trp, Phe, Tyr or Leu
  Variant (8)..(8): xaa in position 8 is Thr, Ala or Gly
  Variant (10)..(10): xaa in position 10 is Ser or Ala
  Variant (13)..(13): xaa in position 13 is Gln, Ser, Gly or His
  Variant (14)..(14): xaa in position 14 is Ser, Thr, Leu, Phe or Tyr
  Variant (18)..(18): xaa in position 18 is any amino acid
  Variant (20)..(20): xaa in position 20 is Glu or Asp
  Variant (22)..(22): xaa in position 22 is Ile, Leu or Val
  Variant (23)..(23): xaa in position 23 is Ala or Ser
  Variant (24)..(25): xaa in position 24 to 25 is any amino acid
  Variant (26)..(26): xaa in position 26 is Ala or Gly
  Variant (27)..(32): xaa in position 27 to 32 is any amino acid
  Variant (33)..(40): xaa in position 33 to 40 is any or no amino acid
  Variant (41)..(41): xaa in position 41 is Val, Ile or Leu
  Variant (42)..(42): xaa in position 42 is any amino acid
  Variant (45)..(45): xaa in position 45 is Asp, Asn or Glu
  Variant (46)..(46): xaa in position 46 is His, Asp or Glu
  Variant (47)..(47): xaa in position 47 is Val, Cys or Ile
  Variant (49)..(49): xaa in position 49 is any amino acid
  Variant (50)..(50): xaa in position 50 is Ser, Gly, Ala or Cys
  Variant (51)..(51): xaa in position 51 is Gln or Ala
  Variant (53)..(53): xaa in position 53 is Ser or Thr
  Variant (56)..(56): xaa in position 56 is any amino acid
  Variant (57)..(57): xaa in position 57 is Phe, Tyr, Val or Ile
  Variant (59)..(59): xaa in position 59 is Thr, Ser or Ala
  Variant (60)..(60): xaa in position 60 is Ala, Val, Thr, Met or Ser
  Variant (61)..(61): xaa in position 61 is Met, Ile, Thr, Leu or Val
  Variant (62)..(62): xaa in position 62 is any amino acid
  Variant (63)..(63): xaa in position 63 is Ile, Val or Leu
  Variant (64)..(64): xaa in position 64 is Ala, Ser, Thr or Val
XXXXXXQXGXGTXXNMNXNXVXXXXXXXXXXXXXXXXXXXXXPNXXXNXXXSXNDXXPXXXXXX

SEQ ID NO: 29274 - protein, 55 aa, Artificial sequence
  Variant (2)..(2): xaa in position 2 is any amino acid
  Variant (7)..(7): xaa in position 7 is Leu, Thr, Met or Phe
  Variant (8)..(8): xaa in position 8 is Gln, Met, Arg or Glu
  Variant (11)..(11): xaa in position 11 is any amino acid
  Variant (13)..(13): xaa in position 13 is Leu, Val, Ile or Met
  Variant (14)..(14): xaa in position 14 is Thr, Arg or Ser
  Variant (15)..(15): xaa in position 15 is Leu, Phe, Met or Val
  Variant (16)..(16): xaa in position 16 is Gly, Ala, Ser or Lys
  Variant (17)..(17): xaa in position 17 is Gln, Asp or Leu
  Variant (18)..(18): xaa in position 18 is Glu or Val
  Variant (19)..(20): xaa in position 19 to 20 is any amino acid
  Variant (21)..(21): xaa in position 21 is Gly, Ala, Ser or Thr
  Variant (22)..(22): xaa in position 22 is Tyr, Trp or Phe
  Variant (23)..(24): xaa in position 23 to 24 is any amino acid
  Variant (25)..(25): xaa in position 25 is Gln, Met, Ala, Cys or Arg
  Variant (26)..(26): xaa in position 26 is Leu, Ile, Val, Phe or Met
  Variant (27)..(32): xaa in position 27 to 32 is any amino acid
  Variant (33)..(33): xaa in position 33 is Ile, Leu, Val or Ala
  Variant (34)..(39): xaa in position 34 to 39 is any amino acid
  Variant (40)..(40): xaa in position 40 is Leu, Val, Ile or Met
  Variant (41)..(42): xaa in position 41 to 42 is any amino acid
  Variant (43)..(43): xaa in position 43 is Leu, Ile or Val
  Variant (44)..(44): xaa in position 44 is Ala, Pro, Asn or Ser
  Variant (45)..(45): xaa in position 45 is any amino acid
  Variant (46)..(47): xaa in position 46 to 47 is Gly or Ala
  Variant (49)..(49): xaa in position 49 is Ala or Ser
  Variant (50)..(50): xaa in position 50 is Val, Ile, Ala or Thr
  Variant (52)..(52): xaa in position 52 is Thr, Ser or Asn
  Variant (53)..(53): xaa in position 53 is Gly or Lys
  Variant (54)..(54): xaa in position 54 is any amino acid
  Variant (55)..(55): xaa in position 55 is Asn, Ser, Asp or Gly
KXGRTHXXDAXPXXXXXXXXXXXXXXXXXXXXXXXXXXXXXXXXXXXTXXGXXXX

SEQ ID NO: 29275 - protein, 101 aa, Artificial sequence
  Variant (1)..(1): xaa in position 1 is Gly, Ala, Asn or Ser
  Variant (2)..(5): xaa in position 2 to 5 is any amino acid
  Variant (6)..(6): xaa in position 6 is Leu, Ile, Val, Ala or Thr
  Variant (7)..(7): xaa in position 7 is Ala, Ser or Gly
  Variant (8)..(9): xaa in position 8 to 9 is any amino acid
  Variant (10)..(10): xaa in position 10 is Leu, Ile, Met, Val or Phe
  Variant (11)..(11): xaa in position 11 is any amino acid
  Variant (12)..(12): xaa in position 12 is Lys or Arg
  Variant (13)..(13): xaa in position 13 is Ile, Leu, Val or Met
  Variant (14)..(14): xaa in position 14 is Ala, Gly, Ser or Cys
  Variant (15)..(15): xaa in position 15 is Asn or Gln
  Variant (17)..(17): xaa in position 17 is Ile, Leu, Val or Met
  Variant (18)..(18): xaa in position 18 is Arg or Lys
  Variant (19)..(19): xaa in position 19 is Trp, Leu, Phe, Tyr or Ile
  Variant (20)..(20): xaa in position 20 is Leu or Met
  Variant (21)..(21): xaa in position 21 is any amino acid
  Variant (22)..(22): xaa in position 22 is Ser, Ala or Cys
  Variant (25)..(26): xaa in position 25 to 26 is any amino acid
  Variant (27)..(27): xaa in position 27 is Gly or Ala
  Variant (28)..(28): xaa in position 28 is Leu, Ile, Phe or Tyr
  Variant (29)..(29): xaa in position 29 is any amino acid
  Variant (31)..(31): xaa in position 31 is Ile, Leu or Val
  Variant (32)..(32): xaa in position 32 is any amino acid
  Variant (33)..(33): xaa in position 33 is Leu, Ile or Phe
  Variant (34)..(34): xaa in position 34 is Pro, Gln or Glu
  Variant (35)..(36): xaa in position 35 to 36 is any amino acid
  Variant (37)..(38): xaa in position 37 to 38 is any or no amino acid
  Variant (39)..(39): xaa in position 39 is Glu, Gln, Ile or Val
  Variant (40)..(40): xaa in position 40 is Pro, Gln or Ala
  Variant (44)..(44): xaa in position 44 is Ile, Ala or Met
  Variant (49)..(49): xaa in position 49 is Val, Ile or Thr
  Variant (52)..(52): xaa in position 52 is Thr, Val or Ser
  Variant (53)..(54): xaa in position 53 to 54 is any amino acid
  Variant (56)..(56): xaa in position 56 is Ala, Ser, Thr or Met
  Variant (57)..(58): xaa in position 57 to 58 is any amino acid
  Variant (59)..(59): xaa in position 59 is Met, Gln, Leu or Trp
  Variant (60)..(60): xaa in position 60 is Val, Leu, Ile, Ala or Ser
  Variant (61)..(63): xaa in position 61 to 63 is any amino acid
  Variant (64)..(64): xaa in position 64 is Val or Ile
  Variant (65)..(65): xaa in position 65 is any amino acid
  Variant (66)..(66): xaa in position 66 is Gly or Ala
  Variant (67)..(73): xaa in position 67 to 73 is any amino acid
  Variant (74)..(74): xaa in position 74 is Ala, Gly or Ser
  Variant (75)..(75): xaa in position 75 is Gly, Ala, Ser or Val
  Variant (76)..(77): xaa in position 76 to 77 is any amino acid
  Variant (78)..(78): xaa in position 78 is any or no amino acid
  Variant (80)..(80): xaa in position 80 is any amino acid
  Variant (81)..(81): xaa in position 81 is Phe, Leu or Ile
  Variant (82)..(82): xaa in position 82 is Glu, Gln or Asp
  Variant (83)..(83): xaa in position 83 is Leu or Met
  Variant (84)..(84): xaa in position 84 is Asn, Ala or Ser
  Variant (85)..(87): xaa in position 85 to 87 is any amino acid
  Variant (89)..(89): xaa in position 89 is Val, Leu, Met, Asn or Ile
  Variant (90)..(94): xaa in position 90 to 94 is any amino acid
  Variant (95)..(95): xaa in position 95 is Leu, Ile, Val, Thr or Phe
  Variant (96)..(96): xaa in position 96 is any amino acid
  Variant (97)..(97): xaa in position 97 is Ser, Gln, Thr or Gly
  Variant (98)..(100): xaa in position 98 to 100 is any amino acid
  Variant (101)..(101): xaa in position 101 is Leu, Ile, Met or Val
XXXXXXXXXXXXXXXDXXXXXXGPXXXXXEXXXXXXXXXXGSSXMPGKXNPXXXEXXXXXXXXXXXXXXXXXXXXXXXGXXXXXXXXPXXXXXXXXXXXXX

SEQ ID NO: 29276 - DNA, 1110 bp, Escherichia coli K12
  CDS (1)..(1110): transl_table=11
atgaaatcgggccgctttattggcgttatgtcaggcaccagccttgatggtgttgatgttgtgttggcgacaattgatgaacaccgggtcgcacagctggcaagtttgagttggccgatcccggtatctctgaaacaggctgtactggatatttgccagggccagcagcttacactttcgcagtttggacagcttgatactcaactcgggcaactttttgctgatgcggtcaatgccttgcttaaggaacaaaatctgcaggcaagagatatagttgcgatcggttgtcacggtcaaaccgtctggcatgaaccgacgggcgtggcaccacacactttacagattggcgataacaatcaaattgtggcacgcaccggaattacggttgtcggtgattttcgccgtcgcgatattgccttgggaggacaaggcgcaccgctggtacctgcgttccatcatgcgctgctggctcacccaaccgagcgacgaatggtgctcaatattggcggcatcgccaatctgtcactgctcattcctgggcagccggttgggggctacgataccggtcctggtaacatgctgatggatgcctggatctggcgtcaggccggtaaaccttacgataaagatgccgagtgggcacgggcgggtaaagttattctcccactgctgcaaaatatgctcagcgacccgtatttctcgcaacctgcaccgaaaagcaccggacgcgaatactttaactatggttggctggagcgccatttgcgccattttccgggtgttgatccccgagatgtgcaggcgacactggcagaactcaccgccgtgaccatttctgaacaagttttgttgagcggtggctgcgaacgattgatggtatgtggtggaggtagtcgtaatccgctactcatggcgcgtctggcggcattactgccaggcacagaagtcaccaccaccgatgccgttggcattagtggcgatgacatggaagcattggctttcgcctggcttgcctggcggacgctggcgggattaccaggaaatctgccttccgtcactggcgcaagccaggagacggtactgggggctattttccccgctaacccgtga

SEQ ID NO: 29277 - protein, 369 aa, Escherichia coli K12
MKSGRFIGVMSGTSLDGVDVVLATIDEHRVAQLASLSWPIPVSLKQAVLDICQGQQLTLSQFGQLDTQLGQLFADAVNALLKEQNLQARDIVAIGCHGQTVWHEPTGVAPHTLQIGDNNQIVARTGITVVGDFRRRDIALGGQGAPLVPAFHHALLAHPTERRMVLNIGGIANLSLLIPGQPVGGYDTGPGNMLMDAWIWRQAGKPYDKDAEWARAGKVILPLLQNMLSDPYFSQPAPKSTGREYFNYGWLERHLRHFPGVDPRDVQATLAELTAVTISEQVLLSGGCERLMVCGGGSRNPLLMARLAALLPGTEVTTTDAVGISGDDMEALAFAWLAWRTLAGLPGNLPSVTGASQETVLGAIFPANP

SEQ ID NO: 29278 - DNA, 1116 bp, Mesorhizobium loti MAFF303099
  CDS (1)..(1116): transl_table=11
atggaaccaatctgggccgtcggcctgatgaccggcaccgtgcttgacggcaatatcgacgtcgcgctgatcaagaccgatggcgagcgcatcgacgatttcggcacctaccggctgatgccctatccccaatcgatccgctcgctgctggaagagacgctgacggcggcgcgggcctggaattttgtcgggccggagccggcgatcttccgcaaggccgaggaggcgctgacgcgtgcccagtcggcggcggtgaaggaattggtcgagggctatggcatgacgatggccgatatcggcgtcgtcggctttcacggccagacggtgctgcatcgcgcgccgcaggtggggcggctcggccagaccagacagctgggtgacggcgagctgatgcattccctgttgagcacgaaggtcgcctatgatttccgctcggccgacatgcgcgccggcgggcaaggcgcgcctctggccgcagcctatcacaccgcgttgatgcgcagcgccggcgccagtggcgaggtggccgtgctcaatctcggcggcgtcgccaacatcacctggtgggacggcgccgacaatgtcgtcgccttcgacaccggccccgccaacgcgccgctcaacgatttcatcaaatcgaagggcctcggcgacatggatcgtgacggcgcgcttggccgtgcgggaacagtcgacgaggcccggctcgccaagctgctgcagcacccttatctgaccaagccctatcccaaatcgctggaccgtttcgatttcggcgccgccatggcggatggcctcaatgccgaggatggcgcggccctgctcaccgccttcacggccggcgccgttggcaaggcgctcgacctcttgcccactcggccgaagaaattggtggtcagcggcggcggccgccacaacccgacgatgatggcgatgctcgccagccgtgccggagtcgaagtggtgcaggcggaaagcctcggctggagcggcgacgcggtggaggcagagtgctttgccttcctcgcggtgcgcgtgctgcgcggcatgccgatcagttttccaagcaccaccggcgcgccgcagccgatgcgcggcggaaagctggcaggttaa

SEQ ID NO: 29279 - protein, 371 aa, Mesorhizobium loti MAFF303099
MEPIWAVGLMTGTVLDGNIDVALIKTDGERIDDFGTYRLMPYPQSIRSLLEETLTAARAWNFVGPEPAIFRKAEEALTRAQSAAVKELVEGYGMTMADIGVVGFHGQTVLHRAPQVGRLGQTRQLGDGELMHSLLSTKVAYDFRSADMRAGGQGAPLAAAYHTALMRSAGASGEVAVLNLGGVANITWWDGADNVVAFDTGPANAPLNDFIKSKGLGDMDRDGALGRAGTVDEARLAKLLQHPYLTKPYPKSLDRFDFGAAMADGLNAEDGAALLTAFTAGAVGKALDLLPTRPKKLVVSGGGRHNPTMMAMLASRAGVEVVQAESLGWSGDAVEAECFAFLAVRVLRGMPISFPSTTGAPQPMRGGKLAG

SEQ ID NO: 29280 - DNA, 1113 bp, Vibrio cholerae O1 biovar eltor str. N16961
  CDS (1)..(1113): transl_table=11
atggcagaacgcgaactctatatcggtgtgatgtcgggaaccagtttggatggtgtggataccgctttagtggcgctgcaagacgataacatcgaactgctggctcaccacgactaccctattcctgccgacctcaagcagcggctgctcaatgtctgcatcggccagccaaccaccttgattgcgatgggtgaattggagcacgatctggggcatttgttcagtgatgcggtgctggcgcttttgcagcacagtggctatcgcgccgagcacatccgtgcgatcggctgtcatggacaaaccgtgttccatcagcctaccggcaccaaaccttttaccatgcaaattggcgatgccaacattatcgctacgcgcacaggcattacgactgtcgccgattttcggcgcaaagatgttgcgctcggagggcaaggcgcaccgttagttcccgcgtttcatcgcacgatttttcatgctgagcaatcgaccgtggtcgtgctcaatatcggggggattgctaatatttcggtgctcaagcccaatggtgaagtggtgggctatgacaccggccctggcaatatgctgatggatagctggtgccaaaaagaacgtaaccagccttacgataaagatgccctgtgggccaaacaaggcagcgtgaatgccgcattacttagccatttaaaacaagaccattactttgctctgccagcacccaaaagcacaggccgcgagctgtttaatctgccttggttagaaacgcagctcgccacgttttcggttgatgccaccgatgtgcaacgcaccttgtgtgaattcactgcgcaaaccattgttgagcaagtcgcaccattcgccgaagggccacaaccacagcttttagtgtgtggcggcggtgcgcaaaatcctttactcatggaacgcttacaagccttgctgccaagctggcaagttgccccgaccacccaaatgggcgtggatggcgataatatggaagccatggctttcgcttggctggcacaacggcgtatacacggtttacccagtaatttgcccgccgtgacgggcgcatcacgtcttgcgagtcttggcgtgatttactaccccgattaa

SEQ ID NO: 29281 - protein, 370 aa, Vibrio cholerae O1 biovar eltor str. N16961
MAERELYIGVMSGTSLDGVDTALVALQDDNIELLAHHDYPIPADLKQRLLNVCIGQPTTLIAMGELEHDLGHLFSDAVLALLQHSGYRAEHIRAIGCHGQTVFHQPTGTKPFTMQIGDANIIATRTGITTVADFRRKDVALGGQGAPLVPAFHRTIFHAEQSTVVVLNIGGIANISVLKPNGEVVGYDTGPGNMLMDSWCQKERNQPYDKDALWAKQGSVNAALLSHLKQDHYFALPAPKSTGRELFNLPWLETQLATFSVDATDVQRTLCEFTAQTIVEQVAPFAEGPQPQLLVCGGGAQNPLLMERLQALLPSWQVAPTTQMGVDGDNMEAMAFAWLAQRRIHGLPSNLPAVTGASRLASLGVIYYPD

SEQ ID NO: 29282 - DNA, 1134 bp, Pasteurella multocida subsp. multocida str. Pm70
  CDS (1)..(1134): transl_table=11
atgaaggaggcaactatgtactatatcggggtcatgtcaggcaccagtttagacggagtggatctggcattaatggatttttcctgtgcgcaaccacaacttatccatgcagatttttaccctatgccacccgcaatacggcaacagatttcaacattatgtaattcgggcacaactactttacaagccttaggtgagttagatcaccaactgggtttactctataccgattgcattcaacaattcttacaaaaacatcggctttcacctgaacagatcaccgccattggttgccacggacaaaccgtttggcattccccaaacagccactatccatttacgatgcaaattggcgatgctaacctgatcgcagcgaaaacgggcattaccacggtggcggattttcgccgtaaagatatggcatttggtggacaaggtgcgccactggtgccggcttttcatcaagccttatttcggaaaccgaatcaagcgaccgtggtgttaaatgtcggtggcatcagcaatatttctcgcttactaccaaatgaagaagttattggctatgacacgggaccgggtaataccttgctcgatgcgtggatcgaaaaacatcaaggcaaagcctatgataaaaatgcagaatgggcgaaatcaggtaaagtaaatacggacttacttgctgatttactcgatgaaccgttcttcgcccttcccgcaccaaaaagcacaggacgcgaattattcaatctggcttggctaaacaaaaaattgcaaaaacacaccgcacttttgccacaagatgtccaagcaactttagtggaactcaccgcacaaagtattgtggatcagcttaaccaaattgaaacggaattagatcgccatttattagtgtgtggtggcggggtgaaaaattgtctcttaatggcacgtctcaccgccttattgccacaatggcaagtgcaaaccaccaatgactacggcttagatgccgattatgtggaagccgccgcttttgcgtggctcgcctatcaacgcctcaatgacctcccgggcaatttaccgagcgtaacaggagcaaaaagtgcggtcagtttaggggcaatttatccgaaggaaaaggatgtggcagcataa

SEQ ID NO: 29283 - protein, 377 aa, Pasteurella multocida subsp. multocida str. Pm70
MKEATMYYIGVMSGTSLDGVDLALMDFSCAQPQLIHADFYPMPPAIRQQISTLCNSGTTTLQALGELDHQLGLLYTDCIQQFLQKHRLSPEQITAIGCHGQTVWHSPNSHYPFTMQIGDANLIAAKTGITTVADFRRKDMAFGGQGAPLVPAFHQALFRKPNQATVVLNVGGISNISRLLPNEEVIGYDTGPGNTLLDAWIEKHQGKAYDKNAEWAKSGKVNTDLLADLLDEPFFALPAPKSTGRELFNLAWLNKKLQKHTALLPQDVQATLVELTAQSIVDQLNQIETELDRHLLVCGGGVKNCLLMARLTALLPQWQVQTTNDYGLDADYVEAAAFAWLAYQRLNDLPGNLPSVTGAKSAVSLGAIYPKEKDVAA

SEQ ID NO: 29284 - DNA, 1092 bp, Pseudomonas aeruginosa PAO1
  CDS (1)..(1092): transl_table=11
gtgccgcgctacctggggttgatgtccggaaccagcctggacggcatggacatcgtcctgatcgagcaaggtgatcgcaccaccttgctcgcttcccattacctacccatgccggccgggctgcgcgaagacatcctcgccctgtgcgtccccggtcccgatgaaatcgcccgcgccgccgaagtcgagcaacgctgggtcgcccttgcagcacagggcgtgcgcgaactgctgctccagcagcagatgagccccgacgaagtccgtgccatcggcagtcatggtcaaaccatccggcatgaacccgctcgccacttcacggtgcagatcggcaaccccgccctgctggcggagctgaccggcatcgatgtcgtcgccgacttccgccgccgtgacgtcgcagccggcggccagggcgccccgctggtaccggccttccatcaggcgctgtttggcgatgatgacacctccagggcggtcctgaacatcggtggcttcagcaacgtttcgctgctcagccccggaaagccggtacgcggcttcgactgcggcccgggcaacgtgctgatggacgcctggattcatcaccagcgcggtgaacatttcgaccgggacggtgcgtgggccgccagcggccaggtgaaccacgcactgctggcaagcctgctggcggatgaattcttcgccgcgcgtggccccaagagcaccgggcgcgagcgcttcaacctgccctggctgcaggagcacctggctcgtcaccctgccttgccggcagcggatatccaggcaaccctgctggaactgagcgcgcgcagcatcagcgaatcgctgctggacgcccagccggactgcgaagaggtgctggtatgcggcggcggcgccttcaatacggcgctgatgaagcgcctggccatgctgatgcccgaagctcgggtcgccagtaccgacgaatacggcattccccctgcctggatggagggcatggcattcgcctggctagcccatcggtttctcgagcgcctgcccggcaactgccctgatgtgaccggtgcgctcggtcccagaactctgggcgcgctgtatcccgcctga

SEQ ID NO: 29285 - protein, 363 aa, Pseudomonas aeruginosa PAO1
MPRYLGLMSGTSLDGMDIVLIEQGDRTTLLASHYLPMPAGLREDILALCVPGPDEIARAAEVEQRWVALAAQGVRELLLQQQMSPDEVRAIGSHGQTIRHEPARHFTVQIGNPALLAELTGIDVVADFRRRDVAAGGQGAPLVPAFHQALFGDDDTSRAVLNIGGFSNVSLLSPGKPVRGFDCGPGNVLMDAWIHHQRGEHFDRDGAWAASGQVNHALLASLLADEFFAARGPKSTGRERFNLPWLQEHLARHPALPAADIQATLLELSARSISESLLDAQPDCEEVLVCGGGAFNTALMKRLAMLMPEARVASTDEYGIPPAWMEGMAFAWLAHRFLERLPGNCPDVTGALGPRTLGALYPA

SEQ ID NO: 29286 - DNA, 1131 bp, Neisseria meningitidis MC58
  CDS (1)..(1131): transl_table=11
atggcgttttgcaccagtttgggagtgatgatggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcggaacggacgcggatttttaccgtcggcgacttccgcagccgcgaccttgcggccggcggacaaggcgcgccactcgtccccgcctttcacgaagccctgttccgcgacaacagggaaacacgcgcggtactgaacatcggcgggattgccaacatcagcgtactcccccccgacgcacccgccttcggcttcgacacagggccgggcaatatgctgatggacgcgtggacgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgacctgaacctcgatccgcaatgggtggaagccgccgcatttgcgtggttggcggcgtgttggattaatcgcattcccggtagtccgcacaaagcaaccggcgcatccaaaccgtgtattctgggcgcgggatattattattga

SEQ ID NO: 29287 - protein, 376 aa, Neisseria meningitidis MC58
MAFCTSLGVMMETQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAAFAWLAACWINRIPGSPHKATGASKPCILGAGYYY

SEQ ID NO: 29288 - DNA, 1104 bp, Neisseria meningitidis Z2491
  CDS (1)..(1104): transl_table=11
atgatggaaacacagctttacatcggcatcatgtcgggaaccagcatggacggggcggatgccgtactgatacggatggacggcggcaaatggctgggcgcggaagggcacgcctttaccccctaccccggcaggttacgccgcaaattgctggatttgcaggacacaggcgcggacgaactgcaccgcagcaggatgttgtcgcaagaactcagccgcctgtacgcgcaaaccgccgccgaactgctgtgcagtcaaaacctcgcgccgtccgacattaccgccctcggctgccacgggcaaaccgtcagacacgcgccggaacacagttacagcgtacagcttgccgatttgccgctgctggcggaacggactcagatttttaccgtcggcgacttccgcagccgcgaccttgcggccggcggacaaggcgcgccgctcgtccccgcctttcacgaagccctgttccgcgacgacagggaaacacgcgcggtactgaacatcggcgggattgccaacatcagcgtactcccccccgacgcacccgccttcggcttcgacacaggaccgggcaatatgctgatggacgcgtggatgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgattcaccgcgcaaaccgttttcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatccgcaatgggtagaagccgccgcgttcgcatggatggcggcgtgttgggtcaaccgcattcccggtagtccgcacaaagcaaccggcgcatccaaaccgtgtattctgggcgcgggatattattattga

SEQ ID NO: 29289 - protein, 367 aa, Neisseria meningitidis Z2491
MMETQLYIGIMSGTSMDGADAVLIRMDGGKWLGAEGHAFTPYPGRLRRKLLDLQDTGADELHRSRMLSQELSRLYAQTAAELLCSQNLAPSDITALGCHGQTVRHAPEHSYSVQLADLPLLAERTQIFTVGDFRSRDLAAGGQGAPLVPAFHEALFRDDRETRAVLNIGGIANISVLPPDAPAFGFDTGPGNMLMDAWMQAHWQLPYDKNGAKAAQGNILPQLLDRLLAHPYFAQPHPKSTGRELFALNWLETYLDGGENRYDVLRTLSRFTAQTVFDAVSHAAADARQMYICGGGIRNPVLMADLAECFGTRVSLHSTAELNLDPQWVEAAAFAWMAACWVNRIPGSPHKATGASKPCILGAGYYY

SEQ ID NO: 29290 - DNA, 1146 bp, Xylella fastidiosa 9a5c
  CDS (1)..(1146): transl_table=11
atgcgtgtgcatgatgatccctgcaatccaaatccagcacctctctacctcggtctcatgtccggcaccagcgtcgacggcatcgacgcagcgttggtacggattaacgcaaacgcgataacacattgtgagctgattgccgcgcaaacctccgcttgggaccctaacctacgcacgacattgttggaactaagccaaggacagaacacagcatcccttgaccaactaggctggctcgacgcccaagtcggactggccttcgccacagcggctaatacactgatcgcaaaaacgggcataaagcacacacagatacgtgcgattggctctcatggccagaccatacgccaccgcccacacggcgatctacccttcacttggcaattaggcgatgcccaccggatcgccgaactcactggaatcactaccgtcgcagacttccgccgccgtgacgtggctgccggcggccaaggcgcaccactcatgcccgctttccatctagcgatccttggatcggccaatgaaaaccgagcagtgctgaacttaggcgggattgcaaacttgacactgatcccgatgaccggcccagtactcggcttcgacaccggaccagcgaacgcactgctcgacagctggtatcaacgccatcatcacgagacattcgatcaaagcggtaacttcgccgcaagcggcaaaatcaaccagaagttactggcctgcctgctagccgacccttggttcaccctcccccctcccaaaagcacagggcgcgaacaattccatttggactgggtgaccaaacaactagaacctacaccaccatcaccagccgatgtgcaggcaacactgctcgaactgaccgcagtcaccgtagcagatgccctactacgccaacaacccaagacgaatcggctactgatatgcggtggcggtgcgcataacccagtattgatggcacgcctggccgcacacctacccaacgtaacagtggaatcgattcaaacctatggactcaatccggactatctggaagcaatggggtttgcttggctggctgcacaaacattggacggccaaccaggtaacctgccaagcgtcactggcgcacgcggcctgcgtttgctcggcgcaatccacccagcctga

SEQ ID NO: 29291 - protein, 381 aa, Xylella fastidiosa 9a5c
MRVHDDPCNPNPAPLYLGLMSGTSVDGIDAALVRINANAITHCELIAAQTSAWDPNLRTTLLELSQGQNTASLDQLGWLDAQVGLAFATAANTLIAKTGIKHTQIRAIGSHGQTIRHRPHGDLPFTWQLGDAHRIAELTGITTVADFRRRDVAAGGQGAPLMPAFHLAILGSANENRAVLNLGGIANLTLIPMTGPVLGFDTGPANALLDSWYQRHHHETFDQSGNFAASGKINQKLLACLLADPWFTLPPPKSTGREQFHLDWVTKQLEPTPPSPADVQATLLELTAVTVADALLRQQPKTNRLLICGGGAHNPVLMARLAAHLPNVTVESIQTYGLNPDYLEAMGFAWLAAQTLDGQPGNLPSVTGARGLRLLGAIHPA

SEQ ID NO: 29292 - DNA, 1152 bp, Sinorhizobium meliloti 1021
  CDS (1)..(1152): transl_table=11
atgggcagagtattgacggcgatcggactgatgagcggcacgagcatggacggcatagatatcgcagtcgtgcgaaccgacggcgacagcatcgtcgatcgcggcccgtctgccggatatgcctatgatccgcggttccgggagcgcctgaaacagggcctcgaagacgcccggtcgattctcaaacgagaagagcggccgggtaccctcgcagacctcgagcgcgacctgacgctgcggcacgcactcgcggttcggatgtttctccaggaaaacaatattttgccggataatgttaatgtaataggttttcacggacaaaccgtcctgcatcgccctgatcaagcgttgacggtacagcttggcgatggcgagctgctggcgcgggaaaccgggatcgacgtggtctacgacatgcgggccaatgacatgacccatggaggccagggcgcacccctcattcccgcctatcacgccgccctggcgcgcggtctctccaaagtcggggagattgccactcccgtcgtcttcgtcaatatcggcggcatttccaatctcacctacataggcgcaggcgaagaaatcgtcgcctatgacagcggacccggcaatacgctgatcgatcaatgggtggaggctcacgccggtattccctacgaccagggcggcatgatcgcgagcgagggcggcgtcctgcgggaactcgccgaccgttatctttctcacccgtttttcagcgccgagaaacgccgctcgctcgaccgtaacgatttcgcgccgccggcggcaggcgatgccagcctcgaggatggggcgcgtaccctcgctcatgtaacggccgccggcatcgtccggtccgcgcgccatcttccggcaaatccggcaacctacattgtctgcggcggcggccgcctgaattccgtcatcatgagcgaccttcacgcgcttgccgaagcggagggcgcgcgcgtgcttgccgcagaagcgctggatctgaacggcgattcgatggaagccgaggcctgggcctatctcgccgtgagatcgcgatactgcctgcctttgacctatcctggaacgacgggcgtcagctgtccggtaagcgggggtaggctcgcggcaaagccggggcggattgcggccgtttcatga

SEQ ID NO: 29293 - protein, 383 aa, Sinorhizobium meliloti 1021
MGRVLTAIGLMSGTSMDGIDIAVVRTDGDSIVDRGPSAGYAYDPRFRERLKQGLEDARSILKREERPGTLADLERDLTLRHALAVRMFLQENNILPDNVNVIGFHGQTVLHRPDQALTVQLGDGELLARETGIDVVYDMRANDMTHGGQGAPLIPAYHAALARGLSKVGEIATPVVFVNIGGISNLTYIGAGEEIVAYDSGPGNTLIDQWVEAHAGIPYDQGGMIASEGGVLRELADRYLSHPFFSAEKRRSLDRNDFAPPAAGDASLEDGARTLAHVTAAGIVRSARHLPANPATYIVCGGGRLNSVIMSDLHALAEAEGARVLAAEALDLNGDSMEAEAWAYLAVRSRYCLPLTYPGTTGVSCPVSGGRLAAKPGRIAAVS

SEQ ID NO: 29294 - DNA, 1161 bp, Caulobacter crescentus CB15
  CDS (1)..(1161): transl_table=11
atggggcctagctaccgtttcaccgccatggcagtcaacggtcccatgaagatcctgggattcatgaccggcacctcgctggatgcggtcgacatggcggtgctggagaccgatggcgtggagatcagcgccttcggtccggcgggcgagcgcaagttgcgggaggccacccgcgacctgctgctgaagaccaccgacatcgcccgcgcctggccgcgcggcgagcctgagccggtgatcttcgaggaggcccggcgcgccgtggccgacgagcacttccaggccgccgaaagctttctggatgagcacggtctctcttggagcgacttcgacctgctgggcgtacacggccagacggttctgcacgagcgcccgacggcgcagcgggtggggcgcacggtgcaactgctcgacgccgatcgcctggcgcgcctctgcgggcgtccggtggcgttcgacttccgcaccgccgatgtcgccgtcggcggagagggcgcgccgctggcgccgatctaccacgccgcccgcgcccgggcctcgggtctggccgcgcccgtggcggcgctgaacgtcggcggcgtggccaacatcaccctgatcggcgcgaacggcgacttgctggccttcgacaccggccccggcaacggcatgatcgacctgatgctgcaggcgagggggcttggccgcttcgatgaagatggccgcttagccctggccggccgtgtcgatgaggccgtgctggcggcgctgctcgacagtccttacttcgacgctccggcgcccaagtcgctggatcgctatgacttctcgttgaccccggtcgatcatctctccgctgaggacgcggcggcgaccctggtggccttcaccgccgaggcggtgttcaaagccttcgcccagtccggcgaggcgcccagcgccctgatcgtctgcggcggtggccggcataatccggcgatcatgcagaccctggccgcgcgcgcgcctgtaccggtcaagagcgccgaggcctatggctggcgcggcgacagcatcgaggctgaggccttcgcctatctggccgcccgtacggccaagggcctgccgatcagcttcccggggacgacaggcgtcccggcgccgatgaccggcgggcggatcgtcgggctgatttccgcttag

SEQ ID NO: 29295 - protein, 386 aa, Caulobacter crescentus CB15
MGPSYRFTAMAVNGPMKILGFMTGTSLDAVDMAVLETDGVEISAFGPAGERKLREATRDLLLKTTDIARAWPRGEPEPVIFEEARRAVADEHFQAAESFLDEHGLSWSDFDLLGVHGQTVLHERPTAQRVGRTVQLLDADRLARLCGRPVAFDFRTADVAVGGEGAPLAPIYHAARARASGLAAPVAALNVGGVANITLIGANGDLLAFDTGPGNGMIDLMLQARGLGRFDEDGRLALAGRVDEAVLAALLDSPYFDAPAPKSLDRYDFSLTPVDHLSAEDAAATLVAFTAEAVFKAFAQSGEAPSALIVCGGGRHNPAIMQTLAARAPVPVKSAEAYGWRGDSIEAEAFAYLAARTAKGLPISFPGTTGVPAPMTGGRIVGLISA

SEQ ID NO: 29296 - DNA, 1122 bp, Salmonella typhimurium LT2
  CDS (1)..(1122): transl_table=11
atgaaatcgggccgttttattggcgttatgtccggaaccagccttgatggcgtggatgttgtactggcggcaattgatgaaaccatggttgcgcaacaggcaagtctcacctggcccattcccgttcatctgaaaaaaggcattctcgatatttgccagggacagccgcttacgctctcgcaactcggccagcttgatacccagttaggccggctttttgcacaggcggttaatgcgctgttagcgcaacaacgtttgcagccgcgggatatcgtcgccattggttgtcatgggcaaacggtctggcatgaaccgaccggcgaggccccgcatacgctgcaaattggcgataataatcacatcgtcgcccatacggggattacagtggtcggcgattttcggcggcgggatattgcgctgggcggacaaggcgcgccgttggtgcctgctttccatcacgcgctgttgggacatccgacggaaaaacgtatggtcctgaatatcggcggcatcgccaatttatctctgcttttccccggacaggcggtgcgcgggtacgacacggggccgggtaatatgttgatggatgcgtggatttggcgacaatgcgcgcagccctacgacaaagacgcggcatgggcgaaagaaggtcaggttattcttccattgctgcaaaagatgttgcgcgatccgtactttgctgcgtcggcgcccaaaagtacaggacgcgaatatttcaactatggctggttagagcgccatcttgcggctttccctggcgcagacgcgcgcgatgtacaggccacgctggcggagctgacggcggtctccatcgcccaacaggtgctgctcaacggcggctgcgagcggctgatggtctgtggcggcggtggccggaatccgttagtgatggcccgtctggcggcgctgttgccaggtatcgaggtttcgaccaccgataaggcggggatcagcggcgatgatatggaagcgctggcctttgcctggcttgcctggcgaacgctcgcgggcctgccgggaaatttaccttccgtgacgggggctacagaagccagtgttttaggcgctatttacccggctaacccaataactcagagttaa

SEQ ID NO: 29297 - protein, 373 aa, Salmonella typhimurium LT2
MKSGRFIGVMSGTSLDGVDVVLAAIDETMVAQQASLTWPIPVHLKKGILDICQGQPLTLSQLGQLDTQLGRLFAQAVNALLAQQRLQPRDIVAIGCHGQTVWHEPTGEAPHTLQIGDNNHIVAHTGITVVGDFRRRDIALGGQGAPLVPAFHHALLGHPTEKRMVLNIGGIANLSLLFPGQAVRGYDTGPGNMLMDAWIWRQCAQPYDKDAAWAKEGQVILPLLQKMLRDPYFAASAPKSTGREYFNYGWLERHLAAFPGADARDVQATLAELTAVSIAQQVLLNGGCERLMVCGGGGRNPLVMARLAALLPGIEVSTTDKAGISGDDMEALAFAWLAWRTLAGLPGNLPSVTGATEASVLGAIYPANPITQS

SEQ ID NO: 29298 - DNA, 1179 bp, Nostoc sp. PCC 7120
  CDS (1)..(1179): transl_table=11
atgtattcttctcaagcatctgccgttcctaaccgtgttgtcggtttaatcagtggcacatctgtagatggtatagatgccgccttagtagagattactggcacagaattggatctgaaagttgagttactagcaggaaaaacatatccttatcctgcggacttaagagaacgcatattggcagtttgtgcaggcgaagctatttccatgttggaacttgcacatatggatgatgcgatcgccctagcttttgcccaagctgctcaaaatattcaaataggttatcagccagcaaatttaattggctctcatggtcaaactgtgtatcatcgaccaccaaaagaagcaggagtagggaagaaaaaccttggttatactctccagcttggtcgtggtgagatgattgcctatttgacgggaattacaactgtcagtaattttcgtgttgctgatatcgctgttggtggtcatggcgcaccacttgttcccagagtcgatgcctttttactgagtcatccccatgaaagtcgttgtattcaaaatttaggtggtattggtaaccttgcctatatcccagcgcgtactgatgactggctttcacaaatttgtggttgggacacaggcccaagtaatagcctgttagatttagcagtagaacgtctgacggctggtgctaaaacctatgatgaagatggtcaatgggcagccagtggaactccttgctatcctttagtcgaaaaatggctcacccatgaatattttcatctctcaccacctaaatcgactggtcgagaattgtttggtgtggcttacctaaatcaatgtttccaagatgccgaaccataccaacttagtccagctgatatgctagcaacacttacggaactaactgtagcttccattgttcacagttaccgtacttttttaccacaaatgccacaacgtgtatttttatgtggcggtggtagtcgtaatttgtatttaaaacaaagattacagttagcgttagaaacagtcccagtcttgaccaccgatgaagcaggcgtgagtgccgactttaaagaagcgatcgcctttgctgttttagctcactggcgacaattagccattccaggcaacctaccaacagccacaggcgcaccacatgaagttttgttgggagaaattcatcaagggtga

SEQ ID NO: 29299 - protein, 392 aa, Nostoc sp. PCC 7120
MYSSQASAVPNRVVGLISGTSVDGIDAALVEITGTELDLKVELLAGKTYPYPADLRERILAVCAGEAISMLELAHMDDAIALAFAQAAQNIQIGYQPANLIGSHGQTVYHRPPKEAGVGKKNLGYTLQLGRGEMIAYLTGITTVSNFRVADIAVGGHGAPLVPRVDAFLLSHPHESRCIQNLGGIGNLAYIPARTDDWLSQICGWDTGPSNSLLDLAVERLTAGAKTYDEDGQWAASGTPCYPLVEKWLTHEYFHLSPPKSTGRELFGVAYLNQCFQDAEPYQLSPADMLATLTELTVASIVHSYRTFLPQMPQRVFLCGGGSRNLYLKQRLQLALETVPVLTTDEAGVSADFKEAIAFAVLAHWRQLAIPGNLPTATGAPHEVLLGEIHQG

SEQ ID NO: 29300 - DNA, 1161 bp, Ralstonia solanacearum GMI1000
  CDS (1)..(1161): transl_table=11
atgctcacgcgcatgacgacacttgcctcctccatcagcgagcgctacatcggcctgatgtccggcaccagcctggacggtgtcgacggcgtgctggtcgacttctccggcccgcgtccgatgctgctgacggacgcctacgtgccctttccgcccgcgctgcggcaggcattcttcgacctgcagtccgccggccacaacgaaatccaccgcgaggcgctggccgccaacgcgctggccgacctgtacgccgaatgcgtcgcgcaactgctgcatgagagcggctgcgatccgcgcgaagtccgcgccatcggcgcccacggccagaccatccgccaccagcccggcgagcacgacggcatcggctatacacggcagacgcagcacgccgccgtgctcgccgagcgcaccggcatcgacgtcatcgccgatttccgcagccgcgacatcgccgccggcggtcagggcgcgccgctggtaccggccgtgcaccgcgcactgttcgcgctgcccgatgcctggcgcgtggtctgcaacatcggcggcatcgccaacctgaccgtgctgccgccgcagcagtcggatgcgcgcgaccgggtgctcggcttcgactgcggcccgggcaacgcgctgctcgactactgggtccatgcccaccgcggcgaagcctacgaccgcaacggcgagtgggcccgcagcggctggatcgacgccgcgctgctcgagaccctgcgcagcgagccgttcttcgccaggatgccacccaagagcaccggccgcgacctgttcaacccgacctggctgcagcagcaggccggcgacacgcttgagcgcatccgccccgaggacgtgcaggccaccctgctcgccctgacggccgacaccattgccgatgccgtccgcacccacgcaccgcgtaccgcatccctcgtggtctgcggcggcggcgcccgcaacggcgcgctgatgcagcggctggcggcacagctgccaggtaccctggtcgccgcgagcgatgacttcggggtccccgcgcatcaggtcgaggcactggccttcgcctggctggcgcgccagtgcgtgcgccgcgaacccggcaacgtctaccatgccaccggtgcggccggcccccgcgtgctgggcacgatctatccggcctag

SEQ ID NO: 29301 - protein, 386 aa, Ralstonia solanacearum GMI1000
MLTRMTTLASSISERYIGLMSGTSLDGVDGVLVDFSGPRPMLLTDAYVPFPPALRQAFFDLQSAGHNEIHREALAANALADLYAECVAQLLHESGCDPREVRAIGAHGQTIRHQPGEHDGIGYTRQTQHAAVLAERTGIDVIADFRSRDIAAGGQGAPLVPAVHRALFALPDAWRVVCNIGGIANLTVLPPQQSDARDRVLGFDCGPGNALLDYWVHAHRGEAYDRNGEWARSGWIDAALLETLRSEPFFARMPPKSTGRDLFNPTWLQQQAGDTLERIRPEDVQATLLALTADTIADAVRTHAPRTASLVVCGGGARNGALMQRLAAQLPGTLVAASDDFGVPAHQVEALAFAWLARQCVRREPGNVYHATGAAGPRVLGTIYPA

SEQ ID NO: 29302 - DNA, 1122 bp, Agrobacterium tumefaciens str. C58
  CDS (1)..(1122): transl_table=11
gtgggcgaggtcaaaacggcaatcgggctgatgagcggcacatcgatggacggcatcgatatcgcggtgttgcgcacggatggcgagagcgtggtccggcacgggccgagcggttattttccctatgatccgggtctgcggggcatctggcagaaggcgctcacgacagccaaagccattcgcgaacggcgcgagcgtccgggcgatctgggggaggctgaacgcaagctgacgcttgcccacgcggctgcggtcaaatccttcctgcaccggcaccggtttgacgtcggtgatatcgatgtgatcggttttcatggacagaccgtgctgcaccggccggatgaggcattgaccgtgcagatcggtgacggcgcgcttctggccgaggaaaccggtatcgatgtggtttacgatatgcgcgcgaacgacatggtgcatggagggcagggtgcgccgctcattcccgcctatcacatggcactgtcagccaatctgccggatgggttcgaaacgcccgccgtcttcgtcaatatcggcggcatctccaacctgacctatatcggcgagggtggccggcttgcggctttcgacagtggtcccggcaatatgctgatcgaccagtggatcgaggcgcatacgggcaaggccttcgacaagggcggcaggacggcggcaggcggcagcgtcgttgcctcgctggtggcgcgttatatggaaagcccgttcttctcggccaatatccgccgctccctcgaccgcagcgatttcgtgccgccgcaaaagggtgaggtatcgctggcggatggggcgcggacgctctcgcatctgacgggggcggcgatcctcaaatcggcgagctatttgccggaagcggcgaagacctatgtggtctgcggcggcggaaggcttaacccagttatcatggaagagttagcggggcttgctgcaaagcagggcgcgcgggtgatcgcggcggaagaggcgggtttcgatggcggggcgatggaggcggaggcttgggcctatctggcggtccgttcgctgagggggctgccgctgacctatccggggactacgggggtgaaggagccggtgacgggtggggttttggtgcgggcgtaa

SEQ ID NO: 29303 - protein, 373 aa, Agrobacterium tumefaciens str. C58
MGEVKTAIGLMSGTSMDGIDIAVLRTDGESVVRHGPSGYFPYDPGLRGIWQKALTTAKAIRERRERPGDLGEAERKLTLAHAAAVKSFLHRHRFDVGDIDVIGFHGQTVLHRPDEALTVQIGDGALLAEETGIDVVYDMRANDMVHGGQGAPLIPAYHMALSANLPDGFETPAVFVNIGGISNLTYIGEGGRLAAFDSGPGNMLIDQWIEAHTGKAFDKGGRTAAGGSVVASLVARYMESPFFSANIRRSLDRSDFVPPQKGEVSLADGARTLSHLTGAAILKSASYLPEAAKTYVVCGGGRLNPVIMEELAGLAAKQGARVIAAEEAGFDGGAMEAEAWAYLAVRSLRGLPLTYPGTTGVKEPVTGGVLVRA

SEQ ID NO: 29304 - DNA, 1122 bp, Brucella melitensis 16M
  CDS (1)..(1122): transl_table=11
atgcccgatttgaaacgcgcaataggactgatgagcggcacctcgatggatgggatcgacattgctcttcttgctaccgacggcgaaaactggatagagcggcgcgcttctgcctcgatggattattcggatggttttcgcgcgcggctgaaagcagggcttgtcgatgcgcgcgccatcaaagacagggccgagcgtcccggcctgctgcggcagcttgagcatgacctgacattgctccatgccgttgctgttcatgatttccttcacgaacagggcttgcagccgcacgagatcgacgtgatcggttttcatggccagacggtgctgcatcgctcgaacgagagcctgactgtccagatcggcgacggcgcgctgctggctcgcgaaacgggcattcctgtcgtttatgacatgcgggcggaagacatgcgccatggtggtcagggtgctcccttgattcccgcctaccatgccgctttggcggccaatctgccgcttggcctcaaaggcccggtcgtcttcgtcaatatcgggggcatctccaatctcacctatgtcggcgaggatggcgcgctgatcgcctatgacagcgggccgggaaacatgctcatcgatcaatggatggaactgcatgggcatggccggtttgatccgggcggtgcaactgcgatgagcggaagtgtggaccgaaacaccgcccaccgatatctcgaacatgaattcttcaagggaaaccaccgccgttcgctcgatcgtggcgatttcgccattccggccaagggtgaattgaaccttgccgatggcgcgcgcacacttgcatttgtaagtgcggcggcaatcctcaaatccgcttcgcatctgcctgcccgtccgcgcacctatgtggtgagcggtggagggcgcaagaatggtgcgctcatggacgagctgaccgcgcttgccgagcgccagggcgcgcatgtgatcgatgcggataatgccggtttcgatggggacgccatggaggcagaggcctgggcctatcttgcagtgcgttcgctttgcggcctgccgctcacctatccctccacgacgggctgcgacaagcccgtttccggcggcgttcctgttaggccctaa

SEQ ID NO: 29305 - protein, 373 aa, Brucella melitensis 16M
MPDLKRAIGLMSGTSMDGIDIALLATDGENWIERRASASMDYSDGFRARLKAGLVDARAIKDRAERPGLLRQLEHDLTLLHAVAVHDFLHEQGLQPHEIDVIGFHGQTVLHRSNESLTVQIGDGALLARETGIPVVYDMRAEDMRHGGQGAPLIPAYHAALAANLPLGLKGPVVFVNIGGISNLTYVGEDGALIAYDSGPGNMLIDQWMELHGHGRFDPGGATAMSGSVDRNTAHRYLEHEFFKGNHRRSLDRGDFAIPAKGELNLADGARTLAFVSAAAILKSASHLPARPRTYVVSGGGRKNGALMDELTALAERQGAHVIDADNAGFDGDAMEAEAWAYLAVRSLCGLPLTYPSTTGCDKPVSGGVPVRP

SEQ ID NO: 29306 - DNA, 1191 bp, Thermoanaerobacter tengcongensis MB4
  CDS (1)..(1191): transl_table=11
atggataggttattgcgtatttacaataaagaagaaagattagtggttgggttaatgtccggtacttctgctgacgggattgatgctgctcttgtgaaggtcaaagggagaggtttagatacaaaggttgaacttttagaattcgaaaagtttccgtacgaagaggaagtgcaaaagaagatatttgagctttttgacccccatactggaactgttgagaagatatgccatatgaattttttactcggtgaactgtttgcagaagctaccttaaaactcattaaaaaagcaggtttaaccccgaaagatatagatttaatagggtctcacgggcagaccatataccatattcctaactttattgaagatatgggatataaagtccgttctactcttcaaataggggaaccagcagtaatagctgaaagaactggaattgtaacagtggctgattttagggtaagagatgtagctgcaggagggcaaggagctcctttagtaccttacactgaatatatcttgtataggtcaccaaatgaaacaatagccttacaaaatataggtggaattggcaatgttactgttttgcctaaaggaggtagtatagaagacgtaattgcatttgatacaggtcctggaaacatggtgatagatgaagttgtgaagaggattactcatgggaaaatgaatttcgacaaagatggtgaattagcatctcgcgggaaagtaaatgaagaatttttagcagagctgttaaaagatgaattttttaaaatgaagcctccaaagaccactggcagagagcattttgggaaaaattatgtggataatttgatgaaaaaggcttcctacttggaaatagataaatacgatttggttgctactgttacagctttaactgcttattcagtggtgagaagctacgaaaagtttatatttccctactacaaagttgacaaagtagtaataggaggtggaggaagtttcaacaaaacccttgtacaaatgataaaaaaacagttgcctcaggttagggtaataacgcaagaagacataggatttaatagcgatgccaaagaagctgttgcttttgcaatccttgcaagtgagactataaatggcaattttaacaatattccaaaagcaacaggagcaaaacatccggtagtaatgggaaaaatttctttatag

SEQ ID NO: 29307 - protein, 396 aa, Thermoanaerobacter tengcongensis MB4
MDRLLRIYNKEERLVVGLMSGTSADGIDAALVKVKGRGLDTKVELLEFEKFPYEEEVQKKIFELFDPHTGTVEKICHMNFLLGELFAEATLKLIKKAGLTPKDIDLIGSHGQTIYHIPNFIEDMGYKVRSTLQIGEPAVIAERTGIVTVADFRVRDVAAGGQGAPLVPYTEYILYRSPNETIALQNIGGIGNVTVLPKGGSIEDVIAFDTGPGNMVIDEVVKRITHGKMNFDKDGELASRGKVNEEFLAELLKDEFFKMKPPKTTGREHFGKNYVDNLMKKASYLEIDKYDLVATVTALTAYSVVRSYEKFIFPYYKVDKVVIGGGGSFNKTLVQMIKKQLPQVRVITQEDIGFNSDAKEAVAFAILASETINGNFNNIPKATGAKHPVVMGKISL

SEQ ID NO: 29308 - DNA, 1176 bp, Streptomyces coelicolor A3(2)
  CDS (1)..(1176): transl_table=11
gtgcgtgtgatcggcctgatgtcgggcacgtcctacgacgccgtcgaggcggccgccgcggacctcgaactggagggcgaggccctggtgatgcgcccgctcggccatctctccgccccctacccggacgggctgcgggacctgatcgcggacagcctgcccccggcggccgcgaccgtccggaccgtggcccggctcgacaccggcatcgggcaggccttcgccgacgtggccgtgcgggcggtgcgcgagctgtgcgggggcgccgccggtctggtggtctcgcacgggcagaccctgtaccactgggtggaggacggcgccgtgcgcggcaccctccagctcggccagcccgcctggatcgccgaggcgaccggtctgcccgtcgtctccgacctgcgcggcagggacgtcgcggccggcggtcagggggcgccgctggtcgccatgaccgacgtcctggccatggcggcgctgcccggcgtccccgccgccctcaacctcggcgggatcgccaacgtcaccgtcgtcgccccgggcgccgagccgctggccttcgacaccggcccggccaacgcgctgatggacgccgccgtacggcacttcaccggcggtgcggccgccttcgacgaggacgggcgccgggccggggccggccgggtcgatccggggctgctgcgggtgctgctggacgacccgtactacggcaggccggctccgaagagcaccggcaaggagcagttccacctgccgtatctgctggcggcgctcgcggcggcgcccgtggcggaacccgacgacgtcctggcgaccctggcccggctcaccgccgtcacggtggccgacgcctgccgggcgcacggcgtgacgcggctcgtcgtgtccggcggtggcgcgcgcaaccccgtgctgatgggcatgatcgccgaggagctgcccggggtggacctcggttccagcgacgcgctcgggctgccgtccgacgccaaggaggcacttgccttcgccctcctgggcttcctgaccgtcaacggcctgcccggcgcgatcccctcggggacgggtgcgcgccgggcgtcactgctcggcagcatcacgcccgggcgggagcccctgcggctgcccgagccggccggcgagccgccccgggtgctgcgcgtcgtcggcgggccctga

SEQ ID NO: 29309 - protein, 391 aa, Streptomyces coelicolor A3(2)
MRVIGLMSGTSYDAVEAAAADLELEGEALVMRPLGHLSAPYPDGLRDLIADSLPPAAATVRTVARLDTGIGQAFADVAVRAVRELCGGAAGLVVSHGQTLYHWVEDGAVRGTLQLGQPAWIAEATGLPVVSDLRGRDVAAGGQGAPLVAMTDVLAMAALPGVPAALNLGGIANVTVVAPGAEPLAFDTGPANALMDAAVRHFTGGAAAFDEDGRRAGAGRVDPGLLRVLLDDPYYGRPAPKSTGKEQFHLPYLLAALAAAPVAEPDDVLATLARLTAVTVADACRAHGVTRLVVSGGGARNPVLMGMIAEELPGVDLGSSDALGLPSDAKEALAFALLGFLTVNGLPGAIPSGTGARRASLLGSITPGREPLRLPEPAGEPPRVLRVVGGP

SEQ ID NO: 29310 - DNA, 1125 bp, Xanthomonas axonopodis pv. citri str. 306
  CDS (1)..(1125): transl_table=11
ttggaacacgttgactcccccttgtacctgggcctgatgtcgggcaccagcgccgacggcatcgatgccgcgctggtgcgctttgccgatgacacccaccgccgctgcgaattggtggccgggacgacggtggcgtgggagccgcagttgcgcgagaccttggtggcgctcggccagggcgccgagacggtggccatcgatgcgctaggccagctggacgcgcaggtggggctggcgttcgcggcggcggccaatcagttgatcggcgacagcggcgtggagcgtcgccagattcgcgcgatcggctcgcatgggcagaccatccgccaccggcccaacgcgagcccggcgttcacctggcagatcggcgatgccagccgaattgccgagcacaccggcattaccacggtggccgatttccgacgtcgcgatgtggctgccggtggccagggcgcgcccctgatgcccgccttccatctggccatgctgggcgcaggcgacgaagaccgcgccgtgctcaatctgggcgggatcggcaacctgaccttgattccgcgcgatggcgcggtgcggggattcgataccggcccggccaatgcgttgctggacagctggtgtcaacgccatcacggcacgccgttcgatgccgatggtgcatttgccgccagtgggcgcgtcgatgcggccttgttgcaggcgctgttggccgatccgtggtttgcgttgccaccacccaagagcaccggccgcgagcaattccatctggactgggcagtgcaggcgatgggcaacgcgcggttggatgctgccgatgtgcaggcgaccttgctcgaactcaccgctgccagcgtggccgatgcgttgctgcggctgcagcccaccacgcgccgggtgctggtctgcggcgggggcgtacgcaacccggtgctgttggcccgactggcggcgcggctgccgggcgcgatggtggaatccagcgcgcggtacgggctggacccggattacctggaggcgatgggctttgcctggctggcagccgagttgctggccggacgcgctgccaatctgccctcggtgactggggccgccgggccccggctgttgggagcgatctatccggcgtga

SEQ ID NO: 29311 - protein, 374 aa, Xanthomonas axonopodis pv. citri str. 306
MEHVDSPLYLGLMSGTSADGIDAALVRFADDTHRRCELVAGTTVAWEPQLRETLVALGQGAETVAIDALGQLDAQVGLAFAAAANQLIGDSGVERRQIRAIGSHGQTIRHRPNASPAFTWQIGDASRIAEHTGITTVADFRRRDVAAGGQGAPLMPAFHLAMLGAGDEDRAVLNLGGIGNLTLIPRDGAVRGFDTGPANALLDSWCQRHHGTPFDADGAFAASGRVDAALLQALLADPWFALPPPKSTGREQFHLDWAVQAMGNARLDAADVQATLLELTAASVADALLRLQPTTRRVLVCGGGVRNPVLLARLAARLPGAMVESSARYGLDPDYLEAMGFAWLAAELLAGRAANLPSVTGAAGPRLLGAIYPA

SEQ ID NO: 29312 - DNA, 1155 bp, Yersinia pestis KIM
  CDS (1)..(1155): transl_table=11
ttgtggttattttattcctcaatggagaataaggtcattgtgatgaaatcaggccgttttattggagtgatgtcaggaaccagcctggacggtgtggatgttgttctggcagctattgatgagcgtatggtggcgcagcaagcctcatatacccatccaattccactacaactgaaaaaagacatccttggtatgtgtcaggggcagtccacgaccttgtcagcagtgggaaaacttgatgcccaactgggtattctgtttgcagaagcggtgttggctttactcgccaaagaagggttgtctgcgcaggatattaccgccattggttgccatgggcagactgtctggcatgaaccattaggtgaacccgcctttactatgcaactcggcgacaataatcgtattgccgcgatgacccaaattgccactgtgggggatttccgccgtcgtgatatggcctatggcgggcagggggcccccttggtgcccgctttccatcatgcgttattagcgcatgcgacggaaaaacgtatggtcttgaatattggtgggattgctaatttatccgtcctactacctgattcgcctattcggggttttgatactggccccggtaatatgttgatggatgcatggatctggcgcaattgctcattaccttatgataaagatgcctgctgggcgttatcagggcatgttaatcagccgttgcttgagcaaatgttcaacgatccttactttcggttacctgcgccgaaaagtaccggtcgtgaatacttcaatgccgcgtggctggataagcaactggccagaatcccaggggtaaccgctgaagatatacaggcaacattggctgagttaacggcggtatcgatcacggaacaggttcggttagcgggaggatgtgatcgcttgctggtgtgtggcgggggggctcgtaacccattagtcatggcgcgcatctcagcgttactgtcgggaacggaagtgtgtactaccgatgacgcgggtatccgtggtgacgatatggaagcactggcgtttgcctggctggcgtttcgcacgttgtctggtaaaccgggtaatttgccttctgtcacgggggccagccgcgagaccattttaggagcagtccatcctgtatcatcatggtga

SEQ ID NO: 29313 - protein, 384 aa, Yersinia pestis KIM
MWLFYSSMENKVIVMKSGRFIGVMSGTSLDGVDVVLAAIDERMVAQQASYTHPIPLQLKKDILGMCQGQSTTLSAVGKLDAQLGILFAEAVLALLAKEGLSAQDITAIGCHGQTVWHEPLGEPAFTMQLGDNNRIAAMTQIATVGDFRRRDMAYGGQGAPLVPAFHHALLAHATEKRMVLNIGGIANLSVLLPDSPIRGFDTGPGNMLMDAWIWRNCSLPYDKDACWALSGHVNQPLLEQMFNDPYFRLPAPKSTGREYFNAAWLDKQLARIPGVTAEDIQATLAELTAVSITEQVRLAGGCDRLLVCGGGARNPLVMARISALLSGTEVCTTDDAGIRGDDMEALAFAWLAFRTLSGKPGNLPSVTGASRETILGAVHPVSSW

SEQ ID NO: 29314 - DNA, 1140 bp, Thermosynechococcus elongatus BP-1
  CDS (1)..(1140): transl_table=11
atgatgcgggtcattggcttgatgagcggaacctctgtggatggcattgacgcggtcttggtggagctatgggggggcgatcgcgacctgcaggtaacggtgttgaatttttgtaccgtgccctatccagacgccctgcggcagcgtattcttgaggtttgtggtgcaaaatccttaaccctggctgagttggcggccttggatgaggcaatcgccgaggccttcgcccatgcggcgcaaagggttcaacggggctatccacgggcagatctcattggctcccatggtcaaacggtctttcatcgcccccccgtaggcgatcgcctaggctacagcctacaactgggacggggggattggattgcttggcgtacaggcatgaccaccattgccaactttcgcgctcaggatattgccctgggtggtcaaggggcgccccttgtgccgcgggtggattggtgtcttttgggtcatgccacggaagtccgctgtgtgcaaaacatcggtgggatcggcaatgtcacctacttgcccgctcagctcgaggatcctgaggggaaaggggtcatgggctgggatacaggtcccggcaatatgctgcttgatctggcggtaacggagttatcggggagtgaattgacctatgatcctgatggcacatgggcacgacagggcaaaattagcgagcccctagtggagcactggctgcaggaccccttctttcaccagccgccgccaaaatccactgggcgggaatactttggtctgcccttttggcaacgctgccgtacggatgccactggtttggcacctgcggatcttctagccacgctaacggaatttacagctcgcagtatcgttgagagctatcgccaatttttgccccaatggccacagcgcatcttcctatgtggcggcggtgcccacaattcttttctcagggagcggctgcaggtgcatttaggagaccttcccgtggaaaccactgctgcggcggggattgcagtggatgcaaaggaggcgatcgccttcgcaattttggcctactggcatgagttgggcttgccagggaatttgccccaggttacgggggcacgccaggcggttcccttaggtcaacgttggctaggacagcgatga

SEQ ID NO: 29315 - protein, 379 aa, Thermosynechococcus elongatus BP-1
MMRVIGLMSGTSVDGIDAVLVELWGGDRDLQVTVLNFCTVPYPDALRQRILEVCGAKSLTLAELAALDEAIAEAFAHAAQRVQRGYPRADLIGSHGQTVFHRPPVGDRLGYSLQLGRGDWIAWRTGMTTIANFRAQDIALGGQGAPLVPRVDWCLLGHATEVRCVQNIGGIGNVTYLPAQLEDPEGKGVMGWDTGPGNMLLDLAVTELSGSELTYDPDGTWARQGKISEPLVEHWLQDPFFHQPPPKSTGREYFGLPFWQRCRTDATGLAPADLLATLTEFTARSIVESYRQFLPQWPQRIFLCGGGAHNSFLRERLQVHLGDLPVETTAAAGIAVDAKEAIAFAILAYWHELGLPGNLPQVTGARQAVPLGQRWLGQR

SEQ ID NO: 29316 - DNA, 1110 bp, Shewanella oneidensis MR-1
  CDS (1)..(1110): transl_table=11
atgaacaaggcttattatattggactgatgtcaggcacgagtatggacggcgttgatgctgtgctggtcgattttgcgggcgagcaacctcagcttattggtactcataccgagacaattccaacgcatttactcaaaggtttacagcgtttgtgcttaccgggtacagatgagattaatcgtcttggtcgtcttgatcgcagtgtcggcaaactgtttgcactggcggtcaataatctgctcgccaaaaccaagattgcgaaagatgagattattgccattggcagtcacggccaaaccgtgcgccatatgccgaaccttgaagtcggttttacgctgcagattggcgatcccaacaccatagccacagaaacaggtatagatgtcattgctgatttccgccgtaaagacattgcgttaggtgggcaaggcgctccgttggtgcccgccttccaccagcagacgtttgcccaagtcggtaaaaaacgtgtcatcctcaatattggtggtattgccaacatcacctatctgccgggcaatagcgaagaagtcttaggctttgatactgggccaggcaacaccttaatcgatgcatgggtccagcaggtaaaaaatgagtcctatgacaaaaacggggcgtgggcggcatcgggtaagactgatcctcaattactggcgcaattgctctcacacccttatttttcccttgcctatcctaagagcactgggcgagagttgtttaatcaggcttggttagaacagcaattatcggcttttaatcaattaaatgaggaagatatccaatcgacactactggatttaacctgccacagtatcgctcaagatatcctcaagctcgctcaggaaggcgagctatttgtctgtggtggtggcgctttcaacgccgagctaatgcagcgtttggcggcactactgccaggttatcgcatcgatacgacctcggcactgggtgttgatcccaaatgggctgaaggcattgcctttgcttggctcgccatgcgttatcaattaggcctgcccgccaatctgccagcggtcaccggtgcctcccgcgaagccatattgggtggacgttttagcgcgaaataa

SEQ ID NO: 29317 - protein, 369 aa, Shewanella oneidensis MR-1
MNKAYYIGLMSGTSMDGVDAVLVDFAGEQPQLIGTHTETIPTHLLKGLQRLCLPGTDEINRLGRLDRSVGKLFALAVNNLLAKTKIAKDEIIAIGSHGQTVRHMPNLEVGFTLQIGDPNTIATETGIDVIADFRRKDIALGGQGAPLVPAFHQQTFAQVGKKRVILNIGGIANITYLPGNSEEVLGFDTGPGNTLIDAWVQQVKNESYDKNGAWAASGKTDPQLLAQLLSHPYFSLAYPKSTGRELFNQAWLEQQLSAFNQLNEEDIQSTLLDLTCHSIAQDILKLAQEGELFVCGGGAFNAELMQRLAALLPGYRIDTTSALGVDPKWAEGIAFAWLAMRYQLGLPANLPAVTGASREAILGGRFSAK

SEQ ID NO: 29318 - DNA, 1092 bp, Pseudomonas putida KT2440
  CDS (1)..(1092): transl_table=11
atggcgctctacttgggggtgatgtccggcaccagcctcgatggcctggatatcgccctggtcgaacaaggcgagcagcttgaactgctcgccacccactacctgcccatgcccccggacctgcgccaggacctgctggccctgtgcagcagcggccctgacgagattgcccgtgcagcactggcggaaaaccgctgggccagcctggccggcgaaggtatccgccaactgctggctcgccagggactgaagcccgaagccgttcgcgccatcggcagccacggccagaccattcgccatgaaccggcccgcggctttactgtgcagatcggtaaccccgcactgctcgccgaactgaccggcatcagcgtggtcgccgacttccgccgtcgcgatgtggctgccggcggccaaggcgcgccactggtaccggccttccacgaaaccctgttcagccagcttggccgacgcctggcaatccttaacgtaggcggtttcagcaacctcagcctgatcgagcaggacaagccggttcatgggttcgattgcggcccggggaacgtgttgctggatgcctggatcgagcgcgagcacggccacccctatgatgcagatggcgcctgggctgcctcgggtgtggctcagcccgggttgctcagcgcactgatggctgacccgttctttgccggcagcggcccgaagagtaccggccgcgaggtgttcaacctgccttggctggatcgccacctggccaacctgccggcataccgggcccaggacgtgcaggcgacactgctggaactgaccgcacgcagcatcatcgattcgcttggcaaagcccagcaaggcaccgaggcgctgttggtctgtggtggaggcgcccgcaacggcgcgctgatggcccgtcttggccagctgctacctgcggcccgtgtcgcaagcactggcgcctatggcgtagacccggactgggtcgaagccatggccttcgcctggctggctcactgctgcctggagggtatcgccgccaaccgccccagcgtcactgccgccaagggcctgcgcgtactgggcgcaatctacccggcatag

SEQ ID NO: 29319 - protein, 363 aa, Pseudomonas putida KT2440
MALYLGVMSGTSLDGLDIALVEQGEQLELLATHYLPMPPDLRQDLLALCSSGPDEIARAALAENRWASLAGEGIRQLLARQGLKPEAVRAIGSHGQTIRHEPARGFTVQIGNPALLAELTGISVVADFRRRDVAAGGQGAPLVPAFHETLFSQLGRRLAILNVGGFSNLSLIEQDKPVHGFDCGPGNVLLDAWIEREHGHPYDADGAWAASGVAQPGLLSALMADPFFAGSGPKSTGREVFNLPWLDRHLANLPAYRAQDVQATLLELTARSIIDSLGKAQQGTEALLVCGGGARNGALMARLGQLLPAARVASTGAYGVDPDWVEAMAFAWLAHCCLEGIAANRPSVTAAKGLRVLGAIYPA

SEQ ID NO: 29320 - DNA, 1164 bp, Vibrio vulnificus CMCP6
  CDS (1)..(1164): transl_table=11
atgaatttgcattacaatggtttgcatgatgaaaacacaatggaattgagtgtgagcacaaaagagttatatatcggtgtcatgtccggcacgagtatggatggggtagattgtgccctcgtggagttcgaccaagagcaagtccgcttaattgcccacagtgactacccgatgccagcagatttgcgccaaaaactgctctccgtttgcaccgggcaagccaccaacttaaagcagattggcgaacttgatcaccgcctcggtcatctttttgccgatgccgtgatggatttgctcagccaagcaggcgtcgacacgagccagattcgcgctatcggtaatcatggccaaacggtatttcatcaaccgaatggcgagtttccttttaccacccaattgggcgacgccaacattattgccacccgcaccaacattgacaccgtggcagattttcgtcgcaaagacatggcattgggcggccagggcgcccctttggttccggcttttcatcaaagtgtatttgcgctgcaagattccactaccgtggtgttgaacatcggcgggattgccaatatctcagtgctccacccaactcgccctgttcttggttacgacacaggacctgggaatatgttgatggatgcttggtgtgaaacacacacacaacagaattacgacaaagacgcacggtttgctcttcaaggagaggtgaatgaggcgttactgaatacgctgttgcaagagccttatttgcatcaagatgccccaaagagcacagggcgcgagcttttcaatatggaatggttgacagcaaaactgcaagggcagaactatcgaagcgaagatgtacagcgcaccttgtgtgagtacaccgccttaaccattagtaaagaagttgagcgctttcgctatggtccaacaccgcagttgctggtttgtggtggcggcgcacgtaacccactgttgatgcaacgattgcagcaacagctgtctcactggcaggtctcaacgaccgatgcaaaaggggtcagtggggactacatggaagccatggcgtttgcttggttggcctatcgccacctgcaccgcttaccaagcaatctacccgaagtgactggcgcgagccgcttggcaagcctcggtgtactctattccaaagcctag

SEQ ID NO: 29321 - protein, 387 aa, Vibrio vulnificus CMCP6
MNLHYNGLHDENTMELSVSTKELYIGVMSGTSMDGVDCALVEFDQEQVRLIAHSDYPMPADLRQKLLSVCTGQATNLKQIGELDHRLGHLFADAVMDLLSQAGVDTSQIRAIGNHGQTVFHQPNGEFPFTTQLGDANIIATRTNIDTVADFRRKDMALGGQGAPLVPAFHQSVFALQDSTTVVLNIGGIANISVLHPTRPVLGYDTGPGNMLMDAWCETHTQQNYDKDARFALQGEVNEALLNTLLQEPYLHQDAPKSTGRELFNMEWLTAKLQGQNYRSEDVQRTLCEYTALTISKEVERFRYGPTPQLLVCGGGARNPLLMQRLQQQLSHWQVSTTDAKGVSGDYMEAMAFAWLAYRHLHRLPSNLPEVTGASRLASLGVLYSKA

SEQ ID NO: 29322 - DNA, 1146 bp, Xylella fastidiosa Temecula1
  CDS (1)..(1146): transl_table=11
atgcctgtgcatgatgatcactgcaatccaaatccagctcctctctacctcggtctcatgtccggcaccagcatcgacggcatcgacgcagcgttggtacggattaacgcaaacccgataacacattgtgagctgattgccgcgcaaacctccgcttgggaccctaacctacgcacgacattgttggaactaagtcaaggacagaacacagcatcccttgaccaactaggctggctcgacgcccaagtcggactggccttcgccacagccgctaatacactgatcgcaaaaacgggcataaagcacacacagatacgtgcaattggctctcatggccagaccatacgccatcgcccacacggcgatctacccttcacttggcaattaggcgatgcccaccggatcgccgaactcactggaatcactaccgtcgcagacttccgacgccgtgacgtggctgccggcggccaaggcgcaccactcatgcccgctttccatctagcgatccttggatccgccaatgaaaaccgagcagtgctgaacttaggcgggattgcaaacttgacactgatcccgatgaccggtccagtactcggcttcgacaccggaccagcgaacgcactgctcgacagctggtatcaacgccatcatcacgagacattcgatcaaagcggtaacttcgccgcaagcggcaaaatcaaccagaagttactggcctgcctgctagacgacccttggttcaccctcccacctcccaaaagcacagggcgcgaacaattccatttggactggatgaccaaacaactagaacctacaccaccatcaccagccgatgtgcaggcaacactgctcgaactgaccgcagtcaccgtagcagatgccctactacgccaacaacccaagacgactcggctactgatatgcggtggcggtgcgcataacccagtattgatggcacgcctggccacacacctacccaacgtaacagtggaatcgattcaaacctatggactcaatccggactatctggaagcaatggggtttgcttggctggccgcacaaacactggacggccaaccaagtaacctgccaagcgtcactggcgcacgcggcctgcgtttgctcggcgcaatccacccagcctga

SEQ ID NO: 29323 - protein, 381 aa, Xylella fastidiosa Temecula1
MPVHDDHCNPNPAPLYLGLMSGTSIDGIDAALVRINANPITHCELIAAQTSAWDPNLRTTLLELSQGQNTASLDQLGWLDAQVGLAFATAANTLIAKTGIKHTQIRAIGSHGQTIRHRPHGDLPFTWQLGDAHRIAELTGITTVADFRRRDVAAGGQGAPLMPAFHLAILGSANENRAVLNLGGIANLTLIPMTGPVLGFDTGPANALLDSWYQRHHHETFDQSGNFAASGKINQKLLACLLDDPWFTLPPPKSTGREQFHLDWMTKQLEPTPPSPADVQATLLELTAVTVADALLRQQPKTTRLLICGGGAHNPVLMARLATHLPNVTVESIQTYGLNPDYLEAMGFAWLAAQTLDGQPSNLPSVTGARGLRLLGAIHPA

SEQ ID NO: 29324 - DNA, 1071 bp, Pseudomonas syringae pv. tomato str. DC3000
  CDS (1)..(1071): transl_table=11
atgtctggcagcagtctcgacgggattgatatcgcccttttgaagcaggatgaccgttcaaggcttgtggccactcactacattcccatgccggaagacctgcatgccgagttgctggggctttgctccagcggcgcggacgagtttgctcgtgcggcaattgccgaacagaagtggtgcaaactggttgcacagggcgtgcagaccttgctgaaagagcaaaacaaggttgtcgccgatatccgcgccatcggcagccacggccagaccatccgccacgagcctgcgcgcggctacagcattcagatcggcaaccccgcattgcttgcagagttgaccgagattaccgtggtcagcgacttccgccgccgcgatatcgcagcaggcggacaaggcgcacctctggtgcctgcattccacgaggcgttgttcgacgacaataaagaccaccgcgcggtattgaacattggtggcttcagcaacctgagcctgatcgaatccgatcgcccggttgagggtttcgattgcgggcccggcaatgtgctgctggatgcctggatacaatcgcagcgccacgaaagctatgacaaggacggcgcatgggccgcgagcggcaaagttgatcccgagctgctcaaaaaactgctcagcgatccgtttttcctgaccaagggcccgaagagtaccggccgggaagtgttcaacctgggctgggtgcaccaccacctctttcagctgccaacgctggctccggaagatgtgcaagccaccctgctggaactgacggcgctgaccatcaccgaatcgctgcaaacagcccaggcggtcaccaaggagcttctggtctgtggcggcggcgcacataacaaggcgctgatgaagcgcttggctgagctgttgccagacaccgaggtcaacagcaccgagaaattcggcgtggaccctgactgggttgaagcaatggcgtttgcctggctggctcattgctgccttgaaggtgtgccggcgaaccgtccaacggtaaccggcgccaaaggccgcagggttctgggcgctatttaccccgcctga

SEQ ID NO: 29325 - protein, 356 aa, Pseudomonas syringae pv. tomato str. DC3000
MSGSSLDGIDIALLKQDDRSRLVATHYIPMPEDLHAELLGLCSSGADEFARAAIAEQKWCKLVAQGVQTLLKEQNKVVADIRAIGSHGQTIRHEPARGYSIQIGNPALLAELTEITVVSDFRRRDIAAGGQGAPLVPAFHEALFDDNKDHRAVLNIGGFSNLSLIESDRPVEGFDCGPGNVLLDAWIQSQRHESYDKDGAWAASGKVDPELLKKLLSDPFFLTKGPKSTGREVFNLGWVHHHLFQLPTLAPEDVQATLLELTALTITESLQTAQAVTKELLVCGGGAHNKALMKRLAELLPDTEVNSTEKFGVDPDWVEAMAFAWLAHCCLEGVPANRPTVTGAKGRRVLGAIYPA

SEQ ID NO: 29326 - DNA, 1113 bp, Vibrio parahaemolyticus RIMD 2210633
  CDS (1)..(1113): transl_table=11
atgaaatttaacgaactgtacattggtgtgatgtctggaaccagtatggacggcgttgataccgctctggttgagattacagataatcacgttcgcttaattgcgcacggcgactatccaatgccagcggcgatgaaagaaatgctgttatcggtttgtaccggtcaagcgacaaacttaaaagccatcggtgaacttgaccaccagctcggccacctatttgcagatgccgtgttgcagctactcaataagtctggttacgtcgcagaacaaattcgtgcgattggtaatcacggtcagacagtgttccatcagcctaccggagacttgccatttaccactcaattgggcgatgccaacattatcgcggtcaaaacaggcattgatacggtagcggattttcgtcgtaaagacatggcgctgggtggacaaggtgctccactggttcccgcttttcacaaaagcatctttgccatgcaagattccacaacggtcgtgctaaacatcggcggcattgccaacatttcggttttgcatccgcagcaacccgtgcacggctacgatacagggccgggcaatatgttgatggacgcatggtgtgagcgacatacgggtcacggtttcgacaaagacgcgcaacttgccctgcgaggcagcgtcaacgaagcattgctggctcatttacttaaagagccttatctcgcaatgtcagccccgaagagtaccggacgtgaactgttcaacatggattggctacatcaccagttagccaattacgatgtatccgtcgaagacgtccaacgcaccttatgcgaatacaccgcgatcactattgcgcatgacgtaacaaagttcacgtatggcgagactcctcagctgttggtttgcggcggcggtgcacgcaacccacttttgatgcaacgtttagcggaacttctcccccaatggcatgtgacaaccactaccgataaaggcgttgatggcgactacatggaagctatggcgtttgcttggcttgcgcagcgccatattcatgacctccctagcaatttaccggaagtcacaggggcaagtcgcctcgcttcacttggtgtgctctattcaaaaaattaa

SEQ ID NO: 29327 - protein, 370 aa, Vibrio parahaemolyticus RIMD 2210633
MKFNELYIGVMSGTSMDGVDTALVEITDNHVRLIAHGDYPMPAAMKEMLLSVCTGQATNLKAIGELDHQLGHLFADAVLQLLNKSGYVAEQIRAIGNHGQTVFHQPTGDLPFTTQLGDANIIAVKTGIDTVADFRRKDMALGGQGAPLVPAFHKSIFAMQDSTTVVLNIGGIANISVLHPQQPVHGYDTGPGNMLMDAWCERHTGHGFDKDAQLALRGSVNEALLAHLLKEPYLAMSAPKSTGRELFNMDWLHHQLANYDVSVEDVQRTLCEYTAITIAHDVTKFTYGETPQLLVCGGGARNPLLMQRLAELLPQWHVTTTTDKGVDGDYMEAMAFAWLAQRHIHDLPSNLPEVTGASRLASLGVLYSKN

SEQ ID NO: 29328 - DNA, 1119 bp, Coxiella burnetii RSA 493
  CDS (1)..(1119): transl_table=11
gtgccaaaagaacggtatatcggtcttatttccggcacgagcatggatgcgcttgataccgctctcgttcaattcgatccattgaaaatcattgcaacgcatggggaacctatcccgacggaattgaaaaaaaatcttgtggctttatccaccggcactgataattccatccccagcatgggagaaaccgacgttgccttgggacggctttttggcgaagctgtcttaacgctgttagaaaaagcgaaggtttcctcggattccattcaggccattggcagtcacgggcagacaattcgacacatgcccaacgggaaacatccttttactctccaaatcggcgaccctaacaccattgccgccctcaccggcattacgacagtggccgattttcgacgtcgcgatatggctttaggggggcaaggagcgccgttagcgcctgcttttcatgaatttcttttacgcgatcaaagcgaaaaccggttgattttgaatattggcggtattgccaatctcacctttcttccgcgcgaccctgaaaaatctaccattggttttgacacggggccaggaaacactttgttggacgcctggtgcttaatgaatttaaataaagattacgatgatcaaggacagtgggccgcgagtggacgtgtgcaagaaaaattagtagcgcaattgttggcagaaccttattttcaaaccccgccccccaaaagcaccggtcgcgaatattttaaccttaattggcttaaaaaaaatttgaatggcgaaaaatttgatcccgtcgatattcaggcaacgctcgttgaattaacggcaagaagcgttgccaattgctgtcgaaatttttctatggattcgggaagtctgtggttatgcggcggcggggcccgcaatcatcatttggttaatcgtttaaaagtattgtgcaaaccactgcgtgttaccacaacagaagaaattgggattcatcccgattggcttgaagccgtttgtttcgcttggcttgccaaacaaaccttagaaaaaaaacccggcaatttacctagcgtcactggcgctaaaaaatccgctattttaggcgcgatttattggggtgaaaaatttaattattaa

SEQ ID NO: 29329 - protein, 372 aa, Coxiella burnetii RSA 493
MPKERYIGLISGTSMDALDTALVQFDPLKIIATHGEPIPTELKKNLVALSTGTDNSIPSMGETDVALGRLFGEAVLTLLEKAKVSSDSIQAIGSHGQTIRHMPNGKHPFTLQIGDPNTIAALTGITTVADFRRRDMALGGQGAPLAPAFHEFLLRDQSENRLILNIGGIANLTFLPRDPEKSTIGFDTGPGNTLLDAWCLMNLNKDYDDQGQWAASGRVQEKLVAQLLAEPYFQTPPPKSTGREYFNLNWLKKNLNGEKFDPVDIQATLVELTARSVANCCRNFSMDSGSLWLCGGGARNHHLVNRLKVLCKPLRVTTTEEIGIHPDWLEAVCFAWLAKQTLEKKPGNLPSVTGAKKSAILGAIYWGEKFNY

SEQ ID NO: 29330 - DNA, 1155 bp, Streptomyces avermitilis MA-4680
  CDS (1)..(1155): transl_table=11
gtgcgggtgatcggcctgatgtccggaacgtcgtacgacgcgatcgacgcggcggccgccgacctcggcctggccggggaccgtctcgtactgaagccactggggctgatgagcgaggcgtacgactccggcctcagggaggagctcgcggcggcgctgcccccggcggcgacgagcctggccggggtctgccgcctcgacacccggatcgggcaggccttcgcggcggcggccgtgcgggcggaccgtgaactgtgcggcgggcgagccgagttggtggcctcgcacgggcagaccgtctatcactgggccgaggcggggcgggtgtacggcacgctccagctcgggcagcccgcctggatcgccgaggcgaccggactgcccgtggtcgcggacttccgcccgcgcgacatcgccgccgggggtcagggcgcgccactggtcagcctggtcgacctgctgtggctgcgcggccgcgcggggacgtccgtggctctgaacctgggcggcatcgccaacctcacggcccccgacgggaccgcgttcgacaccgggccggcgtgcgcgctgatcgacgcggcggcgcacggtctgagcgggggccgcctcgaccacgacgtcgacggggcgctggcggcccgcggcaccgtgcacgagccgatgctgcgacggctgttggcggagccgtactacgcgctgcccgcgccgaagacgacgggcaaggagctgttccacctcggatatctgcgcgacgcgctcgccggattcgggacactgaccgccgaggacgtgatcgcgacgctcacccggctcaccgcgctgacggtcgcggacgccgtgcgcgcggtgcgggccacggaggtcgtcgcctccggcggcgggacccgcaatcccgtcctgatggagatgctcgcccgggaactgggcgcggtggccctgcgcacctccgacgaactcgggctgccctcggccgcgaaggaggcgtacgcgttcgccgtcctggggttcctgaccgtgcacggcctggcgggcaccgacccggtgagcaccggcgcacggcatcccagtgtgctcgggtcggtgacaccggggcgggacggactgcggctgccgccgcgcgcggactggtcacccgtacggctggtgctggagtga

SEQ ID NO: 29331 - protein, 384 aa, Streptomyces avermitilis MA-4680
MRVIGLMSGTSYDAIDAAAADLGLAGDRLVLKPLGLMSEAYDSGLREELAAALPPAATSLAGVCRLDTRIGQAFAAAAVRADRELCGGRAELVASHGQTVYHWAEAGRVYGTLQLGQPAWIAEATGLPVVADFRPRDIAAGGQGAPLVSLVDLLWLRGRAGTSVALNLGGIANLTAPDGTAFDTGPACALIDAAAHGLSGGRLDHDVDGALAARGTVHEPMLRRLLAEPYYALPAPKTTGKELFHLGYLRDALAGFGTLTAEDVIATLTRLTALTVADAVRAVRATEVVASGGGTRNPVLMEMLARELGAVALRTSDELGLPSAAKEAYAFAVLGFLTVHGLAGTDPVSTGARHPSVLGSVTPGRDGLRLPPRADWSPVRLVLE

SEQ ID NO: 29332 - DNA, 1182 bp, Bacillus cereus ATCC 14579
  CDS (1)..(1182): transl_table=11
atgcacgttatgtatattgcaggggtaatgtctggtacttcattagatggaatagatgtagcgctcgttcatatagaaggaagtggtgtagattctaaaatcgaactcattcattttactactgttccattttgtaatgatatgaaaaatgagatccaacaagcgttatcaattgaaacttcgaatgtccaacttatatgtagtttaaattttaaacttggtttatgcttcgccaatgctgtaaaggaagtttgtaaagaagccaattttcctttgagacaattagatttaataggctctcacggacaaacgatttatcatcagccaaagcaagaagggaatattatttcttcaacattgcaaattggggaaccagcagtaatagcatatgaaacgaacacgacggttatctcgaatttccgaacgatggacatggcggcagggggacaaggtgcaccacttgtaccatattcagagattattttatatcggcatcaaactaaaaatagactactacaaaatattggtggaattggtaatgttacagtggttccaagtaaacgaagtaaagagagtgttattgctttcgatactggaccaggcaacatggtaatcgatgaagtatgtcaaagattatttcatgtaccatatgatcaaaatggttggattgcaaagcagggggtagttgtagatgaaattttaacatactgtatgaaccatccatttttgaacatgaaaccaccaaaatcaacaggtagagaacagtttggagaagcgtttgtgactgaattattgaatcgatttaaaaagcatagtaaagaaaatatattggcaactgtcacgatgtttacagcatgttcaattgttcatcattataaggcgtttattttgccgtattatgaaattgatgaggtgattttaggtggtggtggaagttataataatacacttgttgaaatgttacggaatggattaagagaagagaaatgtagcatatgtatacaagaagatattggtcattcttcagcagcgaaagaagcaattgcatttgctattttagcaaacgaaacgtatcatcgtaatccgagtaatgtgctgagcgcaacaggtgctaagaattccgtaattttagggaatataacattccctccatacgcagatgaaaatgaggcgaatatatga

SEQ ID NO: 29333 - protein, 393 aa, Bacillus cereus ATCC 14579
MHVMYIAGVMSGTSLDGIDVALVHIEGSGVDSKIELIHFTTVPFCNDMKNEIQQALSIETSNVQLICSLNFKLGLCFANAVKEVCKEANFPLRQLDLIGSHGQTIYHQPKQEGNIISSTLQIGEPAVIAYETNTTVISNFRTMDMAAGGQGAPLVPYSEIILYRHQTKNRLLQNIGGIGNVTVVPSKRSKESVIAFDTGPGNMVIDEVCQRLFHVPYDQNGWIAKQGVVVDEILTYCMNHPFLNMKPPKSTGREQFGEAFVTELLNRFKKHSKENILATVTMFTACSIVHHYKAFILPYYEIDEVILGGGGSYNNTLVEMLRNGLREEKCSICIQEDIGHSSAAKEAIAFAILANETYHRNPSNVLSATGAKNSVILGNITFPPYADENEANI

SEQ ID NO: 29334 - DNA, 1092 bp, Nitrosomonas europaea ATCC 19718
  CDS (1)..(1092): transl_table=11
atgtattacgtcggcatcatgtcgggtaccagtctggatggtatcgatgcagtactggtagatttctccgggccgtcgttttcgctgctgcatacttgttatattccctatgatcagtctctccgagctgcgctgttgggcctgaatcaggccggtgaaaatgaactgcaccgtgcagctatactgagtaaccagttgtcagggtggtatgcgcaagcagtgggacggttgcttgagaaatccgggattgatcccggggagatcatagcagttggctgccatggccagacgatcaggcattgcccgcaaccggaaaacggctacagtatccaactggtaaatggtgccctgctggcggaattgacaggtatgactgtcgtgactgatttcaggagtcgtgatattgctgccggagggcagggagcaccactggttcctgcatttcatcatgaaatgtttgcacaccgggatattcaccgcctgatcatcaatatcggtgggatcaccaatataaccagtttacccgtcagtggcggtgtgaatggctttgactgtggaccagggaatatgttgatggatgcctggtgtctgaagcatacaggtatgacttatgaccacaatggatcatgggcggaatcaggaagggtgatcaatccactactggaaaatctgctgaattttccctatttttctttgccaccaccaaaaagtaccggcagagaaatgttcagtcttgactggttgcaaccttgtttgaggggtgatgaagctacacaggatgttcagtccacgttgctgcagttgactgtgcgaacgatcaccgattcagtcgagacttactatcctgctgtccgtgagctctatttatgcgggggaggggcgcataacggcaccctggttacccggttgcagcagcaattaccgggtcggagaatcaacctaactgatgcactgggtatcgaggctgactgggtggaggcgtgcgcattcgcctggctggcgcgacaatcgattgaacgcgctcctggcaatcttcctgctgtaaccggcgcaactggcagccggacgctgggtgcgatttacccggcctga

SEQ ID NO: 29335 - protein, 363 aa, Nitrosomonas europaea ATCC 19718
MYYVGIMSGTSLDGIDAVLVDFSGPSFSLLHTCYIPYDQSLRAALLGLNQAGENELHRAAILSNQLSGWYAQAVGRLLEKSGIDPGEIIAVGCHGQTIRHCPQPENGYSIQLVNGALLAELTGMTVVTDFRSRDIAAGGQGAPLVPAFHHEMFAHRDIHRLIINIGGITNITSLPVSGGVNGFDCGPGNMLMDAWCLKHTGMTYDHNGSWAESGRVINPLLENLLNFPYFSLPPPKSTGREMFSLDWLQPCLRGDEATQDVQSTLLQLTVRTITDSVETYYPAVRELYLCGGGAHNGTLVTRLQQQLPGRRINLTDALGIEADWVEACAFAWLARQSIERAPGNLPAVTGATGSRTLGAIYPA

SEQ ID NO: 29336 - DNA, 1134 bp, Prochlorococcus marinus subsp. marinus str. CCMP1375
  CDS (1)..(1134): transl_table=11
atgtatgttttgggtttaatgagtgggactagcgctgatggtgttgatgctgtgttagtggattttagaggtaatttaaataaacctagatggaaattacttaattcagtctcactcaaatattcggttgatttgcagaaagcaattattgatgctggacagggttctaagttgagtggctgtgattggctggaactttctgaagcgattacagaagcccatttttcagcagcaagtagatgtgaccctgatggaatttctactgttgtaggttgccatggacaaactgtttgtcatagaccaccgaaaccctcttttagaggagcaagctggcagcttattcaagcacctttattagcaactcttctagggaaaaatgtcatttatgatttcagatctaaggatcttgctttaggaggacaaggtgctcctttagccccatttttggattatgcattaataggaagagggaagacttggagaggagttcttaatcttggaggtattgccaatctttcattaattccgcctcttaagggtcctcatcgcaaatgccatttattgggatgggattgtggtcctgctaatactcttatagaccttgccgttcagaaaatcactaatgggcaaatgaattttgattgtgatggattgatggcttcaaaaggaaaacctgacttggatgcaataaaaaaatggcttaaggaagatttttttcaacagcctcctccaaaatcaactggtagagaatattttggttctcttgatttagccaaaagattctctgagattaattcagccaatgtaaatgatttagttgctactatcacttgctttactgcttgtgttgttgcccaagatttaaataatttatttaaaaagtcttggattaagcctgctgaattgtttgtagcaggtggaggaagtagaaatattttccttatgaaagaaattacgaatagatccccaggaatacgagttttgtctactgaaaaaattggaatcccttcgcaaagtagagaagctatggcatttgcattattggcatggtggaatattaatcaaaagcctattaacactaacgttacagggttaaaagaaccctctgttcttggcattgcagttagaccataa

SEQ ID NO: 29337 - protein, 377 aa, Prochlorococcus marinus subsp. marinus str. CCMP1375
MYVLGLMSGTSADGVDAVLVDFRGNLNKPRWKLLNSVSLKYSVDLQKAIIDAGQGSKLSGCDWLELSEAITEAHFSAASRCDPDGISTVVGCHGQTVCHRPPKPSFRGASWQLIQAPLLATLLGKNVIYDFRSKDLALGGQGAPLAPFLDYALIGRGKTWRGVLNLGGIANLSLIPPLKGPHRKCHLLGWDCGPANTLIDLAVQKITNGQMNFDCDGLMASKGKPDLDAIKKWLKEDFFQQPPPKSTGREYFGSLDLAKRFSEINSANVNDLVATITCFTACVVAQDLNNLFKKSWIKPAELFVAGGGSRNIFLMKEITNRSPGIRVLSTEKIGIPSQSREAMAFALLAWWNINQKPINTNVTGLKEPSVLGIAVRP

SEQ ID NO: 29338 - DNA, 1137 bp, Bordetella pertussis Tohama I
  CDS (1)..(1137): transl_table=11
atggacagcacgacgcacggcccgcgcacccatgtgccgggccgtttgttcatcggcctgatgtccggcaccagcatggacggcgccgacggcgtgctggtacggctggacgggccgcgacccgaggtgctggccagcgccagcctgcccatgcccgccgccctgcgcgacgagctgttcgcgctcaaccatgccggcgccaacgagctggagcgcgccgcgctggccgccaacggcctggcgcgcctgtatgcccgggccgtgcgccagttgctggaccaggccggactgcaacccggcgacgtggcggcgatcggcgcccacggccagaccgtcaggcaccgccccgacctgggctataccctgcaactgaacgcgccggccctgctggccgagctggccggcatcgacgtggtggccgatttccgcagccgcgacgtggccgccggcggccagggcgcgccgctggtgccgcctttccatgccgcgttgtttgccggcggccaggcgcgcgccgtgctcaacctgggcggcatcgccaatgtcacgctgctcgaacccggccggccgccgcgcggcttcgacaccgggccggccaacgtcctgctggacgcatggtgccagcgccacaccggccagccttacgacgccgacggccggttcgccgcgcaaggccaggtgctggccgacctgctcgaacacctgatcgccagcgagccgtggttcgccctggcgccgcccaaatcgaccggacgcgacctgttcaacctggattggctgctggcacggctgcaggcattcgatggcccggcgccgcaaccgcaggacgtgcaggccacgctgcagcgcctgacggcgcgcacggtcgccaatgccatcgacgccagcgcggccgcgccgcgcgatgtgctggtctgcggcggcggagcccgcaatccgggcctgatgcgcgagctggcctattgcctgcagcgcccggtacgccccaccgacgatgccggcgtgccggcacagtgggtcgaggcgctggccttcgcctggctggcccaggcctgcctggaccgcattcctgccggcctgcccacggtcaccggcgcgcgcgccgcgcgcgtgctgggcgcgctctatcctgcctga

SEQ ID NO: 29339 - protein, 378 aa, Bordetella pertussis Tohama I
MDSTTHGPRTHVPGRLFIGLMSGTSMDGADGVLVRLDGPRPEVLASASLPMPAALRDELFALNHAGANELERAALAANGLARLYARAVRQLLDQAGLQPGDVAAIGAHGQTVRHRPDLGYTLQLNAPALLAELAGIDVVADFRSRDVAAGGQGAPLVPPFHAALFAGGQARAVLNLGGIANVTLLEPGRPPRGFDTGPANVLLDAWCQRHTGQPYDADGRFAAQGQVLADLLEHLIASEPWFALAPPKSTGRDLFNLDWLLARLQAFDGPAPQPQDVQATLQRLTARTVANAIDASAAAPRDVLVCGGGARNPGLMRELAYCLQRPVRPTDDAGVPAQWVEALAFAWLAQACLDRIPAGLPTVTGARAARVLGALYPA

SEQ ID NO: 29340 - DNA, 1137 bp, Bordetella bronchiseptica RB50
  CDS (1)..(1137): transl_table=11
atggacagcacgacgcacggcccgcgcacccatgtgccgggccgtttgttcatcggcctgatgtccggcaccagcatggacggcgccgacggcgtgctggtacggctggacgggccgcggccggaggtactggccagcgccagcctgcccatgcccgccgccctgcgcgacgagctgttcgcgctcaaccatgccggcgccaacgagctggagcgcgccgcgctggccgccaacggcctggcgcgcctgtatgcccgggccgtgcgccagttgctggatcaggccggactgcagcccggcgacgtggcggcgatcggcgcccacggccagaccgtcaggcaccgccccgacctgggctataccctgcagctgaacgcgccggccctgctggccgagctggccggcatcgacgtggtggccgatttccgcagccgcgacgtggccgccggcggccagggcgcgccgctggtgccgcctttccatgccgcgttgtttgccggcggccaggcgcgcgccgtgctcaacctgggcggcatcgccaatgtcacgctgctcgaacccggccggccgccgcgcggcttcgacaccgggccggccaacgtcctgctggacgcatggtgccagcgccacaccggccagccttacgacgccgacggccggttcgccgcgcaaggccaggtgctggccggcctgctcgaacacctgatcgccagcgagccgtggttcgccctggcgccgcccaaatcgaccggacgcgacctgttcaacctggattggctgctggcacggctgcaggcattcgatggcccggcgccccaaccgcaggacgtgcaggccacgctgcagcgcctgacggcgcgcacggtcgccaatgccatcgacgccagcgcggccgcgccgcgcgatgtgctggtctgcggcggcggagcccgcaatccgggcctgatgcgcgagctggcctattgcctgcagcgcccggtacaccccaccgacgatgccggcgtgccggcacagtgggtcgaggcgctggccttcgcctggctggcccaggcctgcctggaccgcattcctgccggcctgcccacggtcaccggcgcgcgcgccgcgcgcgtgctgggcgccctctatcctgcctga

SEQ ID NO: 29341 - protein, 378 aa, Bordetella bronchiseptica RB50
MDSTTHGPRTHVPGRLFIGLMSGTSMDGADGVLVRLDGPRPEVLASASLPMPAALRDELFALNHAGANELERAALAANGLARLYARAVRQLLDQAGLQPGDVAAIGAHGQTVRHRPDLGYTLQLNAPALLAELAGIDVVADFRSRDVAAGGQGAPLVPPFHAALFAGGQARAVLNLGGIANVTLLEPGRPPRGFDTGPANVLLDAWCQRHTGQPYDADGRFAAQGQVLAGLLEHLIASEPWFALAPPKSTGRDLFNLDWLLARLQAFDGPAPQPQDVQATLQRLTARTVANAIDASAAAPRDVLVCGGGARNPGLMRELAYCLQRPVHPTDDAGVPAQWVEALAFAWLAQACLDRIPAGLPTVTGARAARVLGALYPA

SEQ ID NO: 29342 - DNA, 1140 bp, Prochlorococcus marinus str. MIT 9313
  CDS (1)..(1140): transl_table=11
atgcgcgtactggggctgatgagcggcaccagtgctgatggtgttgatgcagtactcgctgagttcagcggttcaccatctgaaccaaaatggtcgctactaaatcttgtctgcatcccctaccccgaggatcttcgccaaacagttgtcaacgcaggacaaggcatcaaactcaatagctgtgaatggctcgagctatctgagtccatcaccgaggttcatgctcaagcagctctggcctgtgaccccagagcacaagctgagctcgtgggttctcatggtcagactgtttggcatcgtcctcctcagaagaatcatcgcggcgccagctggcaaatcctgcaagcccctctactggctgaactgctcaagcgccctgttgttcatgacttccgagccgcagacctggcactaggaggccagggagcacctttggtacctatggctgatgccgcactgctaggtcgagtagggggctggcgtggggtgctcaatcttggaggaattgccaatctcaccctgattcctccccgcagcggtccggatcgccttgcttcagttatgggctgggattgcggcccagccaacagcctgatagatcttgctgttgaacagatcagcaaaggcaagcttgcctttgatcatgatggaatcatcgctgccagtgggcatccgcatacgaccacgatcgaacgctggctgaaggaaaccttcttccaactccctcctcccaaatcaacaggccgggagcaatttgggcttgccgatctagagcagcgcctcaaggaactccccaagatgtcgagggccaatcgtgtcgccacattgaccgctttcagcgcagccgttgtggcacaggatctggacaatcttcaccttagaaatctggttcgccccctggaactcattgttgctggtggaggaagccgaaatcctgtgctgatgaacgaactaagacaacgctgccgtggcatgcgactcctcaatagcgatgagctgggcctcagcgctgaagcccgagaaggtcttgcctttgcattacttgcctggtggcattgcctccagtatccaggcaacgctccggccataacaggggccaagcgtgcggcagttcttggtgtgagagctgatccagcttga

SEQ ID NO: 29343 - protein, 379 aa, Prochlorococcus marinus str. MIT 9313
MRVLGLMSGTSADGVDAVLAEFSGSPSEPKWSLLNLVCIPYPEDLRQTVVNAGQGIKLNSCEWLELSESITEVHAQAALACDPRAQAELVGSHGQTVWHRPPQKNHRGASWQILQAPLLAELLKRPVVHDFRAADLALGGQGAPLVPMADAALLGRVGGWRGVLNLGGIANLTLIPPRSGPDRLASVMGWDCGPANSLIDLAVEQISKGKLAFDHDGIIAASGHPHTTTIERWLKETFFQLPPPKSTGREQFGLADLEQRLKELPKMSRANRVATLTAFSAAVVAQDLDNLHLRNLVRPLELIVAGGGSRNPVLMNELRQRCRGMRLLNSDELGLSAEAREGLAFALLAWWHCLQYPGNAPAITGAKRAAVLGVRADPA

SEQ ID NO: 29344 - DNA, 1140 bp, Synechococcus sp. WH 8102
  CDS (1)..(1140): transl_table=11
atgctctgcctcggcctgatgagtggcaccagtgccgacggcgtcgatgcggtgttggctcgcttccagggtgctcccgatcgtcctgagtggcagctgctgagccatcaccacagcccttacccagctgcacttcgggacgagctggtgcgaatcggccagggagaagcacgaccggccgcggccctgctggatctggcggaggcggtgaccgaacatcaggcgctggcggctcgcggcgccgaccccgatcagcgcgcgagcctgatcggttgccatggccagaccctctggcatcgcccacccagcagcgacaagcgcggcgccagctggcagttgctgctggctccgctgctggcccagctcttggcacggccggtggtgcacgatttccgcgccaccgacctggccctgggaggtcagggggcgcccctggtgcccagggccgatgctgccctgatcgggcctggggacggctggcggggggtgctcaacctgggggggattgccaacctcaccctgatcccaccgcgctggggaccgcagaagcaggaatcggtcctgggctgggactgtggaccagcgaacagcctgatcgatctggcgatggagcagttcagcgatggccagcagctgtttgatcgcgacggtgccatggccgcagcagggcgttgcgacgacggcatgattcaacgttggttgcgggagccctacttccagctcagcccgccgaagtcaactgggcgggaatgcttcggccaagaggatctcagacgtcgcctgcaggagctggaatcggttgagagggccgatgcggtggccaccctcaccggcttcaccgcggcggtggtggctcaggatcttgaccgattgcgggcggacagaagcatccaccttctggagctgctggtggccggcggcggctgccgcaatccagttctgatgagcgaactccaacgtcgctgccggggactggccgtccgggccagcgatcagattggattggcggcggaggcaagggaagcgctcgtctttgcgctgctggcctggtggcatcaccgcggccacccaggcaatgctcccgccatcacaggcgcaacgcgggaagcatgcctcggcgtcagggttgcccccgcttga

SEQ ID NO: 29345 - protein, 379 aa, Synechococcus sp. WH 8102
MLCLGLMSGTSADGVDAVLARFQGAPDRPEWQLLSHHHSPYPAALRDELVRIGQGEARPAAALLDLAEAVTEHQALAARGADPDQRASLIGCHGQTLWHRPPSSDKRGASWQLLLAPLLAQLLARPVVHDFRATDLALGGQGAPLVPRADAALIGPGDGWRGVLNLGGIANLTLIPPRWGPQKQESVLGWDCGPANSLIDLAMEQFSDGQQLFDRDGAMAAAGRCDDGMIQRWLREPYFQLSPPKSTGRECFGQEDLRRRLQELESVERADAVATLTGFTAAVVAQDLDRLRADRSIHLLELLVAGGGCRNPVLMSELQRRCRGLAVRASDQIGLAAEAREALVFALLAWWHHRGHPGNAPAITGATREACLGVRVAPA

SEQ ID NO: 29346 - DNA, 1083 bp, Chromobacterium violaceum ATCC 12472
  CDS (1)..(1083): transl_table=11
atgatgtccggcaccagcctggacggcgtggacgccgtgctggtgcgcttcgacgacgccggccgcccggagccgcaggccgaccacgtcgtgccctatcccgacgcggtcaagcaagccgtgctggcgctgcagccccgcggccatgacgagctgcaccgcgcgcaaaccctggccaaccggctggcggagatttacgcccaggccgcgcgcgagctgctgcagaagtccggccgccgcgcggaggacatccgcgccatcgcctgccatggccagaccgtgcgccatgcgccgcacgacggctacacggtccagatcggcaatatggccaagctggccgagctggccggcatcgacgtgatagcggacttccgcagccgcgatgtcgccgccggcggccatggcgcgccgctggtgcccgccttccagcaaggcgcgttctccagcccggacgaaaaacgcgtgatcctgaacatcggcggcatcagcaacatcgctcggctgcacgcgggccaagaggcgataggtttcgactgcggccccggcaacatgctgatggacgcctggtgcctgcgccacaccggccagcccttcgacgaagacggcaattgggccgccggcggcgcggttcacccgccgctgctggccgcgatgctggccgaaccctacctgacgcagccgccgcccaagagcaccggccgcgacctgttcgacgacgagtggctggcgggcaagctgggcgccttgccatccgccccgcctccgcgcgacgtgcaggccactctgctggccttcagcgcccgcggcatcgccgacgccatcctggagcactgtcccggcaaccaggcggtctacgtctgcggcggcggcgcgcgcaacggcgcgctgatggctgaaatcgcccgccagctgcccgggcagcgcgtggccgccatcgaggcgctgggcctgcccgcgcagctgatcgaggcgatcgccttcgcctggctgggatggcgcttcgaccgacgccaggccggcaacctgccctccgtcaccggcgcgcaaggcccccgcgtgctgggcgcgctgtatcctcggtga

SEQ ID NO: 29347 - protein, 360 aa, Chromobacterium violaceum ATCC 12472
MMSGTSLDGVDAVLVRFDDAGRPEPQADHVVPYPDAVKQAVLALQPRGHDELHRAQTLANRLAEIYAQAARELLQKSGRRAEDIRAIACHGQTVRHAPHDGYTVQIGNMAKLAELAGIDVIADFRSRDVAAGGHGAPLVPAFQQGAFSSPDEKRVILNIGGISNIARLHAGQEAIGFDCGPGNMLMDAWCLRHTGQPFDEDGNWAAGGAVHPPLLAAMLAEPYLTQPPPKSTGRDLFDDEWLAGKLGALPSAPPPRDVQATLLAFSARGIADAILEHCPGNQAVYVCGGGARNGALMAEIARQLPGQRVAAIEALGLPAQLIEAIAFAWLGWRFDRRQAGNLPSVTGAQGPRVLGALYPR

SEQ ID NO: 29348 - DNA, 1140 bp, Gloeobacter violaceus PCC 7421
  CDS (1)..(1140): transl_table=11
gtggatccaacgctggcggtcgggctgatcagcggcacttcgctagacggcatggacggggcactggtagaaattgcaggcagcgcgcagcagccggcggtaacaacccttgccacgctcgccttaccttacccggcagggctgcgcgggcggctgttgcatctggcggagggcaaacccgttccagtggccgaggtgagtgcgctgcaccgcgatgtcgccctcgcctttgcggactgcgccctgcaacttatcgagcaggcgggctttcgctgcgggcagatcgcctgcatcggctcccatggccagaccgttcatcaccagcccccggccgacaacgcagcgggacacacgttgcagttgggcgacggcgcctggatcgccgagcgcaccggggtgacgaccgtgggcaactttcgcacccgcgacatggcggcgggtggccagggtgccccactggtgccgatcctcgactatttgctgttgcgcgacgcccggcgcgaccgctgcatccagaatctgggcggtattgccaatgtcacctacttgcgcgccgggggcggccctgaggaagtgatcgccttcgacaccggcccggccaatctgctcatcgacggcaccgtgcagattgccctgggcgaacccttcgaccggggcggcagcctggcgctgcaaggcacggtcgaccgggactgcctggagcggtggctggccgatccgtactttcgccggccgccccccaaatcgaccggccgcgagtacttcggctacgcgcgcgcccggcggctggccgaggagagcgctcatctgccggtggccgaccgggtggcgacggtgagcgaactgaccgtgcgctcgatcgaacgggcctaccgcgattttttgccccggcttcccgatgaggtgttcctgtgcgggggcggggcacgcaacggctatatccgcgcgcgcctcgggcgattgctcgccccggcgcgcgtcgccgtcagcgacgaagccggcatcgatccggacttcaaagaggcgatggcctttgcgctgctcgcctggttacgctgtaccggggcgccggggaatttgcccgcggtgaccggggccgggcgggcggttcccctgggcgacgtgcatcccgccgggtaa

SEQ ID NO: 29349 - protein, 379 aa, Gloeobacter violaceus PCC 7421
MDPTLAVGLISGTSLDGMDGALVEIAGSAQQPAVTTLATLALPYPAGLRGRLLHLAEGKPVPVAEVSALHRDVALAFADCALQLIEQAGFRCGQIACIGSHGQTVHHQPPADNAAGHTLQLGDGAWIAERTGVTTVGNFRTRDMAAGGQGAPLVPILDYLLLRDARRDRCIQNLGGIANVTYLRAGGGPEEVIAFDTGPANLLIDGTVQIALGEPFDRGGSLALQGTVDRDCLERWLADPYFRRPPPKSTGREYFGYARARRLAEESAHLPVADRVATVSELTVRSIERAYRDFLPRLPDEVFLCGGGARNGYIRARLGRLLAPARVAVSDEAGIDPDFKEAMAFALLAWLRCTGAPGNLPAVTGAGRAVPLGDVHPAG

SEQ ID NO: 29350 - DNA, 1119 bp, Photorhabdus luminescens subsp. laumondii TTO1
  CDS (1)..(1119): transl_table=11
atggttatgaagtcaggtcgttatattggtgtaatgtcgggtacaagtctggatggcgttgatgtggtgcttgccgcaatcaatgataaagttgttgctcagcaagccagttattcgcatccattcccatacgaattaaaacagaaaattctcgcagtctgtcaagggcagcaaacgacattatcggcaatcggtcggttggattatgaacttggttctttattcgctgaagctgtacaaggcttactgattaaaacagggttaaccgcgagtgacattactgctgtgggatgtcatgggcaaaccgtttggcatgagccaaatagtcatacgcctttcacgatgcaacttggcgacaataaccgtattgccgctttgactgggataactgtggttggtgattttcgtcggagggatatggcatatggtgggcagggcgcgccattagttccagcttttcatttcgccgtattaggccatctgacagaacgaaggataattctcaatatcggtggtattgccaatataacgacgctattacctggatcacctgtcaaagggtatgacacaggtccgggtaatatgctgatggatagttgggtatggcgtcatcagaaaaaaccttatgataaagatgcgcaatgggcgcgagaaggtgttgttaataacaaattgcttgggcaaatgctttctgatcactatttttcacgaccagctcctaaaagcacaggccgcgagtatttcaatatgagttggttggaggcgcaattagttaattttcctgacataccacctgtcgatgttcaggcaacgctggccgagctgacagcagcgtctgtatcacagcaaattatgttgagtggtggatgtgaacgtctgctggtttgtggtggtggcgcacataacccgcagataatgagccgactttctgccttattaccggggacggaggtttgcccgacagataaatatggcctaagcggtgatgatatggaagcactggcatttgcttggttagcattccgtacaatgtcaggtgcgccagggaatttaccctctgttactggtgcgagtactgaaactattttaggggcgatttatcctgttattaatcaataa

SEQ ID NO: 29351 - protein, 372 aa, Photorhabdus luminescens subsp. laumondii TTO1
MVMKSGRYIGVMSGTSLDGVDVVLAAINDKVVAQQASYSHPFPYELKQKILAVCQGQQTTLSAIGRLDYELGSLFAEAVQGLLIKTGLTASDITAVGCHGQTVWHEPNSHTPFTMQLGDNNRIAALTGITVVGDFRRRDMAYGGQGAPLVPAFHFAVLGHLTERRIILNIGGIANITTLLPGSPVKGYDTGPGNMLMDSWVWRHQKKPYDKDAQWAREGVVNNKLLGQMLSDHYFSRPAPKSTGREYFNMSWLEAQLVNFPDIPPVDVQATLAELTAASVSQQIMLSGGCERLLVCGGGAHNPQIMSRLSALLPGTEVCPTDKYGLSGDDMEALAFAWLAFRTMSGAPGNLPSVTGASTETILGAIYPVINQ

SEQ ID NO: 29352 - DNA, 1164 bp, Vibrio vulnificus YJ016
  CDS (1)..(1164): transl_table=11
atgaatttgcattacaatggtttgcatgatgaaaacacaatggaattgagtgtgagcacaaaagagttatatatcggtgtcatgtccggcacgagtatggatggggtagattgtgccctcgtggagttcgaccaagagcaagtccgcttaattgcccacagtgactacccgatgccagcagacttgcgccagcaactgctctccgtttgcactgggcaagccaccaacttaaagcagattggcgaacttgatcaccgcctcggccatctttttgccgatgccgtgatggatttgctcagccaagcaggcgtcgacgcgagccagatctgcgctatcggtaatcatggccaaacggtatttcatcaaccgaatggcgagtttccttttaccacccaattgggcgacgccaacattattgccacccgcaccaacattgacaccgtggcagattttcgtcgcaaagacatggcattgggcggccaaggcgcccctttggttccggcttttcatcaaagtgtatttgcgctgcaagattccacgaccgtggtgttgaatatcggcgggattgccaatatctcagtgctccacccaacccgccctgttcttggttacgacacaggacctgggaatatgttgatggatgcttggtgtgaaacacacacacaacagaattacgacaaagacgcgcggtttgctctccaaggagaggtaaatgaggcgttactgaattcgctgttgcaagagccttatttgcatcaagatgccccaaagagcacagggcgcgagcttttcaatatggaatggttgacagcaaaactgcaagggcagaactatcgaagcgaagatgtacagcgcaccttgtgtgagtacaccgccttaaccattagtaaagaagttgagcgctttcgctatggtccaacaccgcagttgctggtttgtggtggcggcgcgcgtaacccactgttgatgcaacgattgcagcaacagctgtctcactggcaggtctcaacgaccgatgcaaaaggggtcagtggggactacatggaagccatggcgtttgcttggttggcctatcgccacatgcaccgcttaccgagtaatttacccgaagtgactggcgcgagccgcttggcgagcctcggtgtcctctatcccaaagcctag

SEQ ID NO: 29353 - protein, 387 aa, Vibrio vulnificus YJ016
MNLHYNGLHDENTMELSVSTKELYIGVMSGTSMDGVDCALVEFDQEQVRLIAHSDYPMPADLRQQLLSVCTGQATNLKQIGELDHRLGHLFADAVMDLLSQAGVDASQICAIGNHGQTVFHQPNGEFPFTTQLGDANIIATRTNIDTVADFRRKDMALGGQGAPLVPAFHQSVFALQDSTTVVLNIGGIANISVLHPTRPVLGYDTGPGNMLMDAWCETHTQQNYDKDARFALQGEVNEALLNSLLQEPYLHQDAPKSTGRELFNMEWLTAKLQGQNYRSEDVQRTLCEYTALTISKEVERFRYGPTPQLLVCGGGARNPLLMQRLQQQLSHWQVSTTDAKGVSGDYMEAMAFAWLAYRHMHRLPSNLPEVTGASRLASLGVLYPKA

SEQ ID NO: 29354 - DNA, 1104 bp, Rhodopseudomonas palustris CGA009
  CDS (1)..(1104): transl_table=11
atgatgatgacggcgatcggactgatgagcgggacgtcgctcgacggcgtcgatgtcgctctgatcaagaccgacggacggcgcgtcggagcgctcggaccgtcgggctaccggccttacaccgagaccgagcgcagcctgctgcgccaagcgcttgctgaagcggtgcaactgactgcgcgcgatgctcggcccggcgtgctcgccgaagccgagcgcgcggtgacgatcgcccacgccgaggctgtcgccgcgtttgtggcgcagaaccggctgtcccccgggagcgtcgatatcgtcggcttccacggccagaccgtgctgcaccggccggccgaaaagctcacggtgcagatcggcgacgccaaggcgctggccaaggcgatccgcattccggtggtgtgcgacttccgcgccgccgatgtcgcggccggcgggcagggcgcgccgctggtgccggtgtatcaccgcgcgctggcgcaatcgctcggccgtgacggcccgatcggcgtaatcaatgtcggcggggtctccaacgtcacttatatcgacggcaccgacacgctgattgcctgcgacactggcccaggcaacgcgctgctcgacgacttcatgttccgcacgctcggcaagccgttcgattgcgaaggccggctggcgtcgcagggcgtgatcgatcaggcgtggctcacggaagcgctgcagcatccgttcttcgccaagccgacgccgaaatcgctcgaccgcaacgacttcgccaacctgaccttgcgcgactggtcgccagcggacggggcggcgacgctgacggcgttcaccgcgcgcgcgattgcggcggtgcagccgctgctgccgaagccgcctcagagttggatcgtgaccggcggcggtgcgcgcaacctgacgctgatgcggatgttgcgcgaggcgctggctccagccagcgtcgagagcgccgatgcgctcggctggtcggccgacgcgatggaggcgcaggcgttcggcttcctcgccacgcgcgggctgaagggcctgccgctgagctatccggcgaccacgggcgtcgcctttccgatgaccggcgggcttctggcgcggccgtaa

SEQ ID NO: 29355 - protein, 367 aa, Rhodopseudomonas palustris CGA009
MMMTAIGLMSGTSLDGVDVALIKTDGRRVGALGPSGYRPYTETERSLLRQALAEAVQLTARDARPGVLAEAERAVTIAHAEAVAAFVAQNRLSPGSVDIVGFHGQTVLHRPAEKLTVQIGDAKALAKAIRIPVVCDFRAADVAAGGQGAPLVPVYHRALAQSLGRDGPIGVINVGGVSNVTYIDGTDTLIACDTGPGNALLDDFMFRTLGKPFDCEGRLASQGVIDQAWLTEALQHPFFAKPTPKSLDRNDFANLTLRDWSPADGAATLTAFTARAIAAVQPLLPKPPQSWIVTGGGARNLTLMRMLREALAPASVESADALGWSADAMEAQAFGFLATRGLKGLPLSYPATTGVAFPMTGGLLARP

SEQ ID NO: 29356 - DNA, 1152 bp, Bacillus cereus ATCC 10987
  CDS (1)..(1152): transl_table=11
atgtatgttgcaggggtaatgtctggtacttcgttagatggtatagatgtagcactcgttcatatagaaggaagcggtgtaggttctaaagttgaactcatccattttactactgtgccatttcgtaatgatataaaaaatgagattcagcaagtattatcaataaaaaattcaaatgtccaactcatatgtagtttgaattttaagttaggtttatgtttcgctaaagccgtaaaggaagtttgtaaagaggccaatttttctttggaacaattagatttgataggttctcacggacaaacgatttaccatcagccaaagccagaaggtaatatgatatcttccacattgcaaattggggaacctgcagtaatagcatatgaaacgaatacgacggttatttctaattttcgaacgatggacatggcagctgggggacaaggtgcaccacttgtaccatattcagagattattttatatcgtcatccaactaaaaatagactactacaaaatatcggcgggattggtaatgttaccgtaataccaagtcaaaaaagtgatcagaatgttatagcttttgatactggtccgggtaatatgataattgatgaagtatgtcaaaggttatttcagttgccatatgatcaaaatggtgaaattgcagaacagggtgaagttgtagatgaaattttgacatattgtatgaatcattcatttttgaaaatgaatccaccgaaatcaactggtagagaacagtttggtgaagagtttgtaagtcagttattgaagcggtatgaaaagcatagtaaagaaaatatattaacgactgtcacgatgtttacagcaagttcaattgttcatcattataaggagtttattctgccatattatgaaattgatgaggtaattttaggcggtggcggcagttataatgacacacttgttgaaatgatacggtatggattgaaggatgaaaaatgtacaatattcattcaagaagatataggctattcttcagaggcgaaagaagcaatcgcctttgccattttagcaaacgaaacgtatcatcgtaatccgagtaacgtgccgagcgcaacaggtgcaatgcaatctgtagtattagggaatataacattccctccaataagatga

SEQ ID NO: 29357 - protein, 383 aa, Bacillus cereus ATCC 10987
MYVAGVMSGTSLDGIDVALVHIEGSGVGSKVELIHFTTVPFRNDIKNEIQQVLSIKNSNVQLICSLNFKLGLCFAKAVKEVCKEANFSLEQLDLIGSHGQTIYHQPKPEGNMISSTLQIGEPAVIAYETNTTVISNFRTMDMAAGGQGAPLVPYSEIILYRHPTKNRLLQNIGGIGNVTVIPSQKSDQNVIAFDTGPGNMIIDEVCQRLFQLPYDQNGEIAEQGEVVDEILTYCMNHSFLKMNPPKSTGREQFGEEFVSQLLKRYEKHSKENILTTVTMFTASSIVHHYKEFILPYYEIDEVILGGGGSYNDTLVEMIRYGLKDEKCTIFIQEDIGYSSEAKEAIAFAILANETYHRNPSNVPSATGAMQSVVLGNITFPPIR

SEQ ID NO: 29358 - DNA, 1311 bp, Neurospora crassa
  CDS (1)..(1311)
atgccttccgcaacaaacctctcgtggggtgctcctctctctctcaaggtcatcggccacaatgccggaacctccatggacggagtcgacctcgtccacgtccacttcacccaggactcgcccacctcccccctcaacatgcagcttctccactacggggagtacccaatgccgcaaaaggtcaagaggcgcgtcatgaagctcatcaaggaaaacaagaccacccccgaggaaatggccattgtcaacatccagctcggcgaggtcattgccgacgccgtcaactcgttcgcccgggaccaaggcttcgacctggcaaaggacgtcgacctgattggtggtcagggccagaccatctggcatctgcctctgcccgagctcttcgagggtgaccagatgcgtgcccacttggacatggccgagattgccatcattgccgcaaacaccggcgtcacttccttgggcaacttccgcgtctctgacatggcactcggccgccagggctgtcctctctttgccgctctcgactcgctgctgttgagccaccctaccctcaaccgggccgttcagaacattggcggtattgccaacttctccatcctgcccaagggcaatgtgcagggttgctatgacttcgacacgggcccaggaaacgtctttatcgatgccgctgtccgttacttcaccgacggcgagcaggagtacgacaagaacggtgccatgggcgccaagggtagggtcgaccaagcgattgtggacgagatcctggcgggaccttactttgtccacgacattcccaagaccactggtcgagaaacgtttggtgaccgtatggccgaggacatttgcgacaggatgttggccgatggcgccactcccgaggactgcgtggcaaccatcacccgcatcacggctcagtctcttgccgacgcttacgagcgctggggccccgaaggcggtgttgacgagatctacatgggcggcggtggctcctataaccccaacattgtcaactatctcaagcagcgcctgcccagtacccgcatcacatatatcgacgagactggtatccccgtcggcgccaaggaggctctggggttcgcccttctcacacacgagtgcttcgttggcaggccaatgatcgtgcccaccaacaccgagtcggacaagcctggtgttgttggccagattcagccggggaagaacatgcaccgtattagacaagccgttgctcagttctggggtgactttccagaggaggaaattcgatgtaccacccagatgaaccttttgcctagcctctgcaactga

SEQ ID NO: 29359 - protein, 436 aa, Neurospora crassa
MPSATNLSWGAPLSLKVIGHNAGTSMDGVDLVHVHFTQDSPTSPLNMQLLHYGEYPMPQKVKRRVMKLIKENKTTPEEMAIVNIQLGEVIADAVNSFARDQGFDLAKDVDLIGGQGQTIWHLPLPELFEGDQMRAHLDMAEIAIIAANTGVTSLGNFRVSDMALGRQGCPLFAALDSLLLSHPTLNRAVQNIGGIANFSILPKGNVQGCYDFDTGPGNVFIDAAVRYFTDGEQEYDKNGAMGAKGRVDQAIVDEILAGPYFVHDIPKTTGRETFGDRMAEDICDRMLADGATPEDCVATITRITAQSLADAYERWGPEGGVDEIYMGGGGSYNPNIVNYLKQRLPSTRITYIDETGIPVGAKEALGFALLTHECFVGRPMIVPTNTESDKPGVVGQIQPGKNMHRIRQAVAQFWGDFPEEEIRCTTQMNLLPSLCN

SEQ ID NO: 29360 - DNA, 1305 bp, Dictyostelium discoideum
  CDS (1)..(1305)
atgagtgatatatttattggtgtaatgtcaggtacatcattggatggtattgatgttgtaattgttgaatttaatgataatgatgatgatataaaaagaataaatgttaaacaaagttattcacatccaatgccaattaatataaagaatgatatattatcaatgtgtcaaggtcaaaaaactacattatcagaagttggtaatttaaatagaagattaggtatagtttattcagaagcaataaatgaagcaataaagttatcatcaattgatccaaattcaatttcagcaattggatgtcatggtcaaactgtttggcatcaaccaccaaccagaaaacatggtgatgatggtgataatgatgataatgatgatgataatgatggatttacaattcaattaggtgattgtaatagaattgcaacattaactggtataactacaattggtgattttagaaatagagatatttcatatggtggacaaggtgcaccattaacaccatcatttcataaatattcattatcaagtttcaatgaaaatagaatcattttaaatattggtggaatttctaatataactttattaccatcattatcatcatcatcatcatcatcaaataatattcaagttacaggatttgatacaggagcaggtaatattttattagatagttggattcaattaaaaaaggatggtacaccatatgataaagatggtgaatgggcaaatcaaggaaatgtaaatgaaaaacttttaaaatcattatatgatcatagtgattcatttttaaataaattaccaccaaaatcaactggtcgtgaattgtttaatattcaatggttattaaatgtaattgaatcaattaaaaatgatgatgatgataatgataatgataatattattataaaagatgaagatgttcaagcaacactattagaatttacatgtaaaacaatagttgatgaaattaaaaaaattaaaatttgtaaaattgatagagttttagtttgtggaggtggtagtaaaaataaattattaatggataaactttctagattattaaaaaaagatgaaaatgaaaatggatgtggtggtagtgttagtagcggtagtagtggtagttgtaaactttcaataactgatgaatttggtatcagtagtcaagatatggaggcaattgcatttgcatggtttgcaaaaagaactttaaataatcaaccttcaaatttaataagtgtgactggtgcttcaaaagaaacaatcttgggtgcaatttatttaaaaaataattttaataattga

SEQ ID NO: 29361 - protein, 434 aa, Dictyostelium discoideum
MSDIFIGVMSGTSLDGIDVVIVEFNDNDDDIKRINVKQSYSHPMPINIKNDILSMCQGQKTTLSEVGNLNRRLGIVYSEAINEAIKLSSIDPNSISAIGCHGQTVWHQPPTRKHGDDGDNDDNDDDNDGFTIQLGDCNRIATLTGITTIGDFRNRDISYGGQGAPLTPSFHKYSLSSFNENRIILNIGGISNITLLPSLSSSSSSSNNIQVTGFDTGAGNILLDSWIQLKKDGTPYDKDGEWANQGNVNEKLLKSLYDHSDSFLNKLPPKSTGRELFNIQWLLNVIESIKNDDDDNDNDNIIIKDEDVQATLLEFTCKTIVDEIKKIKICKIDRVLVCGGGSKNKLLMDKLSRLLKKDENENGCGGSVSSGSSGSCKLSITDEFGISSQDMEAIAFAWFAKRTLNNQPSNLISVTGASKETILGAIYLKNNFNN

SEQ ID NO: 29362 - DNA, 1317 bp, Aspergillus nidulans FGSC A4
  CDS (1)..(1317)
atggccaacgaaactcccaaaaaccatgctctcgacatcacggtgctgggcttgaacagcggcacctcgatggatggcatcgactgtgctctgtgtcgcttccggcaggagactccagagtctcccatgcactttgagctgctcaagtatggagaaatcccgcttgagcagacgatcaagaagcgggtgatgaacatcatcctgcacaacaagacttcgccctcagagctatctgaggtcaatgtcatcctaggagagacattcgccgccgcggtcaagcagttctgtgcagactacaaggtggatatctcctccatcgatgtcattgggtctcatggacagaccatctggcttctgtcgatgcccgaggcgaatgaagtgcgaagcgccttgactatggccgaaggctcgttcctcgcctcgcgcactggtatcacttccgtgacagacttccgagtcagcgaccaggccgccggtcgtcaaggtgcaccgctcatcgctttctttgatgcgctggttctgcaccacccgaccaagcttcgggcgtgccagaacatcggcggcattgccaacgtctgcttcatccctcctgactcgcacggcggcgtcgatgcctgctacgactttgacaccggtcccggcaacgtgttcatcgatgccgtggtccgccactacaccaacggcgagcgcgagtacgacaaggacggcgagatgggcgctcgcggcaccgtcgaccaggagctcgtcgacgagttcatccagaaccacccctacttcaagctcgacccgcccaagactaccggccgcgaggtcttccgggataccttggccttggacctgatccgcaaggctgaaagcaagggcctgacccctgacgatgtcgtcgcgacaatcacccgagtcaccgcacaggcaatcgtcgaccactaccgccgctacgcccctgaaggcctagagatcgaggagatcttcatgtgcggaggaggcgcctacaaccccaacatcaccaagtacatccagcagcactaccccaacgctaagatcatgatgctcgacgaggccggtatccctgctggcgccaaggaggccatcaccttcgcctggcagggcatggaggctatcgttggccgttctattccagtgccgacgcgtgtagagacgcgtcaagaatacgtcctgggcaaagtgtctccgggcaagaactaccgcaaggtaatgcggcagggcatgctttttggcgctggccgcgatcacttgaagccagtcagcgaattaatcaactatgtagacgggaaggtgtttgacaataagtggtaa

SEQ ID NO: 29363 - protein, 438 aa, Aspergillus nidulans FGSC A4
MANETPKNHALDITVLGLNSGTSMDGIDCALCRFRQETPESPMHFELLKYGEIPLEQTIKKRVMNIILHNKTSPSELSEVNVILGETFAAAVKQFCADYKVDISSIDVIGSHGQTIWLLSMPEANEVRSALTMAEGSFLASRTGITSVTDFRVSDQAAGRQGAPLIAFFDALVLHHPTKLRACQNIGGIANVCFIPPDSHGGVDACYDFDTGPGNVFIDAVVRHYTNGEREYDKDGEMGARGTVDQELVDEFIQNHPYFKLDPPKTTGREVFRDTLALDLIRKAESKGLTPDDVVATITRVTAQAIVDHYRRYAPEGLEIEEIFMCGGGAYNPNITKYIQQHYPNAKIMMLDEAGIPAGAKEAITFAWQGMEAIVGRSIPVPTRVETRQEYVLGKVSPGKNYRKVMRQGMLFGAGRDHLKPVSELINYVDGKVFDNKW

SEQ ID NO: 29364 - DNA, 1149 bp, Bacillus anthracis str. Sterne
  CDS (1)..(1149): transl_table=11
atgtatattgcaggggtaatgtctggtacttcattagatggaatagatgtagcgctcgttcgtatagaagggagtggtgtagagtctaaggtcgaactcatccattttactacagttccattttgtaatgatataaaaagtgaaatacaacaagcgttatcaatagaaaattcaaatgtccaactcatatgtagtttgaattttaagctcggtttatgttttgccaatgctgtaaaggaagtttgtaaagaggccaatttttctttggaacaattagatttgataggttctcacggacaaacgatttatcatcagccgaagcaagatggtaataggataccttccacattgcaaattggggaacctgcagtaatagcatacgaaacgaacacgacggttatctcaaatttccgaacgatggacatggcagcaggaggacaaggtgcaccacttgtgccatattcagaggtcattttgtatcgtgatccaagtaaaaatagactactacaaaatattggtgggattagtaatgttacagtaataccaaatcaacaaagtgatcagaacgttatagcttttgatactggtccagggaatatgataattgatgaagtatgtcaaaggttatttcagttgtcatatgatcaaaatggtgaaattgcaaaacagggtagagttgtagatgaaattttgacatattgtatgagtcatccatttttgaaaatgaatccaccgaaatcaacaggtagagaacagtttggagaaaaatttgcaagtgaattattgaagcggtttgaaaagcatagtaaagaaaatatattgacgactgtcacgatgtttactgcaaattcaattgttcatcattataagaagtttatcttgccgtattatgaaatcgatgaggtgatattaggcggtggtggcagttataatagcacacttgttgaaatgttgcgaaatggattgaaggatgaaaactgcgcaatattcattcaagaagatataggctattcttcagaggcgaaagaagctatcgcctttgcaattttagcaaacgaaacgcatcattgcaatccgagtaatgtgccaagcgcaacaggtgcaaagcaatctgtagtttttgggaatataacattccctccggtatga

SEQ ID NO: 29365 - protein, 382 aa, Bacillus anthracis str. Sterne
MYIAGVMSGTSLDGIDVALVRIEGSGVESKVELIHFTTVPFCNDIKSEIQQALSIENSNVQLICSLNFKLGLCFANAVKEVCKEANFSLEQLDLIGSHGQTIYHQPKQDGNRIPSTLQIGEPAVIAYETNTTVISNFRTMDMAAGGQGAPLVPYSEVILYRDPSKNRLLQNIGGISNVTVIPNQQSDQNVIAFDTGPGNMIIDEVCQRLFQLSYDQNGEIAKQGRVVDEILTYCMSHPFLKMNPPKSTGREQFGEKFASELLKRFEKHSKENILTTVTMFTANSIVHHYKKFILPYYEIDEVILGGGGSYNSTLVEMLRNGLKDENCAIFIQEDIGYSSEAKEAIAFAILANETHHCNPSNVPSATGAKQSVVFGNITFPPV

SEQ ID NO: 29366 - DNA, 1149 bp, Bacillus thuringiensis serovar konkukian str. 97-27
  CDS (1)..(1149): transl_table=11
atgtatattgtaggggtaatgtctggtacttcattagatggaatagatgtagcactcgttcgtatagaagggagtggtgtagagtctaaggtcgaactcatccattttactacagttccattttgtaatgatataaaaagtgaaatacaacaagcgttatcaatagaaaattcaaatgtccaactcatatgtagtttgaattttaagctcggtttatgttttgccaatgctgtaaaggaagtttgtaaagaggccaatttttctttggaacaattagatttgataggttctcacggacaaacgatttatcatcagccgaagcaagatggtaataggataccttccacattgcaaattggggaacctgcagtaatagcatacgaaacgaacacgacggttatctcaaatttccgaacgatggacatggcagcaggaggacaaggtgcaccacttgtgccatattcagaggtcattttgtatcgtgatccaagtaaaaatagactactacaaaatattggtgggattagtaatgttacagtaataccaagtcaacaaagtgatcagaacgttatagcttttgatactggtccagggaatatgataattgatgaagtatgtcaaaggttatttcagttgccatatgatcaaaatggtgaaattgcaaaacagggtagagttgtagatgaaattttgacatattgtatgagtcatccatttttgaaaatgaatccaccgaaatcaacaggtagagaacagtttggagaaaaatttgtaagtgaattattgaagcggtttgaaaagcatagtaaagaaaatatattgacgacggtcacgatgtttactgtaaattcaattgttcatcattataagaagtttatcttgccgtattatgaaatcgatgaggtgatattaggcggtggtggcagctataatagcacacttgttgaaatgttgcgaaatggattgaaggatgaaaactgcgcaatattcattcaagaagatataggctattcttcagaggcgaaagaagctatcgcctttgcaattttagcaaacgaaacgcatcatcgtaatccgagtaatgtgccaagcgcaacaggtgcaaaacaatctgtagttttagggaatataaccttccctccgttatga

SEQ ID NO: 29367 - protein, 382 aa, Bacillus thuringiensis serovar konkukian str. 97-27
MYIVGVMSGTSLDGIDVALVRIEGSGVESKVELIHFTTVPFCNDIKSEIQQALSIENSNVQLICSLNFKLGLCFANAVKEVCKEANFSLEQLDLIGSHGQTIYHQPKQDGNRIPSTLQIGEPAVIAYETNTTVISNFRTMDMAAGGQGAPLVPYSEVILYRDPSKNRLLQNIGGISNVTVIPSQQSDQNVIAFDTGPGNMIIDEVCQRLFQLPYDQNGEIAKQGRVVDEILTYCMSHPFLKMNPPKSTGREQFGEKFVSELLKRFEKHSKENILTTVTMFTVNSIVHHYKKFILPYYEIDEVILGGGGSYNSTLVEMLRNGLKDENCAIFIQEDIGYSSEAKEAIAFAILANETHHRNPSNVPSATGAKQSVVLGNITFPPL

SEQ ID NO: 29368 - DNA, 1113 bp, Erwinia carotovora subsp. atroseptica SCRI1043
  CDS (1)..(1113): transl_table=11
atgagatcaggcagatatattggcgtgatgtccggcaccagtcttgatggtgtggatgtcgtgctagccgcgattgacgaacatacagtggctcagcaggcccgctactgccacccgataccgcaggatatcaaaatggctatcttggggatgtgtcaggggcaggcggtgacgttgtcagcgctgggccagttggatacgcgtctgggaatcttgtttgccgaagcagtgctgacgctgcttaaagagacgggcctgagggcgcagggtattactgcgattggctgccatgggcagacggtctggcatgagcccacgggcgaagcaccctgtacgttgcagataggtgataacaaccgcgttgccgccttgactggcatcacgaccataggggattttcgacgccgcgatttggcttatggcgggcagggtgctccgctggtgccatcattccatcacgcgttactattgcaccccgttgagcgccgtatcgtgcttaacatcgggggaatcgccaatttgtcgctgctggtgccgggggcgcctgtgcgcggctacgataccgggcctgggaatatgctgctggatgcttggatctggcggcactgcgcgcaaccgtatgataaagacgccctgtgggcgataaacggacaggcgaacccgttactgctgcgccggatgttgaccgatccttactttgcgttacgagcaccgaaaagcaccggacgtgagtatttcaacctgggctggctcgaaagaatgttggctggcttgccgccgatagcgccgcaggatgttcaggcgacgctggttgagttaacggccataagcatcgccgaccaagtgctgctggtcggtggatgtgaacgcttattagtttgtggcggtggtgcgcataatccactcatcatggcgcgtctctcggccctgctgccgggcatcgaagtcagcacgaccgatgagtgtggcgtgaacggcgatgatatggaagcgctggcatttgcctggctggcgtcgcgtacgctatcgggattgccgggtaatctgccgtctgtcacgggagcgagtcaggaaacggtgttaggtgcgatttatccggttaacgtggattaa

SEQ ID NO: 29369 - protein, 370 aa, Erwinia carotovora subsp. atroseptica SCRI1043
MRSGRYIGVMSGTSLDGVDVVLAAIDEHTVAQQARYCHPIPQDIKMAILGMCQGQAVTLSALGQLDTRLGILFAEAVLTLLKETGLRAQGITAIGCHGQTVWHEPTGEAPCTLQIGDNNRVAALTGITTIGDFRRRDLAYGGQGAPLVPSFHHALLLHPVERRIVLNIGGIANLSLLVPGAPVRGYDTGPGNMLLDAWIWRHCAQPYDKDALWAINGQANPLLLRRMLTDPYFALRAPKSTGREYFNLGWLERMLAGLPPIAPQDVQATLVELTAISIADQVLLVGGCERLLVCGGGAHNPLIMARLSALLPGIEVSTTDECGVNGDDMEALAFAWLASRTLSGLPGNLPSVTGASQETVLGAIYPVNVD

SEQ ID NO: 29370 - DNA, 1128 bp, Mannheimia succiniciproducens MBEL55E
  CDS (1)..(1128): transl_table=11
atgatgaaacaatattatatcggcgtaatgtcgggaaccagccttgacggtgtggatttagccttgatggatttcactctgaatcccccaaaattgatggcaacggattttactccgatgccggaaaaaattcgtgaaaaactgaccgcacttttgcgatccggagagacaagtttgcggaatttaggcgaaattgaccaccaattagggcttctttatgcagaaagtatcaatcgttttttgcaaaaagtgcggttaaaatccgaagatatttgcgcagtcggttgccacggacaaacggtgtggcattcgccgaattgcgaatttccgttcacaatgcaaatcggcgatatgaatttggttgcggcaaaaaccggtatcaccacggtaggtgatttccgccgtaaagatatggcgctgggcggtcagggcgcgcctttagtaccggcttttcatcaggatttattttttgcggcggaacgattgacggtggtgttgaatattggcggaatcagcaatatttccgtgctggaagaaaattgtccgaccgtcggttatgatgtgagcgtaggcaatgcgttgctggattcctggattgaacttcatcagggcaaacgctacgataaagacgctctatgggcaaaaaacggtaaaatttccaccgcacttttaacggatttgctggcggaacccttttttcagcaggcaccgccgaaaagtaccgggcgggaattgtttaatcttgcctggcttaataaaaaactggaaaaattcaccgcactttcgcaaccgatgccttcgccacaggatgtgcaacgcacactggtggaatttaccgctttaagtattgccaacgaattgaaaaaattgcaaaaatccgaccgcactaatttgctgttagtttgtggcggcggtgcgcgaaatccattgattatgcaacgtttaacggcacttttggctgagtggcaggtttcgaccacctcggaattcggtttggatatcgattacgtcgaggcggcggcatttgcctggcttgcttatcgcagaatacataatttgccgagcaacttgcctagtgtcaccggggcgaaaagtgaggttagtttaggtgtgatttttcctaaatag

SEQ ID NO: 29371 - protein, 375 aa, Mannheimia succiniciproducens MBEL55E
MMKQYYIGVMSGTSLDGVDLALMDFTLNPPKLMATDFTPMPEKIREKLTALLRSGETSLRNLGEIDHQLGLLYAESINRFLQKVRLKSEDICAVGCHGQTVWHSPNCEFPFTMQIGDMNLVAAKTGITTVGDFRRKDMALGGQGAPLVPAFHQDLFFAAERLTVVLNIGGISNISVLEENCPTVGYDVSVGNALLDSWIELHQGKRYDKDALWAKNGKISTALLTDLLAEPFFQQAPPKSTGRELFNLAWLNKKLEKFTALSQPMPSPQDVQRTLVEFTALSIANELKKLQKSDRTNLLLVCGGGARNPLIMQRLTALLAEWQVSTTSEFGLDIDYVEAAAFAWLAYRRIHNLPSNLPSVTGAKSEVSLGVIFPK

SEQ ID NO: 29372 - DNA, 1101 bp, Legionella pneumophila subsp. pneumophila str. Philadelphia 1
  CDS (1)..(1101): transl_table=11
atgagtttatatatcggtttgatgtccggtaccagtatggatggcattgatgctgccttgttggagcttccttccaatcatttgattcacgggattactaaacaatacagtgatgatgtcaggagaaatcttgatgatttaattatgggtaatcatttaaccctggcttcgatttgccaactgaacacgctaattggcagggagtttgcagaagcagttcgccaactcttgagtgaaataaaagtgcatccaaaagaaattcaggccattggcagtcatggtcaaactgtctgtcatgatacaagtggaaatatcccgtatactttgcagcttggttgtggccatacgatttcttctttaactggcattaccgttgtagcagattttagaacaagagatttggtgaatggtggtcaaggtgcgccttttgcccccctttaccatcaacagatattttctaaagtgaatgagtctgttgctgttgttaacattggtggtattgctaatgttacctttattgcaaagaatcaaatgactagaggttgggatatagggcctggcaattgtctgatggatgcctggatttataaaaataaaggagccctttttgataaaagtggggtttgggcgagccaaggtgaagtgatttatcctctgcttgaatatttgttacaagatccatttttccatttggattcacctaaaagcattggcaaagaatatttttctttatcctggctacaaaaacatttaaaaccggattacacaccagctgatattcaggctactttgttggcgcttacagcccatacgatagctgaaacaatattaaatgaatcaggagaaattaaacaattatatctctgtggaggcggggcccacaatacgcatttgaaagagaatttagctcgtctactgcctgggatagcagtaaaaagcatagcagagttagggattagtcctgattatcttgaggcaatgatgtttgcatggttagcagcacagacgattaatcaaataccagttaatttaacatcaataactggagctaaaggtattgcaattttaggtgcagtgtatcctataataaaatcatattga

SEQ ID NO: 29373 - protein, 366 aa, Legionella pneumophila subsp. pneumophila str. Philadelphia 1
MSLYIGLMSGTSMDGIDAALLELPSNHLIHGITKQYSDDVRRNLDDLIMGNHLTLASICQLNTLIGREFAEAVRQLLSEIKVHPKEIQAIGSHGQTVCHDTSGNIPYTLQLGCGHTISSLTGITVVADFRTRDLVNGGQGAPFAPLYHQQIFSKVNESVAVVNIGGIANVTFIAKNQMTRGWDIGPGNCLMDAWIYKNKGALFDKSGVWASQGEVIYPLLEYLLQDPFFHLDSPKSIGKEYFSLSWLQKHLKPDYTPADIQATLLALTAHTIAETILNESGEIKQLYLCGGGAHNTHLKENLARLLPGIAVKSIAELGISPDYLEAMMFAWLAAQTINQIPVNLTSITGAKGIAILGAVYPIIKSY

SEQ ID NO: 29374 - DNA, 1212 bp, Burkholderia pseudomallei K96243
  CDS (1)..(1212): transl_table=11
gtgccccccaccctcgatttcggagcgatcaccgtgacgtccaaccgcatgcaaaccggccatccggcggatggcgtgtatttcggcctgatgtccggcacgagcatggacggcgtcgacggcatcgccgtgcgcttcgaggcgggcaagccgcccgccgtgctgtccgaggcgttcgtcggcttcgccgacacgctgcgcgacgcgctcttcgcgctgcaacagccgggcgacgacgagatcgagcgcgaggcgctcgccgcgaacgcgctcgccgcgcgctacgcggtgtgctgccacgagctgctgcgcacggcgggcctctcgcccgacgacgtgcgcgcgctcggcgtgcacggccagacggtgcgccaccggcccgagcgcggctatacgcggcagctcaacaacgcggcgctgctcgcggagctgacccgcatcgacgtgatcgccgatttccgcagccgcgacgtcgccgcgggcggccagggcgcgccgctcgtgccggcgttccatgcgacggtgttcggctcgcccgacgagacgcgcgtggtctgcaacctgggcggcatcagcaacatcacgatcctgcccgccgggggcggcccgcagggcgaagggcacgcgcgcaacgacacggtgcgcggccacgattgcggcccggcgaacgcgctgatcgacgcgtgggtcgagcgccacctgaaacagccgttcgacgacggcggacgcttcgccgcgcgcggcaaagtcgacgaaacgctcctcgccgcgctgctcgacgagccgtacttccgccaaaacgcgccgaaaagcaccgggcgcgatctcttcaacgccgattggctcgatgcgaaactcgccggttttcagcacctcgcgcccgaaaacgtgcaggcgacgctcaccgcgctgaccgccgccaccgtcgccgacgagatcgcgcggcatgcgggcgattgccgagccgtctatgtgtgcggcggcggcgcgcgcaacccggtgctgctcgacgcgctcgcgacggcgctcgcggcgcgcgggctcgacgcggccgtcgccacgacggccgcgctcggcgtgccgccgcagcaagtcgaatcgctcgcgttcgcgtggcttgcgtaccggttcaacgcgcgcgcgccgggcaacgtgtcgaccgtcaccggcgcggcgggcgagcgcgtgctgggcgcgctctacccgcgctga

SEQ ID NO: 29375 - protein, 403 aa, Burkholderia pseudomallei K96243
MPPTLDFGAITVTSNRMQTGHPADGVYFGLMSGTSMDGVDGIAVRFEAGKPPAVLSEAFVGFADTLRDALFALQQPGDDEIEREALAANALAARYAVCCHELLRTAGLSPDDVRALGVHGQTVRHRPERGYTRQLNNAALLAELTRIDVIADFRSRDVAAGGQGAPLVPAFHATVFGSPDETRVVCNLGGISNITILPAGGGPQGEGHARNDTVRGHDCGPANALIDAWVERHLKQPFDDGGRFAARGKVDETLLAALLDEPYFRQNAPKSTGRDLFNADWLDAKLAGFQHLAPENVQATLTALTAATVADEIARHAGDCRAVYVCGGGARNPVLLDALATALAARGLDAAVATTAALGVPPQQVESLAFAWLAYRFNARAPGNVSTVTGAAGERVLGALYPR

SEQ ID NO: 29376 - DNA, 1158 bp, Photobacterium profundum SS9
  CDS (1)..(1158): transl_table=11
ttgctgattcagcacacactagaggttcttatggcaattgagcgttacatcggcattatgtctggtacaagtatggatggtgttgataccgttttggttgaaattgaagaaaacagtatccgcttgatgggtgaaaactcttttcctatgggtgaagatcttaaacaggcattgcttgatatttgcctaggtcaatccaccaatttgcaagcagttggagagctcgatcaccgactcgggcatttatttgctgatgctgtgatcgctttattagagaacaccggtatatctccagactctattacagctattggaagccacgggcaaaccgtatttcactctccagaaacacaatatgctttcaccatgcaactcggtgatgccaatattattgcggcaaaaacacacattacaaccatcgctgattttcgtcgaaaagatatggctctcggtgggcaaggcgcaccactcgttccagcttttcatcaacagctttttagttctcttgatacaacgcgcgtaatcctcaatattggcggcattgctaacatcacagtactcactcccaatcaacctgttacgggctatgatacaggcccaggtaacatgttaatggatgcatggatccaccagcataatggcagtcaatatgatgttaatgccaaatgggctaaaacaggcactgtaaacgaaatactgttagaaagactgctcgacgaaccttacttcaagcagccagcccctaaaagtacaggtcgtgaattatttaatttaccgtggttaaaacaaaaattatcaggtttagatatacccgcagaagatgtacaagcaaccctagctgaatttactgcagtcaccattacaaatgatgtcattacatatcaacataatgaaaggtctgaattatcaaccaaacaggaattgttagtctgtggcggtggtgctcataatccattattaatggcacgtttagctgcacaattacccaagtggcaagtaatgacgacaacagaacgaggtgtagatagcgataatatggaagccatggctttcgcgtggttagcttaccgaacacatcataatatgccgggaaatttaccagaagtaactggcgcttctggattaacaagcctaggggcaatttacccagcatcgtaa

SEQ ID NO: 29377 - protein, 385 aa, Photobacterium profundum SS9
MLIQHTLEVLMAIERYIGIMSGTSMDGVDTVLVEIEENSIRLMGENSFPMGEDLKQALLDICLGQSTNLQAVGELDHRLGHLFADAVIALLENTGISPDSITAIGSHGQTVFHSPETQYAFTMQLGDANIIAAKTHITTIADFRRKDMALGGQGAPLVPAFHQQLFSSLDTTRVILNIGGIANITVLTPNQPVTGYDTGPGNMLMDAWIHQHNGSQYDVNAKWAKTGTVNEILLERLLDEPYFKQPAPKSTGRELFNLPWLKQKLSGLDIPAEDVQATLAEFTAVTITNDVITYQHNERSELSTKQELLVCGGGAHNPLLMARLAAQLPKWQVMTTTERGVDSDNMEAMAFAWLAYRTHHNMPGNLPEVTGASGLTSLGAIYPAS

SEQ ID NO: 29378 - DNA, 1122 bp, Salmonella enterica subsp. enterica serovar Paratyphi A str. ATCC
  CDS (1)..(1122): transl_table=11
atgaaatcgggccgttttattggcgttatgtccggaaccagccttgatggcgttgatgttgtactggcggcaattgatgaaaccatggttgcgcaacaggcaagtctcacctggcccattcccgttcatctgaaaaaaggcattctcgatatttgccagggacagccgcttacgctctcgcaactcggccagctggatacccagttaggccggctttttgcacaggcggttaatgcgctgttagcgcaacaacgtttgcagccgcgggatatcgtcgctattggttgtcatgggcaaacggtctggcatgaaccgaccggcgaggccccgcatacgctgcaaattggcgataataatcacatcgtcgcccatacggggattacagtggtcggcgattttcggcggcgggatattgcgctgggcggacaaggcgcgccgctggtgcccgctttccatcacgcgctgttgggacatccgacggaaaaacgtatggtcctgaatatcggcggcatcgccaatttatctctgcttttccccggacaggcggtgcgcgggtacgacacggggccgggcaatatgttgatggatgcgtggatttggcgacaatgcgcgcagccctacgacaaagacgcggcatgggcgaaagaaggtcaggttattcttccattgctgcaaaagatgttgcgcgatccgtactttgctgcgtcggcgcccaaaagtacaggacgcgaatatttcaactatggctggttagagcgccatcttgcggctttccctggcgcagacgcgcgcgatgtacaggccacgctggcggagctgacggcggtctccatcgcccaacaggtgctgctcaacggcggctgcgagcggctgatggtctgtggcggcggtggccggaatccgttagtgatggcccgtctggcggcgctgttgaccggtatcgaggtttcgaccaccgataaggcggggatcagcggcgatgatatggaagcgctggcctttgcatggcttgcctggcgaacgctcgcgggcctgccgggaaatttaccttccgtgacgggggctacagaagccagtgttttaggcgctatttacccggctaacccaataactcagagttaa

SEQ ID NO: 29379 - protein, 373 aa, Salmonella enterica subsp. enterica serovar Paratyphi A str. ATCC
MKSGRFIGVMSGTSLDGVDVVLAAIDETMVAQQASLTWPIPVHLKKGILDICQGQPLTLSQLGQLDTQLGRLFAQAVNALLAQQRLQPRDIVAIGCHGQTVWHEPTGEAPHTLQIGDNNHIVAHTGITVVGDFRRRDIALGGQGAPLVPAFHHALLGHPTEKRMVLNIGGIANLSLLFPGQAVRGYDTGPGNMLMDAWIWRQCAQPYDKDAAWAKEGQVILPLLQKMLRDPYFAASAPKSTGREYFNYGWLERHLAAFPGADARDVQATLAELTAVSIAQQVLLNGGCERLMVCGGGGRNPLVMARLAALLTGIEVSTTDKAGISGDDMEALAFAWLAWRTLAGLPGNLPSVTGATEASVLGAIYPANPITQS

SEQ ID NO: 29380 - DNA, 1110 bp, Idiomarina loihiensis L2TR
  CDS (1)..(1110): transl_table=11
atgtttcagcgttatattggactgatgtcgggcaccagtatggatgcggttgacgcggcattggtccagatagatgcgcaaggcacgcccagacttgaagctcatcactctttgtctttccccccggaattgcgtactcgcttattggctttaagccacacagacaactggcaggccgatgaactggccggtttagacattgctttttcccagctcagtgccaaagtagtagagcggcttcttgaaaaagtcagtatcgcagcaaaagacattaccgccatagccagtcacggacaaaccgttcgccacaagcccaactcaataccagcctacacctgtcaaattggcgaccctacacggttagctttgggtacgggtattgatgtgatttacgattttcgtcgcaaagacatcgccgcaggtggtcagggtgcgccattggttccggcttttcataagcaagttttttcccgcaagaatcaaagcattgcggtgattaatttaggtggtattgccaatgtcacctggcttggccataacggcaacatactgggcttcgatacaggacctgccaacaccttgctcgaccaatgggttcagcataatgactcaagtaaaagcttcgatgaaaatgctcagtttgcgagagcaggcaaacttcagcctgacctgctaaagcgtttattgcagcatccgttttttgctaagccagctcccaaaagtacgggtcgcgaggagttcaacttaaaatggctgcaacgacaattgaccggacacaacattagcccggctgatgtacagcgcactttgaccgaacttaccgctattagcatcaaagatgcactgacaaccttgccacaacaacccgatacggcttatttttgtggtggcggcacccgaaacccattattgatggagcgcttaactcaacttttagcgccgattcaatgcgatactacagcgagtttaggcgttgacccgcaatgggttgaggcaatcgcttttgcctggttaggctggtgtttcgagcataaaaaaccgggcaaccagcctgaagttacaggagccagtcatccggttgttttaggcgctaaagtcctacatcaatag

SEQ ID NO: 29381 - protein, 369 aa, Idiomarina loihiensis L2TR
MFQRYIGLMSGTSMDAVDAALVQIDAQGTPRLEAHHSLSFPPELRTRLLALSHTDNWQADELAGLDIAFSQLSAKVVERLLEKVSIAAKDITAIASHGQTVRHKPNSIPAYTCQIGDPTRLALGTGIDVIYDFRRKDIAAGGQGAPLVPAFHKQVFSRKNQSIAVINLGGIANVTWLGHNGNILGFDTGPANTLLDQWVQHNDSSKSFDENAQFARAGKLQPDLLKRLLQHPFFAKPAPKSTGREEFNLKWLQRQLTGHNISPADVQRTLTELTAISIKDALTTLPQQPDTAYFCGGGTRNPLLMERLTQLLAPIQCDTTASLGVDPQWVEAIAFAWLGWCFEHKKPGNQPEVTGASHPVVLGAKVLHQ

SEQ ID NO: 29382 - DNA, 1146 bp, Zymomonas mobilis subsp. mobilis ZM4
  CDS (1)..(1146): transl_table=11
gtgaagaaaagatcaaagggctggaaaatagaaatcgggggaaattggatgctggcaatcggacttatgtccggcacgtctttagatggtgttgatgtcgccttgattgaaaccaatggcgaaaaacaagtaaagcctttgaattttgcttcctatccttattcggatacggataaagcctgcctgcgcgaagcctgtcgtcgcgctttgacgatggcggcaccttgtttcatccccgaagatgaagtgatttatcaggccgaacatattgtaacgctccgtcatattcaggcagtcaaagatttcttgaaaaagaatgcgttaggtaatcaggctatcaaagtcatcggcttccatggtcaaacaattgctcataggccggatttgggctggacatggcaaatcggtgatggcgccgctttggcacaggcgaccaaaatcagcgtagtcgatgatttccgttctcatgatgtccaagcaggcggcgagggcgctcctttgctccccatctatcattgggcattatttagcgaagcctctcaccctttggcggtgcttaatcttggcgggattgcgaatattacttggattggggcggatgaaaacgacctcattgcttgcgatacaggccccgctaacggaatgattgatgattgggtcaaggccaaaactggcctcgattatgatgaatccggtcttattgcgagcaaaggcgttgtccatcacgatctggtcgatgcgatgatgagccagaaattcttttcgcaattaccaccgaaatcgttggatagaagcgatttttcaatcgaggcggtcgccaatctctcgatcgaggatggtgctgcaacgctgaccgcttttaccgctgaatcggttgcccgatcgctgtctttctttcctgaaagaccttcaaagattattgtggccggtggtggtcgtcataatgtgacgatgatgaaaatgctgcatgacagtttgaaaatgcctgtccagccaattgaagatttccatttaaatggtgatgcgaccgaggccgaaggctttgcctatctcgcggtcagacgggtatttaacaagcctatcagcttccctaaaacaacaggggtgccgcatcctatgacgggtggccgtattcattatatctga

SEQ ID NO: 29383 - protein, 381 aa, Zymomonas mobilis subsp. mobilis ZM4
MKKRSKGWKIEIGGNWMLAIGLMSGTSLDGVDVALIETNGEKQVKPLNFASYPYSDTDKACLREACRRALTMAAPCFIPEDEVIYQAEHIVTLRHIQAVKDFLKKNALGNQAIKVIGFHGQTIAHRPDLGWTWQIGDGAALAQATKISVVDDFRSHDVQAGGEGAPLLPIYHWALFSEASHPLAVLNLGGIANITWIGADENDLIACDTGPANGMIDDWVKAKTGLDYDESGLIASKGVVHHDLVDAMMSQKFFSQLPPKSLDRSDFSIEAVANLSIEDGAATLTAFTAESVARSLSFFPERPSKIIVAGGGRHNVTMMKMLHDSLKMPVQPIEDFHLNGDATEAEGFAYLAVRRVFNKPISFPKTTGVPHPMTGGRIHYI

SEQ ID NO: 29384 - DNA, 1083 bp, Silicibacter pomeroyi DSS-3
  CDS (1)..(1083): transl_table=11
gtgacggcgctgggggcaatgtctggcacgtcgctggacggggtcgatgcggcggtggtcgagaccgacggtctggcgatttttgggttcgggccggtgggctaccgcgcctattcgcccgaggaacgcgcggtgttgcgcgccggactggggcgttgggccggacccgaggtggaggcggcgggcgatctggtgacgcgcgcccatgcgcaggcgctggccgggttcgagggcgtcgatctggtgggttttcacggacagaccctggcgcatgagccgcgcgggcgcggcaccttgcaggtcggcgatggtgcggctttggccgccgccctgcggcggccggtggtctgggatttccgcagcgacgatgtgcagctgggcggcgaaggcgcgcctttggcgccgttctttcactttgcctgcgccaagtggatcggtgcgaccgagcccttgtgtttcctgaacctgggcggggtgggcaacctgacctatgtggacccgtcatttgagcggcccgaggtgcccggcgcgcttctggcctttgacaccgggccggccaatgccccggtcaacgatctgatgcaggcgcggctggggctgccgatggacgagggcggcgcggtggcgcggggtggcacggtggagaccggcgcgctggagctgttcctggccgagccctatttctcaagaatgccacccaagtctctggaccggaacgattttgccgagatgatcgggttggtgtcggaactcagcgacagcgatgcggtggcaacgctgacagggatgtgcgcggctgcggtggcgcaagggatggagcattgtccgcgcccgcccgcccgcgtactggtcaccggcggcgggcggcacaacccggtgctgatggagatgctgcaagtgtccctggattgtgccgttgaaccggtcgaatgcgttggcctcgatggtgacatgctggaggcgcaggccttcgcctatctggcggtgcgggtcgcgcgcggcctgtcaacctcgtgccccggcaccaccggcgtgggcgcgctggtgggtggcggcatggtcagcctgccggacgaggcctga

SEQ ID NO: 29385 - protein, 360 aa, Silicibacter pomeroyi DSS-3
MTALGAMSGTSLDGVDAAVVETDGLAIFGFGPVGYRAYSPEERAVLRAGLGRWAGPEVEAAGDLVTRAHAQALAGFEGVDLVGFHGQTLAHEPRGRGTLQVGDGAALAAALRRPVVWDFRSDDVQLGGEGAPLAPFFHFACAKWIGATEPLCFLNLGGVGNLTYVDPSFERPEVPGALLAFDTGPANAPVNDLMQARLGLPMDEGGAVARGGTVETGALELFLAEPYFSRMPPKSLDRNDFAEMIGLVSELSDSDAVATLTGMCAAAVAQGMEHCPRPPARVLVTGGGRHNPVLMEMLQVSLDCAVEPVECVGLDGDMLEAQAFAYLAVRVARGLSTSCPGTTGVGALVGGGMVSLPDEA

SEQ ID NO: 29386 - DNA, 1137 bp, Synechococcus elongatus PCC 6301
  CDS (1)..(1137): transl_table=11
atgcgtgttttgggattgatcagtggcaccagtgccgatggcattgatgtagcgatcgcggaaattcagggttttcaggcagacttaagcgttgcgctactggcctttgagacgattgcctacgaaccgagcctgcgcgatcgcattttggaagtcgcagccggatttccgctgagcgtggcggaattgaccgcactcgacgctgcgatcgctcaagcctttgcgacagcagcccaaaccttgattcagcagcatggtgcagtggatctgatcgggtctcacggccagacggtttaccatcagccgctgcaagcagggcaactaggctggagtgtgcagttgggctggggagctgcgatcgcccagcagacagggattacaacggtcagcaacttccgcagtgccgatctggcgttgggcggtcagggagccccccccgttcctgcagtagacctgtggttgttaggcagtgattccgaaaatcgttgtgtgcagaatattggtggcatcggtaatctcacctggctgccgcgccgcgatcaccctgactggcagtcggaagtccgcggttgggataccggccctggtaattccctgctggatctggcggtgcaaaaactgagccaaggtcggctctcctacgatgacggtagtcagtgggccgcaactggacagatcgatcaggtgctctgcgatcgctggttgcaggaggatgactatttccgcttgccgccgccaaaatcgacaggacgcgaacgctacggttggcagtttttagagacttgggcggcagaactcgatcgcctcacagctgcggatcaactggcaactttgacagaatttactgctgccagcattgttaataactatcgccactttttgccagctttacccgatcgcgttttggtctgtggcggtgggttacataatcaatttttgctgcagcgattacagcagcaattaccaacagtgaagatcgcgagtacggatgattttggggtcaactcccaagccaaggaagcgatcgcgatcgcggttctagcctattggcgacagcacaacgttcctggcaatttgccggcagtgactggggcgtcgggtcctgccttactaggcgatgtttttgctcgaacctaa

SEQ ID NO: 29387 - protein, 378 aa, Synechococcus elongatus PCC 6301
MRVLGLISGTSADGIDVAIAEIQGFQADLSVALLAFETIAYEPSLRDRILEVAAGFPLSVAELTALDAAIAQAFATAAQTLIQQHGAVDLIGSHGQTVYHQPLQAGQLGWSVQLGWGAAIAQQTGITTVSNFRSADLALGGQGAPPVPAVDLWLLGSDSENRCVQNIGGIGNLTWLPRRDHPDWQSEVRGWDTGPGNSLLDLAVQKLSQGRLSYDDGSQWAATGQIDQVLCDRWLQEDDYFRLPPPKSTGRERYGWQFLETWAAELDRLTAADQLATLTEFTAASIVNNYRHFLPALPDRVLVCGGGLHNQFLLQRLQQQLPTVKIASTDDFGVNSQAKEAIAIAVLAYWRQHNVPGNLPAVTGASGPALLGDVFART

SEQ ID NO: 29388 - DNA, 1086 bp, Gluconobacter oxydans 621H
  CDS (1)..(1086): transl_table=11
atggtctgggcgctcgggctgatgagcggcacgtccctggacggggtggatgctgctctgatcgaaacggatggcgtgcgcatcggacggatagggccgtccctgacagtgccttacagcccggagctgcgcggccggacccgcgagctgctggatcgtgcggctggccttgctcctgatgatgccgaagtgctggctgtcacgcgggagctgactctccggcatgtggatgccgtgcgtctgctgcgcgaaaaggcgccgggtctggagcctgccgtcataggctttcatggtcagaccattctgcatcagccggaacgtggccggagctggcagatcggcgatgcccggctgcttcaggatctctgcggtgttccggtcgtccatgatttccggtcacgtgatctggaaaacggcggggaaggtgcaccattggtgccggtgtttcacgcggccctgcttcatcaggaagtgcggcccgtggccgttctcaacattggcggggtcgccaatgtgacggttctgggccagcaggagccaaacggacagcggggcgtctgggcctgtgataccgggccgggcaatgcccttctggatgactgggcgcttcagcatactggccagccctgtgattttgggggcgctctggcagcgtcaggggcggtccatcaggatgttctggaaaggcttctggccattccgtatttcgcgcgtcccatgcccaaatcgctcgacaggctgagtttccaccctgaagccatggcatgtgtacgggatctgtctgcggcagatggcgctgcaacgctggcgtcctttacggtcgaggcagtggcagggacaacgtttccggtacggccggagggatggttcgtcgcgggaggcggccgtcacaatccggtactgatggacgggttaaaccatcgtctgggaaatgtggcatctgtggatgtgctggggtgggacggggacgcccttgaagcgcagtgtttcggccttctggccatgcgctttctgcgggggctgccctcctcttggccgggaacgaccggtgtcaggcagccctgcattgcgggaagagccgtctga

SEQ ID NO: 29389 - protein, 361 aa, Gluconobacter oxydans 621H
MVWALGLMSGTSLDGVDAALIETDGVRIGRIGPSLTVPYSPELRGRTRELLDRAAGLAPDDAEVLAVTRELTLRHVDAVRLLREKAPGLEPAVIGFHGQTILHQPERGRSWQIGDARLLQDLCGVPVVHDFRSRDLENGGEGAPLVPVFHAALLHQEVRPVAVLNIGGVANVTVLGQQEPNGQRGVWACDTGPGNALLDDWALQHTGQPCDFGGALAASGAVHQDVLERLLAIPYFARPMPKSLDRLSFHPEAMACVRDLSAADGAATLASFTVEAVAGTTFPVRPEGWFVAGGGRHNPVLMDGLNHRLGNVASVDVLGWDGDALEAQCFGLLAMRFLRGLPSSWPGTTGVRQPCIAGRAV

SEQ ID NO: 29390 - DNA, 1134 bp, Xanthomonas oryzae pv. oryzae KACC10331
  CDS (1)..(1134): transl_table=11
atgcctgtcctggaacacgttgattccctcctttatctaggccttatgtcgggcaccagcgccgacggtatcgatgccgcactggtgcgctttgccgaggacacgcaccgccgctgcgaattggtggccggcacgacggtggcgtgggagccgcaattgcgcgagaccttggtggcgcttggccagggcgccgagaccgtggccatcgatgcgctggggcaattggacgcgcaggtggggttggcattcgcagcggcggccaatcagctgatccgcgacagtggcgtggagcgccggcggattcgcgcaatcggctcgcatgggcaaaccatccgccaccggcccgaggccgacccggccttcacctggcagatcggcgatgccagccggattgccgagcacaccggcatcaccacggtggccgatttccgccgccgtgacgtcgccgccggtggccagggcgcgccgctgatgccagccttccatctggccatgctgggcgcgggcgaccaagacagcgccgtgctcaacctgggcgggatcggcaacctgaccttgattccacgcgacggcgcggtgctgggattcgataccggcccggccaacgcactgctggacagttggtgccaacgccatcacggcacgccgttcgatgccgagggcgcgtttgccgccagcgggcgcgtcgatgcggctttgctgcaggcactgttggccgatccgtggtttgcattgccgccgcccaagagcaccggccgcgagcaattccatctggactgggtcctgcaggcgatgggcagcgcgcggttggatgctgccgatgtgcaggcgaccttgctcgaactcaccgctgccagcgtggccgatgccttgctgcggctgcaacccagcacacgccgcgtgctggtctgcggcggcggggtgcgtaacccagtgctactggcgcgcctggcggcgcggctgccgggcgtggtggtggaatccagcgcgcggtacgggctggacccggattacctggaagcgatgggctttgcctggctggcagccgagctgctggccggacgcgcagccaatctgccatcggtgaccggggcggccgggcctcggctgttgggagcgatctatccggcgtaa

SEQ ID NO: 29391 - protein, 377 aa, Xanthomonas oryzae pv. oryzae KACC10331
MPVLEHVDSLLYLGLMSGTSADGIDAALVRFAEDTHRRCELVAGTTVAWEPQLRETLVALGQGAETVAIDALGQLDAQVGLAFAAAANQLIRDSGVERRRIRAIGSHGQTIRHRPEADPAFTWQIGDASRIAEHTGITTVADFRRRDVAAGGQGAPLMPAFHLAMLGAGDQDSAVLNLGGIGNLTLIPRDGAVLGFDTGPANALLDSWCQRHHGTPFDAEGAFAASGRVDAALLQALLADPWFALPPPKSTGREQFHLDWVLQAMGSARLDAADVQATLLELTAASVADALLRLQPSTRRVLVCGGGVRNPVLLARLAARLPGVVVESSARYGLDPDYLEAMGFAWLAAELLAGRAANLPSVTGAAGPRLLGAIYPA

SEQ ID NO: 29392 - DNA, 1104 bp, Vibrio fischeri ES114
  CDS (1)..(1104): transl_table=11
atggaaaaatacattggcttaatgtctggaaccagtttagatggtgtggatgccgtcatcgttgagactaacggtacaacaatcaatctacttggtcatgctgattatcctatggatccacaactaaaagcggatttacttgctgtatgcacgggacaacaaaccaatttaaaagtgattggtgaaatagatcatcgtcttggtcatctttttgctgaagcaactctgcatttactgagtactttaaatattgcctcctctgacatcactgcgattggcagtcatggtcaaacggtgtttcactcacctgatgcagaataccctttcactatgcaacttggtgatagcaatattattgctgcaaaaacaggtattgatacggttgccgattttcgtagaaaagacatggcattaggaggccaaggagcacctttagttcctgcttttcataacactttatttggaaagccagagagcaccaatgtaattctaaatattggcggtatctctaatatctctattttacaaaaagactctcctgttattggttatgacacaggccctggcaatatgttgatggattcatggattactgagcataaaggggaaagttacgataaagatggcgcatgggctcgttctggtcaaattatagatgagctgctcaaccagctaaaaacacacgattattttgcgcgcccatacccgaaaagcaccggacgagagctgtttaatttagattggtttgcacaatacatcgaaaataaaccgtatcaaccacaagatgttcaagcaacgctattagaattcaccgtgacaactattgttgatcaagtgatccgattccaagttggcaatgacactaagctattagtctgtggtggcggagctcataaccagtttttaatggaacggctgcaatatcatttacctaattgggcagtttccaccactaacgactacaatgtagatagtgacaatatggaagcaatggcctttgcatggcttgctcatcaaagaattcatggcttgccaagtaatgaacctgatgtgacaggtgcttctcgttatgcgagtttaggtgtaatctacccggctaattaa

SEQ ID NO: 29393 - protein, 367 aa, Vibrio fischeri ES114
MEKYIGLMSGTSLDGVDAVIVETNGTTINLLGHADYPMDPQLKADLLAVCTGQQTNLKVIGEIDHRLGHLFAEATLHLLSTLNIASSDITAIGSHGQTVFHSPDAEYPFTMQLGDSNIIAAKTGIDTVADFRRKDMALGGQGAPLVPAFHNTLFGKPESTNVILNIGGISNISILQKDSPVIGYDTGPGNMLMDSWITEHKGESYDKDGAWARSGQIIDELLNQLKTHDYFARPYPKSTGRELFNLDWFAQYIENKPYQPQDVQATLLEFTVTTIVDQVIRFQVGNDTKLLVCGGGAHNQFLMERLQYHLPNWAVSTTNDYNVDSDNMEAMAFAWLAHQRIHGLPSNEPDVTGASRYASLGVIYPAN

SEQ ID NO: 29394 - DNA, 1131 bp, Neisseria gonorrhoeae FA 1090
  CDS (1)..(1131): transl_table=11
atggcgttttgcaccagtttgggagtgatgatggaaacacagctttacatcggcattatgtcgggaaccagtatggacggggcggatgccgtgctggtacggatggacggcggcaaatggctgggcgcggaagggcacgcctttaccccctaccctgaccggttgcgccgcaaattgctggatttgcaggacacaggcacagacgaactgcaccgcagcaggatgttgtcgcaagaactcagccgcctgtacgcgcaaaccgccgccgaactgctgtgcagtcaaaacctcgctccgtgcgacattaccgccctcggctgccacgggcaaaccgtccgacacgcgccggaacacggttacagcatacagcttgccgatttgccgctgctggcggaactgacgcggatttttaccgtcggcgacttccgcagccgcgaccttgctgccggcggacaaggtgcgccgctcgtccccgcctttcacgaagccctgttccgcgatgacagggaaacacgcgtggtactgaacatcggcgggattgccaacatcagcgtactcccccccggcgcacccgccttcggcttcgacacagggccgggcaatatgctgatggacgcgtggacgcaggcacactggcagctgccttacgacaaaaacggtgcaaaggcggcacaaggcaacatattgccgcaactgctcggcaggctgctcgcccacccgtatttctcacaaccccacccaaaaagcacggggcgcgaactgtttgccctaaattggctcgaaacctaccttgacggcggcgaaaaccgatacgacgtattgcggacgctttcccgattcaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatcctcaatgggtggaggcggccgcatttgcgtggttggcggcgtgttggattaaccgcattcccggtagtccgcacaaagcgaccggcgcatccaaaccgtgtattctgggcgcgggatattattattga

SEQ ID NO: 29395 - protein, 376 aa, Neisseria gonorrhoeae FA 1090
MAFCTSLGVMMETQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVCDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 29396 - DNA, 1122 bp, Salmonella enterica subsp. enterica serovar Choleraesuis str
  CDS (1)..(1122): transl_table=11
atgaaatcgggccgttttattggcgttatgtccggaaccagccttgatggcgtggatgttgtattggcggcaattgatgaaaccatggttgcgcaacaggcaagtctcacctggcccattcccgttcatctgaaaaaaggcattctcgatatttgccagggacagccgcttacgctctcgcaactcggccagcttgatacccagttaggccggctttttgcacaggcggttaatgcgctgttagcgcaacaacgtttgcagccgcgggatatcgtcgccattggttgtcatgggcaaacggtctggcatgaaccgaccggcgaggccccgcatacgctgcaaattggcgataataatcacatcgtcgcccatacggggattacagtggtcggcgattttcggcggcgggatattgcgctgggcggacaaggcgcgccgttggtgcctgctttccatcacgcgctgttgggacatccgacggaaaaacgtatggtcctgaatatcggcggcatcgccaatttatctctgcttttccccggacaggcggtgcgcgggtacgacacggggccgggtaatatgttgatggatgcgtggatttggcgacaatgcgcgcagccctacgacaaagacgcggcatgggcgaaagaaggtcaggttattcttccattgctgcaaaagatgttgcgcgatccgtactttgctgcgtcggcacccaaaagtacaggacgcgaatatttcaactatggctggttagagcgtcatcttacggctttccctggcgcagacgcgcgcgatgtacaggccacgttggcggagctgacggcggtctccatcgcccaacaggtgctgctcaatggcggctgcgagcggctgatggtctgtggcggcggaagccggaatccgttagtgatggcccgtctggcggcgctgttgcccggtatcgaggtttcgaccaccgataaggcggggatcagcggcgatgatatggaagcgctggcctttgcatggcttgcctggcgaacgctcgcgggcctgccgggaaatttgccttccgtgacgggtgctacagaagccagtgttttaggcgctatttacccggctaacccaataactcagagttaa

SEQ ID NO: 29397 - protein, 373 aa, Salmonella enterica subsp. enterica serovar Choleraesuis str
MKSGRFIGVMSGTSLDGVDVVLAAIDETMVAQQASLTWPIPVHLKKGILDICQGQPLTLSQLGQLDTQLGRLFAQAVNALLAQQRLQPRDIVAIGCHGQTVWHEPTGEAPHTLQIGDNNHIVAHTGITVVGDFRRRDIALGGQGAPLVPAFHHALLGHPTEKRMVLNIGGIANLSLLFPGQAVRGYDTGPGNMLMDAWIWRQCAQPYDKDAAWAKEGQVILPLLQKMLRDPYFAASAPKSTGREYFNYGWLERHLTAFPGADARDVQATLAELTAVSIAQQVLLNGGCERLMVCGGGSRNPLVMARLAALLPGIEVSTTDKAGISGDDMEALAFAWLAWRTLAGLPGNLPSVTGATEASVLGAIYPANPITQS

SEQ ID NO: 29398 - DNA, 1122 bp, Brucella abortus biovar 1 str. 9-941
  CDS (1)..(1122): transl_table=11
atgcccgatttgaaacgcgcaataggactgatgagcggcacctcgatggatgggatcgacattgctcttcttgctaccgacggcgaaaactggatagagcggcgcgcttctgcctcgatggattattcggatggttttcgcgcgcggctgaaagcagggcttgtcgatgcgcgcgccatcaaagacagggccgagcgtcccggcctgctgcggcagcttgagcatgacctgacattgctccatgccgttgctgttcatgatttccttcacgaacagggcttgcagccgcacgagatcgacgtgatcggttttcatggccagacggtgctgcatcgcccgaacgagagcctgactgtccagatcggcgacggcgcgctgctggctcgcgaaacgggcattcctgtcgtttatgacatgcgggcggaagacatgcgccatggcggtcagggtgctcccttgattcccgcctaccatgccgctttggcggccaatctgccgcttggcctcaaaggcccggtcgtcttcgtcaatatcggcggcatctccaatctcacctatgtcggcgaggatggcgcgctgatcgcctatgacagcgggccgggaaacatgctcatcgatcaatggatggaactgcatgggcatggccggtttgatccgggcggtgcaactgcgatgagcggaagtgtggaccgaaacaccgcccaccgatatctcgaacatgaattcttcaagggaaaccaccgccgttcgctcgatcgtggcgatttcgccattccggccaagggtgaattgaaccttgccgatggcgcgcgcacacttgcatttgtaagtgcggcggcaatcctcaaatccgcttcgcatctgcctgcccgtccgcgcacctatgtggtgagcggtggagggcgcaagaatggtgcgctcatggacgagctgaccgcgcttgccgagcgcgagggcgcgcatgtgatcgatgcggataatgccggtttcgatggggacgccatggaggcagaggcctgggcctatcttgcagtgcgttcgctttgcggcctgccgctcacctatccctccacgacgggctgcgacaagcccgtttccggcggcgttcctgttaggccctaa

SEQ ID NO: 29399 - protein, 373 aa, Brucella abortus biovar 1 str. 9-941
MPDLKRAIGLMSGTSMDGIDIALLATDGENWIERRASASMDYSDGFRARLKAGLVDARAIKDRAERPGLLRQLEHDLTLLHAVAVHDFLHEQGLQPHEIDVIGFHGQTVLHRPNESLTVQIGDGALLARETGIPVVYDMRAEDMRHGGQGAPLIPAYHAALAANLPLGLKGPVVFVNIGGISNLTYVGEDGALIAYDSGPGNMLIDQWMELHGHGRFDPGGATAMSGSVDRNTAHRYLEHEFFKGNHRRSLDRGDFAIPAKGELNLADGARTLAFVSAAAILKSASHLPARPRTYVVSGGGRKNGALMDELTALAEREGAHVIDADNAGFDGDAMEAEAWAYLAVRSLCGLPLTYPSTTGCDKPVSGGVPVRP

SEQ ID NO: 29400 - DNA, 1095 bp, Pseudomonas syringae pv. syringae B728a
  CDS (1)..(1095): transl_table=11
atggacttcttctatataggtgtgatgtccggcagcagtctcgatgggattgatatcgcccttttgaagcaggatgaccgatcaaggcttctggctactcactacatccccatgccggaagacctgcatgccgagctgctggggctttgctccagcggcgcggatgagcttgcgcgtgcggccattgcggagcaaaagtggtgcaggctggtcgcacagggcgtgcagaccttgctgcaagatcaaaacatggtgcccgctcagattcgcgccattggcagccacggccagactattcgtcatgagccatcgcgcggctacagcattcagatcggcaaccctgcgctgctggcagagctgactgaaattaccgtggtcagcgacttccgccgccgcgacatcgcagcaggcggccagggtgcccccctggtgccggctttccacgaagcgttgttcgacgacaacaaggatcatcgcgccgtgttgaacatcggcgggttcagtaacctgagcctgatcgagtcggatcgcccggtcgaaggcttcgactgcggccccggtaacgtactgctcgatgcgtggatatcttcacagctccatgaaagctacgacaaggatggcgcatggtcggcgagcggcaaggttgattctgcgctgctccagaaactgctcagcgatcagtttttcctgaccaagggccccaagagtacaggccgggaagtgttcaacctgggctgggttaaacaccatctgttccagtcgaaaacactggctccagaagatgtgcaggccactctgctggaactgacagcattgacgatcaccgattccctgaaatctgcacaaccgattacccgggagcttctggtctgtggtggcggtgcgcataacaaggcgctgatgaaacgccttgcagagctgttgcccgatacagaggtcagcagtaccgagaagttcggcgtaaaccctgactgggttgaggcaatggcgtttgcctggctggcccattgctgcctcgaaggcgttccggccaaccgtccgacggtaaccggcgccaagggcagacgcgttctgggcgcgatttaccccgcctga

SEQ ID NO: 29401 - protein, 364 aa, Pseudomonas syringae pv. syringae B728a
MDFFYIGVMSGSSLDGIDIALLKQDDRSRLLATHYIPMPEDLHAELLGLCSSGADELARAAIAEQKWCRLVAQGVQTLLQDQNMVPAQIRAIGSHGQTIRHEPSRGYSIQIGNPALLAELTEITVVSDFRRRDIAAGGQGAPLVPAFHEALFDDNKDHRAVLNIGGFSNLSLIESDRPVEGFDCGPGNVLLDAWISSQLHESYDKDGAWSASGKVDSALLQKLLSDQFFLTKGPKSTGREVFNLGWVKHHLFQSKTLAPEDVQATLLELTALTITDSLKSAQPITRELLVCGGGAHNKALMKRLAELLPDTEVSSTEKFGVNPDWVEAMAFAWLAHCCLEGVPANRPTVTGAKGRRVLGAIYPA

SEQ ID NO: 29402 - DNA, 1134 bp, Xanthomonas campestris pv. campestris str. 8004
  CDS (1)..(1134): transl_table=11
atgtctgctccgacacacacgcactccccgctctatctcggcttgatgtcaggcaccagtgccgacggcatcgatgcggcgttggtgcgcttcgacgacgccagccaccgccgctgcgaactggtcgctgggatcacggtgggctgggaaccacagttgcgcgaagcgttggtcgcgctcggccagggcgccgagcagatggcgatcgaccgcttgggccgtctggacgcgcaggtcgggctggcctttgcagacgcggccaatcagctgattgccgaggccggcgtggcgcgcgagcagatccgtgcgattggctcgcacgggcagaccatccgccaccggccacaggccgacccggcctttacctggcagatcggcgacgccagccggatcgccgaacacaccggcattaccacggcggccgatttccgccggcgcgatgtggcggccggcggccagggcgcgccgctgatgccggccttccacctggcgatgctgggtgccagcgacgaagaccgtgcggtgctcaacctgggcggcatcggcaacctgacgctgatcccgcgcgacggcgcggtgctgggctttgacaccggcccggccaatgccttgctcgatagctggtgccagcagcaccgaggcacgccgttcgacgccgacggcgcgtttgcagccagcggcaaggtagatgcagcgttgctacacgcgctgttggccgacccgtggttcgcactgccgccgcccaagagcaccggccgtgagcaatttcacctggcgtgggcactgcaggccatgggcaccgcgacgctgcgcccggccgatgtgcaggccaccttgctggaattgacggcggccacggtggccgatgcgttgctgcgccaccagccgacaacgcgccgcgtactggtctgcggcggcggcgtgcgcaacccggtgctgctggcgcggttggccgcgcgcctgcctggcgtggtggtggagtccagcgcgcgccatgggctggatccggattacctggaggcgatgggctttgcctggctggccgccgagctcctggccggacggccggccaatctgccatcggtgactggtgcggcggggccgcggctgctgggggcgatttatccggcctga

SEQ ID NO: 29403 - protein, 377 aa, Xanthomonas campestris pv. campestris str. 8004
MSAPTHTHSPLYLGLMSGTSADGIDAALVRFDDASHRRCELVAGITVGWEPQLREALVALGQGAEQMAIDRLGRLDAQVGLAFADAANQLIAEAGVAREQIRAIGSHGQTIRHRPQADPAFTWQIGDASRIAEHTGITTAADFRRRDVAAGGQGAPLMPAFHLAMLGASDEDRAVLNLGGIGNLTLIPRDGAVLGFDTGPANALLDSWCQQHRGTPFDADGAFAASGKVDAALLHALLADPWFALPPPKSTGREQFHLAWALQAMGTATLRPADVQATLLELTAATVADALLRHQPTTRRVLVCGGGVRNPVLLARLAARLPGVVVESSARHGLDPDYLEAMGFAWLAAELLAGRPANLPSVTGAAGPRLLGAIYPA

SEQ ID NO: 29404 - DNA, 1092 bp, Pseudomonas fluorescens Pf-5
  CDS (1)..(1092): transl_table=11
atggcgctctatataggtgtgatgtccggtaccagccttgatggcctggacatcgccctgatcgagcaaagcccggcgcttagattggtcgccactcgctacatccccatgcccgataccctgcgcgccgaactcctgggtttgtgcgccagtggccccgacgagatcgcccgttccgccatcgcccaacagcactgggtcgagctggccgcccagggcatcaaccagcttctgcaacaacagcaactgccccctcaagacattcgcgctatcggcagccacggacaaaccgtgcgtcatgagccaagccgcgggttcacggtgcagatcggcaacccggccctgctcactgagctgaccgggatcactgtcgtcagcgacttccgcagccgcgacgtggcagcgggcgggcaaggcgcgccgctggttccggcctttcacgaagccctgttcgaccagcgcccgggaaaccgcgccgtgctgaacgtcggcgggttcagcaacctgagcctgatcgaaaccgccaagccggtggccggattcgactgtggcccgggcaacgtcctgctcgatgcctggatccaggcccaacgcgcagagaacttcgaccgcaatggccaatgggctgccagcggccaggttgatccgcccctactgcaagccctgctcagcgacccgttcttcgccacccaaggcccgaagagcaccgggcgcgaggtattcaatcttgattggctacagcggcatctgagggcacggggcgctattgccgccgaaaacgtgcaggctacccttctggagctgacagctctaaccatcgtcgagtcgctgcagagcgctcaaagtgacacccaggagttgctggtgtgcggcggcggcgcgcataacgcagcgctcatgggccgcctggcagccctcctcccgcaaacacgggtcagcagcactgcggcgtatggcgtagatcccgactgggtagaggctatggcgtttgcctggctggcccactgctgcctggaaggcatcgctgccaaccggcccagcgtcaccggcgcccgtggcctgcgtgtactaggcgccatctacccggcttga

SEQ ID NO: 29405 - protein, 363 aa, Pseudomonas fluorescens Pf-5
MALYIGVMSGTSLDGLDIALIEQSPALRLVATRYIPMPDTLRAELLGLCASGPDEIARSAIAQQHWVELAAQGINQLLQQQQLPPQDIRAIGSHGQTVRHEPSRGFTVQIGNPALLTELTGITVVSDFRSRDVAAGGQGAPLVPAFHEALFDQRPGNRAVLNVGGFSNLSLIETAKPVAGFDCGPGNVLLDAWIQAQRAENFDRNGQWAASGQVDPPLLQALLSDPFFATQGPKSTGREVFNLDWLQRHLRARGAIAAENVQATLLELTALTIVESLQSAQSDTQELLVCGGGAHNAALMGRLAALLPQTRVSSTAAYGVDPDWVEAMAFAWLAHCCLEGIAANRPSVTGARGLRVLGAIYPA

SEQ ID NO: 29406 - DNA, 1401 bp, Psychrobacter arcticum 273-4
  CDS (1)..(1401): transl_table=11
atgaccaaccccgcatcgattactgatagtcagcataataatttttcagatatgagtttagataatgattttaatagccgtctagataatatggacgatttaaactatgccactctgactgaagcacttgaacaaacggttttcgaaaacttcgatgatggcttatatatcggcatgatgtcgggcactagcttagatggtatggatgcgattctttgtcaatttagtaatcatactaatagttcaaatattagtaatgaagacaatacacagcagccaatgcacttgctagcgacatatagccaagattttccgccacgtttacgtgaggtgttattggccttgtgtcagcctaatggcatcaatcaattaacaccaacggcgggtgaaccagatagtgaattagaatggttcggttgggcaagtaaagcatatgctgagtttgcaagcgacgtggtcaatacgttattgcagcaatcaaataccgatatagagtctgtattggcgattggctgtcatggtcaaacggtacgccatcgtccgcagatgggctttagcttgcaattggtcgatgccaacatcatcgccgagcgtactggcattagcgtcgtcagtgattttcgacgccgagatatggcagtcggcggtcaaggtgcgcctctagttcctgcttttcaccaagccttatttgctgtgcctgatagcactcgcatattactcaatctgggtggtattgctaatatcgctgtcttgccagcgatttctgatgacctctcggattttaatgaacactcagacaatcagccatctgatagcgtggttggttatgatacgggtcctgccaatctactattagatgcatggacagcactgcatactgacaaggattatgatgctggcggtacatgggcgcagtcaggtcaagtcgttgagccgctactcaatcaactattagagcatccattttttgttaaagcttatccaaaaagcacagggcgcgaagattttaacttagcatggctgcaagatgagttacaaaaattcgatcaagctgctgctgatattcgctactcatcagccgatgtacaagcaacgctcactgagctgaccgccatcagtgccagtgcacaaatcaatatatttatcaatgctagtagcaataatgccgtctatgtctgcggcggcggtgcactgaacgattatctcatgatgcggttacaagcacatctaccgcgctgcaaagtagaaaccacagccagtttgggacttgagccaacttgggtggaagccgtcgcctttgcatggttggcaagacaaacactcatgggtgaaacgggtaacttacctgccgtaacgggtgcaagtaaaggcgtggtattaggacaagtatgttttgcttga

SEQ ID NO: 29407 - protein, 466 aa, Psychrobacter arcticum 273-4
MTNPASITDSQHNNFSDMSLDNDFNSRLDNMDDLNYATLTEALEQTVFENFDDGLYIGMMSGTSLDGMDAILCQFSNHTNSSNISNEDNTQQPMHLLATYSQDFPPRLREVLLALCQPNGINQLTPTAGEPDSELEWFGWASKAYAEFASDVVNTLLQQSNTDIESVLAIGCHGQTVRHRPQMGFSLQLVDANIIAERTGISVVSDFRRRDMAVGGQGAPLVPAFHQALFAVPDSTRILLNLGGIANIAVLPAISDDLSDFNEHSDNQPSDSVVGYDTGPANLLLDAWTALHTDKDYDAGGTWAQSGQVVEPLLNQLLEHPFFVKAYPKSTGREDFNLAWLQDELQKFDQAAADIRYSSADVQATLTELTAISASAQINIFINASSNNAVYVCGGGALNDYLMMRLQAHLPRCKVETTASLGLEPTWVEAVAFAWLARQTLMGETGNLPAVTGASKGVVLGQVCFA

SEQ ID NO: 29408 - DNA, 1128 bp, Candidatus Pelagibacter ubique HTCC1062
  CDS (1)..(1128): transl_table=11
atggaaaaattttatacttctttagggttaatgagtggcacatctatggatggggttgatgcgtcaattattagatcagatggtgaaagtaactatgaacctatatttgataaatattttgagtatgatggagtaatttactcaaacttactaaatctaagagataagataaattcaataaaagatttacaagataattcttatcaaattaacgagctcgagagaaaaattaccttatttcatgcaaaaattagcaaagaaattataaagaatgcaggagtggatgtagatatagttgggtttcacggtcaaacaatttttcacaatgctcaggaaaaaatatcaaaacaaataggagatggcaatttactatcaagtcttttaaaaaaaaatgtagtttataactttagagaaaatgacattcataatggcggccaaggagctccattagctccaatctttcacaacttacttataaaccagaataaaatagagaaacctgcttgtgttttaaacataggaggtatcgcaaatattactcttgttatctcaaaaaataatgaagatttaaaaagttttgatgtaggtcctggtaattgtcttttagatgaatgggttagaagacacacacaaatgaaatatgatgaaaatggaaaagcatcaaatttaggaaaaacaagtgaagttattctaaatcaagcgattgataattttgacaatataagtaatcaaaaaaaactttcatttgatataaaagattttgatttaagttttgtaaaaggtctcacatatgaggatggcttatctacattagtagattttacagcaataataatttatcaatcaattttaaaatcaatcaacagtgaagaaaataaaaagttattaataatagtttgtggtggtggaagaaaaaacctttcattaatggagagcataagaaaaagactaccaaaaaatatttatttaaaaataattgatgattataaagttgatggtgatttcatcgagtctcaagcttttgcttatcttgcaattaggtctgcacttaaaaaagtaatttcattccccaatactacaaatgtcaaaaaaccgtcaataggtggagttttagttaaaaactattaa

SEQ ID NO: 29409 - protein, 375 aa, Candidatus Pelagibacter ubique HTCC1062
MEKFYTSLGLMSGTSMDGVDASIIRSDGESNYEPIFDKYFEYDGVIYSNLLNLRDKINSIKDLQDNSYQINELERKITLFHAKISKEIIKNAGVDVDIVGFHGQTIFHNAQEKISKQIGDGNLLSSLLKKNVVYNFRENDIHNGGQGAPLAPIFHNLLINQNKIEKPACVLNIGGIANITLVISKNNEDLKSFDVGPGNCLLDEWVRRHTQMKYDENGKASNLGKTSEVILNQAIDNFDNISNQKKLSFDIKDFDLSFVKGLTYEDGLSTLVDFTAIIIYQSILKSINSEENKKLLIIVCGGGRKNLSLMESIRKRLPKNIYLKIIDDYKVDGDFIESQAFAYLAIRSALKKVISFPNTTNVKKPSIGGVLVKNY

SEQ ID NO: 29410 - DNA, 1191 bp, Colwellia psychrerythraea 34H
  CDS (1)..(1191): transl_table=11
atgattaataataaaacggtagcagaaggaagatactatattggcttaatgtcaggcaccagtgctgatggtatcgacttggcgctagtagactttactgataaggggcaacagcctcgattagttgctagtttctatcaaagttatagcgctattattgcagataaaatcacctcactttatcaacctgggagtaatgagattgatcgtgcatttcatttggatgttgaattagcgcagttattttctcaggccattaatgcattacttaatcaagaaaagctaacccctgaagatattattgccattggtaatcacgggcaaaccattcgtcatcgtccaagtggcgataacccatttactttacaaataggttgctgccaaacgttggctacgttgactgggattcgcgtggtaggtcagtttcgtcgtaaagatatggcgttaggtggtcaaggcgcacctttagtcccgatttttcatcaacagttattcactcaaacaaccgccgcgaactttgtggtgaatataggcggtattgccaatataacctttttgccaacacgagattctaatcaagctgttttgggttttgatacaggaccaggtaatgctttacttgatgattggttcactaaacatcacccaaatagtgatgactgctttgataaaaatggcgcttgggcaacaacgggacaagttattccgttgttgctagagcagttgatgcaagatgattatataaattctgcagcacctaaaagtacaggaagagaatattttcaccttgaatggcttgaacagcaattaacagcttttaaagaggcaactcattcgcaacatgaaacagtaatcaatcataatgccgatattcaagcgacactattggcttttaccgcacagagtattagcgacgccattatggcgctaacggcacaaggtaaagtctacttgtgtggcggcggtgtccataataaggctctagtggaagcgcttagcagtagattaactgcatccgacactgtctttgaaataaacaccatgcaagcactgaatattgatggtgatattcttgaagctatggcgtttgcttggcttgcatacgcttttgatcaaggtttagacagtaatctgccagcagtcactggtgcgagcgcaagttgtaccttaggtagtgcttttcttccttaa

SEQ ID NO: 29411 - protein, 396 aa, Colwellia psychrerythraea 34H
MINNKTVAEGRYYIGLMSGTSADGIDLALVDFTDKGQQPRLVASFYQSYSAIIADKITSLYQPGSNEIDRAFHLDVELAQLFSQAINALLNQEKLTPEDIIAIGNHGQTIRHRPSGDNPFTLQIGCCQTLATLTGIRVVGQFRRKDMALGGQGAPLVPIFHQQLFTQTTAANFVVNIGGIANITFLPTRDSNQAVLGFDTGPGNALLDDWFTKHHPNSDDCFDKNGAWATTGQVIPLLLEQLMQDDYINSAAPKSTGREYFHLEWLEQQLTAFKEATHSQHETVINHNADIQATLLAFTAQSISDAIMALTAQGKVYLCGGGVHNKALVEALSSRLTASDTVFEINTMQALNIDGDILEAMAFAWLAYAFDQGLDSNLPAVTGASASCTLGSAFLP

SEQ ID NO: 29412 - DNA, 1095 bp, Pseudomonas syringae pv. phaseolicola 1448A
  CDS (1)..(1095): transl_table=11
atggacttcttctatataggtgtgatgtccggcagcagtctcgatgggattgatatcgcccttttgaagcaggatgaccgctcaaggcttctggctactcactacatcccgatgccggaagatctgcatgccgaactgctggggctttgctccagtggcgtcgatgagcttgcacgcgcagcaatcgccgagcagaagtggtgcaggctggtcgcacagggcgtgcagaccttgctggaagatcaaaacatggtgcctgctcagattcgcgccattggcagccacggccagactattcgtcatgaacctgcgcgcggctacagcattcagatcggcaacccggcgctgctggcagagctgacagaaatcaccgtggtaagcgattttcgtcgtcgcgacatcgccgcaggcggacagggtgcgccgctcgtacccgccttccacgaagcactgttcgacgataacaaagaccaccgcgctgtattgaacatcggcggcttcagcaatctgagcctgatcgaatccgatcgcccggtcgaaggcttcgattgcggtccaggtaacgtgctgctggatgcctggatacaatcccagcgccatgaaagctacgacaaggacggggaatgggcggcgagcggcgaggttgatcaagcgcttctccagaaactgctcagcgatcagtttttcctgaccaaaggcccaaaaagcaccggtcgggaagtgttcaacctgggttgggtgcaccatcatctgttccagctgccaacgttgacacctgaagacgtgcaagccacgctgctggaactgactgcattgaccatcacagagtccctgcaatcggcacaagcgatcaccaaggagcttctggtctgtggcggcggcgcacataacaaggcgctgatgaaacgccttgcagagctattgcctgacacagaggtcagcagtaccgagaagttcggcgtggaccctgactgggttgaggccatggcatttgcctggctggctcattgctgcctcgaaggcgtaccggccaaccgcccaacggtaaccggcgctaaaggcagacgtgttctgggcgcgatctaccccgcctga

SEQ ID NO: 29413 - protein, 364 aa, Pseudomonas syringae pv. phaseolicola 1448A
MDFFYIGVMSGSSLDGIDIALLKQDDRSRLLATHYIPMPEDLHAELLGLCSSGVDELARAAIAEQKWCRLVAQGVQTLLEDQNMVPAQIRAIGSHGQTIRHEPARGYSIQIGNPALLAELTEITVVSDFRRRDIAAGGQGAPLVPAFHEALFDDNKDHRAVLNIGGFSNLSLIESDRPVEGFDCGPGNVLLDAWIQSQRHESYDKDGEWAASGEVDQALLQKLLSDQFFLTKGPKSTGREVFNLGWVHHHLFQLPTLTPEDVQATLLELTALTITESLQSAQAITKELLVCGGGAHNKALMKRLAELLPDTEVSSTEKFGVDPDWVEAMAFAWLAHCCLEGVPANRPTVTGAKGRRVLGAIYPA

SEQ ID NO: 29414 - DNA, 1137 bp, Prochlorococcus marinus str. NATL2A
  CDS (1)..(1137): transl_table=11
atgcgtgtattgggtttgatgagtggtacgagtgcggatggaatagatgcagttttagttgattttacaggtgatccttcaaggccaaaatggcaaattttaaacacattttcttatgaatatccttcatcaattagagaaaaaataatacaagtaggtcaaggattaaaaattagtagcaaagattggctcgagttggctgaggaaattactgaactaaatgcttttgctgctcgtacttgtgaccctgattcaaccgcagaggttgttggatgtcatgggcaaactttatttcatagaagtgtaaaaaaatctaaaagaggaggaagtcttcaaattcttttaggacctttactcgcaaatcttttagatcaaattgttatttatgattttagatctaaggatattgcttcaggtggtcatggtgcccctttagtagcattagtcgatgaagctttagttggaaggttatatggatggagaggagtcctcaaccttggtggaattgctaatcttacaattattccacctaaaactggaattgataaaacttctcaatgcttaggctgggattgcggaccggctaattctttagttgatttagctgttaaagaaagtacaaattcatctttaacttttgatgaaaatggatcattagcatcgcttgggattcctaaattagaaatcatcgataagtggttgagggatccttttttttatctagagcctccacgatctacaggtagagaacaattcggttttcaatacttacagaaaagaaaaaaggaattgggtgatatttccaaagaagatttaatatctacattaactacatttaccgcgtcaattatctctcaagatttagataatctttttaagcttaaacagatacgtttaattgagcttttggttgctggaggtggaagtaaaaatctatttttaatgaggcaactacagaaacaatgttgtggtgttcatgttcgtccaatacatgaaattggtgttccatcgcaatatagagaagccctcgtttttgcaactttatcttggtggaactttttaggaaaaaaagttcacccgaagtacatcacaggagcaaataaacctattttatatggagtacgtgttgatccttaa

SEQ ID NO: 29415 - protein, 378 aa, Prochlorococcus marinus str. NATL2A
MRVLGLMSGTSADGIDAVLVDFTGDPSRPKWQILNTFSYEYPSSIREKIIQVGQGLKISSKDWLELAEEITELNAFAARTCDPDSTAEVVGCHGQTLFHRSVKKSKRGGSLQILLGPLLANLLDQIVIYDFRSKDIASGGHGAPLVALVDEALVGRLYGWRGVLNLGGIANLTIIPPKTGIDKTSQCLGWDCGPANSLVDLAVKESTNSSLTFDENGSLASLGIPKLEIIDKWLRDPFFYLEPPRSTGREQFGFQYLQKRKKELGDISKEDLISTLTTFTASIISQDLDNLFKLKQIRLIELLVAGGGSKNLFLMRQLQKQCCGVHVRPIHEIGVPSQYREALVFATLSWWNFLGKKVHPKYITGANKPILYGVRVDP

SEQ ID NO: 29416 - DNA, 1119 bp, Thiobacillus denitrificans ATCC 25259
  CDS (1)..(1119): transl_table=11
ttgagcgcagttcccacgcatgaggccgaaccctacgtcggcctcatgtccggcaccagccttgacggcatagacgcggtcctggccgagatcggcaccggcaaccaagttcgcctgctccgtacccgatacatccattatcccgacgacctgcgcgcgcagttgctcgcgctccatacgccgcaggccgacgaagtccatctcgcggcgcttgccgccaacgctctggcacgtctctacgccgaagcggtcggagcgctgcttgagggcatcgatccggccaaaatccgcgcgatcggctgccacggccagaccctgcgccaccggccgggggacggctatacgatccagatcggaaacgcgtcgctgctggccgaactcgcgggcatcgccgtcgtctcggacttccgaagccgcgacatcgcggcgggcggccagggcgcgccgctggtcccggccttccacgcccgcgtgctggcccatcccgagattcaccgggtcattgccaacgtcggggggatcgcgaacatcacggaccttccgccgaatggcccgatccggggctgggatacggggccgggcaacatgctcatggacgcgtggatccatcggcatcagggaagccggtacgatcgcgatgggagttgggccgccgagggcagcgtggccgccggactcctgcaagcattgctgcgccacccctacctggagcagcgcccgccgaaaagcgccgggcgcgagcagttcaacctggaaagtctcgacacgacgctggccggactagggcagaggctcgagccgggcacggtacaggccaccctgctcgaatttaccgccgtctcgctctgcgacgccgtgacgcaggagtgccgcggcgcgcaagaactctacgtctgtggcggcggcgcgcacaacggcgccttgatgcggcgcatcgcggcgctcctcccgcacgtccgcgtcacgacgactgccgacctgggcatcgacccggattgggtcgaggcgctcgcgtttgcttggctcgcccggcagacgatgcacggcgaagccggcaacctgcctgccgtgacaggcgcatgcggggaacgcatactcggcgcgatccatccggcctga

SEQ ID NO: 29417 - protein, 372 aa, Thiobacillus denitrificans ATCC 25259
MSAVPTHEAEPYVGLMSGTSLDGIDAVLAEIGTGNQVRLLRTRYIHYPDDLRAQLLALHTPQADEVHLAALAANALARLYAEAVGALLEGIDPAKIRAIGCHGQTLRHRPGDGYTIQIGNASLLAELAGIAVVSDFRSRDIAAGGQGAPLVPAFHARVLAHPEIHRVIANVGGIANITDLPPNGPIRGWDTGPGNMLMDAWIHRHQGSRYDRDGSWAAEGSVAAGLLQALLRHPYLEQRPPKSAGREQFNLESLDTTLAGLGQRLEPGTVQATLLEFTAVSLCDAVTQECRGAQELYVCGGGAHNGALMRRIAALLPHVRVTTTADLGIDPDWVEALAFAWLARQTMHGEAGNLPAVTGACGERILGAIHPA

SEQ ID NO: 29418 - DNA, 1158 bp, Haemophilus somnus 129PT
  CDS (1)..(1158)
atgttattatgtttagcaaacatacgttcttcttttatgcaaaaaaataatcactattatattggaattatgtccggtacaagtttagacggtgttgatatagccttaatggattttaatcaaagaccgcccaaactgcttgcaagttattgtttctctatgccggaaaatttacgccaaaaacttaccgcacttttatcatccggcacaatcggtttgcagcaattaggcgagttggatcatcaactgggattactttacgcaaactcggtacaacgtttcttagcacaaaatcaaatgaccgctgataatattcaagccatcggttgtcatggacaaacgatttggcattcaccccaaggtcaatatcctttcactatgcaaattggcgatgctaacctgattagtgtactgacaggaattacgactatcgctgattttcgtcgcaaagatatggcttatggtggacaaggtgcacctttgtccactgcatttcatcaagccttatttgcacaacccgatcgtattacagtagtgttaaatattggcggtatcagtaatatttcttgtttaattccggaacaagaagttattggttatgataccggtgtaggtaatgctttgatggatagttggattgaacaacatttaggggtgcctttcgaccaagacggtgaatgggcaaagagcggtagtgttcaccaagatttgctaaaagatttattggacgaacctttttttcaacaacttccccctaaaagtactggacgggaattatttaatttggcgtggttgaacaaaaaactgaaaaaacataccgcactttctgcacaagatgtacaggcaacgttgctggaatttacggtacaatgcacggtgcaagagctggttaaactcgctaatccgaaccatttgccttgtttgttgttggtttgtggcggtggtgcaaaaaacagacaactaatggctcgtttacaagcctgtttaccgcaatggcacgtagcaacaactacagagcatggtttatcggttgattatgttgaagccgccgcttttgcttggttagcgtatcagcgtataaatcatttaccctctaatttgccaagtgtaaccggtgctaaaagtgcggtcagtcttggcgttatttatccgaaataa

SEQ ID NO: 29419 - protein, 385 aa, Haemophilus somnus 129PT
MLLCLANIRSSFMQKNNHYYIGIMSGTSLDGVDIALMDFNQRPPKLLASYCFSMPENLRQKLTALLSSGTIGLQQLGELDHQLGLLYANSVQRFLAQNQMTADNIQAIGCHGQTIWHSPQGQYPFTMQIGDANLISVLTGITTIADFRRKDMAYGGQGAPLSTAFHQALFAQPDRITVVLNIGGISNISCLIPEQEVIGYDTGVGNALMDSWIEQHLGVPFDQDGEWAKSGSVHQDLLKDLLDEPFFQQLPPKSTGRELFNLAWLNKKLKKHTALSAQDVQATLLEFTVQCTVQELVKLANPNHLPCLLLVCGGGAKNRQLMARLQACLPQWHVATTTEHGLSVDYVEAAAFAWLAYQRINHLPSNLPSVTGAKSAVSLGVIYPK

SEQ ID NO: 29420 - DNA, 1158 bp, Haemophilus somnus 2336
  CDS (1)..(1158)
atgttattatgtttagcaaacatacgttcttcttttatgcaaaaaaataatcactattatattggaattatgtccggtacaagtttagacggtgttgatatagccttaatggattttaatcaaagaccgcccaagctacttgcaagccattgtttctctatgccggaaaatttacgccaacaactcaccgcacttttaaaaaacggagaaattggcttacagcaattaggcgagttggatcatcaactgggattactttacgcaaactcggtacaacgtttcttagcacaaaatcaaatgaccgctgatagtattcaagccatcggttgtcatggacaaacgatttggcattcaccccaaggtcaatatcctttcactatgcaaattggcgatgctaacctgattagtgtactgacaggaattacgactatcgctgattttcgtcgcaaagatatggctcatggtggacaaggtgcacctttgtcccctgcatttcatcaagccttatttgcacaacccgatcgcattacggtagtgttaaatattggcggtatcagtaatatttcttgtttaattccggaacaagaagttattggttatgataccggtgtaggtaatgctttgatggatagttggattgaacaacatttaggggtgcctttcgaccaagacggtgaatgggcaaagagcggtagtgttcaccaagatttgctaaaagatttattggacgaacctttttttcaacaacttccccctaaaagtaccggacgggaattatttaatttggcgtggttgaacaaaaaactgaaaaaacataccgcactttctgcacaagatgtacaggcaacgttgctggaatttacggtacaatgcacggtgcaagagctggttaaactcactaatccgaaccatttgccttgtttgttgttggtttgtggcggtggtgcaaaaaacagacaactaatggctcgtttacaagcctgtttaccgcaatggcacgtagcaacaactacagagcatggtttatcggttgattatgttgaagccgccgcttttgcttggttagcgtatcagcgtataaatcatttaccctctaatttaccaagtgtaaccggtgctaaaagtgcggtcagtcttggcgttatttatccgaaataa

SEQ ID NO: 29421 - protein, 385 aa, Haemophilus somnus 2336
MLLCLANIRSSFMQKNNHYYIGIMSGTSLDGVDIALMDFNQRPPKLLASHCFSMPENLRQQLTALLKNGEIGLQQLGELDHQLGLLYANSVQRFLAQNQMTADSIQAIGCHGQTIWHSPQGQYPFTMQIGDANLISVLTGITTIADFRRKDMAHGGQGAPLSPAFHQALFAQPDRITVVLNIGGISNISCLIPEQEVIGYDTGVGNALMDSWIEQHLGVPFDQDGEWAKSGSVHQDLLKDLLDEPFFQQLPPKSTGRELFNLAWLNKKLKKHTALSAQDVQATLLEFTVQCTVQELVKLTNPNHLPCLLLVCGGGAKNRQLMARLQACLPQWHVATTTEHGLSVDYVEAAAFAWLAYQRINHLPSNLPSVTGAKSAVSLGVIYPK

SEQ ID NO: 29422 - DNA, 1110 bp, Actinobacillus pleuropneumoniae serovar 1 str. 4074
  CDS (1)..(1110)
atgactaaaaacctctacctcggcgtgatgtccggcaccagccttgacggcgtggatttatgtgtgatggactttgcaaaaaatccgccaaaattgaccgcttgcggctttaccccaatgccggaagatttacgcaccgatttatcgcacttactcaaaagcggagaaacttccttacaaaagttaggtgaaatcgatcaccgtttaggcttgctgtatgccgaaagtatcaagcgttttttagccgaacatcaactcagtgcaagtgatattcaggcaatcggctgtcacggacaaactgtctggcattctccaaacggcaacttcccgtttactatgcaaatcggcgatatgaatttggttgccgctcataccggcattactactattgcagatttccgtcgtaaagatatggcagtcggcggacaaggcgcaccattagtgcctgcttttcacgaagggatttttgcctcgccggaacgcttaaccgtagtgctgaacatcggcggtatttccaatatttcggtacttgcgccacagcagccgacaatcggctacgatgtcagtgtcggtaatgcactgatggattcgtggatagagctgcaccaagctaaacgctatgacaaaaatgccgaatgggcaaaaaccggaacactgattccggcattgctcgacagtctgcttgacgagccttttttcaaattacctgccccgaaaagcaccggacgagaattatttaatctcgaatggcttgcaaaaaaatcggcaaatttaaccgcttatcgtcctgaagacgtacagcgtacattggcggaatttaccgtacaaagtgtagtaaacgaactaaaaaccttagaaagtgaaaagcaatgcttgttacttgcttgtggtggtggcgcacgcaacccattgttaatgcagagattttcagaattactgccaaaatggcaggtggctaccaccgatgagtacggattggatattgattatgtcgaagcagctgcttttgcctggctggcttatcaacgagtgcataatttaacgaacaacttaccaagcgtaaccggagcaaaagagccggtgagtttaggggtaatttatcctaagtaa

SEQ ID NO: 29423 - protein, 369 aa, Actinobacillus pleuropneumoniae serovar 1 str. 4074
MTKNLYLGVMSGTSLDGVDLCVMDFAKNPPKLTACGFTPMPEDLRTDLSHLLKSGETSLQKLGEIDHRLGLLYAESIKRFLAEHQLSASDIQAIGCHGQTVWHSPNGNFPFTMQIGDMNLVAAHTGITTIADFRRKDMAVGGQGAPLVPAFHEGIFASPERLTVVLNIGGISNISVLAPQQPTIGYDVSVGNALMDSWIELHQAKRYDKNAEWAKTGTLIPALLDSLLDEPFFKLPAPKSTGRELFNLEWLAKKSANLTAYRPEDVQRTLAEFTVQSVVNELKTLESEKQCLLLACGGGARNPLLMQRFSELLPKWQVATTDEYGLDIDYVEAAAFAWLAYQRVHNLTNNLPSVTGAKEPVSLGVIYPK

SEQ ID NO: 29424 - DNA, 1116 bp, Microbulbifer degradans 2-40
  CDS (1)..(1116)
atgaaaccctctttgtttgtaggcgttatgtctggcacgagcgcagatggcattgatgtcgcgctcgtagattttagccaagctacacctgcactagtaggcagcgaatcgcatgcctaccccaaccacattcgcgagcacgttttaggcttgtgcacacccgccaacaacgaaatagacgctctcggtcagctggatgtagaattgggcaaattgtacgcccacgcggtgaactcactactggccaacacccaaacacccgcagcacaaatccaagccattggttgccacggccaaaccttgcgccaccgcccgctaggcagcggttatgctagcccgtttagcttacaaattggcgatccaaacactattgctgcccttaccggcattgctacggtggccgattttcgtcgcaaagacgtggccctaggcggccaaggagcaccacttgtgccagcgtttcatgcggctgtttttggcagcactacaaccgatagatgtatcgccaacattggcggtatagctaacattacctgcctacccgcaaatagccatattgctggctacgatacaggccctgggaacgcgttgatggacgcatggatagaggccaatcaaggcgctaaatacgacgcaggtggcgcgtgggcgcaaaccggcaagcttaaccagccgctgctagaaatattgctgcaacacccctatttcgcgctgccagcccctaaaagcactggccgcgaagactttaatatgacatggctacaggcctgtctaaaccaaacgaatttaccgctaccacccgaagatgtgcaggccacgctcacagaattgacggctataagcctaaccgacggcgtaaaacgaagctgccccaacgctgagctggtcatttgtggcggcggagcctttaacaccgccctacttgaacgcattcaacaccattacccccaaaagcccacagtaacgagccagcagcttggtatagcaccaacatgggtagaagccatggcctttgcttggttggctatgcgcaggctagaaaaccaaccgggcaatgtccctgcagtaactggcgctagtcgtgaagcggtgttgggcggcatatacacaccctaa

SEQ ID NO: 29425 - protein, 371 aa, Microbulbifer degradans 2-40
MKPSLFVGVMSGTSADGIDVALVDFSQATPALVGSESHAYPNHIREHVLGLCTPANNEIDALGQLDVELGKLYAHAVNSLLANTQTPAAQIQAIGCHGQTLRHRPLGSGYASPFSLQIGDPNTIAALTGIATVADFRRKDVALGGQGAPLVPAFHAAVFGSTTTDRCIANIGGIANITCLPANSHIAGYDTGPGNALMDAWIEANQGAKYDAGGAWAQTGKLNQPLLEILLQHPYFALPAPKSTGREDFNMTWLQACLNQTNLPLPPEDVQATLTELTAISLTDGVKRSCPNAELVICGGGAFNTALLERIQHHYPQKPTVTSQQLGIAPTWVEAMAFAWLAMRRLENQPGNVPAVTGASREAVLGGIYTP

SEQ ID NO: 29426 - DNA, 1212 bp, Brevibacterium linens BL2
  CDS (1)..(1212)
atgatcatcgccggcctgatgacaggaacgtccgccgatgccctcgacgtcgtcctcgctgatttcatccacgatgacggtgacgagctgagtgtccgccaggcggctggtctctccgaacttggtgtccgcatcctcgccagccgagaggtcgaattcgaccagcagctgcgccgcgacatcctgcgtctgctcgagcctgccgacgtccccctgtccttggtctccagtgtcgatgcccgcttgggccgcttctgcgcccaggccgtcagcgacctctgcaccgaaaccggagtcgaggccgagctcatcgtctcccacgggcagaccgtgcgccacgacatcaccgagggtgccgtcacctccacactgcagatcggccaaccggcatggatcgccgaggcgaccggagctcccgtactctccgacgtccgtgcccgcgacgttgccgccggtgggcagggcgccccgctcgtcggaatcctcgacagcctccttgtcggtgacgtcgaggctccgattgcggtgctcaacctcggcggcatcgccaacatcacggtcctcgcgcccgagcgcgcaccgctggccttcgacaccggccccgccaatgcactcatcgacatcctcgcccgcaggatcaccaaaggggaggcgggcttcgaccgtgacggggagctggccgcacgcggtcgggtcgatgaggagctgctcgagcagctgctggccgatccgtactaccaacttccggcaccgaagtcgacgggcaaggaactcttccacgcggactacctcgatggattcctcgaacccaggacccacctcggcgagcatgatgccatcgcgacggtcacggcgctgaccgcgcgcacggtcgccgatgcctgccacgcacacggagtcaccacggtcatcgcctccggcgggggcacccggaacccgacgttgctggggcgaatggcctcggaactcggccccggcatcaccctgaccagcacggatcaggccttcgggctgcccgaaggtgccaaagaagccctcctcatggcgctgctcggatggctgagctggaacggactcgcaggcaccgagccgaacctcaccggtgccgcgcattcgagcatcgccggacggctgagtccgggacgcggcccgctgaacctgcccgagcctctggaagccagacccacacgcctgagaatcctggaccgatga

SEQ ID NO: 29427 - protein, 403 aa, Brevibacterium linens BL2
MIIAGLMTGTSADALDVVLADFIHDDGDELSVRQAAGLSELGVRILASREVEFDQQLRRDILRLLEPADVPLSLVSSVDARLGRFCAQAVSDLCTETGVEAELIVSHGQTVRHDITEGAVTSTLQIGQPAWIAEATGAPVLSDVRARDVAAGGQGAPLVGILDSLLVGDVEAPIAVLNLGGIANITVLAPERAPLAFDTGPANALIDILARRITKGEAGFDRDGELAARGRVDEELLEQLLADPYYQLPAPKSTGKELFHADYLDGFLEPRTHLGEHDAIATVTALTARTVADACHAHGVTTVIASGGGTRNPTLLGRMASELGPGITLTSTDQAFGLPEGAKEALLMALLGWLSWNGLAGTEPNLTGAAHSSIAGRLSPGRGPLNLPEPLEARPTRLRILDR

SEQ ID NO: 29428 - DNA, 1095 bp, Azotobacter vinelandii AvOP
  CDS (1)..(1095): transl_table=11
atgacgctttatctgggagtaatgtcaggcaccagcctggacggaatagacattgccctcgtcgcgcaggagggtacccacaccaggctactcggcacccactatttgcccatgccggcgggtcttcgcatcgatctgctgtccctatgctctcccggtcccgatgaactggtacgagcagctctcgctgaacagcagtgggtgcgtctggccgcccaaggtatcggcagtctgctcgaacggcaaggcatcgagcctacccggattcgcgccattggcagccatggacaaaccgtccgccaccaccccgctcaaggcgttaccatccagatcggcaatccggccctgctggccgaatgcaccggcatcagcgtcgtcagcgatttccggcgacgcgacctggccgctggcggccaaggtgcgccactggtaccagccttccatcagacgctcttcgcagacgacaacagtcgccgcgccattctcaatatcggtggtttcagcaacctgaccctgatcgagccgggaaaaccggtctacggtttcgactgcggccccggcaacgttcttctggatgcctggatacaacatcagcagggtgccgagttcgatcgcgacggagcctgggcggccagtggcaaggtgcagccggcattactgcagacattgcttggcgaccccttcttcctgacccatggcccgaaaagcacgggtcgcgaactgttcaacatggactggctgagccggcaactggccaaactgccagccatggcaccggtggacatacaggccacgctgcttgagctcaccgccgccagcaccgtaaacgccttgcaggcaatccaggacaagactgacgagttgctcgtctgcggcggcggcgcccataacctggcactcatgggacgactggccgcgctattgcctgctaccagggtagccagcaccgaagcctacggaatccccccggactggatcgaggccatggccttcgcctggttggcacattgttgcctggaaagtattcctgccaaccgaccgagcgtgaccggtgcgcggggtcccaggattctcggggcgatctatccggcctga

SEQ ID NO: 29429 - protein, 364 aa, Azotobacter vinelandii AvOP
MTLYLGVMSGTSLDGIDIALVAQEGTHTRLLGTHYLPMPAGLRIDLLSLCSPGPDELVRAALAEQQWVRLAAQGIGSLLERQGIEPTRIRAIGSHGQTVRHHPAQGVTIQIGNPALLAECTGISVVSDFRRRDLAAGGQGAPLVPAFHQTLFADDNSRRAILNIGGFSNLTLIEPGKPVYGFDCGPGNVLLDAWIQHQQGAEFDRDGAWAASGKVQPALLQTLLGDPFFLTHGPKSTGRELFNMDWLSRQLAKLPAMAPVDIQATLLELTAASTVNALQAIQDKTDELLVCGGGAHNLALMGRLAALLPATRVASTEAYGIPPDWIEAMAFAWLAHCCLESIPANRPSVTGARGPRILGAIYPA

SEQ ID NO: 29430 - DNA, 1116 bp, Chromohalobacter salexigens DSM 3043
  CDS (1)..(1116): transl_table=11
atgcccctttacatcggcttgatgtccggcaccagcctggatggtatcgacgccgccctggtacggtgcggcgagggccgtcccgagtggctcggcgccaccggcctgcccttttccgctgcgctgcacgatgacctgctggcactctgcctggcacgcgaggtttcgttcgccgaactggcacgcctcgagaccgccttctgcgaacgtcaggccgaagcggtcaaccgcctgctgctcgaaacgggcacgccccgggaagcgatcacggccatcggcagccacggccaaaccatcgaacacgccccgaacgccacgccggcgcatacctaccagctcgacaatcccagcctgctggccgagctgaccgggtgcgccgtggtcggcgatctgcggcgccgggacctggcggccggaggccaggccgcccctctggcgcccgcctttcatgctgccctcttcaccgcgtcggaggcctatcgcctggtactcaatctcggcggcatcgccaacctgacgcgactgccgccgtccggccaggctgcccccgtggtgggcttcgataccggtcccgccaacatgctcatggatgcctggagccagcgccacctgggacacccctacgatgccgacggtgcctgggccgccagcggtcgtgtcgatgatgcgctgctcgcccgactgctcgatgacgactacttctcacgcctgccgcccaagagcacgggacgcgagcattttcacctcgactggctgacgtcacgcttgagcgggcacgaatccccttgtgacgtacaggcgaccctggccgagctgaccgccgccagcatcgccatgggcgtcacccaatgcagcgctggcgtctccactgcctatgacgccctgatcccctgcggcggaggcgcccacaacgccgacctgctgacacgcatacagcgccacttgcccgagattccgctgacgccctgtgaacggttcggctggtcgccggactggctcgaagccggcgccttcgcctggctggcgcatcaacgcgtggcaggactccccggcaacctgcccgacgtcacgggtgcacgcggcccacgggtattgggcggtctctacgccggctga

SEQ ID NO: 29431 - protein, 371 aa, Chromohalobacter salexigens DSM 3043
MPLYIGLMSGTSLDGIDAALVRCGEGRPEWLGATGLPFSAALHDDLLALCLAREVSFAELARLETAFCERQAEAVNRLLLETGTPREAITAIGSHGQTIEHAPNATPAHTYQLDNPSLLAELTGCAVVGDLRRRDLAAGGQAAPLAPAFHAALFTASEAYRLVLNLGGIANLTRLPPSGQAAPVVGFDTGPANMLMDAWSQRHLGHPYDADGAWAASGRVDDALLARLLDDDYFSRLPPKSTGREHFHLDWLTSRLSGHESPCDVQATLAELTAASIAMGVTQCSAGVSTAYDALIPCGGGAHNADLLTRIQRHLPEIPLTPCERFGWSPDWLEAGAFAWLAHQRVAGLPGNLPDVTGARGPRVLGGLYAG

SEQ ID NO: 29432 - DNA, 1080 bp, Methylobacillus flagellatus KT
  CDS (1)..(1080): transl_table=11
atgtcaggcaccagcctggatggtgccgacagcgtaatcgtcaagctggaaaatcagcgctgccaagtcatccagcaacagttcacaccttaccccgcagctttgaaacatatgctgttggcattgcataatccgggccataacgagctcgagtcaatggcacgtacaggcaaccaacttgccacgttatacgccgaaaatatagaagcattgctgaagaaggcctgtctccaccctaaggcaatacgtgcgattggctgccacggccaaaccatacgccatcgtcctgaatggggctttacgctgcagatcggcaacccagcattgttggccgagctgacaggaatcgacgtcgtcgccgacttccgtagccgcgacattgcggcaggcggtcatggcgctcccctggtacctgccttccatgccgccatgttctcttctgccgagaagcaccgggttgtgctcaatattggcggtattgccaaccttaccaacctaccggcaacagggggcaacatcatcggatttgatacaggccctggcaatatgctcatggatgcttggatcaataaacaccaaggcagggactacgataggcaaggaacttgggcagcaagcggctccatccttcccgatctgttacaccgcatgctttccgactcatttttcgccagacagccacctaaaagtacgggccgtgatacgttcaacctggcttggcttgagcagctattgcaccaaattaaagacaaaccccggccgcaggatgtgcaacgcacactattggaactgactgccgtttcaattgccatggcagtgacacagcattgcggtaatgttgatgagctgtatgtatgtggtggtggcgcttataataacgccttgatgcaacgcttacggcaattgctgcagccagtgcctattgcactgagtgatacactgggccttgcagccaatgctgtagaagcagctgcttttgcctggctggcgaaacagactttacatggactgcctggcaacctgcctgccgtgactggcgcatgtggtccgagaatacttggcgcagtttatgctgcttaa

SEQ ID NO: 29433 - protein, 359 aa, Methylobacillus flagellatus KT
MSGTSLDGADSVIVKLENQRCQVIQQQFTPYPAALKHMLLALHNPGHNELESMARTGNQLATLYAENIEALLKKACLHPKAIRAIGCHGQTIRHRPEWGFTLQIGNPALLAELTGIDVVADFRSRDIAAGGHGAPLVPAFHAAMFSSAEKHRVVLNIGGIANLTNLPATGGNIIGFDTGPGNMLMDAWINKHQGRDYDRQGTWAASGSILPDLLHRMLSDSFFARQPPKSTGRDTFNLAWLEQLLHQIKDKPRPQDVQRTLLELTAVSIAMAVTQHCGNVDELYVCGGGAYNNALMQRLRQLLQPVPIALSDTLGLAANAVEAAAFAWLAKQTLHGLPGNLPAVTGACGPRILGAVYAA

SEQ ID NO: 29434 - DNA, 1110 bp, Shewanella baltica OS155
  CDS (1)..(1110): transl_table=11
atgaaaaacgcttattatattggacttatgtcaggcaccagcatggacggtgtcgatgccgtattggtcgacttttctggcgcgcagccgcagcttatcaccagccataccgaagccataccgagccatttgctcaaaggcctacagcgcctttgttcacccagcacagatgaaattaaccgcctcggccgtttagatcgtaatgtgggtgaactgtttgctttagcagtgaataatctactaaccaaatgcgccattgccaaagaagatgtcatcgccattggtagccacggccaaaccgtgcgccacatgccaaacctcgaagtcggctttaccctgcaaattggcgacccgaatactattgcgaccgaaaccggtattgatgtgattgccgattttcgccgtaaagatattgccctaggtggccaaggcgcgcccttagtgccagcattccaccagcaaacctttgctgaagtcggcaaaaaacgcatcattttaaatattggcggcatagccaacattacttatttaccaggcaacagtgaccaagtactgggtttcgacacgggacctggcaataccttgatcgatgcttggatccagcaggtgaaaagtgagcccttcgatagagatggtgcatgggctgagtccggcaaaaccgaccaagacctgttaactcaactgctttcgcacccgtatttctcccttgcttaccctaaaagcaccggccgagagctatttaaccaagcttggttagaacagcaattatcgccttttaatcatttagatgaagaagatatccaatcgacgttattggatttaacctgccacagcatagcccgcgatatgattaaattatcgaatgaaggggagttgtacgtctgtggtggcggcgcgttcaacggccaactgatgcagcgtcttgccgccctattgccaggttataccttgaataccacctcagctcttggcgtcgaccctaaatgggctgaaggcatcgccttcgcgtggctcgccatgcgtaaccacttaggcttacccgccaacctccctgcagtcacaggcgcctcccgcgaagctgtactcggcggaagatttagcgctaagtaa

SEQ ID NO: 29435 - protein, 369 aa, Shewanella baltica OS155
MKNAYYIGLMSGTSMDGVDAVLVDFSGAQPQLITSHTEAIPSHLLKGLQRLCSPSTDEINRLGRLDRNVGELFALAVNNLLTKCAIAKEDVIAIGSHGQTVRHMPNLEVGFTLQIGDPNTIATETGIDVIADFRRKDIALGGQGAPLVPAFHQQTFAEVGKKRIILNIGGIANITYLPGNSDQVLGFDTGPGNTLIDAWIQQVKSEPFDRDGAWAESGKTDQDLLTQLLSHPYFSLAYPKSTGRELFNQAWLEQQLSPFNHLDEEDIQSTLLDLTCHSIARDMIKLSNEGELYVCGGGAFNGQLMQRLAALLPGYTLNTTSALGVDPKWAEGIAFAWLAMRNHLGLPANLPAVTGASREAVLGGRFSAK

SEQ ID NO: 29436 - DNA, 1110 bp, Shewanella amazonensis SB2B
  CDS (1)..(1110): transl_table=11
atgagccaatctttgtttatcggactcatgtccggcaccagtatggacggtgtggacgctgtcctggtggatttcgacactccatcccccaaactcattgccacccacacagaagccattccggaacacctgttcaaagggctgcagcgtttatgtcagcccggacaggatgaagtaaatcggcttggacgactcgaccgcagcgttggcagtctctttgccaaagccgtcaacaacctgcttgccagcagtggcatagataagtcccaggtcgtggccattggcagccatggtcaaaccgttaggcacatgcccaacctcgaggtggggttcactgtgcaaatcggcgatcccaacaccattgccgccgaaacaggtatcgatgtcattgctgattttcgccgcaaagatattgcacttggcggccagggagcaccgctggtcccggcattccaccagcagatttttgctaaagcagataaacgccgggtgatcctcaacataggtggtatcgccaatatcacctggttgccgggcaatgcagaggctgtacttggatttgataccgggccgggcaacaccctgatagatggctggatacagcaggtaaaacaacaggctttcgatcgggacggcgcctttgccgccagtggtaaaaccgacaatacgctcttggcccagttgctgtcgcatccgtattttatgcagccataccccaagagcaccggtcgtgagcttttcaataacgcttggctggaacagcaactggaaaagtttggccacctcgacgaggccgatattcagtcaaccctgctggacttaacctgccacagtatcgcggcggatattctcaagctgtcaaacagtggcgagttgtttgtatgcggcggtggcgccctcaatattgagctgatgaaccgcctgcaggccctgttacccgggtttacactgactaccacttcggtgcttggagttgacccgaaatgggttgaggccatcgcctttgcctggcttgccctgcgccaccatcagggactgccggccaacctgcccgccgtgacaggggcaagacgcgaagccatactcggcgcccgcttcccggcggcttga

SEQ ID NO: 29437 - protein, 369 aa, Shewanella amazonensis SB2B
MSQSLFIGLMSGTSMDGVDAVLVDFDTPSPKLIATHTEAIPEHLFKGLQRLCQPGQDEVNRLGRLDRSVGSLFAKAVNNLLASSGIDKSQVVAIGSHGQTVRHMPNLEVGFTVQIGDPNTIAAETGIDVIADFRRKDIALGGQGAPLVPAFHQQIFAKADKRRVILNIGGIANITWLPGNAEAVLGFDTGPGNTLIDGWIQQVKQQAFDRDGAFAASGKTDNTLLAQLLSHPYFMQPYPKSTGRELFNNAWLEQQLEKFGHLDEADIQSTLLDLTCHSIAADILKLSNSGELFVCGGGALNIELMNRLQALLPGFTLTTTSVLGVDPKWVEAIAFAWLALRHHQGLPANLPAVTGARREAILGARFPAA

SEQ ID NO: 29438 - DNA, 1134 bp, Mesorhizobium sp. BNC1
  CDS (1)..(1134): transl_table=11
atggagcctgcctgggcgatcggcttgatgaccggaaccgtgcttgatgggaatatcgacatcgccatgatccgcaccgacggagaaaaggtggatgcgttcgggccatataagctggcgccttacccgcccgaattgccgatcctgcttggccgcgcgctcgaagaggccgccaaatggcgttttcagggtcaagagcccgccattttccgtgaagcagaagcggccctcacccaggcacaggctttggccgtttgcgactttctgcgcgagaacgggctttcgcctggcgatatcaaggcgattggctttcacgggcagacggtgcttcacatcgccccaaaagatggccggcgcggccacacgcgccagctcggcgatgggccgctgatggccaagatcgtcggcgcggatgtggtctatgacttccgcaccgcagatgttgaggcaggcggacaaggcgcgcccctggtgccgatctatcatcgagcgcttctcgacaggatcggcggcggctgcgagaccgcaatgctcaatctgggtggcgtcggcaatataagttggttcgacggcgatcaaatggtcgcgttcgacaccggtccggccaacgctccgatcaatgactgggtcaaacgccatggccggggtaatttcgacacggacgggcgcatcgcactttccggaaccgtggatgaagctcggctctcgcgcctgctcgaccacccgtatcttaatgcaccttatccaaagtcgctcgaccgcaactccttcaccgcggacatggcggagggtttaagtcttgagaacggcgcggcgacgctgacggccttcagcgcggccgcggtcgggcgggcgctcgaccttctgcctgaacgccccaaccggcttctggtgtgcggaggcgggcgcaagaacccggcgctgatggcgcagcttcgccgccgtgcgaatgtccaggccatggatgtggaccagtttggaatgcgaggggatgccatcgaagccgaatgcttcgcttttctcgcggtgcgaagcatacgcgggttgccgatcagctttccgcaaaccacaggcgtatcgaagccgatgagcggcggcaggctcgcgcccgcctcagccaggaatgcagcctga

SEQ ID NO: 29439 - protein, 377 aa, Mesorhizobium sp. BNC1
MEPAWAIGLMTGTVLDGNIDIAMIRTDGEKVDAFGPYKLAPYPPELPILLGRALEEAAKWRFQGQEPAIFREAEAALTQAQALAVCDFLRENGLSPGDIKAIGFHGQTVLHIAPKDGRRGHTRQLGDGPLMAKIVGADVVYDFRTADVEAGGQGAPLVPIYHRALLDRIGGGCETAMLNLGGVGNISWFDGDQMVAFDTGPANAPINDWVKRHGRGNFDTDGRIALSGTVDEARLSRLLDHPYLNAPYPKSLDRNSFTADMAEGLSLENGAATLTAFSAAAVGRALDLLPERPNRLLVCGGGRKNPALMAQLRRRANVQAMDVDQFGMRGDAIEAECFAFLAVRSIRGLPISFPQTTGVSKPMSGGRLAPASARNAA

SEQ ID NO: 29440 - DNA, 1101 bp, Nitrobacter hamburgensis X14
  CDS (1)..(1101): transl_table=11
atgatgacggcgatcggcctgatgagcggcacctctctggatggcgtcgatatcgccttgatcgaaaccgacggcaaccaggtggcggcgtttgggccgaccggctaccgcccttacacggaacacgaacgcggcctgctgcgcgaagccctcgcggaggccgtcaatctgccgcggcgcgacgcgcggccaggcgtgatcggcgaggccgagcgtgccgtgactctggctcacgccgaagccgtagcggcgttcaccgcgcaaaatcgcatcgtccgtgaggccatcgatatcgtcggcttccatggtcagaccgtgctgcatcggccggcgcagcggttgaccgtgcagatcggcgacgggacggctttggcaaaagcgatccgcgttccggtgatgcatgatttccgcgcggccgacgtggccgccggcgggcagggcgcgccatttgtccccgtctatcatcgcgcactggcgcaatcgctcggccgcgagggaccgatctgcgtggtcaatatcggcggcgtctccaacatcacctatatcgacggcgccgatacgctgatcgcttgcgacaccggacccggcaatgcgctgctcgatgatttcatggtccgcgtgatgggccagccgttcgaccgcgagggccggctggcggcgcagggccgtcccgacgcggactggatcgcgcacgccttgcaacacccgttcttcgcgctgccgccgcccaagtctctcgaccgcaacgatttcgcttcgttcgcaccgcacgacatggcgccggccgatggcgcggcaaccctgacggccttcaccgcggcggccattacgcggatcgttccgctgttgcccaaatcgccagcgaactggatcgtggctggcgggggagcccgcaacctgaccatgctcgggatgctgcgggagaggcttgctccggcgacggtcgagccggccgatgcgctgggctggtcggtcgatgccatggaggcgcaagccttcggctatctcgcggtgaggggcctgaaaggcttgcccttgagctatccggcgaccaccggcgtgccgatgccgatgaccggcggaatgatcgcgcgaccgtaa

SEQ ID NO: 29441 - protein, 366 aa, Nitrobacter hamburgensis X14
MMTAIGLMSGTSLDGVDIALIETDGNQVAAFGPTGYRPYTEHERGLLREALAEAVNLPRRDARPGVIGEAERAVTLAHAEAVAAFTAQNRIVREAIDIVGFHGQTVLHRPAQRLTVQIGDGTALAKAIRVPVMHDFRAADVAAGGQGAPFVPVYHRALAQSLGREGPICVVNIGGVSNITYIDGADTLIACDTGPGNALLDDFMVRVMGQPFDREGRLAAQGRPDADWIAHALQHPFFALPPPKSLDRNDFASFAPHDMAPADGAATLTAFTAAAITRIVPLLPKSPANWIVAGGGARNLTMLGMLRERLAPATVEPADALGWSVDAMEAQAFGYLAVRGLKGLPLSYPATTGVPMPMTGGMIARP

SEQ ID NO: 29442 - DNA, 1113 bp, Shewanella denitrificans OS-217
  CDS (1)..(1113): transl_table=11
atgagcaagcctgaatattttatcggcctaatgtctggcaccagcatggatggcgtagatgccgttttggtggatttctcccaagctaaacctcaattaatcgccggccacacccaagctattcctaagcatctacttaagggcctacaaagattatgtaaccctgccgccgatgagattaatcgtttaggccgcttagacagagccgtgggcagcttgtttgccgatgcggttaatgccttgcttgagaaaactaatatccctaagtcgcagatcattgccataggtagccacggtcagactgtgcgtcatatgcccaatttagaggtgggttttaccctgcaaattggcgatcccaataccatagccgttgagacaggcatagatgtcatcgccgattttcgtcgtaaagacattgccttaggtggtcaaggcgctcccttagtgcccgctttccaccagcaagtgtttgccgaaaaagatcaaatcagggtcattttaaacattggcggtatcgccaatgtgacttacctgcccggcaacagcgagcaagtgctagggtttgataccggccctggtaacaccttaattgatgcgtatattctacaaaacctagagcaagccttcgatgaagatggccaatgggcagactcaggaaacagcaatcaagccctgttaacccaaatgctatcccatccgtatttttcgctgcactaccctaaaagtaccggccgggagttgtttaaccaagcttggctcgagcagcaactggctaactttagccacttagatgccgaagatatccaatccaccttgctggacttaacctgtcacagcatagccaatgacatcaataaactcgcccctaaaggtcagttattcgtctgcggtggtggggccttaaatggcgcgttaatgaagcgcttaactcagcttgtacctgggtatcagctgcaaaccacttcggccttaggtgtagatgccaaatgggtagaaggcatagcgtttgcgtggcttgccatgcgccatcatcataatttacccgccaacttacccgcggtgacgggtgcatcaaaatctgctgtacttggtgggcgctacagcgctaaataa

SEQ ID NO: 29443 - protein, 370 aa, Shewanella denitrificans OS-217
MSKPEYFIGLMSGTSMDGVDAVLVDFSQAKPQLIAGHTQAIPKHLLKGLQRLCNPAADEINRLGRLDRAVGSLFADAVNALLEKTNIPKSQIIAIGSHGQTVRHMPNLEVGFTLQIGDPNTIAVETGIDVIADFRRKDIALGGQGAPLVPAFHQQVFAEKDQIRVILNIGGIANVTYLPGNSEQVLGFDTGPGNTLIDAYILQNLEQAFDEDGQWADSGNSNQALLTQMLSHPYFSLHYPKSTGRELFNQAWLEQQLANFSHLDAEDIQSTLLDLTCHSIANDINKLAPKGQLFVCGGGALNGALMKRLTQLVPGYQLQTTSALGVDAKWVEGIAFAWLAMRHHHNLPANLPAVTGASKSAVLGGRYSAK

SEQ ID NO: 29444 - DNA, 1107 bp, Thiomicrospira denitrificans ATCC 33889
  CDS (1)..(1107): transl_table=11
gtgagtgagttttatataggtgttatgtctgggactagtcttgatggaatcgatttagctctttgtgagatagaagatgatgcttttgagcttcttttatgcgcttcttacccttttgatgcagagttaaagagcgatattttaaatgctataaatgcgcaaacaacgcttaaaaacattggcgaaatagatattcgtttaggcaaaatgtatgctgatgcgttagagaaatttattgaagaaaatagccttaagagagttaaaataagagctatcggtctgcatgggcaaacactttggcatgagccagagagccaaaatcctttctccatgcagttaggaaatgccaacatactaacagctaggcttggcatctgcgtagtgagtgattttaggcaaaaagatatagctcttggaggtcaaggggcaccatttactcccgcttttcatgaatttttattctctaaattaagtgggaatgtagctgttttaaatattggtggaatggcgaacattacgcttcttagagagatgcttagcggttatgatactggatgcggaaatgtacttatggattactggatttctaaatataacggctccccatacgacaaagatggagagtgggcaaaatcaggaactccaaacagagaactcttaagagagtttttaaaggagccttactttttaaagagtcccccaaagagtactgggcgtgagctttttggcgaaaaatggctgaaaaaacagttgagtgaatttgctaaaaaaaatcaaaactgctcatacttaaaagcaagagatattcaagctacactccttgagttgagtgttcaaagtattgcaaatgagataaaaaaaagtgatacaactctgctaatagtctgcggtggaggtataaacaaccgctatcttatggaacgcttgcaagaggagctaggagatataaagatagcttcaagtgacgaatatggcgtaagtagcgaatttatggaggctatggcatttgcttggctcgcacatgagagaatccataaaaaatgtgttaaaatttcatctgttagcggagcgttaagagactcaattttaggtgctatttatgaataa

SEQ ID NO: 29445 - protein, 368 aa, Thiomicrospira denitrificans ATCC 33889
MSEFYIGVMSGTSLDGIDLALCEIEDDAFELLLCASYPFDAELKSDILNAINAQTTLKNIGEIDIRLGKMYADALEKFIEENSLKRVKIRAIGLHGQTLWHEPESQNPFSMQLGNANILTARLGICVVSDFRQKDIALGGQGAPFTPAFHEFLFSKLSGNVAVLNIGGMANITLLREMLSGYDTGCGNVLMDYWISKYNGSPYDKDGEWAKSGTPNRELLREFLKEPYFLKSPPKSTGRELFGEKWLKKQLSEFAKKNQNCSYLKARDIQATLLELSVQSIANEIKKSDTTLLIVCGGGINNRYLMERLQEELGDIKIASSDEYGVSSEFMEAMAFAWLAHERIHKKCVKISSVSGALRDSILGAIYE

SEQ ID NO: 29446 - DNA, 1146 bp, Xylella fastidiosa Dixon
  CDS (1)..(1146): transl_table=11
atgcctgtgcatgatgatcactgcaatccaaatccagctcctctctacctcggtctcatgtccggcaccagcatcgacggcatcgacgcagcgttggtacggattaacgcaaacccgataacacattgtgagctgattgccgcgcaaacctccgcttgggaccctaacctacgcacgacattgttggaactaagtcaaggtcagaacacagcatcccttgaccaactaggctggctcgacgcccaagtcggactggccttcgccacagccgctaatacactgatcgcaaaaacgggcataaagcacacacagatacgtgcgattggctgtcatggccagaccatacgccatcgcccacacggcgatctacccttcacttggcaattaggcgatgcccaccggatcgccgaactcactggaatcactaccgtcgcagacttccgccgccgtgacgtggctgccggcggccaaggcgcaccactcatgcccgctttccatctagcgatccttggatccgccaatgaaaaccgagcagtgctgaacttaggcgggattgcaaacttgacactgatcccgatgaccggcccagtactcggcttcgacaccggaccagcgaacgcactgctcgacagctggtatcaacgccatcatcacgagacattcgatcaaagcggtaacttcgccgcaagcggcaaaatcaaccagaagttactggcctgcctgctagacgacccttggttcaccctcccacctcccaaaagcacagggcgcgaacaattccatttggactggatgaccaaacaactagaacctacaccaccatcaccagccgatgtgcaggcaacactgctcgaactgaccgcagtcaccgtagcagatgccctactacgccaacaacccaagacgactcggctactgatatgcggtggcggtgcgcataacccagtattgatggcacgcctggccgcacacctacccaacgtaacagtggaatcgattcaaacctatggactcaatccggactatctggaagcaatggggtttgcttggctggccgcacaaacactggacggccaaccaagtaacctgccaagcgtcactggcgcacgcggcctgcgtttgctcggcgcaatccacccagcctga

SEQ ID NO: 29447 - protein, 381 aa, Xylella fastidiosa Dixon
MPVHDDHCNPNPAPLYLGLMSGTSIDGIDAALVRINANPITHCELIAAQTSAWDPNLRTTLLELSQGQNTASLDQLGWLDAQVGLAFATAANTLIAKTGIKHTQIRAIGCHGQTIRHRPHGDLPFTWQLGDAHRIAELTGITTVADFRRRDVAAGGQGAPLMPAFHLAILGSANENRAVLNLGGIANLTLIPMTGPVLGFDTGPANALLDSWYQRHHHETFDQSGNFAASGKINQKLLACLLDDPWFTLPPPKSTGREQFHLDWMTKQLEPTPPSPADVQATLLELTAVTVADALLRQQPKTTRLLICGGGAHNPVLMARLAAHLPNVTVESIQTYGLNPDYLEAMGFAWLAAQTLDGQPSNLPSVTGARGLRLLGAIHPA

SEQ ID NO: 29448 - DNA, 1374 bp, Psychrobacter cryohalolentis K5
  CDS (1)..(1374): transl_table=11
atgaccaaccctgcatcgattgctgatagtcagcataataatttttcaaatctgagtttagatgatgattttgatagccgtctagataatatggacgatttaaactatgccaccttgaccgatgcgctcgaacaaacggtgtttgaaaacttcgatgatggcttatatataggtatgatgtcgggcactagcttagatggtatggacgcggtcctttgtcaattcagtgagaaagataatacccaacaaccgatgcacgtgttagcgactcatagccaagatttcccaccgcgtctgcgtgaagtgctactagcattgtgtcagcctaatgggattcaagcattaacgccatccgatgatgaaccaaatagcgaattagactggtttggctgggcaagtaaagaatatgcagaattttcaagcgacgtggttaatacgttattgcagcaatcaaatactgatagtgaatctgtactagcgattggctgtcatggtcaaacggtacgccatcgtccgcagatgggttttagcttgcaattggtcgatgccaatatcattgctgaacgtacgggcattagcgtcgtcagtgatttccgtcgccgtgatatggcagttggtggtcaaggtgcgcctttggttccagcttttcatcaagcattgtttgcggtgcctgatagcacgcgtgtgttattaaacttgggcggtattgctaatatcgctgtcttgccagcgatttctaatgaccttgtagattctaatgaacactcagaaaatcagccatctgatagcgtggttggttatgataccggacctgccaatctattattggatgcgtggacaacattgcacacggacaaggattatgatgcgggcggtacatgggcacagtcaggtcaagtcgttgagcctttactgaatcagctattagagcatccattttttaagaaaacctatccaaaaagtacggggcgtgaagattttaacttagcatggctacaagatgagttacaaaaattcgaccaagcttctgctgatgttcgctactcatccgccgacgtacaagcaacgctcactgagctgaccgccatcagtgccagtgcgcaaatcaatttatttatcaatgctagtagcagtaatgctgtttatgtctgcggcggcggggcgttaaataattatttaatgactcgcttacaagtacacctgcaacgatgcaaagtagaaacgacagccagcttgggacttgaaccaacttgggtcgaagccgttgcctttgcttggttagcaagacaaacacttatgggtgaaaccggtaacttgcctgccgtgacaggcgcaagtaaaggcgtggtattgggacaagtatgttttgcctga

SEQ ID NO: 29449 - protein, 457 aa, Psychrobacter cryohalolentis K5
MTNPASIADSQHNNFSNLSLDDDFDSRLDNMDDLNYATLTDALEQTVFENFDDGLYIGMMSGTSLDGMDAVLCQFSEKDNTQQPMHVLATHSQDFPPRLREVLLALCQPNGIQALTPSDDEPNSELDWFGWASKEYAEFSSDVVNTLLQQSNTDSESVLAIGCHGQTVRHRPQMGFSLQLVDANIIAERTGISVVSDFRRRDMAVGGQGAPLVPAFHQALFAVPDSTRVLLNLGGIANIAVLPAISNDLVDSNEHSENQPSDSVVGYDTGPANLLLDAWTTLHTDKDYDAGGTWAQSGQVVEPLLNQLLEHPFFKKTYPKSTGREDFNLAWLQDELQKFDQASADVRYSSADVQATLTELTAISASAQINLFINASSSNAVYVCGGGALNNYLMTRLQVHLQRCKVETTASLGLEPTWVEAVAFAWLARQTLMGETGNLPAVTGASKGVVLGQVCFA

SEQ ID NO: 29450 - DNA, 1101 bp, Nitrobacter winogradskyi Nb
  CDS (1)..(1101): transl_table=11
atgatgacggcgatcggcatgatgagcggtacctcgcttgacggcgttgatgtcgccctgatcgaaaccgacggcgagcgcgtgacggcgttcgggccgacaggctatcgcccttacacgaacgacgaacgcggcctgttgcgggaggcgctggcggaggcggtcaatctgacgcgacgtgacgcacggccgggcgtgatcggcatggccgaacacgccgtgaccatggcgcactctgacgccgtcacgtccttcctcgcgcggaacggcatcaggcgcgaggatatcgatatcgtcggttttcacggccagacggttctgcatcggccgggggagcggctgaccgtgcagatcggcgatgcggacgcgctggcgaaagcgatccgcgtgccggtgatgcatgatttccgcgcggccgacgtcgccgccggcgggcagggcgcgccattcgtccccgcctatcatcgcgcgctggcgcagtcgctcggccgcgacggtccgatttgcgtggtcaatatcggcggcgtctccaatgtcacctatatcgacggcgcggacactttgatcgcctgcgacaccggacccggtaatgcgctgctcgacgatttcatgcttcgcacgacgggtgaaccgttcgaccgcgatggcaggctggcgcagcagggccgccccgacgcggactggatcgcgagcgccctgaatcacccctttttcgcgctgccaccacccaaatcgctcgaccgcaacgattttgcctctctcgccctgcccgataggccgccagccgatggcgccgccaccctgacggcgtttaccgcggcggccatcgcgcggatcgttccgctgctgccgaaggcgccggaaagatggatcgtcgcaggcggcggagcccgcaacccgatcatgctcgagatgctacgggagaaggttgcccctgcgcctgtcgagcgggcggacgcgctcggctggtcgattgacgcgatggaggcgcaggccttcggctatctcgcggcgcgtggcctgaaaggcttgcccttgagctaccccgcgaccaccggagtgccggtgccgatgaccggcggtgtggtcacgcggccctga

SEQ ID NO: 29451 - protein, 366 aa, Nitrobacter winogradskyi Nb
MMTAIGMMSGTSLDGVDVALIETDGERVTAFGPTGYRPYTNDERGLLREALAEAVNLTRRDARPGVIGMAEHAVTMAHSDAVTSFLARNGIRREDIDIVGFHGQTVLHRPGERLTVQIGDADALAKAIRVPVMHDFRAADVAAGGQGAPFVPAYHRALAQSLGRDGPICVVNIGGVSNVTYIDGADTLIACDTGPGNALLDDFMLRTTGEPFDRDGRLAQQGRPDADWIASALNHPFFALPPPKSLDRNDFASLALPDRPPADGAATLTAFTAAAIARIVPLLPKAPERWIVAGGGARNPIMLEMLREKVAPAPVERADALGWSIDAMEAQAFGYLAARGLKGLPLSYPATTGVPVPMTGGVVTRP

SEQ ID NO: 29452 - DNA, 1134 bp, Zymomonas mobilis
  CDS (1)..(1134): transl_table=11
atgggttttcagcttgtgaagaaaagatcaaagggctggaaaatagaaatcgggggaaattggatgctggcaatcggacttatgtccggcacgtctttagatggtgttgatgtcgccttgattgaaaccaatggcgaaaaacaagtaaagcctttgaattttgcttcctatccttattcggatacggataaagcctgcctgcgcgaagctgtcgtcgcgcttttgacgatggcggcaccttgtttcatccccgaagatgaagtgatttatcaggccgaacatattgtaacgctccgtcatattcaggcagtcaaagatttcttgaaaaagaatgcgttaggtaatcaggctatcaaagtcatcggcttccatggtcaaacaattgctcataggccggatttgggctggacatggcaaatcggtgatggcgccgctttggcacaggcgaccaaaatcagcgtagtcgatgatttccgttctcatgatgtccaagcaggcggcgagggcgctcctttgctccccatctatcattgggcattatttagcgaagctctcaccctttggcggtgcttaatcttggcgggattgcgaatattacttggatttggggcggatgaaaacgacctcattgcttgcgatacaggccccgctaacggaatgattgatgattgggtcaaggccaaaactggcctcgattatgatgaatccggtcttattgcgagcaaaggcgttgtccatcacgatctggtcgatgcgatgatgagccagaaattcttttcgcaattaccaccgaaatcgttggatagaagcgatttttcaatcgaggcggtcgccaatctctcgatcgaggatggtgctgcaacgctgaccgcttttaccgctgaatcggttgcccgatcgctgtctttctttcctgaaagaccttcaaagattattgtggccggtggtggtcgtcataatgtgacgatgatgaaaatgctgcatgacagtttgaaaatgcctgtccagccaattgaagatttccatttaaatggtgatgcgaccgaggccgaaggtttgcctatctcgcggtcagacgggtatttaacaagcctatcagcttccctaaaacaacaggggtgccgcatcctatga

SEQ ID NO: 29453 - protein, 377 aa, Zymomonas mobilis
MGFQLVKKRSKGWKIEIGGNWMLAIGLMSGTSLDGVDVALIETNGEKQVKPLNFASYPYSDTDKACLREAVVALLTMAAPCFIPEDEVIYQAEHIVTLRHIQAVKDFLKKNALGNQAIKVIGFHGQTIAHRPDLGWTWQIGDGAALAQATKISVVDDFRSHDVQAGGEGAPLLPIYHWALFSEALTLWRCLILAGLRILLGFGADENDLIACDTGPANGMIDDWVKAKTGLDYDESGLIASKGVVHHDLVDAMMSQKFFSQLPPKSLDRSDFSIEAVANLSIEDGAATLTAFTAESVARSLSFFPERPSKIIVAGGGRHNVTMMKMLHDSLKMPVQPIEDFHLNGDATEAEGLPISRSDGYLTSLSASLKQQGCRIL

SEQ ID NO: 29454 - DNA, 1095 bp, Gamma
  CDS (1)..(1095)
atgagtaaaaagatctatattggagcaatgacaggaactagtcatgacgctattgatatttcatttcttagcattggtacaaaaatacatcttgagtatttccattcaattaaattcccaaaatccctaagattaaaagtaaaaaaacttattgaaaataacgaaagctcgttgtcagatttaggcactatcaataaagagataggattcttattttcaaaatctattaatgaggcgattggatttagtaaaattaagaaatcatctatagagtgtgttgctatttctggacaaaccattaggcatgaaattaataagagatttccattttctatgcaaattggtgatccaaatattgttgcaaaagaaacgggccttctggtggtaagtgattttagaaatatgcatattgctctgggtggcgaaggcgcccctcttgttccggaattccataatcaattattttataaagctagaaacccacgaattattttaaatataggggggatttcaaattactcatttgtaaaaaatagaaatgacatatggggaactgatgtaggccctggtaatgcaattttagatgcatattgtagtgattttcttcagattccttttgataaaaatggtgcaattgcagccaaaggaaaagtagatcacattgagttaggaagattgcttcaaaataatttttttaaaagaaaatgtccaaaatcaacaggcaaagagctctttaatataaaaatattatccaagaaattcttaaaaaagaaagctgaagatattctatgtaccctggttgaattttcagcaaaatctataataaattcaatccataaaaatggtcataataattgtgacattgtcatttgtggcggtggtgcccataacaagtatctggtaaaaagaatttctgagatggctagtaatgatatcgtcctctcaagtgatttaggccatgatgtttttgctattgagtccatggcatttgcctggatgggatataaaagagtcagtaatgaggctctgatagttcagacatcaagcaagaatgtaaaaggacttttgggttcaattacaaaatctaaactgtaa

SEQ ID NO: 29455 - protein, 364 aa, Gamma
MSKKIYIGAMTGTSHDAIDISFLSIGTKIHLEYFHSIKFPKSLRLKVKKLIENNESSLSDLGTINKEIGFLFSKSINEAIGFSKIKKSSIECVAISGQTIRHEINKRFPFSMQIGDPNIVAKETGLLVVSDFRNMHIALGGEGAPLVPEFHNQLFYKARNPRIILNIGGISNYSFVKNRNDIWGTDVGPGNAILDAYCSDFLQIPFDKNGAIAAKGKVDHIELGRLLQNNFFKRKCPKSTGKELFNIKILSKKFLKKKAEDILCTLVEFSAKSIINSIHKNGHNNCDIVICGGGAHNKYLVKRISEMASNDIVLSSDLGHDVFAIESMAFAWMGYKRVSNEALIVQTSSKNVKGLLGSITKSKL

SEQ ID NO: 29456 - DNA, 1131 bp, Synechocystis sp
  CDS (1)..(1131): transl_table=11
gtggatggcattgatgcctgtttagtcgacattagtgggtctggattagacctcaaggttgatttgttgcggggggaaacctacccttaccccgatgcattgcgccaggagattttagctttgtgtgcaggaactcccgttagtccggaggcgatcgcctttttggatgacagtattgccaaggaatttgcccaggcggcccagcaaattcaacaatctttgcccccagcggatctcattggttcccatggccaaactattttccaccgtccccccaatccagagaaagccttttccctcggttacagttggcagttgggccggggagaggcgatcgccaatttgacaggcattaccacggtgagtaattttcgggcggcggacattgccgcagggggccagggagcaccattagtttctaaaatcgatgtctgcctgttgagccatcaaaatgaacaccgctgtgtgcagaatttaggtggcattggtaatgtgacctatctccctccccgcagtcagacaaattggcaggaaaaaatttgtggctgggatacggggcccgccaacgtcctagttgacctggcagtgcaaaaatttacccagggagaaaaaacctatgatcaggggggacaatgggcggcccagggtaagccccgccaagaactggtagaccaatggttacaagaaccctttttcgagcaatatccgcctaaatccaccgggcgggaattgtttggggcgttgtacctcgataactgttggatagaagcccagcgccatggcttgaatgaaaccgattttttgaccactctgacagaatttacggcccgctctgtagtgactgaataccaaagatttttaccccaactgcccgatcgcctgttactgtgtggcggtggtgcccataacctctatctgagggagcggctccaatatcacttaggctccaacacaaaaattcagcgcaccgacgatgttggtctgaacagcgatttcaaagaggcgatcgcctttgcggtgctggcctattggcgtttccaggagcaatttccaggtaatgtccccctagtcaccggtgctagtcaagattgtctgttgggggatattcaccttgtcccagttggtagttaa

SEQ ID NO: 29457 - protein, 376 aa, Synechocystis sp
MDGIDACLVDISGSGLDLKVDLLRGETYPYPDALRQEILALCAGTPVSPEAIAFLDDSIAKEFAQAAQQIQQSLPPADLIGSHGQTIFHRPPNPEKAFSLGYSWQLGRGEAIANLTGITTVSNFRAADIAAGGQGAPLVSKIDVCLLSHQNEHRCVQNLGGIGNVTYLPPRSQTNWQEKICGWDTGPANVLVDLAVQKFTQGEKTYDQGGQWAAQGKPRQELVDQWLQEPFFEQYPPKSTGRELFGALYLDNCWIEAQRHGLNETDFLTTLTEFTARSVVTEYQRFLPQLPDRLLLCGGGAHNLYLRERLQYHLGSNTKIQRTDDVGLNSDFKEAIAFAVLAYWRFQEQFPGNVPLVTGASQDCLLGDIHLVPVGS

SEQ ID NO: 29458 - DNA, 1149 bp, Haemophilus influenzae
  CDS (1)..(1149): transl_table=11
atgattaatatgaaacctcaatattatcttggtatgatgtcgggtactagcttagatggcgtggatattgtgttggttgatttttctcaagatcctcaacttatcctatctgatttttttcctatgccagaagatttgcgtgagaaattaaccacacttattcaagtaggtgaaacaactctacaaaatttaggcgaactggatcataaacttgccttgctatacagtgattgtgtcaatgcttttctgcagaaaaatacttttttgccaaatcaaattcaggctattggttgccacgggcaaacggtatggcattctccaaattcacaatttccctttacaatgcaattaggcgatatgaatttacttgccgctaaaacaggcatttcggttattggggattttcgccgtaaggatatggcttggggtggacaaggtgcgcctcttgtgcctgcgtttcacgaggcggtattttcaaattctaattttgctacagctgttttaaatattggcgggattagtaatgtgtctattttgtttccaaatcaagctgtcatcggctttgatacaggtccaggtaatacattattagatcaatggatcgaaaaacatcaagggcttcgttatgatgaaaatggcgagtgggcagcaaaaggcaacgtgaataaagttctgcttgatgaattactcaatgaacctttcttttctttacctgcacccaagagtactgggagagaattatttaaccttgtttggttaaatcacaaaatagcaaaaataagggaaaaattgaccgcactttcagttgaaatgtcttttcgcccagaggatgtgcaagcgacgcttgttgaattgacggtaacaagcattgttaatgcactaaatcagctccaaacagatttaccaaaacgtttactagtatgtggcggtggtgccaagaatagcttaattatgcgtggattgcatgataatttactcgattggcaggtcagcacaacgacagagcaaggttttgatattgattatgtcgaagccgctgcttttgcttggttagcttattgtcgaatcaacaatttacctgcaaatctaccaagtgtaactggggcaaaaagtgcggttagtttgggggctatttttcctaaagactaa

SEQ ID NO: 29459 - protein, 382 aa, Haemophilus influenzae
MINMKPQYYLGMMSGTSLDGVDIVLVDFSQDPQLILSDFFPMPEDLREKLTTLIQVGETTLQNLGELDHKLALLYSDCVNAFLQKNTFLPNQIQAIGCHGQTVWHSPNSQFPFTMQLGDMNLLAAKTGISVIGDFRRKDMAWGGQGAPLVPAFHEAVFSNSNFATAVLNIGGISNVSILFPNQAVIGFDTGPGNTLLDQWIEKHQGLRYDENGEWAAKGNVNKVLLDELLNEPFFSLPAPKSTGRELFNLVWLNHKIAKIREKLTALSVEMSFRPEDVQATLVELTVTSIVNALNQLQTDLPKRLLVCGGGAKNSLIMRGLHDNLLDWQVSTTTEQGFDIDYVEAAAFAWLAYCRINNLPANLPSVTGAKSAVSLGAIFPKD

SEQ ID NO: 29460 - DNA, 23 bp, Artificial sequence
  (1)..(23): primer
atgaaatcgggccgctttattgg

SEQ ID NO: 29461 - DNA, 24 bp, Artificial sequence
  (1)..(24): primer
ttacgggttagcggggaaaatagc

SEQ ID NO: 29462 - protein, 468 aa, Artificial sequence
  Variant (12)..(12): xaa in position 12 is any or no amino acid
  Variant (15)..(16): xaa in position 15 to 16 is any amino acid
  Variant (19)..(34): xaa in position 19 to 34 is any amino acid
  Variant (35)..(54): xaa in position 35 to 54 is any or no amino acid
  Variant (57)..(58): xaa in position 57 to 58 is any amino acid
  Variant (60)..(77): xaa in position 60 to 77 is any amino acid
  Variant (78)..(91): xaa in position 78 to 91 is any or no amino acid
  Variant (93)..(96): xaa in position 93 to 96 is any amino acid
  Variant (98)..(103): xaa in position 98 to 103 is any amino acid
  Variant (105)..(108): xaa in position 105 to 108 is any amino acid
  Variant (109)..(114): xaa in position 109 to 114 is any or no amino acid
  Variant (116)..(117): xaa in position 116 to 117 is any amino acid
  Variant (120)..(120): xaa in position 120 is any amino acid
  Variant (126)..(126): xaa in position 126 is any amino acid
  Variant (128)..(128): xaa in position 128 is any amino acid
  Variant (130)..(133): xaa in position 130 to 133 is any amino acid
  Variant (134)..(150): xaa in position 134 to 150 is any or no amino acid
  Variant (152)..(152): xaa in position 152 is any amino acid
  Variant (156)..(159): xaa in position 156 to 159 is any amino acid
  Variant (162)..(163): xaa in position 162 to 163 is any amino acid
  Variant (165)..(165): xaa in position 165 is any amino acid
  Variant (167)..(168): xaa in position 167 to 168 is any amino acid
  Variant (170)..(170): xaa in position 170 is any amino acid
  Variant (174)..(175): xaa in position 174 to 175 is any amino acid
  Variant (179)..(179): xaa in position 179 is any amino acid
  Variant (189)..(193): xaa in position 189 to 193 is any amino acid
  Variant (195)..(202): xaa in position 195 to 202 is any amino acid
  Variant (203)..(209): xaa in position 203 to 209 is any or no amino acid
  Variant (221)..(221): xaa in position 221 is any amino acid
  Variant (223)..(225): xaa in position 223 to 225 is any amino acid
  Variant (226)..(243): xaa in position 226 to 243 is any or no amino acid
  Variant (245)..(245): xaa in position 245 is any or no amino acid
  Variant (249)..(249): xaa in position 249 is any amino acid
  Variant (254)..(254): xaa in position 254 is any amino acid
  Variant (258)..(267): xaa in position 258 to 267 is any amino acid
  Variant (268)..(270): xaa in position 268 to 270 is any or no amino acid
  Variant (273)..(274): xaa in position 273 to 274 is any amino acid
  Variant (276)..(277): xaa in position 276 to 277 is any amino acid
  Variant (279)..(280): xaa in position 279 to 280 is any amino acid
  Variant (282)..(282): xaa in position 282 is any amino acid
  Variant (284)..(286): xaa in position 284 to 286 is any amino acid
  Variant (289)..(291): xaa in position 289 to 291 is any amino acid
  Variant (293)..(295): xaa in position 293 to 295 is any amino acid
  Variant (296)..(297): xaa in position 296 to 297 is any or no amino acid
  Variant (300)..(303): xaa in position 300 to 303 is any amino acid
  Variant (311)..(311): xaa in position 311 is any amino acid
  Variant (313)..(316): xaa in position 313 to 316 is any amino acid
  Variant (318)..(327): xaa in position 318 to 327 is any amino acid
  Variant (328)..(345): xaa in position 328 to 345 is any or no amino acid
  Variant (348)..(350): xaa in position 348 to 350 is any amino acid
  Variant (353)..(354): xaa in position 353 to 354 is any amino acid
  Variant (356)..(366): xaa in position 356 to 366 is any amino acid
  Variant (367)..(375): xaa in position 367 to 375 is any or no amino acid
  Variant (377)..(377): xaa in position 377 is any or no amino acid
  Variant (379)..(379): xaa in position 379 is any or no amino acid
  Variant (383)..(384): xaa in position 383 to 384 is any amino acid
  Variant (386)..(387): xaa in position 386 to 387 is any amino acid
  Variant (390)..(391): xaa in position 390 to 391 is any amino acid
  Variant (393)..(395): xaa in position 393 to 395 is any amino acid
  Variant (397)..(398): xaa in position 397 to 398 is any amino acid
  Variant (399)..(418): xaa in position 399 to 418 is any or no amino acid
  Variant (420)..(425): xaa in position 420 to 425 is any amino acid
  Variant (428)..(432): xaa in position 428 to 432 is any amino acid
  Variant (435)..(435): xaa in position 435 is any amino acid
  Variant (439)..(439): xaa in position 439 is any amino acid
  Variant (442)..(451): xaa in position 442 to 451 is any amino acid
  Variant (452)..(453): xaa in position 452 to 453 is any or no amino acid
  Variant (455)..(456): xaa in position 455 to 456 is any amino acid
  Variant (460)..(464): xaa in position 460 to 464 is any amino acid
  Variant (467)..(467): xaa in position 467 is any amino acid
IGLMSGTSLDGXVDXXLVXXXXXXXXXXXXXXXXXXXXXXXXXXXXXXXXXXXXLRXXLXXXXXXXXXXXXXXXXXXXXXXXXXXXXXXXXLXXXXAXXXXXXLXXXXXXXXXXIXXIGXHGQTVXHXPXXXXXXXXXXXXXXXXXXXXXTXQIGXXXXIAXXTXIXXVXDFRXXDMAXGGQGAPLVPXXXXXLXXXXXXXXXXXXXXXVLNIGGIANITXLXXXXXXXXXXXXXXXXXXXXXVXGFDXGPGNXLLDXXXXXXXXXXXXXYDXXGXXAXXGXVXXXLLXXXLXXXXXYFXXXXPKSTGREXFXXXXLXXXXXXXXXXXXXXXXXXXXXXXXXXXXTLXXXTAXXIXXXXXXXXXXXXXXXXXXXXLXVXGGGXXNXXLMXXLXXXLXXXXXXXXXXXXXXXXXXXXXXVXXXXXXGLXXXXXEAXAFAXLAXXXXXXXXXXXXPXXTGAXXXXXLGXI

SEQ ID NO: 29463 - protein, 15 aa, Artificial sequence
  Variant (2)..(2): xaa in position 2 is Ile, Leu, Met or Val
  Variant (3)..(3): xaa in position 3 is Ile or Met
  Variant (8)..(8): xaa in position 8 is any amino acid
  Variant (11)..(11): xaa in position 11 is any amino acid
  Variant (13)..(14): xaa in position 13 to 14 is any amino acid
  Variant (15)..(15): xaa in position 15 is Ala, Ile, Leu or Val
GXXSGTSXDGXDXXX

SEQ ID NO: 29464 - protein, 11 aa, Artificial sequence
  Variant (2)..(2): xaa in position 2 is any amino acid
  Variant (7)..(7): xaa in position 7 is Ile, Leu or Val
  Variant (8)..(8): xaa in position 8 is any amino acid
  Variant (10)..(10): xaa in position 10 is any amino acid
GXHGQTXXHXP

SEQ ID NO: 29465 - protein, 36 aa, Artificial sequence
  Variant (2)..(2): xaa in position 2 is Ile or Leu
  Variant (3)..(7): xaa in position 3 to 7 is any amino acid
  Variant (8)..(8): xaa in position 8 is Ile, Leu, Met or Val
  Variant (9)..(15): xaa in position 9 to 15 is any amino acid
  Variant (16)..(16): xaa in position 16 is Thr or Val
  Variant (17)..(17): xaa in position 17 is Ala, Ile or Val
  Variant (18)..(18): xaa in position 18 is any amino acid
  Variant (19)..(19): xaa in position 19 is Asp or Asn
  Variant (22)..(23): xaa in position 22 to 23 is any amino acid
  Variant (25)..(25): xaa in position 25 is Ile, Leu, Met or Val
  Variant (26)..(27): xaa in position 26 to 27 is any amino acid
  Variant (30)..(30): xaa in position 30 is any amino acid
  Variant (35)..(35): xaa in position 35 is any amino acid
  Variant (36)..(36): xaa in position 36 is Ala, Pro, Ser or Thr
QXXXXXXXXXXXXXXXXXXFRXXDXXXGGXGAPLXX

SEQ ID NO: 29466 - protein, 11 aa, Artificial sequence
  Variant (2)..(2): xaa in position 2 is Ile, Leu or Val
  Variant (6)..(6): xaa in position 6 is Ala, Gly or Ser
  Variant (8)..(8): xaa in position 8 is any amino acid
  Variant (9)..(9): xaa in position 9 is Ala, Cys, Ser or Thr
  Variant (10)..(10): xaa in position 10 is any amino acid
  Variant (11)..(11): xaa in position 11 is Ile, Leu, Pro or Val
NXGGIXNXXXX

SEQ ID NO: 29467 - protein, 10 aa, Artificial sequence
  Variant (2)..(2): xaa in position 2 is Cys or Thr
  Variant (5)..(5): xaa in position 5 is Ala or Gly
  Variant (7)..(7): xaa in position 7 is any amino acid
  Variant (8)..(8): xaa in position 8 is Phe, Ile, Leu, Met or Val
  Variant (9)..(9): xaa in position 9 is Ile, Leu, Met or Val
DXGPXNXXXD

SEQ ID NO: 29468 - protein, 39 aa, Artificial sequence
  Variant (2)..(2): xaa in position 2 is any amino acid
  Variant (3)..(3): xaa in position 3 is Asp, Glu, Gly, Asn, Gln or Ser
  Variant (4)..(4): xaa in position 4 is Ala or Gly
  Variant (5)..(6): xaa in position 5 to 6 is any amino acid
  Variant (7)..(7): xaa in position 7 is Ala, Gly or Ser
  Variant (8)..(9): xaa in position 8 to 9 is any amino acid
  Variant (11)..(16): xaa in position 11 to 16 is any amino acid
  Variant (17)..(17): xaa in position 17 is Ile, Leu or Val
  Variant (18)..(24): xaa in position 18 to 24 is any amino acid
  Variant (25)..(25): xaa in position 25 is Phe, Trp or Tyr
  Variant (26)..(26): xaa in position 26 is Phe, Ile or Leu
  Variant (27)..(30): xaa in position 27 to 30 is any amino acid
  Variant (34)..(34): xaa in position 34 is any amino acid
  Variant (35)..(35): xaa in position 35 is Asp or Gly
  Variant (37)..(38): xaa in position 37 to 38 is any amino acid
DXXXXXXXXGXXXXXXXXXXXXXXXXXXXXPKSXXRXXF

SEQ ID NO: 29469 - protein, 10 aa, Artificial sequence
  Variant (4)..(5): xaa in position 4 to 5 is any amino acid
  Variant (7)..(7): xaa in position 7 is any amino acid
  Variant (8)..(8): xaa in position 8 is any or no amino acid
  Variant (10)..(10): xaa in position 10 is Ile, Leu, Met or Val
GGGXXNXXLX

SEQ ID NO: 29470 - protein, 35 aa, Artificial sequence
  Variant (2)..(2): xaa in position 2 is Ala, Gly or Ser
  Variant (3)..(4): xaa in position 3 to 4 is any amino acid
  Variant (5)..(5): xaa in position 5 is Phe, Ile or Met
  Variant (6)..(6): xaa in position 6 is Ala or Gly
  Variant (7)..(7): xaa in position 7 is any amino acid
  Variant (8)..(8): xaa in position 8 is Phe, Leu or Met
  Variant (9)..(9): xaa in position 9 is Ala, Gly or Ser
  Variant (10)..(23): xaa in position 10 to 23 is any amino acid
  Variant (26)..(27): xaa in position 26 to 27 is any or no amino acid
  Variant (29)..(32): xaa in position 29 to 32 is any amino acid
  Variant (33)..(34): xaa in position 33 to 34 is any or no amino acid
EXXXXXXXXXXXXXXXXXXXXXXTGXXAXXXXXXG

SEQ ID NO: 29471 - DNA, 1047 bp, Escherichia coli K12; identical to SEQ ID NO: 1323
  CDS (1)..(1047)

SEQ ID NO: 29472 - protein, 348 aa, Escherichia coli K12; identical to SEQ ID NO: 1324

SEQ ID NO: 29473 - DNA, 1235 bp, Salmonella typhimurium; identical to SEQ ID NO: 1325
  CDS (165)..(1235)

SEQ ID NO: 29474 - protein, 356 aa, Salmonella typhimurium; identical to SEQ ID NO: 1326

SEQ ID NO: 29475 - DNA, 1086 bp, Deinococcus radiodurans; identical to SEQ ID NO: 1327
  CDS (1)..(1086)

SEQ ID NO: 29476 - protein, 361 aa, Deinococcus radiodurans; identical to SEQ ID NO: 1328

SEQ ID NO: 29477 - DNA, 1056 bp, Neisseria meningitidis; identical to SEQ ID NO: 1329
  CDS (1)..(1056)

SEQ ID NO: 29478 - protein, 351 aa, Neisseria meningitidis; identical to SEQ ID NO: 1330

SEQ ID NO: 29479 - DNA, 1047 bp, Yersinia pestis; identical to SEQ ID NO: 1331
  CDS (1)..(1047)

SEQ ID NO: 29480 - protein, 348 aa, Yersinia pestis; identical to SEQ ID NO: 1332

SEQ ID NO: 29481 - DNA, 1071 bp, Escherichia coli; identical to SEQ ID NO: 1333
  CDS (1)..(1071)

SEQ ID NO: 29482 - protein, 356 aa, Escherichia coli; identical to SEQ ID NO: 1334

SEQ ID NO: 29483 - DNA, 1131 bp, Nostoc sp. PCC 7120; identical to SEQ ID NO: 1335
  CDS (1)..(1131)

SEQ ID NO: 29484 - protein, 376 aa, Nostoc sp. PCC 7120; identical to SEQ ID NO: 1336

SEQ ID NO: 29485 - DNA, 1053 bp, Salmonella enterica subsp. enterica serovar Typhi; identical to SEQ ID NO: 1337
  CDS (1)..(1053)

SEQ ID NO: 29486 - protein, 350 aa, Salmonella enterica subsp. enterica serovar Typhi; identical to SEQ ID NO: 1338

SEQ ID NO: 29487 - DNA, 1077 bp, Pseudomonas aeruginosa; identical to SEQ ID NO: 1339
  CDS (1)..(1077)

SEQ ID NO: 29488 - protein, 358 aa, Pseudomonas aeruginosa; identical to SEQ ID NO: 1340

SEQ ID NO: 29489 - DNA, 1047 bp, Buchnera sp; identical to SEQ ID NO: 1341
  CDS (1)..(1047)

SEQ ID NO: 29490 - protein, 348 aa, Buchnera sp; identical to SEQ ID NO: 1342

SEQ ID NO: 29491 - DNA, 1074 bp, Vibrio cholerae; identical to SEQ ID NO: 1343
  CDS (1)..(1074)

SEQ ID NO: 29492 - protein, 357 aa, Vibrio cholerae; identical to SEQ ID NO: 1344

SEQ ID NO: 29493 - DNA, 1038 bp, Lactococcus lactis subsp. lactis; identical to SEQ ID NO: 1345
  CDS (1)..(1038)

SEQ ID NO: 29494 - protein, 345 aa, Lactococcus lactis subsp. lactis; identical to SEQ ID NO: 1346

SEQ ID NO: 29495 - DNA, 1023 bp, Lactococcus lactis subsp. lactis; identical to SEQ ID NO: 1347
  CDS (1)..(1023)

SEQ ID NO: 29496 - protein, 340 aa, Lactococcus lactis subsp. lactis; identical to SEQ ID NO: 1348

SEQ ID NO: 29497 - DNA, 1032 bp, Streptococcus pneumoniae; identical to SEQ ID NO: 1349
  CDS (1)..(1032)

SEQ ID NO: 29498 - protein, 343 aa, Streptococcus pneumoniae; identical to SEQ ID NO: 1350

SEQ ID NO: 29499 - DNA, 1095 bp, Pseudomonas aeruginosa; identical to SEQ ID NO: 1351
  CDS (1)..(1095)

SEQ ID NO: 29500 - protein, 364 aa, Pseudomonas aeruginosa; identical to SEQ ID NO: 1352

SEQ ID NO: 29501 - DNA, 1110 bp, Caulobacter crescentus; identical to SEQ ID NO: 1353
  CDS (1)..(1110)

SEQ ID NO: 29502 - protein, 369 aa, Caulobacter crescentus; identical to SEQ ID NO: 1354

SEQ ID NO: 29503 - DNA, 1032 bp, Streptococcus pneumoniae; identical to SEQ ID NO: 1355
  CDS (1)..(1032)

SEQ ID NO: 29504 - protein, 343 aa, Streptococcus pneumoniae; identical to SEQ ID NO: 1356

SEQ ID NO: 29505 - DNA, 1047 bp, Buchnera aphidicola; identical to SEQ ID NO: 1357
  CDS (1)..(1047)

SEQ ID NO: 29506 - protein, 348 aa, Buchnera aphidicola; identical to SEQ ID NO: 1358

SEQ ID NO: 29507 - DNA, 1089 bp, Haemophilus influenzae; identical to SEQ ID NO: 1359
  CDS (1)..(1089)

SEQ ID NO: 29508 - protein, 362 aa, Haemophilus influenzae; identical to SEQ ID NO: 1360

SEQ ID NO: 29509 - DNA, 1502 bp, Candida albicans; identical to SEQ ID NO: 1361
  CDS (336)..(1442)

SEQ ID NO: 29510 - protein, 368 aa, Candida albicans; identical to SEQ ID NO: 1362

SEQ ID NO: 29511 - DNA, 1113 bp, Saccharomyces cerevisiae; identical to SEQ ID NO: 1363
  CDS (1)..(1113)

SEQ ID NO: 29512 - protein, 370 aa, Saccharomyces cerevisiae; identical to SEQ ID NO: 1364

SEQ ID NO: 29513 - DNA, 2048 bp, Saccharomyces cerevisiae; identical to SEQ ID NO: 1365
  CDS (619)..(1731)

SEQ ID NO: 29514 - protein, 370 aa, Saccharomyces cerevisiae; identical to SEQ ID NO: 1366

SEQ ID NO: 29515 - DNA, 1107 bp, Schizosaccharomyces pombe; identical to SEQ ID NO: 1367
  CDS (1)..(1107)

SEQ ID NO: 29516 - protein, 368 aa, Schizosaccharomyces pombe; identical to SEQ ID NO: 1368

SEQ ID NO: 29517 - DNA, 1089 bp, Amycolatopsis orientalis; identical to SEQ ID NO: 1369
  CDS (1)..(1089)

SEQ ID NO: 29518 - protein, 362 aa, Amycolatopsis orientalis; identical to SEQ ID NO: 1370

SEQ ID NO: 29519 - DNA, 1119 bp, Schizosaccharomyces pombe; identical to SEQ ID NO: 1371
  CDS (1)..(1119)

SEQ ID NO: 29520 - protein, 372 aa, Schizosaccharomyces pombe; identical to SEQ ID NO: 1372

SEQ ID NO: 29521 - DNA, 1248 bp, Corynebacterium glutamicum; identical to SEQ ID NO: 1373
  CDS (101)..(1228)

SEQ ID NO: 29522 - protein, 375 aa, Corynebacterium glutamicum; identical to SEQ ID NO: 1374

SEQ ID NO: 29523 - DNA, 1083 bp, Methylophilus methylotrophus; identical to SEQ ID NO: 1375
  CDS (1)..(1083)

SEQ ID NO: 29524 - protein, 360 aa, Methylophilus methylotrophus; identical to SEQ ID NO: 1376

SEQ ID NO: 29525 - DNA, 1107 bp, Debaryomyces hansenii; identical to SEQ ID NO: 1377
  CDS (1)..(1107)

SEQ ID NO: 29526 - protein, 368 aa, Debaryomyces hansenii; identical to SEQ ID NO: 1378

SEQ ID NO: 29527 - DNA, 1074 bp, Yarrowia lipolytica; identical to SEQ ID NO: 1379
  CDS (1)..(1074)

SEQ ID NO: 29528 - protein, 357 aa, Yarrowia lipolytica; identical to SEQ ID NO: 1380

SEQ ID NO: 29529 - DNA, 1089 bp, Yarrowia lipolytica; identical to SEQ ID NO: 1381
  CDS (1)..(1089)

SEQ ID NO: 29530 - protein, 362 aa, Yarrowia lipolytica; identical to SEQ ID NO: 1382

SEQ ID NO: 29531 - DNA, 1119 bp, Kluyveromyces lactis; identical to SEQ ID NO: 1383
  CDS (1)..(1119)

SEQ ID NO: 29532 - protein, 372 aa, Kluyveromyces lactis; identical to SEQ ID NO: 1384

SEQ ID NO: 29533 - DNA, 1095 bp, Kluyveromyces lactis; identical to SEQ ID NO: 1385
  CDS (1)..(1095)

SEQ ID NO: 29534 - protein, 364 aa, Kluyveromyces lactis; identical to SEQ ID NO: 1386

SEQ ID NO: 29535 - DNA, 1074 bp, Erwinia carotovora subsp; identical to SEQ ID NO: 1387
  CDS (1)..(1074)

SEQ ID NO: 29536 - protein, 357 aa, Erwinia carotovora subsp; identical to SEQ ID NO: 1388

SEQ ID NO: 29537 - DNA, 1047 bp, Erwinia carotovora subsp; identical to SEQ ID NO: 1389
  CDS (1)..(1047)

SEQ ID NO: 29538 - protein, 348 aa, Erwinia carotovora subsp; identical to SEQ ID NO: 1390

SEQ ID NO: 29539 - DNA, 1056 bp, Erwinia carotovora subsp; identical to SEQ ID NO: 1391
  CDS (1)..(1056)

SEQ ID NO: 29540 - protein, 351 aa, Erwinia carotovora subsp; identical to SEQ ID NO: 1392

SEQ ID NO: 29541 - DNA, 1113 bp, Acinetobacter sp; identical to SEQ ID NO: 1393
  CDS (1)..(1113)

SEQ ID NO: 29542 - protein, 370 aa, Acinetobacter sp; identical to SEQ ID NO: 1394

SEQ ID NO: 29543 - DNA, 1056 bp, Acinetobacter sp; identical to SEQ ID NO: 1395
  CDS (1)..(1056)

SEQ ID NO: 29544 - protein, 351 aa, Acinetobacter sp; identical to SEQ ID NO: 1396

SEQ ID NO: 29545 - DNA, 1119 bp, Candida glabrata; identical to SEQ ID NO: 1397
  CDS (1)..(1119)

SEQ ID NO: 29546 - protein, 372 aa, Candida glabrata; identical to SEQ ID NO: 1398

SEQ ID NO: 29547 - DNA, 1071 bp, Candida glabrata; identical to SEQ ID NO: 1399
  CDS (1)..(1071)

SEQ ID NO: 29548 - protein, 356 aa, Candida glabrata; identical to SEQ ID NO: 1400

SEQ ID NO: 29549 - DNA, 1083 bp, Photobacterium profundum; identical to SEQ ID NO: 1401
  CDS (1)..(1083)

SEQ ID NO: 29550 - protein, 360 aa, Photobacterium profundum; identical to SEQ ID NO: 1402

SEQ ID NO: 29551 - DNA, 1053 bp, Photobacterium profundum; identical to SEQ ID NO: 1403
  CDS (1)..(1053)

SEQ ID NO: 29552 - protein, 350 aa, Photobacterium profundum; identical to SEQ ID NO: 1404

SEQ ID NO: 29553 - DNA, 1113 bp, Photobacterium profundum; identical to SEQ ID NO: 1405
  CDS (1)..(1113)

SEQ ID NO: 29554 - protein, 370 aa, Photobacterium profundum; identical to SEQ ID NO: 1406

SEQ ID NO: 29555 - DNA, 1056 bp, Photobacterium profundum; identical to SEQ ID NO: 1407
  CDS (1)..(1056)

SEQ ID NO: 29556 - protein, 351 aa, Photobacterium profundum; identical to SEQ ID NO: 1408

SEQ ID NO: 29557 - DNA, 1092 bp, Parachlamydia sp; identical to SEQ ID NO: 1409
  CDS (1)..(1092)

SEQ ID NO: 29558 - protein, 363 aa, Parachlamydia sp; identical to SEQ ID NO: 1410

SEQ ID NO: 29559 - DNA, 1095 bp, Rhodopseudomonas palustris; identical to SEQ ID NO: 1411
  CDS (1)..(1095)

SEQ ID NO: 29560 - protein, 364 aa, Rhodopseudomonas palustris; identical to SEQ ID NO: 1412

SEQ ID NO: 29561 - DNA, 1100 bp, Amycolatopsis methanolica; identical to SEQ ID NO: 1413
  CDS (1)..(1086)

SEQ ID NO: 29562 - protein, 361 aa, Amycolatopsis methanolica; identical to SEQ ID NO: 1414

SEQ ID NO: 29563 - DNA, 1071 bp, Treponema denticola; identical to SEQ ID NO: 1415
  CDS (1)..(1071)

SEQ ID NO: 29564 - protein, 356 aa, Treponema denticola; identical to SEQ ID NO: 1416

SEQ ID NO: 29565 - DNA, 1068 bp, Geobacter sulfurreducens; identical to SEQ ID NO: 1417
  CDS (1)..(1068)

SEQ ID NO: 29566 - protein, 355 aa, Geobacter sulfurreducens; identical to SEQ ID NO: 1418

SEQ ID NO: 29567 - DNA, 1095 bp, Ashbya gossypii; identical to SEQ ID NO: 1419
  CDS (1)..(1095)

SEQ ID NO: 29568 - protein, 364 aa, Ashbya gossypii; identical to SEQ ID NO: 1420

SEQ ID NO: 29569 - DNA, 1122 bp, Ashbya gossypii; identical to SEQ ID NO: 1421
  CDS (1)..(1122)

SEQ ID NO: 29570 - protein, 373 aa, Ashbya gossypii; identical to SEQ ID NO: 1422

SEQ ID NO: 29571 - DNA, 1098 bp, Amycolatopsis balhimycina; identical to SEQ ID NO: 1423
  CDS (1)..(1098)

SEQ ID NO: 29572 - protein, 365 aa, Amycolatopsis balhimycina; identical to SEQ ID NO: 1424

SEQ ID NO: 29573 - DNA, 1071 bp, Vibrio vulnificus; identical to SEQ ID NO: 1425
  CDS (1)..(1071)

SEQ ID NO: 29574 - protein, 356 aa, Vibrio vulnificus; identical to SEQ ID NO: 1426

SEQ ID NO: 29575 - DNA, 1047 bp, Photorhabdus luminescens; identical to SEQ ID NO: 1427
  CDS (1)..(1047)

SEQ ID NO: 29576 - protein, 348 aa, Photorhabdus luminescens; identical to SEQ ID NO: 1428

SEQ ID NO: 29577 - DNA, 1053 bp, Photorhabdus luminescens; identical to SEQ ID NO: 1429
  CDS (1)..(1053)

SEQ ID NO: 29578 - protein, 350 aa, Photorhabdus luminescens; identical to SEQ ID NO: 1430

SEQ ID NO: 29579 - DNA, 1095 bp, Photorhabdus luminescens; identical to SEQ ID NO: 1431
  CDS (1)..(1095)

SEQ ID NO: 29580 - protein, 364 aa, Photorhabdus luminescens; identical to SEQ ID NO: 1432

SEQ ID NO: 29581 - DNA, 1119 bp, Gloeobacter violaceus; identical to SEQ ID NO: 1433
  CDS (1)..(1119)

SEQ ID NO: 29582 - protein, 372 aa, Gloeobacter violaceus; identical to SEQ ID NO: 1434

SEQ ID NO: 29583 - DNA, 1107 bp, Chromobacterium violaceum; identical to SEQ ID NO: 1435
  CDS (1)..(1107)

SEQ ID NO: 29584 - protein, 368 aa, Chromobacterium violaceum; identical to SEQ ID NO: 1436

SEQ ID NO: 29585 - DNA, 1059 bp, Chromobacterium violaceum; identical to SEQ ID NO: 1437
  CDS (1)..(1059)

SEQ ID NO: 29586 - protein, 352 aa, Chromobacterium violaceum; identical to SEQ ID NO: 1438

SEQ ID NO: 29587 - DNA, 1140 bp, Neurospora crassa; identical to SEQ ID NO: 1439
  CDS (1)..(1140)

SEQ ID NO: 29588 - protein, 379 aa, Neurospora crassa; identical to SEQ ID NO: 1440

SEQ ID NO: 29589 - DNA, 1092 bp, Neurospora crassa; identical to SEQ ID NO: 1441
  CDS (1)..(1092)

SEQ ID NO: 29590 - protein, 363 aa, Neurospora crassa; identical to SEQ ID NO: 1442

SEQ ID NO: 29591 - DNA, 1068 bp, Synechococcus sp; identical to SEQ ID NO: 1443
  CDS (1)..(1068)

SEQ ID NO: 29592 - protein, 355 aa, Synechococcus sp; identical to SEQ ID NO: 1444

SEQ ID NO: 29593 - DNA, 1053 bp, Rhodopirellula baltica; identical to SEQ ID NO: 1445
  CDS (1)..(1053)

SEQ ID NO: 29594 - protein, 350 aa, Rhodopirellula baltica; identical to SEQ ID NO: 1446

SEQ ID NO: 29595 - DNA, 1068 bp, Prochlorococcus marinus subsp; identical to SEQ ID NO: 1447
  CDS (1)..(1068)

SEQ ID NO: 29596 - protein, 355 aa, Prochlorococcus marinus subsp; identical to SEQ ID NO: 1448

SEQ ID NO: 29597 - DNA, 1083 bp, Prochlorococcus marinus; identical to SEQ ID NO: 1449
  CDS (1)..(1083)

SEQ ID NO: 29598 - protein, 360 aa, Prochlorococcus marinus; identical to SEQ ID NO: 1450

SEQ ID NO: 29599 - DNA, 1074 bp, Prochlorococcus marinus; identical to SEQ ID NO: 1451
  CDS (1)..(1074)

SEQ ID NO: 29600 - protein, 357 aa, Prochlorococcus marinus; identical to SEQ ID NO: 1452

SEQ ID NO: 29601 - DNA, 1113 bp, Haemophilus ducreyi; identical to SEQ ID NO: 1453
  CDS (1)..(1113)

SEQ ID NO: 29602 - protein, 370 aa, Haemophilus ducreyi; identical to SEQ ID NO: 1454

SEQ ID NO: 29603 - DNA, 1080 bp, Haemophilus ducreyi; identical to SEQ ID NO: 1455
  CDS (1)..(1080)

SEQ ID NO: 29604 - protein, 359 aa, Haemophilus ducreyi; identical to SEQ ID NO: 1456

SEQ ID NO: 29605 - DNA, 1086 bp, Candidatus Blochmannia floridanus; identical to SEQ ID NO: 1457
  CDS (1)..(1086)

SEQ ID NO: 29606 - protein, 361 aa, Candidatus Blochmannia floridanus; identical to SEQ ID NO: 1458

SEQ ID NO: 29607 - DNA, 1074 bp, Bordetella pertussis; identical to SEQ ID NO: 1459
  CDS (1)..(1074)

SEQ ID NO: 29608 - protein, 357 aa, Bordetella pertussis; identical to SEQ ID NO: 1460

SEQ ID NO: 29609 - DNA, 1119 bp, Bordetella bronchiseptica; identical to SEQ ID NO: 1461
  CDS (1)..(1119)

SEQ ID NO: 29610 - protein, 372 aa, Bordetella bronchiseptica; identical to SEQ ID NO: 1462

SEQ ID NO: 29611 - DNA, 1179 bp, Nitrosomonas europaea; identical to SEQ ID NO: 1463
  CDS (1)..(1179)

SEQ ID NO: 29612 - protein, 392 aa, Nitrosomonas europaea; identical to SEQ ID NO: 1464

SEQ ID NO: 29613 - DNA, 1083 bp, Coxiella burnetii; identical to SEQ ID NO: 1465
  CDS (1)..(1083)

SEQ ID NO: 29614 - protein, 360 aa, Coxiella burnetii; identical to SEQ ID NO: 1466

SEQ ID NO: 29615 - DNA, 834 bp, Vibrio anguillarum; identical to SEQ ID NO: 1467
  CDS (1)..(834)

SEQ ID NO: 29616 - protein, 277 aa, Vibrio anguillarum; identical to SEQ ID NO: 1468

SEQ ID NO: 29617 - DNA, 1143 bp, Xylella fastidiosa; identical to SEQ ID NO: 1469
  CDS (1)..(1143)

SEQ ID NO: 29618 - protein, 380 aa, Xylella fastidiosa; identical to SEQ ID NO: 1470

SEQ ID NO: 29619 - DNA, 1053 bp, Vibrio parahaemolyticus; identical to SEQ ID NO: 1471
  CDS (1)..(1053)

SEQ ID NO: 29620 - protein, 350 aa, Vibrio parahaemolyticus; identical to SEQ ID NO: 1472

SEQ ID NO: 29621 - DNA, 1053 bp, Vibrio parahaemolyticus; identical to SEQ ID NO: 1473
  CDS (1)..(1053)

SEQ ID NO: 29622 - protein, 350 aa, Vibrio parahaemolyticus; identical to SEQ ID NO: 1474

SEQ ID NO: 29623 - DNA, 1074 bp, Vibrio parahaemolyticus; identical to SEQ ID NO: 1475
  CDS (1)..(1074)

SEQ ID NO: 29624 - protein, 357 aa, Vibrio parahaemolyticus; identical to SEQ ID NO: 1476

SEQ ID NO: 29625 - DNA, 1083 bp, Pseudomonas syringae; identical to SEQ ID NO: 1477
  CDS (1)..(1083)

SEQ ID NO: 29626 - protein, 360 aa, Pseudomonas syringae; identical to SEQ ID NO: 1478

SEQ ID NO: 29627 - DNA, 1077 bp, Pseudomonas syringae; identical to SEQ ID NO: 1479
  CDS (1)..(1077)

SEQ ID NO: 29628 - protein, 358 aa, Pseudomonas syringae; identical to SEQ ID NO: 1480

SEQ ID NO: 29629 - DNA, 1062 bp, Pseudomonas putida; identical to SEQ ID NO: 1481
  CDS (1)..(1062)

SEQ ID NO: 29630 - protein, 353 aa, Pseudomonas putida; identical to SEQ ID NO: 1482

SEQ ID NO: 29631 - DNA, 1113 bp, Pseudomonas putida; identical to SEQ ID NO: 1483
  CDS (1)..(1113)

SEQ ID NO: 29632 - protein, 370 aa, Pseudomonas putida; identical to SEQ ID NO: 1484

SEQ ID NO: 29633 - DNA, 1086 bp, Bradyrhizobium japonicum; identical to SEQ ID NO: 1485
  CDS (1)..(1086)

SEQ ID NO: 29634 - protein, 361 aa, Bradyrhizobium japonicum; identical to SEQ ID NO: 1486

SEQ ID NO: 29635 - DNA, 1053 bp, Yersinia pestis; identical to SEQ ID NO: 1487
  CDS (1)..(1053)

SEQ ID NO: 29636 - protein, 350 aa, Yersinia pestis; identical to SEQ ID NO: 1488

SEQ ID NO: 29637 - DNA, 1077 bp, Yersinia pestis; identical to SEQ ID NO: 1489
  CDS (1)..(1077)

SEQ ID NO: 29638 - protein, 358 aa, Yersinia pestis; identical to SEQ ID NO: 1490

SEQ ID NO: 29639 - DNA, 1038 bp, Wigglesworthia glossinidia brevipalpis; identical to SEQ ID NO: 1491
  CDS (1)..(1038)

SEQ ID NO: 29640 - protein, 345 aa, Wigglesworthia glossinidia brevipalpis; identical to SEQ ID NO: 1492

SEQ ID NO: 29641 - DNA, 1053 bp, Vibrio vulnificus; identical to SEQ ID NO: 1493
  CDS (1)..(1053)

SEQ ID NO: 29642 - protein, 350 aa, Vibrio vulnificus; identical to SEQ ID NO: 1494

SEQ ID NO: 29643 - DNA, 1053 bp, Vibrio vulnificus; identical to SEQ ID NO: 1495
  CDS (1)..(1053)

SEQ ID NO: 29644 - protein, 350 aa, Vibrio vulnificus; identical to SEQ ID NO: 1496

SEQ ID NO: 29645 - DNA, 1071 bp, Vibrio vulnificus; identical to SEQ ID NO: 1497
  CDS (1)..(1071)

SEQ ID NO: 29646 - protein, 356 aa, Vibrio vulnificus; identical to SEQ ID NO: 1498

SEQ ID NO: 29647 - DNA, 1062 bp, Synechococcus elongatus; identical to SEQ ID NO: 1499
  CDS (1)..(1062)

SEQ ID NO: 29648 - protein, 353 aa, Synechococcus elongatus; identical to SEQ ID NO: 1500

SEQ ID NO: 29649 - DNA, 1032 bp, Streptococcus mutans; identical to SEQ ID NO: 1501
  CDS (1)..(1032)

SEQ ID NO: 29650 - protein, 343 aa, Streptococcus mutans; identical to SEQ ID NO: 1502

SEQ ID NO: 29651 - DNA, 1035 bp, Streptococcus mutans; identical to SEQ ID NO: 1503
  CDS (1)..(1035)

SEQ ID NO: 29652 - protein, 344 aa, Streptococcus mutans; identical to SEQ ID NO: 1504

SEQ ID NO: 29653 - DNA, 1008 bp, Streptococcus agalactiae; identical to SEQ ID NO: 1505
  CDS (1)..(1008)

SEQ ID NO: 29654 - protein, 335 aa, Streptococcus agalactiae; identical to SEQ ID NO: 1506

SEQ ID NO: 29655 - DNA, 1065 bp, Shewanella oneidensis; identical to SEQ ID NO: 1507
  CDS (1)..(1065)

SEQ ID NO: 29656 - protein, 354 aa, Shewanella oneidensis; identical to SEQ ID NO: 1508

SEQ ID NO: 29657 - DNA, 1092 bp, Shewanella oneidensis; identical to SEQ ID NO: 1509
  CDS (1)..(1092)

SEQ ID NO: 29658 - protein, 363 aa, Shewanella oneidensis; identical to SEQ ID NO: 1510

SEQ ID NO: 29659 - DNA, 1059 bp, Shewanella oneidensis; identical to SEQ ID NO: 1511
  CDS (1)..(1059)

SEQ ID NO: 29660 - protein, 352 aa, Shewanella oneidensis; identical to SEQ ID NO: 1512

SEQ ID NO: 29661 - DNA, 1053 bp, Escherichia coli O6; identical to SEQ ID NO: 1513
  CDS (1)..(1053)

SEQ ID NO: 29662 - protein, 350 aa, Escherichia coli O6; identical to SEQ ID NO: 1514

SEQ ID NO: 29663 - DNA, 1170 bp, Corynebacterium efficiens; identical to SEQ ID NO: 1515
  CDS (1)..(1170)

SEQ ID NO: 29664 - protein, 389 aa, Corynebacterium efficiens; identical to SEQ ID NO: 1516

SEQ ID NO: 29665 - DNA, 1134 bp, Bifidobacterium longum; identical to SEQ ID NO: 1517
  CDS (1)..(1134)

SEQ ID NO: 29666 - protein, 377 aa, Bifidobacterium longum; identical to SEQ ID NO: 1518

SEQ ID NO: 29667 - DNA, 1233 bp, Bifidobacterium longum; identical to SEQ ID NO: 1519
  CDS (1)..(1233)

SEQ ID NO: 29668 - protein, 410 aa, Bifidobacterium longum; identical to SEQ ID NO: 1520

SEQ ID NO: 29669 - DNA, 1221 bp, Phytophthora infestans; identical to SEQ ID NO: 1521
  CDS (20)..(1153)

SEQ ID NO: 29670 - protein, 377 aa, Phytophthora infestans; identical to SEQ ID NO: 1522

SEQ ID NO: 29671 - DNA, 1062 bp, Chlorobium tepidum; identical to SEQ ID NO: 1523
  CDS (1)..(1062)

SEQ ID NO: 29672 - protein, 353 aa, Chlorobium tepidum; identical to SEQ ID NO: 1524

SEQ ID NO: 29673 - DNA, 1074 bp, Xanthomonas campestris; identical to SEQ ID NO: 1525
  CDS (1)..(1074)

SEQ ID NO: 29674 - protein, 357 aa, Xanthomonas campestris; identical to SEQ ID NO: 1526

SEQ ID NO: 29675 - DNA, 1074 bp, Xanthomonas axonopodis; identical to SEQ ID NO: 1527
  CDS (1)..(1074)

SEQ ID NO: 29676 - protein, 357 aa, Xanthomonas axonopodis; identical to SEQ ID NO: 1528

SEQ ID NO: 29677 - DNA, 1080 bp, Ralstonia solanacearum; identical to SEQ ID NO: 1529
  CDS (1)..(1080)

SEQ ID NO: 29678 - protein, 359 aa, Ralstonia solanacearum; identical to SEQ ID NO: 1530

SEQ ID NO: 29679 - DNA, 1179 bp, Ralstonia solanacearum; identical to SEQ ID NO: 1531
  CDS (1)..(1179)

SEQ ID NO: 29680 - protein, 392 aa, Ralstonia solanacearum; identical to SEQ ID NO: 1532

SEQ ID NO: 29681 - DNA, 1065 bp, Synechococcus sp; identical to SEQ ID NO: 1533
  CDS (1)..(1065)

SEQ ID NO: 29682 - protein, 354 aa, Synechococcus sp; identical to SEQ ID NO: 1534

SEQ ID NO: 29683 - DNA, 1035 bp, Escherichia coli; identical to SEQ ID NO: 1535
  CDS (1)..(1035)

SEQ ID NO: 29684 - protein, 344 aa, Escherichia coli; identical to SEQ ID NO: 1536

SEQ ID NO: 29685 - DNA, 1200 bp, Stigmatella aurantiaca; identical to SEQ ID NO: 1537
  CDS (62)..(1147)

SEQ ID NO: 29686 - protein, 361 aa, Stigmatella aurantiaca; identical to SEQ ID NO: 1538

SEQ ID NO: 29687 - DNA, 1092 bp, Rhizobium loti; identical to SEQ ID NO: 1539
  CDS (1)..(1092)

SEQ ID NO: 29688 - protein, 363 aa, Rhizobium loti; identical to SEQ ID NO: 1540

SEQ ID NO: 29689 - DNA, 1083 bp, Amycolatopsis mediterranei; identical to SEQ ID NO: 1541
  CDS (1)..(1083)

SEQ ID NO: 29690 - protein, 360 aa, Amycolatopsis mediterranei; identical to SEQ ID NO: 1542

SEQ ID NO: 29691 - DNA, 1053 bp, Pasteurella multocida; identical to SEQ ID NO: 1543
  CDS (1)..(1053)

SEQ ID NO: 29692 - protein, 350 aa, Pasteurella multocida; identical to SEQ ID NO: 1544

SEQ ID NO: 29693 - DNA, 1086 bp, Pasteurella multocida; identical to SEQ ID NO: 1545
  CDS (1)..(1086)

SEQ ID NO: 29694 - protein, 361 aa, Pasteurella multocida; identical to SEQ ID NO: 1546

SEQ ID NO: 29695 - DNA, 1125 bp, Emericella nidulans; identical to SEQ ID NO: 1547
  CDS (1)..(1125)

SEQ ID NO: 29696 - protein, 374 aa, Emericella nidulans; identical to SEQ ID NO: 1548

SEQ ID NO: 29697 - DNA, 1089 bp, Emericella nidulans; identical to SEQ ID NO: 1549
  CDS (1)..(1089)

SEQ ID NO: 29698 - protein, 362 aa, Emericella nidulans; identical to SEQ ID NO: 1550

SEQ ID NO: 29699 - DNA, 1239 bp, Vibrio cholerae; identical to SEQ ID NO: 1551
  CDS (114)..(1175)

SEQ ID NO: 29700 - protein, 353 aa, Vibrio cholerae; identical to SEQ ID NO: 1552

SEQ ID NO: 29701 - DNA, 2184 bp, Candida albicans; identical to SEQ ID NO: 1553
  CDS (461)..(1573)

SEQ ID NO: 29702 - protein, 370 aa, Candida albicans; identical to SEQ ID NO: 1554

SEQ ID NO: 29703 - DNA, 1047 bp, Buchnera aphidicola; identical to SEQ ID NO: 1555
  CDS (1)..(1047)

SEQ ID NO: 29704 - protein, 348 aa, Buchnera aphidicola; identical to SEQ ID NO: 1556

SEQ ID NO: 29705 - DNA, 1047 bp, Buchnera aphidicola; identical to SEQ ID NO: 1557
  CDS (1)..(1047)

SEQ ID NO: 29706 - protein, 348 aa, Buchnera aphidicola; identical to SEQ ID NO: 1558

SEQ ID NO: 29707 - DNA, 1047 bp, Erwinia herbicola; identical to SEQ ID NO: 1559
  CDS (1)..(1047)

SEQ ID NO: 29708 - protein, 348 aa, Erwinia herbicola; identical to SEQ ID NO: 1560

SEQ ID NO: 29709 - DNA, 1047 bp, Salmonella typhimurium; identical to SEQ ID NO: 1561
  CDS (1)..(1047)

SEQ ID NO: 29710 - protein, 348 aa, Salmonella typhimurium; identical to SEQ ID NO: 1562

SEQ ID NO: 29711 - DNA, 23 bp, Artificial sequence
  (1)..(23): primer
atgaacagaactgacgaactccg

SEQ ID NO: 29712 - DNA, 24 bp, Artificial sequence
  (1)..(24): primer
ttagaagcgggtatctaccgcaga

SEQ ID NO: 29713 - protein, 352 aa, Artificial sequence; identical to SEQ ID NO: 19007
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (42)..(43): xaa in position 42 to 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(128): xaa in position 121 to 128 is any amino acid
  Variant (130)..(130): xaa in position 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(167): xaa in position 166 to 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (180)..(180): xaa in position 180 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 29714 - protein, 24 aa, Artificial sequence
  Variant (2)..(2): xaa in position 2 is any amino acid
  Variant (3)..(3): xaa in position 3 is Leu, Val, Phe, Ile, Ala or Met
  Variant (4)..(4): xaa in position 4 is Val, Ile, Leu or Ala
  Variant (5)..(5): xaa in position 5 is Val or Ile
  Variant (6)..(6): xaa in position 6 is Val, Ile, Cys or Thr
  Variant (11)..(11): xaa in position 11 is Ile, Val, Ser or Leu
  Variant (12)..(12): xaa in position 12 is His or Asp
  Variant (13)..(13): xaa in position 13 is Asp or Asn
  Variant (14)..(15): xaa in position 14 to 15 is any amino acid
  Variant (16)..(16): xaa in position 16 is Ala, Ser, Gln or Thr
  Variant (17)..(17): xaa in position 17 is Ala, Val or Gly
  Variant (18)..(18): xaa in position 18 is any amino acid
  Variant (19)..(19): xaa in position 19 is Glu, Asp, Ala or Gln
  Variant (21)..(21): xaa in position 21 is Ala, Gly, Cys or Ser
  Variant (22)..(22): xaa in position 22 is any amino acid
  Variant (23)..(23): xaa in position 23 is Arg, Lys, Gln, His or Leu
  Variant (24)..(24): xaa in position 24 is Leu, Ile or Phe
RXXXXXGPCSXXXXXXXXXYXXXX

SEQ ID NO: 29715 - protein, 42 aa, Artificial sequence; identical to SEQ ID NO: 2884
  Variant (1)..(1): xaa in position 1 is Leu, Ile, Phe or Met
  Variant (2)..(2): xaa in position 2 is any amino acid
  Variant (3)..(3): xaa in position 3 is Ile, Val, Leu or Met
  Variant (4)..(4): xaa in position 4 is Val, Ile or Leu
  Variant (7)..(7): xaa in position 7 is Val, Ala or Thr
  Variant (9)..(9): xaa in position 9 is Phe, Leu, Thr or Val
  Variant (10)..(10): xaa in position 10 is Glu or Ala
  Variant (15)..(16): xaa in position 15 to 16 is any amino acid
  Variant (17)..(17): xaa in position 17 is any or no amino acid
  Variant (19)..(19): xaa in position 19 is Trp or Tyr
  Variant (20)..(20): xaa in position 20 is Lys or Arg
  Variant (22)..(22): xaa in position 22 is Leu, Phe, Met or Tyr
  Variant (23)..(23): xaa in position 23 is Ile, Val, Ala or Leu
  Variant (24)..(24): xaa in position 24 is any amino acid
  Variant (25)..(25): xaa in position 25 is Asp, Glu or Gln
  Variant (27)..(27): xaa in position 27 is any amino acid
  Variant (28)..(28): xaa in position 28 is Leu, Met, Ile, Val, Ala or Thr
  Variant (29)..(29): xaa in position 29 is Asp, Asn or Ser
  Variant (30)..(33): xaa in position 30 to 33 is any amino acid
  Variant (34)..(34): xaa in position 34 is Ile, Val, Leu or Met
  Variant (35)..(36): xaa in position 35 to 36 is any amino acid
  Variant (38)..(38): xaa in position 38 is Leu, Ile, Met or Val
  Variant (39)..(40): xaa in position 39 to 40 is any amino acid
  Variant (41)..(41): xaa in position 41 is Ala, Ser, Gly, Val or Thr

SEQ ID NO: 29716 - protein, 65 aa, Artificial sequence; identical to SEQ ID NO: 2885
  Variant (2)..(2): xaa in position 2 is any amino acid
  Variant (4)..(4): xaa in position 4 is Asp, Tyr, Gln, Asn or Glu
  Variant (5)..(9): xaa in position 5 to 9 is any amino acid
  Variant (10)..(10): xaa in position 10 is Tyr, Phe or Leu
  Variant (11)..(12): xaa in position 11 to 12 is any amino acid
  Variant (13)..(13): xaa in position 13 is Asp or Glu
  Variant (14)..(15): xaa in position 14 to 15 is any amino acid
  Variant (16)..(16): xaa in position 16 is Ser, Ala, Thr or Cys
  Variant (17)..(17): xaa in position 17 is Trp, Phe, Tyr, Leu or Val
  Variant (18)..(18): xaa in position 18 is any amino acid
  Variant (19)..(19): xaa in position 19 is Ala or Ser
  Variant (20)..(20): xaa in position 20 is Ile or Val
  Variant (24)..(24): xaa in position 24 is Thr, Ser or Asn
  Variant (25)..(25): xaa in position 25 is Thr, Val, Ala, Ser or Ile
  Variant (26)..(26): xaa in position 26 is Glu or Ala
  Variant (27)..(27): xaa in position 27 is Ser, Asp or Asn
  Variant (29)..(29): xaa in position 29 is any amino acid
  Variant (32)..(32): xaa in position 32 is Glu, Gln, Phe or Met
  Variant (33)..(33): xaa in position 33 is Leu, Met, Val, Ile or Phe
  Variant (34)..(34): xaa in position 34 is Ala, Ser, Thr, Cys or Val
  Variant (36)..(36): xaa in position 36 is Gly, Ala or Asn
  Variant (37)..(39): xaa in position 37 to 39 is any amino acid
  Variant (40)..(40): xaa in position 40 is Pro or Ala
  Variant (41)..(41): xaa in position 41 is Val, Ile, Thr or Leu
  Variant (43)..(43): xaa in position 43 is Phe, Met, Tyr or Ile
  Variant (46)..(46): xaa in position 46 is any amino acid
  Variant (47)..(47): xaa in position 47 is Thr, Ser or Arg
  Variant (48)..(48): xaa in position 48 is any amino acid
  Variant (50)..(53): xaa in position 50 to 53 is any amino acid
  Variant (54)..(54): xaa in position 54 is Ala or Met
  Variant (55)..(55): xaa in position 55 is any amino acid
  Variant (56)..(56): xaa in position 56 is Asp, Asn or Glu
  Variant (57)..(57): xaa in position 57 is Ala or Gly
  Variant (58)..(59): xaa in position 58 to 59 is any amino acid
  Variant (60)..(60): xaa in position 60 is Ala or Ser
  Variant (61)..(61): xaa in position 61 is Ala, Ser, Val or Thr
  Variant (62)..(64): xaa in position 62 to 64 is any amino acid
  Variant (65)..(65): xaa in position 65 is His or Gln

SEQ ID NO: 29717 - protein, 71 aa, Artificial sequence; identical to SEQ ID NO: 2886
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
  Variant (26)..(29): xaa in position 26 to 29 is any amino acid
  Variant (30)..(30): xaa in position 30 is Val, Ile or Leu
  Variant (31)..(36): xaa in position 31 to 36 is any amino acid
  Variant (37)..(37): xaa in position 37 is Leu, Met, Ile, Tyr or His
  Variant (38)..(40): xaa in position 38 to 40 is any amino acid
  Variant (41)..(51): xaa in position 41 to 51 is any or no amino acid
  Variant (52)..(52): xaa in position 52 is Leu, Ile or Val
  Variant (53)..(53): xaa in position 53 is Met, Val, Ile or Leu
  Variant (54)..(54): xaa in position 54 is Ile or Val
  Variant (56)..(56): xaa in position 56 is Cys, Phe, Ala, Thr, Tyr or Val
  Variant (57)..(57): xaa in position 57 is Ser, Asn or Ala
  Variant (59)..(59): xaa in position 59 is Gly, Ala or Asp
  Variant (61)..(61): xaa in position 61 is Ser or Cys
  Variant (62)..(62): xaa in position 62 is any amino acid
  Variant (64)..(66): xaa in position 64 to 66 is any amino acid
  Variant (67)..(67): xaa in position 67 is Arg, Asn, Lys, Leu or Glu
  Variant (69)..(70): xaa in position 69 to 70 is any amino acid
  Variant (71)..(71): xaa in position 71 is Val or Ile

SEQ ID NO: 29718 - protein, 41 aa, Artificial sequence; identical to SEQ ID NO: 2887
  Variant (2)..(2): xaa in position 2 is any amino acid
  Variant (4)..(4): xaa in position 4 is Ile, Leu, Val, Ala or Met
  Variant (7)..(7): xaa in position 7 is His, Asn, Phe or Tyr
  Variant (8)..(8): xaa in position 8 is Leu or Ile
  Variant (9)..(10): xaa in position 9 to 10 is any amino acid
  Variant (12)..(12): xaa in position 12 is any amino acid
  Variant (14)..(19): xaa in position 14 to 19 is any amino acid
  Variant (20)..(30): xaa in position 20 to 30 is any or no amino acid
  Variant (32)..(32): xaa in position 32 is any amino acid
  Variant (34)..(34): xaa in position 34 is Ile or Val
  Variant (37)..(37): xaa in position 37 is Ala, Pro, Gly, Lys, Ser or Glu
  Variant (39)..(39): xaa in position 39 is Ile, Leu or Val
  Variant (40)..(40): xaa in position 40 is any amino acid
  Variant (41)..(41): xaa in position 41 is Trp, Ile, Leu or Phe

SEQ ID NO: 29719 - DNA, 627 bp, Escherichia coli K12; identical to SEQ ID NO: 20534
  CDS (1)..(627): transl_table=11

SEQ ID NO: 29720 - protein, 208 aa, Escherichia coli K12; identical to SEQ ID NO: 20535

SEQ ID NO: 29721 - DNA, 519 bp, Archaeoglobus fulgidus DSM 4304; identical to SEQ ID NO: 20536
  CDS (1)..(519): transl_table=11

SEQ ID NO: 29722 - protein, 172 aa, Archaeoglobus fulgidus DSM 4304; identical to SEQ ID NO: 20537

SEQ ID NO: 29723 - DNA, 561 bp, Pyrococcus abyssi GE5; identical to SEQ ID NO: 20538
  CDS (1)..(561): transl_table=11

SEQ ID NO: 29724 - protein, 186 aa, Pyrococcus abyssi GE5; identical to SEQ ID NO: 20539

SEQ ID NO: 29725 - DNA, 621 bp, Vibrio cholerae O1 biovar eltor str. N16961; identical to SEQ ID NO: 20540
  CDS (1)..(621): transl_table=11

SEQ ID NO: 29726 - protein, 206 aa, Vibrio cholerae O1 biovar eltor str. N16961; identical to SEQ ID NO: 20541

SEQ ID NO: 29727 - DNA, 588 bp, Methanothermobacter thermautotrophicus str. Delta H; identical to SEQ ID NO: 20542
  CDS (1)..(588): transl_table=11

SEQ ID NO: 29728 - protein, 195 aa, Methanothermobacter thermautotrophicus str. Delta H; identical to SEQ ID NO: 20543

SEQ ID NO: 29729 - DNA, 678 bp, Halobacterium sp. NRC-1; identical to SEQ ID NO: 20544
  CDS (1)..(678): transl_table=11

SEQ ID NO: 29730 - protein, 225 aa, Halobacterium sp. NRC-1; identical to SEQ ID NO: 20545

SEQ ID NO: 29731 - DNA, 612 bp, Sinorhizobium meliloti 1021; identical to SEQ ID NO: 20546
  CDS (1)..(612): transl_table=11

SEQ ID NO: 29732 - protein, 203 aa, Sinorhizobium meliloti 1021; identical to SEQ ID NO: 20547

SEQ ID NO: 29733 - DNA, 588 bp, Clostridium perfringens str. 13; identical to SEQ ID NO: 20548
  CDS (1)..(588): transl_table=11

SEQ ID NO: 29734 - protein, 195 aa, Clostridium perfringens str. 13; identical to SEQ ID NO: 20549

SEQ ID NO: 29735 - DNA, 564 bp, Pyrococcus furiosus DSM 3638; identical to SEQ ID NO: 20550
  CDS (1)..(564): transl_table=11

SEQ ID NO: 29736 - protein, 187 aa, Pyrococcus furiosus DSM 3638; identical to SEQ ID NO: 20551

SEQ ID NO: 29737 - DNA, 585 bp, Methanosarcina acetivorans C2A; identical to SEQ ID NO: 20552
  CDS (1)..(585): transl_table=11

SEQ ID NO: 29738 - protein, 194 aa, Methanosarcina acetivorans C2A; identical to SEQ ID NO: 20553

SEQ ID NO: 29739 - DNA, 618 bp, Streptomyces coelicolor A3(2); identical to SEQ ID NO: 20554
  CDS (1)..(618): transl_table=11

SEQ ID NO: 29740 - protein, 205 aa, Streptomyces coelicolor A3(2); identical to SEQ ID NO: 20555

SEQ ID NO: 29741 - DNA, 612 bp, Vibrio parahaemolyticus RIMD 2210633; identical to SEQ ID NO: 20556
  CDS (1)..(612): transl_table=11

SEQ ID NO: 29742 - protein, 203 aa, Vibrio parahaemolyticus RIMD 2210633; identical to SEQ ID NO: 20557

SEQ ID NO: 29743 - DNA, 678 bp, Vibrio vulnificus YJ016; identical to SEQ ID NO: 20558
  CDS (1)..(678): transl_table=11

SEQ ID NO: 29744 - protein, 225 aa, Vibrio vulnificus YJ016; identical to SEQ ID NO: 20559

SEQ ID NO: 29745 - DNA, 774 bp, Thermus thermophilus HB27; identical to SEQ ID NO: 20560
  CDS (1)..(774): transl_table=11

SEQ ID NO: 29746 - protein, 257 aa, Thermus thermophilus HB27; identical to SEQ ID NO: 20561

SEQ ID NO: 29747 - DNA, 618 bp, Desulfotalea psychrophila LSv54; identical to SEQ ID NO: 20562
  CDS (1)..(618): transl_table=11

SEQ ID NO: 29748 - protein, 205 aa, Desulfotalea psychrophila LSv54; identical to SEQ ID NO: 20563

SEQ ID NO: 29749 - DNA, 597 bp, Legionella pneumophila subsp. pneumophila str. Philadelphia 1; identical to SEQ ID NO: 20564
  CDS (1)..(597): transl_table=11

SEQ ID NO: 29750 - protein, 198 aa, Legionella pneumophila subsp. pneumophila str. Philadelphia 1; identical to SEQ ID NO: 20565

SEQ ID NO: 29751 - DNA, 588 bp, Legionella pneumophila subsp. pneumophila str. Philadelphia 1; identical to SEQ ID NO: 20566
  CDS (1)..(588): transl_table=11

SEQ ID NO: 29752 - protein, 195 aa, Legionella pneumophila subsp. pneumophila str. Philadelphia 1; identical to SEQ ID NO: 20567

SEQ ID NO: 29753 - DNA, 657 bp, Nocardia farcinica IFM 10152; identical to SEQ ID NO: 20568
  CDS (1)..(657): transl_table=11

SEQ ID NO: 29754 - protein, 218 aa, Nocardia farcinica IFM 10152; identical to SEQ ID NO: 20569

SEQ ID NO: 29755 - DNA, 597 bp, Legionella pneumophila str. Paris; identical to SEQ ID NO: 20570
  CDS (1)..(597): transl_table=11

SEQ ID NO: 29756 - protein, 198 aa, Legionella pneumophila str. Paris; identical to SEQ ID NO: 20571

SEQ ID NO: 29757 - DNA, 597 bp, Legionella pneumophila str. Lens; identical to SEQ ID NO: 20572
  CDS (1)..(597): transl_table=11

SEQ ID NO: 29758 - protein, 198 aa, Legionella pneumophila str. Lens; identical to SEQ ID NO: 20573

SEQ ID NO: 29759 - DNA, 630 bp, Photobacterium profundum SS9; identical to SEQ ID NO: 20574
  CDS (1)..(630): transl_table=11

SEQ ID NO: 29760 - protein, 209 aa, Photobacterium profundum SS9; identical to SEQ ID NO: 20575

SEQ ID NO: 29761 - DNA, 774 bp, Thermus thermophilus HB8; identical to SEQ ID NO: 20576
  CDS (1)..(774): transl_table=11

SEQ ID NO: 29762 - protein, 257 aa, Thermus thermophilus HB8; identical to SEQ ID NO: 20577

SEQ ID NO: 29763 - DNA, 639 bp, Idiomarina loihiensis L2TR; identical to SEQ ID NO: 20578
  CDS (1)..(639): transl_table=11

SEQ ID NO: 29764 - protein, 212 aa, Idiomarina loihiensis L2TR; identical to SEQ ID NO: 20579

SEQ ID NO: 29765 - DNA, 600 bp, Francisella tularensis subsp. tularensis SCHU S4; identical to SEQ ID NO: 20580
  CDS (1)..(600): transl_table=11

SEQ ID NO: 29766 - protein, 199 aa, Francisella tularensis subsp. tularensis SCHU S4; identical to SEQ ID NO: 20581

SEQ ID NO: 29767 - DNA, 783 bp, Ehrlichia ruminantium str. Welgevonden; identical to SEQ ID NO: 20582
  CDS (1)..(783): transl_table=11

SEQ ID NO: 29768 - protein, 260 aa, Ehrlichia ruminantium str. Welgevonden; identical to SEQ ID NO: 20583

SEQ ID NO: 29769 - DNA, 570 bp, Thermococcus kodakarensis KOD1; identical to SEQ ID NO: 20584
  CDS (1)..(570): transl_table=11

SEQ ID NO: 29770 - protein, 189 aa, Thermococcus kodakarensis KOD1; identical to SEQ ID NO: 20585

SEQ ID NO: 29771 - DNA, 783 bp, Ehrlichia ruminantium str. Gardel; identical to SEQ ID NO: 20586
  CDS (1)..(783): transl_table=11

SEQ ID NO: 29772 - protein, 260 aa, Ehrlichia ruminantium str. Gardel; identical to SEQ ID NO: 20587

SEQ ID NO: 29773 - DNA, 609 bp, Vibrio fischeri ES114; identical to SEQ ID NO: 20588
  CDS (1)..(609): transl_table=11

SEQ ID NO: 29774 - protein, 202 aa, Vibrio fischeri ES114; identical to SEQ ID NO: 20589

SEQ ID NO: 29775 - DNA, 666 bp, Corynebacterium jeikeium K411; identical to SEQ ID NO: 20590
  CDS (1)..(666): transl_table=11

SEQ ID NO: 29776 - protein, 221 aa, Corynebacterium jeikeium K411; identical to SEQ ID NO: 20591

SEQ ID NO: 29777 - DNA, 678 bp, Thermobifida fusca YX; identical to SEQ ID NO: 20592
  CDS (1)..(678): transl_table=11

SEQ ID NO: 29778 - protein, 225 aa, Thermobifida fusca YX; identical to SEQ ID NO: 20593

SEQ ID NO: 29779 - DNA, 780 bp, Ehrlichia canis str. Jake; identical to SEQ ID NO: 20594
  CDS (1)..(780): transl_table=11

SEQ ID NO: 29780 - protein, 259 aa, Ehrlichia canis str. Jake; identical to SEQ ID NO: 20595

SEQ ID NO: 29781 - DNA, 534 bp, Methanosarcina barkeri str. fusaro; identical to SEQ ID NO: 20596
  CDS (1)..(534): transl_table=11

SEQ ID NO: 29782 - protein, 177 aa, Methanosarcina barkeri str. fusaro; identical to SEQ ID NO: 20597

SEQ ID NO: 29783 - DNA, 582 bp, Dehalococcoides sp. CBDB1; identical to SEQ ID NO: 20598
  CDS (1)..(582): transl_table=11

SEQ ID NO: 29784 - protein, 193 aa, Dehalococcoides sp. CBDB1; identical to SEQ ID NO: 20599

SEQ ID NO: 29785 - DNA, 609 bp, Rhodobacter sphaeroides 2.4.1; identical to SEQ ID NO: 20600
  CDS (1)..(609)

SEQ ID NO: 29786 - protein, 202 aa, Rhodobacter sphaeroides 2.4.1; identical to SEQ ID NO: 20601

SEQ ID NO: 29787 - DNA, 795 bp, Magnetospirillum magnetotacticum MS-1; identical to SEQ ID NO: 20602
  CDS (1)..(795)

SEQ ID NO: 29788 - protein, 264 aa, Magnetospirillum magnetotacticum MS-1; identical to SEQ ID NO: 20603

SEQ ID NO: 29789 - DNA, 795 bp, Deinococcus geothermalis DSM 11300; identical to SEQ ID NO: 20604
  CDS (1)..(795): transl_table=11

SEQ ID NO: 29790 - protein, 264 aa, Deinococcus geothermalis DSM 11300; identical to SEQ ID NO: 20605

SEQ ID NO: 29791 - DNA, 900 bp, Anaeromyxobacter dehalogenans 2CP-C; identical to SEQ ID NO: 20606
  CDS (1)..(900): transl_table=11

SEQ ID NO: 29792 - protein, 299 aa, Anaeromyxobacter dehalogenans 2CP-C; identical to SEQ ID NO: 20607

SEQ ID NO: 29793 - DNA, 645 bp, Chromohalobacter salexigens DSM 3043; identical to SEQ ID NO: 20608
  CDS (1)..(645): transl_table=11

SEQ ID NO: 29794 - protein, 214 aa, Chromohalobacter salexigens DSM 3043; identical to SEQ ID NO: 20609

SEQ ID NO: 29795 - DNA, 663 bp, Solibacter usitatus Ellin6076; identical to SEQ ID NO: 20610
  CDS (1)..(663): transl_table=11

SEQ ID NO: 29796 - protein, 220 aa, Solibacter usitatus Ellin6076; identical to SEQ ID NO: 20611

SEQ ID NO: 29797 - DNA, 582 bp, Exiguobacterium sp. 255-15; identical to SEQ ID NO: 20612
  CDS (1)..(582): transl_table=11

SEQ ID NO: 29798 - protein, 193 aa, Exiguobacterium sp. 255-15; identical to SEQ ID NO: 20613

SEQ ID NO: 29799 - DNA, 777 bp, Ehrlichia chaffeensis str. Sapulpa; identical to SEQ ID NO: 20614
  CDS (1)..(777): transl_table=11

SEQ ID NO: 29800 - protein, 258 aa, Ehrlichia chaffeensis str. Sapulpa; identical to SEQ ID NO: 20615

SEQ ID NO: 29801 - DNA, 612 bp, Jannaschia sp. CCS1; identical to SEQ ID NO: 20616
  CDS (1)..(612): transl_table=11

SEQ ID NO: 29802 - protein, 203 aa, Jannaschia sp. CCS1; identical to SEQ ID NO: 20617

SEQ ID NO: 29803 - DNA, 603 bp, Sphingopyxis alaskensis RB2256; identical to SEQ ID NO: 20618
  CDS (1)..(603): transl_table=11

SEQ ID NO: 29804 - protein, 200 aa, Sphingopyxis alaskensis RB2256; identical to SEQ ID NO: 20619

SEQ ID NO: 29805 - DNA, 561 bp, Mesorhizobium sp. BNC1; identical to SEQ ID NO: 20620
  CDS (1)..(561): transl_table=11

SEQ ID NO: 29806 - protein, 186 aa, Mesorhizobium sp. BNC1; identical to SEQ ID NO: 20621

SEQ ID NO: 29807 - DNA, 609 bp, Silicibacter sp. TM1040; identical to SEQ ID NO: 20622
  CDS (1)..(609): transl_table=11

SEQ ID NO: 29808 - protein, 202 aa, Silicibacter sp. TM1040; identical to SEQ ID NO: 20623

SEQ ID NO: 29809 - DNA, 666 bp, Shewanella frigidimarina NCIMB 400; identical to SEQ ID NO: 20624
  CDS (1)..(666): transl_table=11

SEQ ID NO: 29810 - protein, 221 aa, Shewanella frigidimarina NCIMB 400; identical to SEQ ID NO: 20625

SEQ ID NO: 29811 - DNA, 660 bp, Psychrobacter cryohalolentis K5; identical to SEQ ID NO: 20626
  CDS (1)..(660): transl_table=11

SEQ ID NO: 29812 - protein, 219 aa, Psychrobacter cryohalolentis K5; identical to SEQ ID NO: 20627

SEQ ID NO: 29813 - DNA, 648 bp, Nocardioides sp. JS614; identical to SEQ ID NO: 20628
  CDS (1)..(648): transl_table=11

SEQ ID NO: 29814 - protein, 215 aa, Nocardioides sp. JS614; identical to SEQ ID NO: 20629

SEQ ID NO: 29815 - DNA, 732 bp, uncultured archaeon GZfos19C7; identical to SEQ ID NO: 20630
  CDS (1)..(732)

SEQ ID NO: 29816 - protein, 243 aa, uncultured archaeon GZfos19C7; identical to SEQ ID NO: 20631

SEQ ID NO: 29817 - DNA, 591 bp, Aquifex aeolicus; identical to SEQ ID NO: 20632
  CDS (1)..(591): transl_table=11

SEQ ID NO: 29818 - protein, 196 aa, Aquifex aeolicus; identical to SEQ ID NO: 20633

SEQ ID NO: 29819 - DNA, 567 bp, Pyrococcus horikoshii; identical to SEQ ID NO: 20634
  CDS (1)..(567): transl_table=11

SEQ ID NO: 29820 - protein, 188 aa, Pyrococcus horikoshii; identical to SEQ ID NO: 20635

SEQ ID NO: 29821 - DNA, 22 bp, Artificial sequence
  (1)..(22): primer
atgcctgtgctagaccgccatc

SEQ ID NO: 29822 - DNA, 22 bp, Artificial sequence
  (1)..(22): primer
ttactgacgctggagcgacttc

SEQ ID NO: 29823 - protein, 219 aa, Artificial sequence; identical to SEQ ID NO: 20638
  Variant (2)..(5): xaa in position 2 to 5 is any amino acid
  Variant (9)..(14): xaa in position 9 to 14 is any amino acid
  Variant (16)..(16): xaa in position 16 is any amino acid
  Variant (18)..(27): xaa in position 18 to 27 is any amino acid
  Variant (28)..(31): xaa in position 28 to 31 is any or no amino acid
  Variant (33)..(35): xaa in position 33 to 35 is any amino acid
  Variant (37)..(37): xaa in position 37 is any amino acid
  Variant (39)..(42): xaa in position 39 to 42 is any amino acid
  Variant (44)..(44): xaa in position 44 is any amino acid
  Variant (48)..(48): xaa in position 48 is any amino acid
  Variant (52)..(55): xaa in position 52 to 55 is any amino acid
  Variant (56)..(58): xaa in position 56 to 58 is any or no amino acid
  Variant (60)..(61): xaa in position 60 to 61 is any amino acid
  Variant (63)..(64): xaa in position 63 to 64 is any amino acid
  Variant (67)..(69): xaa in position 67 to 69 is any amino acid
  Variant (71)..(79): xaa in position 71 to 79 is any amino acid
  Variant (81)..(90): xaa in position 81 to 90 is any amino acid
  Variant (91)..(102): xaa in position 91 to 102 is any or no amino acid
  Variant (104)..(127): xaa in position 104 to 127 is any amino acid
  Variant (128)..(161): xaa in position 128 to 161 is any or no amino acid
  Variant (163)..(163): xaa in position 163 is any amino acid
  Variant (165)..(166): xaa in position 165 to 166 is any amino acid
  Variant (168)..(194): xaa in position 168 to 194 is any amino acid
  Variant (195)..(214): xaa in position 195 to 214 is any or no amino acid
  Variant (216)..(218): xaa in position 216 to 218 is any amino acid

SEQ ID NO: 29824 - protein, 9 aa, Artificial sequence
  Variant (2)..(2): xaa in position 2 is Ala, Gly, Asn, Ser, Thr or Val
  Variant (3)..(3): xaa in position 3 is any amino acid
  Variant (6)..(6): xaa in position 6 is any amino acid
  Variant (7)..(7): xaa in position 7 is Ile, Leu, Met or Val
DXXDGXXAR

SEQ ID NO: 29825 - protein, 9 aa, Artificial sequence
  Variant (2)..(2): xaa in position 2 is Ala, Gly or Thr
  Variant (3)..(3): xaa in position 3 is any amino acid
  Variant (6)..(8): xaa in position 6 to 8 is any amino acid
GXXLDXXXD

SEQ ID NO: 29826 - DNA, 785 bp, Escherichia coli K12; identical to SEQ ID NO: 3693
  CDS (86)..(781)

SEQ ID NO: 29827 - protein, 231 aa, Escherichia coli K12; identical to SEQ ID NO: 3694

SEQ ID NO: 29828 - DNA, 1005 bp, Nostoc sp. PCC 7120; identical to SEQ ID NO: 3695
  CDS (1)..(1005)

SEQ ID NO: 29829 - protein, 334 aa, Nostoc sp. PCC 7120; identical to SEQ ID NO: 3696

SEQ ID NO: 29830 - DNA, 642 bp, Salmonella enterica subsp. enterica serovar Typhi; identical to SEQ ID NO: 3697
  CDS (1)..(642)

SEQ ID NO: 29831 - protein, 213 aa, Salmonella enterica subsp. enterica serovar Typhi; identical to SEQ ID NO: 3698

SEQ ID NO: 29832 - DNA, 942 bp, Nostoc sp. PCC 7120; identical to SEQ ID NO: 3699
  CDS (1)..(942)

SEQ ID NO: 29833 - protein, 313 aa, Nostoc sp. PCC 7120; identical to SEQ ID NO: 3700

SEQ ID NO: 29834 - DNA, 642 bp, Yersinia pestis; identical to SEQ ID NO: 3701
  CDS (1)..(642)

SEQ ID NO: 29835 - protein, 213 aa, Yersinia pestis; identical to SEQ ID NO: 3702

SEQ ID NO: 29836 - DNA, 1668 bp, Thermotoga maritima; identical to SEQ ID NO: 3703
  CDS (1)..(1668)

SEQ ID NO: 29837 - protein, 555 aa, Thermotoga maritima; identical to SEQ ID NO: 3704

SEQ ID NO: 29838 - DNA, 2056 bp, Arabidopsis thaliana (mouse-ear cress); identical to SEQ ID NO: 3705
  CDS (1)..(2025)

SEQ ID NO: 29839 - protein, 674 aa, Arabidopsis thaliana (mouse-ear cress); identical to SEQ ID NO: 3706

SEQ ID NO: 29840 - DNA, 624 bp, Staphylococcus aureus; identical to SEQ ID NO: 3707
  CDS (1)..(624)

SEQ ID NO: 29841 - protein, 207 aa, Staphylococcus aureus; identical to SEQ ID NO: 3708

SEQ ID NO: 29842 - DNA, 639 bp, Streptococcus pneumoniae; identical to SEQ ID NO: 3709
  CDS (1)..(639)

SEQ ID NO: 29843 - protein, 212 aa, Streptococcus pneumoniae; identical to SEQ ID NO: 3710

SEQ ID NO: 29844 - DNA, 642 bp, Mycoplasma genitalium; identical to SEQ ID NO: 3711
  CDS (1)..(642): transl_table=4

SEQ ID NO: 29845 - protein, 213 aa, Mycoplasma genitalium; identical to SEQ ID NO: 3712

SEQ ID NO: 29846 - DNA, 636 bp, Bacillus halodurans; identical to SEQ ID NO: 3713
  CDS (1)..(636)

SEQ ID NO: 29847 - protein, 211 aa, Bacillus halodurans; identical to SEQ ID NO: 3714

SEQ ID NO: 29848 - DNA, 1668 bp, Treponema pallidum subsp. pallidum (syphilis spirochete); identical to SEQ ID NO: 3715
  CDS (1)..(1668)

SEQ ID NO: 29849 - protein, 555 aa, Treponema pallidum subsp. pallidum (syphilis spirochete); identical to SEQ ID NO: 3716

SEQ ID NO: 29850 - DNA, 669 bp, Chlamydophila pneumoniae, Chlamydia pneumoniae; identical to SEQ ID NO: 3717
  CDS (1)..(669)

SEQ ID NO: 29851 - protein, 222 aa, Chlamydophila pneumoniae, Chlamydia pneumoniae; identical to SEQ ID NO: 3718

SEQ ID NO: 29852 - DNA, 621 bp, Lactococcus lactis subsp. lactis; identical to SEQ ID NO: 3719
  CDS (1)..(621)

SEQ ID NO: 29853 - protein, 206 aa, Lactococcus lactis subsp. lactis; identical to SEQ ID NO: 3720

SEQ ID NO: 29854 - DNA, 633 bp, Deinococcus radiodurans; identical to SEQ ID NO: 3721
  CDS (1)..(633)

SEQ ID NO: 29855 - protein, 210 aa, Deinococcus radiodurans; identical to SEQ ID NO: 3722

SEQ ID NO: 29856 - DNA, 1932 bp, Arabidopsis thaliana (mouse-ear cress); identical to SEQ ID NO: 3723
  CDS (1)..(1932)

SEQ ID NO: 29857 - protein, 643 aa, Arabidopsis thaliana (mouse-ear cress); identical to SEQ ID NO: 3724

SEQ ID NO: 29858 - DNA, 636 bp, Bacillus subtilis; identical to SEQ ID NO: 3725
  CDS (1)..(636)

SEQ ID NO: 29859 - protein, 211 aa, Bacillus subtilis; identical to SEQ ID NO: 3726

SEQ ID NO: 29860 - DNA, 624 bp, Borrelia burgdorferi (Lyme disease spirochete); identical to SEQ ID NO: 3727
  CDS (1)..(624)

SEQ ID NO: 29861 - protein, 207 aa, Borrelia burgdorferi (Lyme disease spirochete); identical to SEQ ID NO: 3728

SEQ ID NO: 29862 - DNA, 624 bp, Ureaplasma urealyticum; identical to SEQ ID NO: 3729
  CDS (1)..(624): transl_table=4

SEQ ID NO: 29863 - protein, 207 aa, Ureaplasma urealyticum; identical to SEQ ID NO: 3730

SEQ ID NO: 29864 - DNA, 642 bp, Haemophilus influenzae; identical to SEQ ID NO: 3731
  CDS (1)..(642)

SEQ ID NO: 29865 - protein, 213 aa, Haemophilus influenzae; identical to SEQ ID NO: 3732

SEQ ID NO: 29866 - DNA, 1470 bp, Spinacia oleracea (spinach); identical to SEQ ID NO: 3733
  CDS (49)..(1257)

SEQ ID NO: 29867 - protein, 402 aa, Spinacia oleracea (spinach); identical to SEQ ID NO: 3734

SEQ ID NO: 29868 - DNA, 1533 bp, Triticum sp. (wheat); identical to SEQ ID NO: 3735
  CDS (65)..(1279)

SEQ ID NO: 29869 - protein, 404 aa, Triticum sp. (wheat); identical to SEQ ID NO: 3736

SEQ ID NO: 29870 - DNA, 1240 bp, Arabidopsis thaliana (mouse-ear cress); identical to SEQ ID NO: 3737
  CDS (1)..(1188)

SEQ ID NO: 29871 - protein, 395 aa, Arabidopsis thaliana (mouse-ear cress); identical to SEQ ID NO: 3738

SEQ ID NO: 29872 - DNA, 2077 bp, Saccharomyces cerevisiae; identical to SEQ ID NO: 3739
  CDS (482)..(1987)

SEQ ID NO: 29873 - protein, 501 aa, Saccharomyces cerevisiae; identical to SEQ ID NO: 3740

SEQ ID NO: 29874 - DNA, 642 bp, Mycoplasma pneumoniae; identical to SEQ ID NO: 3741
  CDS (1)..(642): transl_table=4

SEQ ID NO: 29875 - protein, 213 aa, Mycoplasma pneumoniae; identical to SEQ ID NO: 3742

SEQ ID NO: 29876 - DNA, 1245 bp, Chlamydomonas reinhardtii; identical to SEQ ID NO: 3743
  CDS (28)..(1155)

SEQ ID NO: 29877 - protein, 375 aa, Chlamydomonas reinhardtii; identical to SEQ ID NO: 3744

SEQ ID NO: 29878 - DNA, 1520 bp, Mesembryanthemum crystallinum (common ice plant); identical to SEQ ID NO: 3745
  CDS (127)..(1320)

SEQ ID NO: 29879 - protein, 397 aa, Mesembryanthemum crystallinum (common ice plant); identical to SEQ ID NO: 3746

SEQ ID NO: 29880 - DNA, 690 bp, Caenorhabditis elegans; identical to SEQ ID NO: 3747
  CDS (1)..(690)

SEQ ID NO: 29881 - protein, 229 aa, Caenorhabditis elegans; identical to SEQ ID NO: 3748

SEQ ID NO: 29882 - DNA, 1668 bp, Caenorhabditis elegans; identical to SEQ ID NO: 3749
  CDS (1)..(1668)

SEQ ID NO: 29883 - protein, 555 aa, Caenorhabditis elegans; identical to SEQ ID NO: 3750

SEQ ID NO: 29884 - DNA, 1365 bp, Schizosaccharomyces pombe; identical to SEQ ID NO: 3751
  CDS (1)..(1365)

SEQ ID NO: 29885 - protein, 454 aa, Schizosaccharomyces pombe; identical to SEQ ID NO: 3752

SEQ ID NO: 29886 - DNA, 1647 bp, Homo sapiens; identical to SEQ ID NO: 3753
  CDS (1)..(1647)

SEQ ID NO: 29887 - protein, 548 aa, Homo sapiens; identical to SEQ ID NO: 3754

SEQ ID NO: 29888 - DNA, 738 bp, Debaryomyces hansenii; identical to SEQ ID NO: 3755
  CDS (1)..(738)

SEQ ID NO: 29889 - protein, 245 aa, Debaryomyces hansenii; identical to SEQ ID NO: 3756

SEQ ID NO: 29890 - DNA, 1521 bp, Debaryomyces hansenii; identical to SEQ ID NO: 3757
  CDS (1)..(1521)

SEQ ID NO: 29891 - protein, 506 aa, Debaryomyces hansenii; identical to SEQ ID NO: 3758

SEQ ID NO: 29892 - DNA, 1353 bp, Yarrowia lipolytica; identical to SEQ ID NO: 3759
  CDS (1)..(1353)

SEQ ID NO: 29893 - protein, 450 aa, Yarrowia lipolytica; identical to SEQ ID NO: 3760

SEQ ID NO: 29894 - DNA, 1380 bp, Kluyveromyces lactis; identical to SEQ ID NO: 3761
  CDS (1)..(1380)

SEQ ID NO: 29895 - protein, 459 aa, Kluyveromyces lactis; identical to SEQ ID NO: 3762

SEQ ID NO: 29896 - DNA, 642 bp, Erwinia carotovora subsp; identical to SEQ ID NO: 3763
  CDS (1)..(642)

SEQ ID NO: 29897 - protein, 213 aa, Erwinia carotovora subsp; identical to SEQ ID NO: 3764

SEQ ID NO: 29898 - DNA, 627 bp, Mesoplasma florum L1; identical to SEQ ID NO: 3765
  CDS (1)..(627)

SEQ ID NO: 29899 - protein, 208 aa, Mesoplasma florum L1; identical to SEQ ID NO: 3766

SEQ ID NO: 29900 - DNA, 1431 bp, Candida glabrata; identical to SEQ ID NO: 3767
  CDS (1)..(1431)

SEQ ID NO: 29901 - protein, 476 aa, Candida glabrata; identical to SEQ ID NO: 3768

SEQ ID NO: 29902 - DNA, 639 bp, Bacillus thuringiensis serovar konkukian str; identical to SEQ ID NO: 3769
  CDS (1)..(639)

SEQ ID NO: 29903 - protein, 212 aa, Bacillus thuringiensis serovar konkukian str; identical to SEQ ID NO: 3770

SEQ ID NO: 29904 - DNA, 834 bp, Homo sapiens; identical to SEQ ID NO: 3771
  CDS (1)..(834)

SEQ ID NO: 29905 - protein, 277 aa, Homo sapiens [sequence omitted]

SEQ ID NO: 29906 - DNA, 1965 bp, Oryza sativa; identical to SEQ ID NO: 3773
  CDS (257)..(1726)

SEQ ID NO: 29907 - protein, 489 aa, Oryza sativa; identical to SEQ ID NO: 3774

SEQ ID NO: 29908 - DNA, 747 bp, Photobacterium profundum; identical to SEQ ID NO: 3775
  CDS (1)..(747)

SEQ ID NO: 29909 - protein, 248 aa, Photobacterium profundum; identical to SEQ ID NO: 3776

SEQ ID NO: 29910 - DNA, 621 bp, Bdellovibrio bacteriovorus; identical to SEQ ID NO: 3777
  CDS (1)..(621)

SEQ ID NO: 29911 - protein, 206 aa, Bdellovibrio bacteriovorus; identical to SEQ ID NO: 3778

SEQ ID NO: 29912 - DNA, 624 bp, Bdellovibrio bacteriovorus; identical to SEQ ID NO: 3779
  CDS (1)..(624)

SEQ ID NO: 29913 - protein, 207 aa, Bdellovibrio bacteriovorus; identical to SEQ ID NO: 3780

SEQ ID NO: 29914 - DNA, 618 bp, Mycoplasma mycoides; identical to SEQ ID NO: 3781
  CDS (1)..(618)

SEQ ID NO: 29915 - protein, 205 aa, Mycoplasma mycoides; identical to SEQ ID NO: 3782

SEQ ID NO: 29916 - DNA, 2638 bp, Oryza sativa; identical to SEQ ID NO: 3783
  CDS (248)..(2206)

SEQ ID NO: 29917 - protein, 652 aa, Oryza sativa; identical to SEQ ID NO: 3784

SEQ ID NO: 29918 - DNA, 1494 bp, Oryza sativa; identical to SEQ ID NO: 3785
  CDS (20)..(1231)

SEQ ID NO: 29919 - protein, 403 aa, Oryza sativa; identical to SEQ ID NO: 3786

SEQ ID NO: 29920 - DNA, 1824 bp, Homo sapiens; identical to SEQ ID NO: 3787
  CDS (45)..(1232)

SEQ ID NO: 29921 - protein, 395 aa, Homo sapiens [sequence omitted]

SEQ ID NO: 29922 - DNA, 630 bp, Listeria monocytogenes; identical to SEQ ID NO: 3789
  CDS (1)..(630)

SEQ ID NO: 29923 - protein, 209 aa, Listeria monocytogenes; identical to SEQ ID NO: 3790

SEQ ID NO: 29924 - DNA, 636 bp, Thermus thermophilus; identical to SEQ ID NO: 3791
  CDS (1)..(636)

SEQ ID NO: 29925 - protein, 211 aa, Thermus thermophilus; identical to SEQ ID NO: 3792

SEQ ID NO: 29926 - DNA, 1653 bp, Treponema denticola; identical to SEQ ID NO: 3793
  CDS (1)..(1653)

SEQ ID NO: 29927 - protein, 550 aa, Treponema denticola; identical to SEQ ID NO: 3794

SEQ ID NO: 29928 - DNA, 636 bp, Lactobacillus johnsonii; identical to SEQ ID NO: 3795
  CDS (1)..(636)

SEQ ID NO: 29929 - protein, 211 aa, Lactobacillus johnsonii; identical to SEQ ID NO: 3796

SEQ ID NO: 29930 - DNA, 1497 bp, Ashbya gossypii; identical to SEQ ID NO: 3797
  CDS (1)..(1497)

SEQ ID NO: 29931 - protein, 498 aa, Ashbya gossypii; identical to SEQ ID NO: 3798

SEQ ID NO: 29932 - DNA, 651 bp, Vibrio vulnificus; identical to SEQ ID NO: 3799
  CDS (1)..(651)

SEQ ID NO: 29933 - protein, 216 aa, Vibrio vulnificus; identical to SEQ ID NO: 3800

SEQ ID NO: 29934 - DNA, 630 bp, Porphyromonas gingivalis; identical to SEQ ID NO: 3801
  CDS (1)..(630)

SEQ ID NO: 29935 - protein, 209 aa, Porphyromonas gingivalis; identical to SEQ ID NO: 3802

SEQ ID NO: 29936 - DNA, 642 bp, Photorhabdus luminescens; identical to SEQ ID NO: 3803
  CDS (1)..(642)

SEQ ID NO: 29937 - protein, 213 aa, Photorhabdus luminescens; identical to SEQ ID NO: 3804

SEQ ID NO: 29938 - DNA, 645 bp, Mycoplasma gallisepticum; identical to SEQ ID NO: 3805
  CDS (1)..(645): transl_table=4

SEQ ID NO: 29939 - protein, 214 aa, Mycoplasma gallisepticum; identical to SEQ ID NO: 3806

SEQ ID NO: 29940 - DNA, 930 bp, Gloeobacter violaceus; identical to SEQ ID NO: 3807
  CDS (1)..(930)

SEQ ID NO: 29941 - protein, 309 aa, Gloeobacter violaceus; identical to SEQ ID NO: 3808

SEQ ID NO: 29942 - DNA, 996 bp, Gloeobacter violaceus; identical to SEQ ID NO: 3809
  CDS (1)..(996)

SEQ ID NO: 29943 - protein, 331 aa, Gloeobacter violaceus; identical to SEQ ID NO: 3810

SEQ ID NO: 29944 - DNA, 1038 bp, Gloeobacter violaceus; identical to SEQ ID NO: 3811
  CDS (1)..(1038)

SEQ ID NO: 29945 - protein, 345 aa, Gloeobacter violaceus; identical to SEQ ID NO: 3812

SEQ ID NO: 29946 - DNA, 615 bp, Chromobacterium violaceum; identical to SEQ ID NO: 3813
  CDS (1)..(615)

SEQ ID NO: 29947 - protein, 204 aa, Chromobacterium violaceum; identical to SEQ ID NO: 3814

SEQ ID NO: 29948 - DNA, 2049 bp, Giardia lamblia ATCC 50803; identical to SEQ ID NO: 3815
  CDS (1)..(2049)

SEQ ID NO: 29949 - protein, 682 aa, Giardia lamblia ATCC 50803; identical to SEQ ID NO: 3816

SEQ ID NO: 29950 - DNA, 1425 bp, Neurospora crassa; identical to SEQ ID NO: 3817
  CDS (1)..(1425)

SEQ ID NO: 29951 - protein, 474 aa, Neurospora crassa; identical to SEQ ID NO: 3818

SEQ ID NO: 29952 - DNA, 612 bp, Synechococcus sp; identical to SEQ ID NO: 3819
  CDS (1)..(612)

SEQ ID NO: 29953 - protein, 203 aa, Synechococcus sp; identical to SEQ ID NO: 3820

SEQ ID NO: 29954 - DNA, 654 bp, Haemophilus ducreyi; identical to SEQ ID NO: 3821
  CDS (1)..(654)

SEQ ID NO: 29955 - protein, 217 aa, Haemophilus ducreyi; identical to SEQ ID NO: 3822

SEQ ID NO: 29956 - DNA, 1609 bp, Chlorarachnion sp; identical to SEQ ID NO: 3823
  CDS (10)..(1464)

SEQ ID NO: 29957 - protein, 484 aa, Chlorarachnion sp; identical to SEQ ID NO: 3824

SEQ ID NO: 29958 - DNA, 630 bp, Enterococcus faecalis; identical to SEQ ID NO: 3825
  CDS (1)..(630)

SEQ ID NO: 29959 - protein, 209 aa, Enterococcus faecalis; identical to SEQ ID NO: 3826

SEQ ID NO: 29960 - DNA, 648 bp, Coxiella burnetii; identical to SEQ ID NO: 3827
  CDS (1)..(648)

SEQ ID NO: 29961 - protein, 215 aa, Coxiella burnetii; identical to SEQ ID NO: 3828

SEQ ID NO: 29962 - DNA, 1659 bp, Clostridium tetani; identical to SEQ ID NO: 3829
  CDS (1)..(1659)

SEQ ID NO: 29963 - protein, 552 aa, Clostridium tetani; identical to SEQ ID NO: 3830

SEQ ID NO: 29964 - DNA, 1674 bp, Bacteroides thetaiotaomicron; identical to SEQ ID NO: 3831
  CDS (1)..(1674)

SEQ ID NO: 29965 - protein, 557 aa, Bacteroides thetaiotaomicron; identical to SEQ ID NO: 3832

SEQ ID NO: 29966 - DNA, 618 bp, Bacteroides thetaiotaomicron; identical to SEQ ID NO: 3833
  CDS (1)..(618)

SEQ ID NO: 29967 - protein, 205 aa, Bacteroides thetaiotaomicron; identical to SEQ ID NO: 3834

SEQ ID NO: 29968 - DNA, 630 bp, Streptococcus agalactiae; identical to SEQ ID NO: 3835
  CDS (1)..(630)

SEQ ID NO: 29969 - protein, 209 aa, Streptococcus agalactiae; identical to SEQ ID NO: 3836

SEQ ID NO: 29970 - DNA, 1524 bp, Galdieria sulphuraria; identical to SEQ ID NO: 3837
  CDS (77)..(1423)

SEQ ID NO: 29971 - protein, 448 aa, Galdieria sulphuraria; identical to SEQ ID NO: 3838

SEQ ID NO: 29972 - DNA, 1005 bp, Synechococcus vulcanus; identical to SEQ ID NO: 3839
  CDS (1)..(1005)

SEQ ID NO: 29973 - protein, 334 aa, Synechococcus vulcanus; identical to SEQ ID NO: 3840

SEQ ID NO: 29974 - DNA, 1831 bp, Arabidopsis thaliana; identical to SEQ ID NO: 3841
  CDS (116)..(1525)

SEQ ID NO: 29975 - protein, 469 aa, Arabidopsis thaliana; identical to SEQ ID NO: 3842

SEQ ID NO: 29976 - DNA, 1875 bp, Homo sapiens; identical to SEQ ID NO: 3843
  CDS (14)..(1273)

SEQ ID NO: 29977 - protein, 419 aa, Homo sapiens; identical to SEQ ID NO: 3844

SEQ ID NO: 29978 - DNA, 1644 bp, Thermoanaerobacter tengcongensis; identical to SEQ ID NO: 3845
  CDS (1)..(1644)

SEQ ID NO: 29979 - protein, 547 aa, Thermoanaerobacter tengcongensis; identical to SEQ ID NO: 3846

SEQ ID NO: 29980 - DNA, 1665 bp, Clostridium perfringens; identical to SEQ ID NO: 3847
  CDS (1)..(1665)

SEQ ID NO: 29981 - protein, 554 aa, Clostridium perfringens; identical to SEQ ID NO: 3848

SEQ ID NO: 29982 - DNA, 1258 bp, Odontella sinensis; identical to SEQ ID NO: 3849
  CDS (23)..(1213)

SEQ ID NO: 29983 - protein, 396 aa, Odontella sinensis; identical to SEQ ID NO: 3850

SEQ ID NO: 29984 - DNA, 606 bp, Homo sapiens; identical to SEQ ID NO: 3851
  CDS (1)..(606)

SEQ ID NO: 29985 - protein, 201 aa, Homo sapiens [sequence omitted]

SEQ ID NO: 29986 - DNA, 1299 bp, Vaucheria litorea; identical to SEQ ID NO: 3853
  CDS (8)..(1225)

SEQ ID NO: 29987 - protein, 405 aa, Vaucheria litorea; identical to SEQ ID NO: 3854

SEQ ID NO: 29988 - DNA, 1711 bp, Cryptosporidium parvum; identical to SEQ ID NO: 3855
  CDS (290)..(1549)

SEQ ID NO: 29989 - protein, 419 aa, Cryptosporidium parvum; identical to SEQ ID NO: 3856

SEQ ID NO: 29990 - DNA, 1492 bp, Arabidopsis thaliana; identical to SEQ ID NO: 3857
  CDS (1)..(1461)

SEQ ID NO: 29991 - protein, 486 aa, Arabidopsis thaliana; identical to SEQ ID NO: 3858

SEQ ID NO: 29992 - DNA, 1480 bp, Dictyostelium discoideum; identical to SEQ ID NO: 3859
  CDS (1)..(1479)

SEQ ID NO: 29993 - protein, 492 aa, Dictyostelium discoideum; identical to SEQ ID NO: 3860

SEQ ID NO: 29994 - DNA, 1545 bp, Synechococcus sp; identical to SEQ ID NO: 3861
  CDS (267)..(1268)

SEQ ID NO: 29995 - protein, 333 aa, Synechococcus sp; identical to SEQ ID NO: 3862

SEQ ID NO: 29996 - DNA, 1452 bp, Arabidopsis thaliana; identical to SEQ ID NO: 3863
  CDS (1)..(1452)

SEQ ID NO: 29997 - protein, 483 aa, Arabidopsis thaliana; identical to SEQ ID NO: 3864

SEQ ID NO: 29998 - DNA, 1398 bp, Arabidopsis thaliana; identical to SEQ ID NO: 3865
  CDS (1)..(1398)

SEQ ID NO: 29999 - protein, 465 aa, Arabidopsis thaliana; identical to SEQ ID NO: 3866

SEQ ID NO: 30000 - DNA, 1856 bp, Drosophila melanogaster; identical to SEQ ID NO: 3867
  CDS (77)..(1762)

SEQ ID NO: 30001 - protein, 561 aa, Drosophila melanogaster; identical to SEQ ID NO: 3868

SEQ ID NO: 30002 - DNA, 1869 bp, Synechocystis sp; identical to SEQ ID NO: 3869
  CDS (233)..(1231)

SEQ ID NO: 30003 - protein, 332 aa, Synechocystis sp; identical to SEQ ID NO: 3870

SEQ ID NO: 30004 - DNA, 834 bp, Mus musculus; identical to SEQ ID NO: 3871
  CDS (1)..(834)

SEQ ID NO: 30005 - protein, 277 aa, Mus musculus; identical to SEQ ID NO: 3872

SEQ ID NO: 30006 - DNA, 1200 bp, Homo sapiens; identical to SEQ ID NO: 3873
  CDS (180)..(965)

SEQ ID NO: 30007 - protein, 261 aa, Homo sapiens; identical to SEQ ID NO: 3874

SEQ ID NO: 30008 - DNA, 822 bp, Drosophila melanogaster; identical to SEQ ID NO: 3875
  CDS (40)..(822)

SEQ ID NO: 30009 - protein, 260 aa, Drosophila melanogaster; identical to SEQ ID NO: 3876

SEQ ID NO: 30010 - DNA, 1823 bp, Mus musculus; identical to SEQ ID NO: 3877
  CDS (6)..(1652)

SEQ ID NO: 30011 - protein, 548 aa, Mus musculus; identical to SEQ ID NO: 3878

SEQ ID NO: 30012 - DNA, 627 bp, Clostridium perfringens; identical to SEQ ID NO: 3879
  CDS (1)..(627)

SEQ ID NO: 30013 - protein, 208 aa, Clostridium perfringens; identical to SEQ ID NO: 3880

SEQ ID NO: 30014 - DNA, 630 bp, Clostridium tetani; identical to SEQ ID NO: 3881
  CDS (1)..(630)

SEQ ID NO: 30015 - protein, 209 aa, Clostridium tetani; identical to SEQ ID NO: 3882

SEQ ID NO: 30016 - DNA, 678 bp, Halobacterium sp; identical to SEQ ID NO: 3883
  CDS (1)..(678)

SEQ ID NO: 30017 - protein, 225 aa, Halobacterium sp; identical to SEQ ID NO: 3884

SEQ ID NO: 30018 - DNA, 630 bp, Lactobacillus plantarum; identical to SEQ ID NO: 3885
  CDS (1)..(630)

SEQ ID NO: 30019 - protein, 209 aa, Lactobacillus plantarum; identical to SEQ ID NO: 3886

SEQ ID NO: 30020 - DNA, 633 bp, Oceanobacillus iheyensis; identical to SEQ ID NO: 3887
  CDS (1)..(633)

SEQ ID NO: 30021 - protein, 210 aa, Oceanobacillus iheyensis; identical to SEQ ID NO: 3888

SEQ ID NO: 30022 - DNA, 651 bp, Pasteurella multocida; identical to SEQ ID NO: 3889
  CDS (1)..(651)

SEQ ID NO: 30023 - protein, 216 aa, Pasteurella multocida; identical to SEQ ID NO: 3890

SEQ ID NO: 30024 - DNA, 639 bp, Shewanella oneidensis; identical to SEQ ID NO: 3891
  CDS (1)..(639)

SEQ ID NO: 30025 - protein, 212 aa, Shewanella oneidensis; identical to SEQ ID NO: 3892

SEQ ID NO: 30026 - DNA, 624 bp, Staphylococcus epidermidis; identical to SEQ ID NO: 3893
  CDS (1)..(624)

SEQ ID NO: 30027 - protein, 207 aa, Staphylococcus epidermidis; identical to SEQ ID NO: 3894

SEQ ID NO: 30028 - DNA, 627 bp, Streptococcus pyogenes; identical to SEQ ID NO: 3895
  CDS (1)..(627)

SEQ ID NO: 30029 - protein, 208 aa, Streptococcus pyogenes; identical to SEQ ID NO: 3896

SEQ ID NO: 30030 - DNA, 642 bp, Vibrio cholerae; identical to SEQ ID NO: 3897
  CDS (1)..(642)

SEQ ID NO: 30031 - protein, 213 aa, Vibrio cholerae; identical to SEQ ID NO: 3898

SEQ ID NO: 30032 - DNA, 642 bp, Vibrio parahaemolyticus; identical to SEQ ID NO: 3899
  CDS (1)..(642)

SEQ ID NO: 30033 - protein, 213 aa, Vibrio parahaemolyticus; identical to SEQ ID NO: 3900

SEQ ID NO: 30034 - DNA, 816 bp, Xenopus laevis; identical to SEQ ID NO: 3901
  CDS (1)..(816)

SEQ ID NO: 30035 - protein, 271 aa, Xenopus laevis; identical to SEQ ID NO: 3902

SEQ ID NO: 30036 - DNA, 21 bp, Artificial sequence
  (1)..(21): primer
atggcgcttcgtcgccccctt

SEQ ID NO: 30037 - DNA, 27 bp, Artificial sequence
  (1)..(27): primer
ttattcaaagaactgacttattttcgc

SEQ ID NO: 30038 - protein, 242 aa, Artificial sequence; identical to SEQ ID NO: 20857
  Variant (5)..(5): xaa in position 5 is any amino acid
  Variant (7)..(7): xaa in position 7 is any amino acid
  Variant (15)..(18): xaa in position 15 to 18 is any amino acid
  Variant (20)..(26): xaa in position 20 to 26 is any amino acid
  Variant (27)..(51): xaa in position 27 to 51 is any or no amino acid
  Variant (54)..(55): xaa in position 54 to 55 is any amino acid
  Variant (57)..(57): xaa in position 57 is any amino acid
  Variant (60)..(68): xaa in position 60 to 68 is any amino acid
  Variant (69)..(76): xaa in position 69 to 76 is any or no amino acid
  Variant (79)..(79): xaa in position 79 is any amino acid
  Variant (81)..(81): xaa in position 81 is any amino acid
  Variant (83)..(83): xaa in position 83 is any amino acid
  Variant (85)..(86): xaa in position 85 to 86 is any amino acid
  Variant (89)..(91): xaa in position 89 to 91 is any amino acid
  Variant (93)..(94): xaa in position 93 to 94 is any amino acid
  Variant (96)..(97): xaa in position 96 to 97 is any amino acid
  Variant (99)..(100): xaa in position 99 to 100 is any amino acid
  Variant (102)..(103): xaa in position 102 to 103 is any amino acid
  Variant (105)..(105): xaa in position 105 is any amino acid
  Variant (107)..(114): xaa in position 107 to 114 is any amino acid
  Variant (115)..(121): xaa in position 115 to 121 is any or no amino acid
  Variant (123)..(123): xaa in position 123 is any amino acid
  Variant (124)..(126): xaa in position 124 to 126 is any or no amino acid
  Variant (134)..(140): xaa in position 134 to 140 is any amino acid
  Variant (141)..(143): xaa in position 141 to 143 is any or no amino acid
  Variant (145)..(151): xaa in position 145 to 151 is any amino acid
  Variant (155)..(167): xaa in position 155 to 167 is any or no amino acid
  Variant (169)..(171): xaa in position 169 to 171 is any amino acid
  Variant (173)..(176): xaa in position 173 to 176 is any amino acid
  Variant (180)..(180): xaa in position 180 is any amino acid
  Variant (183)..(192): xaa in position 183 to 192 is any amino acid
  Variant (193)..(195): xaa in position 193 to 195 is any or no amino acid
  Variant (197)..(202): xaa in position 197 to 202 is any amino acid
  Variant (206)..(209): xaa in position 206 to 209 is any amino acid
  Variant (212)..(212): xaa in position 212 is any amino acid
  Variant (214)..(217): xaa in position 214 to 217 is any amino acid
  Variant (223)..(226): xaa in position 223 to 226 is any amino acid
  Variant (227)..(232): xaa in position 227 to 232 is any or no amino acid
  Variant (234)..(241): xaa in position 234 to 241 is any amino acid

SEQ ID NO: 30039 - protein, 58 aa, Artificial sequence; identical to SEQ ID NO: 6166
  Variant (1)..(1): xaa in position 1 is Ile, Val, Leu or Ala
  Variant (2)..(2): xaa in position 2 is Ile, Val or Leu
  Variant (3)..(3): xaa in position 3 is any amino acid
  Variant (4)..(4): xaa in position 4 is Ile, Val or Leu
  Variant (5)..(5): xaa in position 5 is any amino acid
  Variant (6)..(6): xaa in position 6 is Gly or Ala
  Variant (7)..(7): xaa in position 7 is any amino acid
  Variant (8)..(8): xaa in position 8 is Ser, Thr or Ala
  Variant (9)..(9): xaa in position 9 is Gly, Ala or Ser
  Variant (10)..(10): xaa in position 10 is Ser, Cys, Ala or Gly
  Variant (13)..(13): xaa in position 13 is Thr or Ser
  Variant (14)..(18): xaa in position 14 to 18 is any amino acid
  Variant (19)..(19): xaa in position 19 is Ile, Leu, Val or Met
  Variant (20)..(27): xaa in position 20 to 27 is any amino acid
  Variant (28)..(52): xaa in position 28 to 52 is any or no amino acid
  Variant (53)..(53): xaa in position 53 is Ile, Leu or Val
  Variant (54)..(55): xaa in position 54 to 55 is any amino acid
  Variant (57)..(57): xaa in position 57 is any amino acid
  Variant (58)..(58): xaa in position 58 is Tyr or Phe

SEQ ID NO: 30040 - protein, 74 aa, Artificial sequence; identical to SEQ ID NO: 6167
  Variant (1)..(1): xaa in position 1 is Ala, Ser, Val, Glu or Cys
  Variant (2)..(10): xaa in position 2 to 10 is any amino acid
  Variant (11)..(11): xaa in position 11 is Leu, Ile, Val or Met
  Variant (12)..(13): xaa in position 12 to 13 is any amino acid
  Variant (14)..(14): xaa in position 14 is Leu or Ile
  Variant (15)..(19): xaa in position 15 to 19 is any amino acid
  Variant (20)..(20): xaa in position 20 is Val, Ile, Leu, Thr or Tyr
  Variant (21)..(22): xaa in position 21 to 22 is any amino acid
  Variant (24)..(24): xaa in position 24 is any amino acid
  Variant (26)..(34): xaa in position 26 to 34 is any amino acid
  Variant (35)..(46): xaa in position 35 to 46 is any or no amino acid
  Variant (47)..(47): xaa in position 47 is Val, Ile or Phe
  Variant (48)..(48): xaa in position 48 is Ile, Val, Leu or Phe
  Variant (49)..(49): xaa in position 49 is Ile, Val or Leu
  Variant (50)..(50): xaa in position 50 is any amino acid
  Variant (51)..(51): xaa in position 51 is Glu or Asp
  Variant (53)..(53): xaa in position 53 is Ile or Leu
  Variant (54)..(54): xaa in position 54 is Leu, His, Tyr, Phe or Met
  Variant (55)..(59): xaa in position 55 to 59 is any amino acid
  Variant (60)..(63): xaa in position 60 to 63 is any or no amino acid
  Variant (64)..(64): xaa in position 64 is Leu, Ile, Val or Met
  Variant (65)..(71): xaa in position 65 to 71 is any amino acid
  Variant (72)..(72): xaa in position 72 is Ile, Val or Leu
  Variant (73)..(73): xaa in position 73 is Phe, Tyr or Ser
  Variant (74)..(74): xaa in position 74 is Val, Met, Leu, Ile or Phe

SEQ ID NO: 30041 - protein, 44 aa, Artificial sequence; identical to SEQ ID NO: 6168
  Variant (1)..(1): xaa in position 1 is Arg or Lys
  Variant (2)..(2): xaa in position 2 is Ile, Val, Leu or Met
  Variant (3)..(3): xaa in position 3 is any amino acid
  Variant (6)..(29): xaa in position 6 to 29 is any amino acid
  Variant (30)..(32): xaa in position 30 to 32 is any or no amino acid
  Variant (33)..(33): xaa in position 33 is Phe, Tyr, Trp or Asn
  Variant (34)..(34): xaa in position 34 is Ile, Val or Cys
  Variant (35)..(35): xaa in position 35 is any amino acid
  Variant (36)..(36): xaa in position 36 is Pro or Lys
  Variant (37)..(40): xaa in position 37 to 40 is any amino acid
  Variant (42)..(43): xaa in position 42 to 43 is any amino acid
  Variant (44)..(44): xaa in position 44 is Ile, Val, Leu, Met or Lys

SEQ ID NO: 30042 - DNA, 1323 bp, Escherichia coli K12; identical to SEQ ID NO: 20861
  CDS (1)..(1323): transl_table=11

SEQ ID NO: 30043 - protein, 440 aa, Escherichia coli K12; identical to SEQ ID NO: 20862

SEQ ID NO: 30044 - DNA, 1461 bp, Archaeoglobus fulgidus DSM 4304; identical to SEQ ID NO: 20863
  CDS (1)..(1461): transl_table=11

SEQ ID NO: 30045 - protein, 486 aa, Archaeoglobus fulgidus DSM 4304; identical to SEQ ID NO: 20864

SEQ ID NO: 30046 - DNA, 1455 bp, Aeropyrum pernix K1; identical to SEQ ID NO: 20865
  CDS (1)..(1455): transl_table=11

SEQ ID NO: 30047 - protein, 484 aa, Aeropyrum pernix K1; identical to SEQ ID NO: 20866

SEQ ID NO: 30048 - DNA, 1365 bp, Helicobacter pylori J99; identical to SEQ ID NO: 20867
  CDS (1)..(1365): transl_table=11

SEQ ID NO: 30049 - protein, 454 aa, Helicobacter pylori J99; identical to SEQ ID NO: 20868

SEQ ID NO: 30050 - DNA, 1326 bp, Bacillus halodurans C-125; identical to SEQ ID NO: 20869
  CDS (1)..(1326): transl_table=11

SEQ ID NO: 30051 - protein, 441 aa, Bacillus halodurans C-125; identical to SEQ ID NO: 20870

SEQ ID NO: 30052 - DNA, 1425 bp, Pseudomonas aeruginosa PAO1; identical to SEQ ID NO: 20871
  CDS (1)..(1425): transl_table=11

SEQ ID NO: 30053 - protein, 474 aa, Pseudomonas aeruginosa PAO1; identical to SEQ ID NO: 20872

SEQ ID NO: 30054 - DNA, 1377 bp, Fusobacterium nucleatum subsp. nucleatum ATCC 25586; identical to SEQ ID NO: 20873
  CDS (1)..(1377): transl_table=11

SEQ ID NO: 30055 - protein, 458 aa, Fusobacterium nucleatum subsp. nucleatum ATCC 25586; identical to SEQ ID NO: 20874

SEQ ID NO: 30056 - DNA, 1407 bp, Streptococcus pyogenes MGAS8232; identical to SEQ ID NO: 20875
  CDS (1)..(1407): transl_table=11

SEQ ID NO: 30057 - protein, 468 aa, Streptococcus pyogenes MGAS8232; identical to SEQ ID NO: 20876

SEQ ID NO: 30058 - DNA, 1326 bp, Oceanobacillus iheyensis HTE831; identical to SEQ ID NO: 20877
  CDS (1)..(1326): transl_table=11

SEQ ID NO: 30059 - protein, 441 aa, Oceanobacillus iheyensis HTE831; identical to SEQ ID NO: 20878

SEQ ID NO: 30060 - DNA, 1332 bp, Shewanella oneidensis MR-1; identical to SEQ ID NO: 20879
  CDS (1)..(1332): transl_table=11

SEQ ID NO: 30061 - protein, 443 aa, Shewanella oneidensis MR-1; identical to SEQ ID NO: 20880

SEQ ID NO: 30062 - DNA, 1419 bp, Pseudomonas putida KT2440; identical to SEQ ID NO: 20881
  CDS (1)..(1419): transl_table=11

SEQ ID NO: 30063 - protein, 472 aa, Pseudomonas putida KT2440; identical to SEQ ID NO: 20882

SEQ ID NO: 30064 - DNA, 1419 bp, Pseudomonas syringae pv. tomato str. DC3000; identical to SEQ ID NO: 20883
  CDS (1)..(1419): transl_table=11

SEQ ID NO: 30065 - protein, 472 aa, Pseudomonas syringae pv. tomato str. DC3000; identical to SEQ ID NO: 20884

SEQ ID NO: 30066 - DNA, 1407 bp, Streptococcus pyogenes SSI-1; identical to SEQ ID NO: 20885
  CDS (1)..(1407): transl_table=11

SEQ ID NO: 30067 - protein, 468 aa, Streptococcus pyogenes SSI-1; identical to SEQ ID NO: 20886

SEQ ID NO: 30068 - DNA, 1350 bp, Bordetella pertussis Tohama I; identical to SEQ ID NO: 20887
  CDS (1)..(1350): transl_table=11

SEQ ID NO: 30069 - protein, 449 aa, Bordetella pertussis Tohama I; identical to SEQ ID NO: 20888

SEQ ID NO: 30070 - DNA, 1464 bp, Bordetella pertussis Tohama I; identical to SEQ ID NO: 20889
  CDS (1)..(1464): transl_table=11

SEQ ID NO: 30071 - protein, 487 aa, Bordetella pertussis Tohama I; identical to SEQ ID NO: 20890

SEQ ID NO: 30072 - DNA, 1434 bp, Bordetella parapertussis 12822; identical to SEQ ID NO: 20891
  CDS (1)..(1434): transl_table=11

SEQ ID NO: 30073 - protein, 477 aa, Bordetella parapertussis 12822; identical to SEQ ID NO: 20892

SEQ ID NO: 30074 - DNA, 1464 bp, Bordetella parapertussis 12822; identical to SEQ ID NO: 20893
  CDS (1)..(1464): transl_table=11

SEQ ID NO: 30075 - protein, 487 aa, Bordetella parapertussis 12822; identical to SEQ ID NO: 20894

SEQ ID NO: 30076 - DNA, 1446 bp, Bordetella parapertussis 12822; identical to SEQ ID NO: 20895
  CDS (1)..(1446): transl_table=11

SEQ ID NO: 30077 - protein, 481 aa, Bordetella parapertussis 12822; identical to SEQ ID NO: 20896

SEQ ID NO: 30078 - DNA, 1464 bp, Bordetella bronchiseptica RB50; identical to SEQ ID NO: 20897
  CDS (1)..(1464): transl_table=11

SEQ ID NO: 30079 - protein, 487 aa, Bordetella bronchiseptica RB50; identical to SEQ ID NO: 20898

SEQ ID NO: 30080 - DNA, 1314 bp, Bordetella bronchiseptica RB50; identical to SEQ ID NO: 20899
  CDS (1)..(1314): transl_table=11

SEQ ID NO: 30081 - protein, 437 aa, Bordetella bronchiseptica RB50; identical to SEQ ID NO: 20900

SEQ ID NO: 30082 - DNA, 1365 bp, Bdellovibrio bacteriovorus HD100; identical to SEQ ID NO: 20901
  CDS (1)..(1365): transl_table=11

SEQ ID NO: 30083 - protein, 454 aa, Bdellovibrio bacteriovorus HD100; identical to SEQ ID NO: 20902

SEQ ID NO: 30084 - DNA, 1347 bp, Bacillus cereus ATCC 10987; identical to SEQ ID NO: 20903
  CDS (1)..(1347): transl_table=11

SEQ ID NO: 30085 - protein, 448 aa, Bacillus cereus ATCC 10987; identical to SEQ ID NO: 20904

SEQ ID NO: 30086 - DNA, 1347 bp, Bacillus anthracis str. Sterne; identical to SEQ ID NO: 20905
  CDS (1)..(1347): transl_table=11

SEQ ID NO: 30087 - protein, 448 aa, Bacillus anthracis str. Sterne; identical to SEQ ID NO: 20906

SEQ ID NO: 30088 - DNA, 1347 bp, Bacillus thuringiensis serovar konkukian str. 97-27; identical to SEQ ID NO: 20907
  CDS (1)..(1347): transl_table=11

SEQ ID NO: 30089 - protein, 448 aa, Bacillus thuringiensis serovar konkukian str. 97-27; identical to SEQ ID NO: 20908

SEQ ID NO: 30090 - DNA, 1410 bp, Acinetobacter sp. ADP1; identical to SEQ ID NO: 20909
  CDS (1)..(1410): transl_table=11

SEQ ID NO: 30091 - protein, 469 aa, Acinetobacter sp. ADP1; identical to SEQ ID NO: 20910

SEQ ID NO: 30092 - DNA, 1347 bp, Bacillus cereus E33L; identical to SEQ ID NO: 20911
  CDS (1)..(1347): transl_table=11

SEQ ID NO: 30093 - protein, 448 aa, Bacillus cereus E33L; identical to SEQ ID NO: 20912

SEQ ID NO: 30094 - DNA, 1404 bp, Haloarcula marismortui ATCC 43049; identical to SEQ ID NO: 20913
  CDS (1)..(1404): transl_table=11

SEQ ID NO: 30095 - protein, 467 aa, Haloarcula marismortui ATCC 43049; identical to SEQ ID NO: 20914

SEQ ID NO: 30096 - DNA, 1320 bp, Bacillus clausii KSM-K16; identical to SEQ ID NO: 20915
  CDS (1)..(1320): transl_table=11

SEQ ID NO: 30097 - protein, 439 aa, Bacillus clausii KSM-K16; identical to SEQ ID NO: 20916

SEQ ID NO: 30098 - DNA, 1419 bp, Pseudomonas syringae pv. syringae B728a; identical to SEQ ID NO: 20917
  CDS (1)..(1419): transl_table=11

SEQ ID NO: 30099 - protein, 472 aa, Pseudomonas syringae pv. syringae B728a; identical to SEQ ID NO: 20918

SEQ ID NO: 30100 - DNA, 1344 bp, Haemophilus influenzae 86-028NP; identical to SEQ ID NO: 20919
  CDS (1)..(1344): transl_table=11

SEQ ID NO: 30101 - protein, 447 aa, Haemophilus influenzae 86-028NP; identical to SEQ ID NO: 20920

SEQ ID NO: 30102 - DNA, 1419 bp, Pseudomonas fluorescens Pf-5; identical to SEQ ID NO: 20921
  CDS (1)..(1419): transl_table=11

SEQ ID NO: 30103 - protein, 472 aa, Pseudomonas fluorescens Pf-5; identical to SEQ ID NO: 20922

SEQ ID NO: 30104 - DNA, 1425 bp, Pseudomonas syringae pv. phaseolicola 1448A; identical to SEQ ID NO: 20923
  CDS (1)..(1425): transl_table=11

SEQ ID NO: 30105 - protein, 474 aa, Pseudomonas syringae pv. phaseolicola 1448A; identical to SEQ ID NO: 20924

SEQ ID NO: 30106 - DNA, 1407 bp, Streptococcus pyogenes MGAS5005; identical to SEQ ID NO: 20925
  CDS (1)..(1407): transl_table=11

SEQ ID NO: 30107 - protein, 468 aa, Streptococcus pyogenes MGAS5005; identical to SEQ ID NO: 20926

SEQ ID NO: 30108 - DNA, 1449 bp, Ralstonia eutropha JMP134; identical to SEQ ID NO: 20927
  CDS (1)..(1449): transl_table=11

SEQ ID NO: 30109 - protein, 482 aa, Ralstonia eutropha JMP134; identical to SEQ ID NO: 20928

SEQ ID NO: 30110 - DNA, 1344 bp, Haemophilus somnus 2336; identical to SEQ ID NO: 20929
  CDS (1)..(1344)

SEQ ID NO: 30111 - protein, 447 aa, Haemophilus somnus 2336; identical to SEQ ID NO: 20930

SEQ ID NO: 30112 - DNA, 1326 bp, Fusobacterium nucleatum subsp. vincentii ATCC 49256; identical to SEQ ID NO: 20931
  CDS (1)..(1326): transl_table=11

SEQ ID NO: 30113 - protein, 441 aa, Fusobacterium nucleatum subsp. vincentii ATCC 49256; identical to SEQ ID NO: 20932

SEQ ID NO: 30114 - DNA, 1344 bp, Haemophilus influenzae R2866; identical to SEQ ID NO: 20933
  CDS (1)..(1344)

SEQ ID NO: 30115 - protein, 447 aa, Haemophilus influenzae R2866; identical to SEQ ID NO: 20934

SEQ ID NO: 30116 - DNA, 1452 bp, Burkholderia cepacia R18194; identical to SEQ ID NO: 20935
  CDS (1)..(1452)

SEQ ID NO: 30117 - protein, 483 aa, Burkholderia cepacia R18194; identical to SEQ ID NO: 20936

SEQ ID NO: 30118 - DNA, 1290 bp, Burkholderia cepacia R18194; identical to SEQ ID NO: 20937
  CDS (1)..(1290)

SEQ ID NO: 30119 - protein, 429 aa, Burkholderia cepacia R18194; identical to SEQ ID NO: 20938

SEQ ID NO: 30120 - DNA, 1347 bp, Bacillus cereus G9241; identical to SEQ ID NO: 20939
  CDS (1)..(1347): transl_table=11

SEQ ID NO: 30121 - protein, 448 aa, Bacillus cereus G9241; identical to SEQ ID NO: 20940

SEQ ID NO: 30122 - DNA, 1332 bp, Pseudomonas fluorescens PfO-1; identical to SEQ ID NO: 20941
  CDS (1)..(1332)

SEQ ID NO: 30123 - protein, 443 aa, Pseudomonas fluorescens PfO-1; identical to SEQ ID NO: 20942

SEQ ID NO: 30124 - DNA, 1434 bp, Rhodospirillum rubrum; identical to SEQ ID NO: 20943
  CDS (1)..(1434)

SEQ ID NO: 30125 - protein, 477 aa, Rhodospirillum rubrum; identical to SEQ ID NO: 20944

SEQ ID NO: 30126 - DNA, 1035 bp, Haemophilus influenzae 86-028NP; identical to SEQ ID NO: 20945
  CDS (1)..(1035)

SEQ ID NO: 30127 - protein, 344 aa, Haemophilus influenzae 86-028NP; identical to SEQ ID NO: 20946

SEQ ID NO: 30128 - DNA, 1431 bp, Ralstonia eutropha JMP134; identical to SEQ ID NO: 20947
  CDS (1)..(1431)

SEQ ID NO: 30129 - protein, 476 aa, Ralstonia eutropha JMP134; identical to SEQ ID NO: 20948

SEQ ID NO: 30130 - DNA, 1380 bp, Brevibacterium linens BL2; identical to SEQ ID NO: 20949
  CDS (1)..(1380)

SEQ ID NO: 30131 - protein, 459 aa, Brevibacterium linens BL2; identical to SEQ ID NO: 20950

SEQ ID NO: 30132 - DNA, 1242 bp, Bacillus anthracis str. A2012; identical to SEQ ID NO: 20951
  CDS (1)..(1242): n means a or g or c or t/u, s means g or c

SEQ ID NO: 30133 - protein, 413 aa, Bacillus anthracis str. A2012; identical to SEQ ID NO: 20952
  Xaa in position 43 and 129 is unknown

SEQ ID NO: 30134 - DNA, 1440 bp, Azotobacter vinelandii AvOP; identical to SEQ ID NO: 20953
  CDS (1)..(1440): transl_table=11

SEQ ID NO: 30135 - protein, 479 aa, Azotobacter vinelandii AvOP; identical to SEQ ID NO: 20954

SEQ ID NO: 30136 - DNA, 1311 bp, Chromohalobacter salexigens DSM 3043; identical to SEQ ID NO: 20955
  CDS (1)..(1311): transl_table=11

SEQ ID NO: 30137 - protein, 436 aa, Chromohalobacter salexigens DSM 3043; identical to SEQ ID NO: 20956

SEQ ID NO: 30138 - DNA, 1356 bp, Shewanella baltica OS155; identical to SEQ ID NO: 20957
  CDS (1)..(1356): transl_table=11

SEQ ID NO: 30139 - protein, 451 aa, Shewanella baltica OS155; identical to SEQ ID NO: 20958

SEQ ID NO: 30140 - DNA, 1338 bp, Ralstonia metallidurans CH34; identical to SEQ ID NO: 20959
  CDS (1)..(1338): transl_table=11

SEQ ID NO: 30141 - protein, 445 aa, Ralstonia metallidurans CH34; identical to SEQ ID NO: 20960

SEQ ID NO: 30142 - DNA, 1395 bp, Rubrobacter xylanophilus DSM 9941; identical to SEQ ID NO: 20961
  CDS (1)..(1395): transl_table=11

SEQ ID NO: 30143 - protein, 464 aa, Rubrobacter xylanophilus DSM 9941; identical to SEQ ID NO: 20962

SEQ ID NO: 30144 - DNA, 1320 bp, Psychrobacter cryohalolentis K5; identical to SEQ ID NO: 20963
  CDS (1)..(1320): transl_table=11

SEQ ID NO: 30145 - protein, 439 aa, Psychrobacter cryohalolentis K5; identical to SEQ ID NO: 20964

SEQ ID NO: 30146 - DNA, 1353 bp, Burkholderia ambifaria AMMD; identical to SEQ ID NO: 20965
  CDS (1)..(1353): transl_table=11

SEQ ID NO: 30147 - protein, 450 aa, Burkholderia ambifaria AMMD; identical to SEQ ID NO: 20966

SEQ ID NO: 30148 - DNA, 1344 bp, Bacillus cereus; identical to SEQ ID NO: 20967
  CDS (1)..(1344): transl_table=11

SEQ ID NO: 30149 - protein, 447 aa, Bacillus cereus; identical to SEQ ID NO: 20968

SEQ ID NO: 30150 - DNA, 1341 bp, Alcaligenes eutrophus; identical to SEQ ID NO: 20969
  CDS (1)..(1341): transl_table=11

SEQ ID NO: 30151 - protein, 446 aa, Alcaligenes eutrophus; identical to SEQ ID NO: 20970

SEQ ID NO: 30152 - DNA, 1239 bp, Aeropyrum pernix; identical to SEQ ID NO: 20971
  CDS (1)..(1239): transl_table=11

SEQ ID NO: 30153 - protein, 412 aa, Aeropyrum pernix; identical to SEQ ID NO: 20972

SEQ ID NO: 30154 - DNA, 1344 bp, Haemophilus influenzae; identical to SEQ ID NO: 20973
  CDS (1)..(1344): transl_table=11

SEQ ID NO: 30155 - protein, 447 aa, Haemophilus influenzae; identical to SEQ ID NO: 20974

SEQ ID NO: 30156 - DNA, 24 bp, Artificial sequence
  (1)..(24): primer
atgattggtcgcatatcgcgtttt

SEQ ID NO: 30157 - DNA, 26 bp, Artificial sequence
  (1)..(26): primer
ttagaacagcgttaaaccaatgacga

SEQ ID NO: 30158 - protein, 465 aa, Artificial sequence; identical to SEQ ID NO: 20977
  Variant (3)..(3): xaa in position 3 is any amino acid
  Variant (6)..(7): xaa in position 6 to 7 is any amino acid
  Variant (9)..(11): xaa in position 9 to 11 is any amino acid
  Variant (13)..(15): xaa in position 13 to 15 is any amino acid
  Variant (17)..(34): xaa in position 17 to 34 is any amino acid
  Variant (35)..(44): xaa in position 35 to 44 is any or no amino acid
  Variant (47)..(47): xaa in position 47 is any amino acid
  Variant (51)..(51): xaa in position 51 is any amino acid
  Variant (54)..(54): xaa in position 54 is any amino acid
  Variant (56)..(56): xaa in position 56 is any amino acid
  Variant (60)..(60): xaa in position 60 is any amino acid
  Variant (65)..(65): xaa in position 65 is any amino acid
  Variant (67)..(68): xaa in position 67 to 68 is any amino acid
  Variant (71)..(71): xaa in position 71 is any amino acid
  Variant (74)..(76): xaa in position 74 to 76 is any amino acid
  Variant (78)..(78): xaa in position 78 is any amino acid
  Variant (80)..(81): xaa in position 80 to 81 is any amino acid
  Variant (84)..(91): xaa in position 84 to 91 is any amino acid
  Variant (94)..(95): xaa in position 94 to 95 is any amino acid
  Variant (97)..(98): xaa in position 97 to 98 is any amino acid
  Variant (100)..(101): xaa in position 100 to 101 is any amino acid
  Variant (103)..(105): xaa in position 103 to 105 is any amino acid
  Variant (110)..(111): xaa in position 110 to 111 is any amino acid
  Variant (114)..(115): xaa in position 114 to 115 is any amino acid
  Variant (118)..(119): xaa in position 118 to 119 is any amino acid
  Variant (121)..(121): xaa in position 121 is any amino acid
  Variant (125)..(127): xaa in position 125 to 127 is any amino acid
  Variant (128)..(132): xaa in position 128 to 132 is any or no amino acid
  Variant (134)..(134): xaa in position 134 is any amino acid
  Variant (136)..(139): xaa in position 136 to 139 is any amino acid
  Variant (144)..(144): xaa in position 144 is any amino acid
  Variant (146)..(148): xaa in position 146 to 148 is any amino acid
  Variant (149)..(149): xaa in position 149 is any or no amino acid
  Variant (151)..(152): xaa in position 151 to 152 is any amino acid
  Variant (156)..(156): xaa in position 156 is any amino acid
  Variant (158)..(162): xaa in position 158 to 162 is any amino acid
  Variant (164)..(175): xaa in position 164 to 175 is any amino acid
  Variant (176)..(183): xaa in position 176 to 183 is any or no amino acid
  Variant (186)..(188): xaa in position 186 to 188 is any amino acid
  Variant (192)..(195): xaa in position 192 to 195 is any amino acid
  Variant (197)..(203): xaa in position 197 to 203 is any amino acid
  Variant (205)..(208): xaa in position 205 to 208 is any amino acid
  Variant (210)..(214): xaa in position 210 to 214 is any amino acid
  Variant (216)..(241): xaa in position 216 to 241 is any amino acid
  Variant (242)..(256): xaa in position 242 to 256 is any or no amino acid
  Variant (259)..(259): xaa in position 259 is any amino acid
  Variant (262)..(262): xaa in position 262 is any amino acid
  Variant (264)..(265): xaa in position 264 to 265 is any amino acid
  Variant (267)..(269): xaa in position 267 to 269 is any amino acid
  Variant (271)..(273): xaa in position 271 to 273 is any amino acid
  Variant (275)..(276): xaa in position 275 to 276 is any amino acid
  Variant (279)..(281): xaa in position 279 to 281 is any amino acid
  Variant (283)..(289): xaa in position 283 to 289 is any amino acid
  Variant (290)..(293): xaa in position 290 to 293 is any or no amino acid
  Variant (295)..(297): xaa in position 295 to 297 is any amino acid
  Variant (299)..(299): xaa in position 299 is any amino acid
  Variant (303)..(304): xaa in position 303 to 304 is any amino acid
  Variant (310)..(311): xaa in position 310 to 311 is any amino acid
  Variant (312)..(313): xaa in position 312 to 313 is any or no amino acid
  Variant (315)..(316): xaa in position 315 to 316 is any amino acid
  Variant (319)..(319): xaa in position 319 is any amino acid
  Variant (321)..(323): xaa in position 321 to 323 is any amino acid
  Variant (325)..(329): xaa in position 325 to 329 is any amino acid
  Variant (337)..(337): xaa in position 337 is any amino acid
  Variant (342)..(343): xaa in position 342 to 343 is any amino acid
  Variant (346)..(349): xaa in position 346 to 349 is any amino acid
  Variant (350)..(356): xaa in position 350 to 356 is any or no amino acid
  Variant (358)..(360): xaa in position 358 to 360 is any amino acid
  Variant (363)..(364): xaa in position 363 to 364 is any amino acid
  Variant (367)..(367): xaa in position 367 is any amino acid
  Variant (370)..(372): xaa in position 370 to 372 is any amino acid
  Variant (373)..(373): xaa in position 373 is any or no amino acid
  Variant (375)..(380): xaa in position 375 to 380 is any amino acid
  Variant (382)..(382): xaa in position 382 is any amino acid
  Variant (387)..(389): xaa in position 387 to 389 is any amino acid
  Variant (396)..(396): xaa in position 396 is any amino acid
  Variant (398)..(398): xaa in position 398 is any amino acid
  Variant (400)..(400): xaa in position 400 is any amino acid
  Variant (403)..(403): xaa in position 403 is any amino acid
  Variant (406)..(406): xaa in position 406 is any amino acid
  Variant (409)..(410): xaa in position 409 to 410 is any amino acid
  Variant (412)..(415): xaa in position 412 to 415 is any amino acid
  Variant (417)..(424): xaa in position 417 to 424 is any amino acid
  Variant (427)..(429): xaa in position 427 to 429 is any amino acid
  Variant (437)..(437): xaa in position 437 is any amino acid
  Variant (440)..(440): xaa in position 440 is any amino acid
  Variant (444)..(445): xaa in position 444 to 445 is any amino acid
  Variant (447)..(448): xaa in position 447 to 448 is any amino acid
  Variant (455)..(458): xaa in position 455 to 458 is any amino acid
  Variant (461)..(464): xaa in position 461 to 464 is any amino acid

SEQ ID NO: 30159 - protein, 36 aa, Artificial sequence; identical to SEQ ID NO: 20978
  Variant (2)..(2): xaa in position 2 is any amino acid
  Variant (3)..(3): xaa in position 3 is any or no amino acid
  Variant (5)..(5): xaa in position 5 is any amino acid
  Variant (7)..(7): xaa in position 7 is Ile or Leu
  Variant (8)..(8): xaa in position 8 is any amino acid
  Variant (10)..(10): xaa in position 10 is Ala, Gly, Ser or Thr
  Variant (14)..(14): xaa in position 14 is any amino acid
  Variant (15)..(15): xaa in position 15 is Phe, Ile, Leu, Met or Val
  Variant (16)..(16): xaa in position 16 is Ile, Leu or Val
  Variant (17)..(17): xaa in position 17 is Ala, Ile, Leu or Val
  Variant (18)..(18): xaa in position 18 is Ala, Ile or Val
  Variant (19)..(19): xaa in position 19 is any amino acid
  Variant (21)..(22): xaa in position 21 to 22 is any amino acid
  Variant (23)..(23): xaa in position 23 is Ile, Leu or Val
  Variant (25)..(32): xaa in position 25 to 32 is any amino acid
  Variant (33)..(35): xaa in position 33 to 35 is any or no amino acid

SEQ ID NO: 30160 - protein, 29 aa, Artificial sequence
  Variant (2)..(2): xaa in position 2 is any amino acid
  Variant (3)..(3): xaa in position 3 is Ala, Leu or Val
  Variant (4)..(4): xaa in position 4 is Ala, Ile, Leu or Val
  Variant (5)..(5): xaa in position 5 is any amino acid
  Variant (6)..(6): xaa in position 6 is Ala or Val
  Variant (7)..(7): xaa in position 7 is Ala, Cys or Ser
  Variant (8)..(8): xaa in position 8 is Ala, Gly or Ser
  Variant (10)..(10): xaa in position 10 is any amino acid
  Variant (12)..(15): xaa in position 12 to 15 is any amino acid
  Variant (16)..(18): xaa in position 16 to 18 is any or no amino acid
  Variant (20)..(20): xaa in position 20 is Phe, Leu or Met
  Variant (21)..(21): xaa in position 21 is Ala, Gly, Ser or Thr
  Variant (22)..(22): xaa in position 22 is Ala, Gly or Ser
  Variant (24)..(24): xaa in position 24 is any amino acid
  Variant (25)..(25): xaa in position 25 is Ala, Pro or Ser
  Variant (26)..(28): xaa in position 26 to 28 is any amino acid
  Variant (29)..(29): xaa in position 29 is Ala, Asn, Ser or Thr
YXXXXXXXYXGXXXXXXXGXXXSXXXXXX

SEQ ID NO: 30161 - protein, 48 aa, Artificial sequence; identical to SEQ ID NO: 20980
  Variant (2)..(2): xaa in position 2 is Phe or Leu
  Variant (3)..(3): xaa in position 3 is any amino acid
  Variant (4)..(4): xaa in position 4 is Phe, Ile or Leu
  Variant (5)..(7): xaa in position 5 to 7 is any amino acid
  Variant (8)..(8): xaa in position 8 is Ala, Gly or Ile
  Variant (9)..(10): xaa in position 9 to 10 is any amino acid
  Variant (12)..(14): xaa in position 12 to 14 is any amino acid
  Variant (15)..(21): xaa in position 15 to 21 is any or no amino acid
  Variant (23)..(28): xaa in position 23 to 28 is any amino acid
  Variant (29)..(29): xaa in position 29 is Phe, Ile, Leu or Val
  Variant (30)..(31): xaa in position 30 to 31 is any amino acid
  Variant (32)..(32): xaa in position 32 is Ala, Gly or Ser
  Variant (33)..(34): xaa in position 33 to 34 is any amino acid
  Variant (35)..(35): xaa in position 35 is Ala, Gly, Ser or Thr
  Variant (36)..(37): xaa in position 36 to 37 is any amino acid
  Variant (39)..(39): xaa in position 39 is Ile, Leu or Val
  Variant (40)..(40): xaa in position 40 is Ile, Leu, Met or Val
  Variant (41)..(41): xaa in position 41 is Ile, Leu or Val
  Variant (43)..(43): xaa in position 43 is Phe or Tyr
  Variant (45)..(45): xaa in position 45 is Phe or Leu
  Variant (47)..(47): xaa in position 47 is Ala or Gly
  Variant (48)..(48): xaa in position 48 is Gly or Ser

SEQ ID NO: 30162 - protein, 52 aa, Artificial sequence; identical to SEQ ID NO: 20981
  Variant (5)..(5): xaa in position 5 is Gly or Ser
  Variant (6)..(6): xaa in position 6 is any amino acid
  Variant (7)..(7): xaa in position 7 is Phe or Trp
  Variant (8)..(8): xaa in position 8 is Ala, Ile or Val
  Variant (9)..(9): xaa in position 9 is Ile or Val
  Variant (10)..(10): xaa in position 10 is any amino acid
  Variant (11)..(11): xaa in position 11 is Ala, Gly or Ser
  Variant (13)..(16): xaa in position 13 to 16 is any amino acid
  Variant (17)..(17): xaa in position 17 is any or no amino acid
  Variant (19)..(39): xaa in position 19 to 39 is any amino acid
  Variant (40)..(40): xaa in position 40 is any or no amino acid
  Variant (42)..(42): xaa in position 42 is Leu or Met
  Variant (43)..(43): xaa in position 43 is Ala, Ile, Leu or Val
  Variant (44)..(44): xaa in position 44 is any amino acid
  Variant (47)..(47): xaa in position 47 is Phe, Trp or Tyr
  Variant (48)..(48): xaa in position 48 is any amino acid
  Variant (50)..(50): xaa in position 50 is Pro or Ser
  Variant (51)..(51): xaa in position 51 is any amino acid

SEQ ID NO: 30163 - DNA, 1518 bp, Escherichia coli
  CDS (1)..(1518)
atgtgcggtattgtcggtatcgccggtgttatgccggttaaccagtcgatttatgatgccttaacggtgcttcagcatcgcggtcaggatgccgccggcatcatcaccatagatgccaataactgcttccgtttgcgtaaagcgaacgggctggtgagcgatgtatttgaagctcgccatatgcagcgtttgcagggcaatatgggcattggtcatgtgcgttaccctacggctggcagctccagcgcctctgaagcgcagccgttttacgttaactccccgtatggcattacgcttgcccacaacggcaatctgaccaacgctcacgagttgcgtaaaaaactgtttgaagaaaaacgccgccacatcaacaccacttccgactcggaaattctgcttaatatcttcgctagcgagctggacaacttccgccactacccgctggaagccgacaatattttcgctgccattgctgccacaaaccgcttaatccgcggcgcatatgcctgtgtggcgatgattatcggccacggtatggttgctttccgcgatccaaacgggattcgtccgctggtactgggaaaacgtgatattgacgagaaccgtacagaatatatggtcgcttccgaaagcgtagcgctcgatacgctgggctttgatttcctgcgtgacgtcgcgccgggcgaagcgatttacatcactgaagaagggcagttgtttacccgtcaatgtgctgacaatccggtcagcaatccgtgcctgtttgagtatgtatactttgctcgcccggactcgttcatcgacaaaatttccgtttacagcgcgcgtgtgaatatgggcacgaaactgggcgagaaaattgcccgcgaatgggaagatctggatatcgacgtggtgatcccgatcccagaaacctcgtgtgatatcgcgctggaaattgctcgtattctgggcaaaccgtaccgccagggcttcgttaaaaaccgctatgttggccgcacctttatcatgccgggccagcagctgcgtcgtaagtccgtgcgccgtaaactgaatgccaaccgcgccgagttccgcgataaaaacgtcctgctggtcgacgactccatcgtccgtggcaccacttctgagcagattatcgagatggcacgcgaagccggagcgaagaaagtgtacctcgcttctgcggcaccggaaattcgcttcccgaacgtttatggtattgatatgccgagcgccacggaactgatcgctcacggtcgcgaagttgatgaaattcgccagatcatcggtgctgacgggttgattttccaggatctgaacgatctgatcgacgccgttcgcgctgaaaatccggatatccagcagtttgaatgctcggtgttcaacggcgtctacgtcaccaaagatgttgatcagggctacctcgatttcctcgatacgttacgtaatgatgacgccaaagcagtgcaacgtcagaacgaagtggaaaatctcgaaatgcataacgaaggatga

SEQ ID NO: 30164 - protein, 505 aa, Escherichia coli
MCGIVGIAGVMPVNQSIYDALTVLQHRGQDAAGIITIDANNCFRLRKANGLVSDVFEARHMQRLQGNMGIGHVRYPTAGSSSASEAQPFYVNSPYGITLAHNGNLTNAHELRKKLFEEKRRHINTTSDSEILLNIFASELDNFRHYPLEADNIFAAIAATNRLIRGAYACVAMIIGHGMVAFRDPNGIRPLVLGKRDIDENRTEYMVASESVALDTLGFDFLRDVAPGEAIYITEEGQLFTRQCADNPVSNPCLFEYVYFARPDSFIDKISVYSARVNMGTKLGEKIAREWEDLDIDVVIPIPETSCDIALEIARILGKPYRQGFVKNRYVGRTFIMPGQQLRRKSVRRKLNANRAEFRDKNVLLVDDSIVRGTTSEQIIEMAREAGAKKVYLASAAPEIRFPNVYGIDMPSATELIAHGREVDEIRQIIGADGLIFQDLNDLIDAVRAENPDIQQFECSVFNGVYVTKDVDQGYLDFLDTLRNDDAKAVQRQNEVENLEMHNEG

SEQ ID NO: 30165 - DNA, 1374 bp, Archaeoglobus fulgidus DSM 4304
  CDS (1)..(1374): transl_table=11
atgtgtggggttgtaggtatataccatcctgacggggagcttgctccccgactcgcctactattctctcttctcccttcagcatcgcggtcaggagtcggcaggtatcgcgtcctttgacaaccacataaggcagaagaggggcatgggcctcgtcaccgaggttttcaacgacgaggactttgagctgcttgcaggcaaatcggtaatcggccacgtcagatactcaacgaccggtaggtcgagacttgagaacgctcagcctttcgtcgtcaaatcaaaggcgggatacatagctgtagcacataacggaaacctcgttaactactctcagctgagaaacgagctggaaaacgagggaagggttttcacaaccgattcagataccgaggtaatttcccagctgctctcaaagtttctgatcgaggaaggggacatcataaatgctcttgaaaggctgaacgaatcacttgtgggcagctacaccatgaccatgctcgttgacgatgcggtgataggctaccgcgaccctctcggcttcaagccgctgtgcgttggaaggattgatgatggttatgtgatatgcagcgaaagctgcgcaatcgatgctctcggtggagagtttataagagacgtacagcctgggaaagcggcgattataaaagatggtgagcttgagttcgtaaaaatcgccaaatcggagaggagagctgtttgcattttcgagtacatatacttcgcccgcccggactcaataattgacggaataagcgtttacaaagcgagaagcgagatgggaaaggttctggcgagggagtctcctgtcgaagctgacttcgtttcagctgtacccgacagcggaataaccgcggcaataggctacgctcaggaatcagggctgccttactttgagggcttgataaagaacagatacgtgggcaggactttcataatgccggttcagagtctaagggagacgtcagtgaggctgaaggtaaacgtcgtcagggagaacgtgagggggaggagggttgtgctggttgacgacagcatagtgagagggaccacctcaaggagaatcgtgcagatgataaaagacgcgggagcaaaggaggtgcacatgagaatcggcagccccccaatcatagccccgtgctacttcggaatagacatgaaatcgagggaggagctgatagccgccagccataccgttgaggagatagggagaattttcggaacggatagcctcgcctacctgagcctggaaggtcttctcgaagcggttaggagggcgggtggaaagaggggatactgccttgcctgtctgacctccaaataccccgtttcagtgcctggagaggagtgtgagtgttaa

SEQ ID NO: 30166 - protein, 457 aa, Archaeoglobus fulgidus DSM 4304
MCGVVGIYHPDGELAPRLAYYSLFSLQHRGQESAGIASFDNHIRQKRGMGLVTEVFNDEDFELLAGKSVIGHVRYSTTGRSRLENAQPFVVKSKAGYIAVAHNGNLVNYSQLRNELENEGRVFTTDSDTEVISQLLSKFLIEEGDIINALERLNESLVGSYTMTMLVDDAVIGYRDPLGFKPLCVGRIDDGYVICSESCAIDALGGEFIRDVQPGKAAIIKDGELEFVKIAKSERRAVCIFEYIYFARPDSIIDGISVYKARSEMGKVLARESPVEADFVSAVPDSGITAAIGYAQESGLPYFEGLIKNRYVGRTFIMPVQSLRETSVRLKVNVVRENVRGRRVVLVDDSIVRGTTSRRIVQMIKDAGAKEVHMRIGSPPIIAPCYFGIDMKSREELIAASHTVEEIGRIFGTDSLAYLSLEGLLEAVRRAGGKRGYCLACLTSKYPVSVPGEECEC

SEQ ID NO: 30167 - DNA, 1452 bp, Mesorhizobium loti MAFF303099
  CDS (1)..(1452): transl_table=11
gtgctttccgccgaggccgacgaccatttccacgacgaatgcggcgttttcggcattttcggccggcaggacgcagcggccatcgtcacactcggcctgcatgcgctgcagcatcgcggccaggaagcggccggcatcgtttcctatgacggcagccagttccatgtcgaacgccatgtcggcctgatcggcgacactttcaccaagcagcgcgttatcgacagcctgcaaggcaaccgcgccatcggccatacgcgctacgccacgacgggcggcgccggcatgcgcaacatccagcccttcttcgccgagctcgccgatggcggctttgccgtcgcccataatggcaatctgaccaacgccatgacggtgcagcgcgcgctgcagaagcagggcgcgatcttctcctcgacctccgacaccgagacgctcctgcatctggttgcgaccagcaaggaacgcgacctcaactcacgcttcatcgacgccgtgcggcaggtcgaaggtgccttctcgctggtggcgatgacggccaagaagatgatcggctgccgcgatccgctcggcatccggccgctggtgctcggcgacctcgacggcgcttggattctcgcttccgagacctgcgcgctcgacattatcggcgcgcgtttcgtgcgcgacctgaaacccggcgagatggtcgtcgtcacctccaagggcattgaaagcctgttcccgttcgaaccgcagaagacccgcttctgcatctttgaatatgtctatttcgcccggccggattcttcggtcgaaggccgcaacgtctacgaggtgcgcaagcgcatcggcgccgaattggcacaggaaaacccggtcgaggccgacatcgtcgtgccggtgccggattcgggcaccccggcggcgatcggcttcagccaggcggccggcattcccttcgagctcggcatcatccgcaaccactatgtcggccgtaccttcatccagcccggcgattcgatccgccacatgggcgtcaagctgaagcacaacgccaaccgccgcatgatcgagggcaagcgcgtcgtgctggtcgacgattcgatcgtgcgcggcaccaccagccagaagatcgtgcagatggtgcgcgatgccggcgcccgggaggtgcatatgcgcatcgcttcgccgccgaccagcgcctcctgcttctacggcgttgacacgccggagaaatcgaaactgctggcgtcgcgcatgtcggtggaagagatggccgagttcatccgtgtcgattcgctcggcttcctttccatcaacggcctctaccgcgccgtcggcgaggccggccgcaacgatgagcaaccgcaattctgcgacgcctgcttcaccggccagtatccgacccgcctgctcgacttcgaaggccacgacaatgtgcgcacgctgtcgctgctggcgaacagtggggcgtaa

SEQ ID NO: 30168 - protein, 483 aa, Mesorhizobium loti MAFF303099
MLSAEADDHFHDECGVFGIFGRQDAAAIVTLGLHALQHRGQEAAGIVSYDGSQFHVERHVGLIGDTFTKQRVIDSLQGNRAIGHTRYATTGGAGMRNIQPFFAELADGGFAVAHNGNLTNAMTVQRALQKQGAIFSSTSDTETLLHLVATSKERDLNSRFIDAVRQVEGAFSLVAMTAKKMIGCRDPLGIRPLVLGDLDGAWILASETCALDIIGARFVRDLKPGEMVVVTSKGIESLFPFEPQKTRFCIFEYVYFARPDSSVEGRNVYEVRKRIGAELAQENPVEADIVVPVPDSGTPAAIGFSQAAGIPFELGIIRNHYVGRTFIQPGDSIRHMGVKLKHNANRRMIEGKRVVLVDDSIVRGTTSQKIVQMVRDAGAREVHMRIASPPTSASCFYGVDTPEKSKLLASRMSVEEMAEFIRVDSLGFLSINGLYRAVGEAGRNDEQPQFCDACFTGQYPTRLLDFEGHDNVRTLSLLANSGA

SEQ ID NO: 30169 - DNA, 1425 bp, Thermoplasma volcanium GSS1
  CDS (1)..(1425): transl_table=11
gtggattcccggccccaaggatcagatcctataaatgggcaaaagccaagtgaagattgcgcagttgtggggttcaaggggaagataaacgcctataaccccataataactgcacttcgaacattgcaacatagaggccaggaatcggctggtatggctgtttttgacggcaagaaggtaacgttgaaaaaaggaagtggcctagtaacagatgtttttaatcctgcaaccgacgatattaaaggttacgtgggagtaggccatacacgttattcaactgctggatcaaaaaatgtggttaatgctgggccatttgtaatgaactcttctttcggttacataaccatatcccacaacggtgagatagtaaacgctgatgaattgcgtgattccatgaaaaaagaagggatcacgttccagagcgattcagatacagaggttatgctggcagagctttcgagaaatatctcaaagtatggcctaaaaagaggattcgaacagtccatggagagcctaaggggagcttatgcatgcgcaataagcataaatgatcgcctctacgccgtaagggacccaaatgggataaggcctctggttatagggaagaataacgacggatacatagtagcttcagaaagctgcgcaatagatgctctcgaaggcacgttaataaaaaacatcgaaccaggggaagtagttgagatatctgacgaaggcataagaacaattgtaagcaaatctgcaaatcgaatagcccactgcatgtttgagtatgtatatttctcaaggccggatagcgttatagacggcataaacgtttatgccgccagggtaaacatgggcagaatacttgctaaggagagcccagttgaagctgacatagtcgtccctgttccagattcagggcgttctcaagcaataggttattccatggaatctggaatgccttacacagaggggctgattaagaataggtattcggagaggaccttcataatgcctactcagagcgataggaaggccgcgatacatttgaagctaaatcctatacgcgaagtgatagggggaaagaaggtagtgcttgtagatgatagcatagtccgtggaaacactatgaggttcatcgtcggcctaatgaggaaatatggcgcaaaggagatacatgtcagaattggatcgccgcatataatcgcaccatgctattttggtgtcgacatgaagacgaaggatcaattcatagcgcgcggtaaaaccgatgaggagataaacagagaaatcggggccgattcactcgcgtttctttcagttgacggcctcaaacaggcgatatctatgaaaaacaataacctgtgccttgggtgcctcacaggagaatatcctatagatatatcaaagaaactcgcagaaaatattacttcttactag

SEQ ID NO: 30170 - protein, 474 aa, Thermoplasma volcanium GSS1
MDSRPQGSDPINGQKPSEDCAVVGFKGKINAYNPIITALRTLQHRGQESAGMAVFDGKKVTLKKGSGLVTDVFNPATDDIKGYVGVGHTRYSTAGSKNVVNAGPFVMNSSFGYITISHNGEIVNADELRDSMKKEGITFQSDSDTEVMLAELSRNISKYGLKRGFEQSMESLRGAYACAISINDRLYAVRDPNGIRPLVIGKNNDGYIVASESCAIDALEGTLIKNIEPGEVVEISDEGIRTIVSKSANRIAHCMFEYVYFSRPDSVIDGINVYAARVNMGRILAKESPVEADIVVPVPDSGRSQAIGYSMESGMPYTEGLIKNRYSERTFIMPTQSDRKAAIHLKLNPIREVIGGKKVVLVDDSIVRGNTMRFIVGLMRKYGAKEIHVRIGSPHIIAPCYFGVDMKTKDQFIARGKTDEEINREIGADSLAFLSVDGLKQAISMKNNNLCLGCLTGEYPIDISKKLAENITSY

SEQ ID NO: 30171 - DNA, 1701 bp, Arabidopsis thaliana
  CDS (1)..(1701)
atggcggccacaacaagcttctcctcttccctctctttaatcactaaaccaaacaattcttcttacaccaatcaacctctccctctcttccccaaacccttccttaaacctccccatctctctctccttccttctcccctctcctctcctcctccttcactcatccatggagtctcctcctacttctcctctccttcaccatccgaagacaattctcataccccttttgattaccacaacgacgaagacgacgaaaagcctcgagaagagtgcggtgtcgttggaatctatggagatccagaagcttcacggctctgttacttagctctccacgcacttcaacatcgtggtcaagaaggtgcaggtattgtaacagttagtcccgagaaagttcttcaaaccattacaggtgttggtttagtctctgaggttttcaacgaatcaaaacttgatcaattacctggtgaatttgctattggtcatgttcgttactcaacagctggagcttctatgctcaagaacgttcagcctttcgtcgccggttatcgattcggttctatcggtgttgcccacaatggtaatttagtaaattacaaaactttgagagctatgcttgaagagaacggttctatcttcaatactagctctgatactgaggttgtgcttcatttgattgctatttctaaagctagacctttttttatgaggattattgatgcttgtgagaaacttcaaggtgcttattcaatggtgtttgttactgaggataagcttgttgctgttcgtgatccttatgggtttagaccgttagttatgggtaggagaagtaatggagctgttgttttcgcttcggagacttgtgctcttgatttgattgaagctacttatgagagagaggtttatcctggtgaggttttggttgtggataaggatggtgtcaagtctcagtgtttgatgcccaagtttgagcctaagcaatgtattttcgaacatatctacttctcgttgcctaactcgattgtgtttggtcggtccgtgtatgaatctaggcatgtttttggtgagattttggctaccgagtcgcctgttgagtgcgatgttgtcatcgctgtgcctgactctggtgttgtggctgctctcgggtacgctgcgaaatccggtgtgccgtttcaacaggggttgattaggtctcattacgtagggaggacgttcattgagccgtcacagaagattagagactttggtgtgaagcttaagttgtctcctgttcgtggtgttttagaagggaagagagttgttgtggtggatgattcgattgttagaggcacaacttcgtctaagattgtgcgtttattgagagaagctggtgcaaaagaggttcatatgaggattgctagtcctcctatagtagcttcttgttactatggtgttgatacgcctagctcagaggagttgatatccaatagattgagtgttgaggagattaacgagttcatcgggagtgactctcttgcgtttctatcgttcgatacgttgaagaaacacttggggaaagactctaagagcttctgctatgcgtgcttcacgggtgactatcccgtgaagccaacagaagttaaggtgaaacgaggaggaggggatttcattgatgacggtctcgttggtagcttcgaaaacatcgaagcaggttgggttcgataa

SEQ ID NO: 30172 - protein, 566 aa, Arabidopsis thaliana
MAATTSFSSSLSLITKPNNSSYTNQPLPLFPKPFLKPPHLSLLPSPLSSPPPSLIHGVSSYFSSPSPSEDNSHTPFDYHNDEDDEKPREECGVVGIYGDPEASRLCYLALHALQHRGQEGAGIVTVSPEKVLQTITGVGLVSEVFNESKLDQLPGEFAIGHVRYSTAGASMLKNVQPFVAGYRFGSIGVAHNGNLVNYKTLRAMLEENGSIFNTSSDTEVVLHLIAISKARPFFMRIIDACEKLQGAYSMVFVTEDKLVAVRDPYGFRPLVMGRRSNGAVVFASETCALDLIEATYEREVYPGEVLVVDKDGVKSQCLMPKFEPKQCIFEHIYFSLPNSIVFGRSVYESRHVFGEILATESPVECDVVIAVPDSGVVAALGYAAKSGVPFQQGLIRSHYVGRTFIEPSQKIRDFGVKLKLSPVRGVLEGKRVVVVDDSIVRGTTSSKIVRLLREAGAKEVHMRIASPPIVASCYYGVDTPSSEELISNRLSVEEINEFIGSDSLAFLSFDTLKKHLGKDSKSFCYACFTGDYPVKPTEVKVKRGGGDFIDDGLVGSFENIEAGWVR

SEQ ID NO: 30173 - DNA, 1686 bp, Arabidopsis thaliana
  CDS (1)..(1686)
atggcggccacctctagcatctcttcttctctatctctcaatgctaaacccaacaagctctctaacaacaacaacaacaataagcctcaccgtttcctccgtaatcccttccttaacccctcctcctcctctttctctcctcttccggcttctatctcctcttcttcttcttctccttcgtttccgctcagagtttcaaaccctcttaccctgttggcggcagacaacgatgattatgacgagaagcctcgggaagagtgtggagttgtcggaatctacggtgactcagaagcttcacgactctgttacttagctctccatgcgcttcagcatcgaggtcaagaaggtgcaggtattgttaccgttagtaaagataaggttcttcagaccattacaggtgttggtttggtctctgaggttttcagtgaatccaaactcgatcaattaccaggagacatagccattggtcatgtcaggtactcgactgctggttcttctatgctcaagaacgttcagccgtttgttgctggttatcgatttggctctgttggtgttgctcacaatggcaatttagtgaattacacgaaattgagagctgatttagaggaaaatggttcgattttcaatactagctctgatactgaggttgtgcttcatttgattgccatttctaaagctagaccctttttcatgagaattgttgatgcttgtgagaagcttcaaggtgcttattcgatggtgtttgtgactgaggataagcttgttgctgttcgtgacccacatgggtttaggcctttagttatgggtaggagaagtaatggagctgttgtgtttgcttctgagacttgtgctcttgatttgattgaagctacttatgagagagaggtttatcctggtgaggttttagttgtggataaagatggtgtcaaatgtcagtgtttgatgcctcatcctgagccaaagcaatgcattttcgaacatatttacttctcgttgcctaattcgattgtctttggtcggtctgtgtatgagtctaggcatgtctttggtgagattttagctactgagtcacctgttgattgtgatgtggtgatcgctgtgcctgactcgggtgttgtggctgctcttggttacgcggctaaagctggtgtagcgtttcagcaaggtttgattaggtctcattatgttggaaggactttcattgagccgtctcagaaaatcagagattttggagtgaagctgaagctatcgccagtccgaggagttttagaagggaaaagagttgttgttgttgatgattcgattgttagaggaacaacttcgtccaagattgtgcgtttattgagagaagcgggtgcgaaagaggttcacatgaggatcgcgagtcctcctattattgcatcttgttactacggagtggacacgcctagctcaaatgagttgatatcgaataggatgagtgttgatgaaatcagggattacatcggatgtgattcccttgcgtttttgtcgtttgagacgttaaagaaacatttgggggaagattctagaagcttctgctatgcatgcttcacgggggactatccggtgaagcctacagaggataaggtgaagcgaggaggagattttatcgatgatggtctcgttggaggaatccacaacattgaaggaggttgggtacggtag

SEQ ID NO: 30174 - protein, 561 aa, Arabidopsis thaliana
MAATSSISSSLSLNAKPNKLSNNNNNNKPHRFLRNPFLNPSSSSFSPLPASISSSSSSPSFPLRVSNPLTLLAADNDDYDEKPREECGVVGIYGDSEASRLCYLALHALQHRGQEGAGIVTVSKDKVLQTITGVGLVSEVFSESKLDQLPGDIAIGHVRYSTAGSSMLKNVQPFVAGYRFGSVGVAHNGNLVNYTKLRADLEENGSIFNTSSDTEVVLHLIAISKARPFFMRIVDACEKLQGAYSMVFVTEDKLVAVRDPHGFRPLVMGRRSNGAVVFASETCALDLIEATYEREVYPGEVLVVDKDGVKCQCLMPHPEPKQCIFEHIYFSLPNSIVFGRSVYESRHVFGEILATESPVDCDVVIAVPDSGVVAALGYAAKAGVAFQQGLIRSHYVGRTFIEPSQKIRDFGVKLKLSPVRGVLEGKRVVVVDDSIVRGTTSSKIVRLLREAGAKEVHMRIASPPIIASCYYGVDTPSSNELISNRMSVDEIRDYIGCDSLAFLSFETLKKHLGEDSRSFCYACFTGDYPVKPTEDKVKRGGDFIDDGLVGGIHNIEGGWVR

SEQ ID NO: 30175 - DNA, 1599 bp, Arabidopsis thaliana
  CDS (1)..(1599)
atggccttctctgtagaagaaatctcgtctattctccctaacagtttatccgcaaaccctaggaatgtttctcaaaatactatttccccttcctttttcaagccctcccttaaaccgtacgcttccaaaaccctaatctcattgtcatgtagacgctcactttcccctgttttctcggcgggaacatatgtcactaacgttgacgaagatgacaagcttcacgaagaatgcggagttgtcggaatccatggagaccctgaagcttcccgtctctcttacttggctctacacgcactgcaacaccgtggccaagaaggagcaggaattgtagccgctaatcaaaacggtctcgaatcaatcacaggggtcggattagtctcagatgtgttcaccgagtcaaaactaaacaatcttcctggcgacatagcgatagggcatgtccggtactcaacttccggagcctctatgctcaagaatgttcagcctttcatcgctagctgcaagctaggatcactcgcagtagctcacaatggtaatttcgtgaattacaagcaactgaagacaaagctcgaggagatgggttcaatcttcatcacaagttctgataccgagctcgttcttcacctgatcgccaaatctaaggctaagacgtttcttttgagggtcattgatgcttgtgagaagcttagaggtgcttactcgatggttttcgtctttgaagacaagcttattgctgttcgtgacccttttgggtttagaccacttgtgatgggcagaagaagcaacggagcagttgtttttgcctccgagacttgtgctctggacctgattgatgcgacttatgaacgtgaagtgtgtcccggtgagattgtggtcgtggatagaaaccatggagacagttcaatgttcatgatctctcaccctgaacagaaacagtgcgtttttgagcatggttacttctcacagcccaactcaattgtctttggccgttctgtgtatgaaacacgccgcatgtacggcgagatcctagccaccgtggcacctgtcgattgtgatgttgtcattgcagtgccagactcggggacagtggctgctcttggatatgcagccaaagctggagtgccgttccagattggtcttctgagatcacactatgctaaacgtacgtttatagagccgactcaggaaatccgtgattttgcagtgaaggtgaagctatctcctgttcgagcagtccttgaagggaagcgggtggtagtagtggacgactctattgtccgcggtaccacgagtttgaagatagttcggatgcttagagatgccggagcaaaggaggttcatatgagaatcgcattgccgccgatgattgcatcgtgttactatggagtggacaccccgaggagccaagagttgatctctagtaagatgagcgttgaggcgatccagaagcatattaattgtgattctttggcgtttctaccattagatagcttgaaaggagtctatggaccagtcgagtcacacaggtattgctatgcctgctttactgggaagtaccctgtgaccaaaacagagtctgaggaggccgacgcttcatga

SEQ ID NO: 30176 - protein, 532 aa, Arabidopsis thaliana
MAFSVEEISSILPNSLSANPRNVSQNTISPSFFKPSLKPYASKTLISLSCRRSLSPVFSAGTYVTNVDEDDKLHEECGVVGIHGDPEASRLSYLALHALQHRGQEGAGIVAANQNGLESITGVGLVSDVFTESKLNNLPGDIAIGHVRYSTSGASMLKNVQPFIASCKLGSLAVAHNGNFVNYKQLKTKLEEMGSIFITSSDTELVLHLIAKSKAKTFLLRVIDACEKLRGAYSMVFVFEDKLIAVRDPFGFRPLVMGRRSNGAVVFASETCALDLIDATYEREVCPGEIVVVDRNHGDSSMFMISHPEQKQCVFEHGYFSQPNSIVFGRSVYETRRMYGEILATVAPVDCDVVIAVPDSGTVAALGYAAKAGVPFQIGLLRSHYAKRTFIEPTQEIRDFAVKVKLSPVRAVLEGKRVVVVDDSIVRGTTSLKIVRMLRDAGAKEVHMRIALPPMIASCYYGVDTPRSQELISSKMSVEAIQKHINCDSLAFLPLDSLKGVYGPVESHRYCYACFTGKYPVTKTESEEADAS

SEQ ID NO: 30177 - DNA, 1398 bp, Aquifex aeolicus VF5
  CDS (1)..(1398): transl_table=11
atgtgcggagttgcaggagtctttaattccccttacgcagcggaatatgcccttttaatgatttactcactccagcacaggggacaggaaagtgtagggataagttcctctgatgaaaaggaaatttacaccgttaaaaaacccggaagggttttagaagcgataaaaaaagaagaccttgaaaaattaaaaggaagtatagcgatagcacacgtcaggtactcaacagcgggaaacgcaggaggctttaacgcccagcctcttgtgagggaaacacctctcggaaaagttgcggtagtacacaacggaaacctcgtaaacttcctaactttgagaaaggagcttgaagataaaggtataaagttcaattacaactctgacagcgaactctttttagcacttcttgaggaaggaaggacctatatacctgaaggtgtaacgcttcatccggaggacaaggatttccttccctacatcttttacgccctttctagagttaaaggtgcctacagtttgatatacctctttagggacaagctcgtagttgcgagggatccatacggtttcagacccttagccttgggaaggaagaaaaacaccattctggtagcttcggagagctgtgcctttgacatacttgaagctgaattctggagagaagtaaaaccgggtgaagttctcgtaatagacaaaaaaggaaagaggagctacaggatattcagttcacccagaaaagctatgtgcatatttgagtttgtgtacttctcaagaccggacagctacatattcggcgactgggtatacaacgtgagaaaagaaatgggaagacagcttgcgagagaagataacatagaagcggacgttgtcattcccgttcccgattctggagtcgttccggcactcggatacgcggaggaaaagggactgccttttgagtacgggcttataagaaaccactacgtgggaaggagctttatagaaccaacacccgaactcagaaacttaagagttttaatgaagctctctcccaacagagccgttctgcaagggaagagagttatagttatagatgactccctcgtgagaggaactacctcaaagaggatagtcagcatgctcaggagggcaggtgctaaggaaatacacatgaggatagcctctccgcccgtcgtgggaccctgttactacggcatagacacgcccacaaaagaggagttaatagcaaacaaaatgccgatagaggatatagccaagttcataggtgtagattccctgaagtacctttctttagaaggcttgagaaagtgtgttgataagcctgaagatttctgcgacgcatgctttagcctgaattatcccgtagaagttgaagataatgtcccctcaaagatacgctaa

SEQ ID NO: 30178 - protein, 465 aa, Aquifex aeolicus VF5
MCGVAGVFNSPYAAEYALLMIYSLQHRGQESVGISSSDEKEIYTVKKPGRVLEAIKKEDLEKLKGSIAIAHVRYSTAGNAGGFNAQPLVRETPLGKVAVVHNGNLVNFLTLRKELEDKGIKFNYNSDSELFLALLEEGRTYIPEGVTLHPEDKDFLPYIFYALSRVKGAYSLIYLFRDKLVVARDPYGFRPLALGRKKNTILVASESCAFDILEAEFWREVKPGEVLVIDKKGKRSYRIFSSPRKAMCIFEFVYFSRPDSYIFGDWVYNVRKEMGRQLAREDNIEADVVIPVPDSGVVPALGYAEEKGLPFEYGLIRNHYVGRSFIEPTPELRNLRVLMKLSPNRAVLQGKRVIVIDDSLVRGTTSKRIVSMLRRAGAKEIHMRIASPPVVGPCYYGIDTPTKEELIANKMPIEDIAKFIGVDSLKYLSLEGLRKCVDKPEDFCDACFSLNYPVEVEDNVPSKIR

SEQ ID NO: 30179 - DNA, 1296 bp, Thermotoga maritima MSB8
  CDS (1)..(1296): transl_table=11
atgtgcggaatcgcaggagtctggaatgtgaaagatgccttttctgtccttcacgacgtgcttctcggtcttcagcatagaggacaggaaagtgtgggtgttgtggtagacgggttcaaaacgataaaaggaaaaggactcgtagacaccgttctcaccgaagacaggtgggaagacgctgaaaagggtattggacacgtaaggtactccacggcaggatcgctcgaggacattcagccaatcgtggcgttcacgagaaagggaaggctcgcgatcgctcacaacggaaacatacccaacggcgaaaagtggatagagatgctcaaagaaaaaggagcggttttccagagctcgctcgactcggaggtcttccttcatctcatctcgatgtctgaaggtgacctgaaagagtccatagtgaaagcgctgaagaaagtccctcttgcctactcacttctcattctacacgaagaattcctcgctgcggcgagagacccatacggcgtccgtcccctgttctatggaaaatacggtgatggaatcgttgtggcatcggaagacgcagcgctgaaagcgataggtgtggaagacatagaagaagttccctctggaacggtcgtgttcttctcgaacaaaggcacagaaacggtgaggttctccaaaaaagaaaagcggttctgctccttcgaattcatctatttcgcgaggccggacagtcactttctcgatcagagtgtacacatagcccgttacagaatgggtgaagaactctacagagaaaacccgatagaagcggacgtggtcgttccggtgctggactccggactttccggagcgatgggattttcttcggcttcgggtatacctctcgacatcggtctcatgaggaacagatatgtgggaagaagtttcatcatgccggtggacagggaaaagatcgtcaagaaaaaactcgtccccatagaagacgttgtgagtggaaagagggttgttgtaatcgatgattcgatcgtcagaggaacaaccatgggcatcatcgtgaagatattgagagaggcgggtgcgaaggaagtacacgttggcatacactctccacctgtacgttttccctgtttctacggaatagataccgccagaaagaaagagctcgtcgcgggagaacgtgccgtggaagaagtgaaaaaaatagtcaacgcagactctctcttttacctttcactcgaagggttgaaaagagccatcgggaggagtgaactgtgtgtagcgtgcttcagcggagagtacctccacgaatag

SEQ ID NO: 30180 - protein, 431 aa, Thermotoga maritima MSB8
MCGIAGVWNVKDAFSVLHDVLLGLQHRGQESVGVVVDGFKTIKGKGLVDTVLTEDRWEDAEKGIGHVRYSTAGSLEDIQPIVAFTRKGRLAIAHNGNIPNGEKWIEMLKEKGAVFQSSLDSEVFLHLISMSEGDLKESIVKALKKVPLAYSLLILHEEFLAAARDPYGVRPLFYGKYGDGIVVASEDAALKAIGVEDIEEVPSGTVVFFSNKGTETVRFSKKEKRFCSFEFIYFARPDSHFLDQSVHIARYRMGEELYRENPIEADVVVPVLDSGLSGAMGFSSASGIPLDIGLMRNRYVGRSFIMPVDREKIVKKKLVPIEDVVSGKRVVVIDDSIVRGTTMGIIVKILREAGAKEVHVGIHSPPVRFPCFYGIDTARKKELVAGERAVEEVKKIVNADSLFYLSLEGLKRAIGRSELCVACFSGEYLHE

SEQ ID NO: 30181 - DNA, 1422 bp, Bacillus halodurans C-125
  CDS (1)..(1422): transl_table=11
atgtttgctgaaatcaaaggcttaaacgaagaatgtggtgtgtttgcgatttggggtcatgaagatgcggcacaagtagcttattacggcttgcacagcctccaacatcgcgggcaagaaggcgctggaatcgttgtgacagatggccatcaactgtcggttcacaaaggactcggtttagttaatgatgtctttaatcctgatatttttgattcgttaaaaggaaaggcagctgtcggtcacgttcgctatgcgacggcaggaggtgggggctatgctaacgttcagccccttgtcttccgttcacagattggtagccttgcgatcgcccataacggaaatctcgtcaatgcgaaccatttaaaaaatcaattggagaatcagggaagtatttttcaatcaacgtccgatacagaagtgctcgcccatctcattaagcgaagcggatatcaccatattcgggagcagttgaaaagctcgctctccatgcttaaaggagcctatgcctttgcggtgatgacggaacgtgagctcatggtcgcacttgatccgaatggtttgcgccccctttccatcggtcgattgggagaagcctacgtcgttgcctctgaaacatgtgcctttgacgtcatcggtgctgaatatgtgcgtgaagtggagcctggggagctcgtgacgattaacgacgacggtcttacgtcagagcggtttgtaggcgaagcggcccgtgccatttgtagcatggagtacgtttacttcgcacgtcctgatagcaacgtggatacgatcaatgttcatacagctcggaaaaatttagggaagcaactcgcgattgaagctccagtagaagcagatgtcgtgactggggtacctgattccagtatctctgcggcgattggttatgctgagcagtcagggattccgtatgagttaggcttaatcaaaaatcgttatgtaggacgaacgtttattcagccgtcccaagccttgcgcgaacaaggggtcaaaatgaagctttccgctgtacgtggagttgtggaaggcaagcgtgtcgtcatgattgatgattccatcgtgcgtgggacgacgagccgacgaattgtcaacatgctccgtgaagcgggagcgaaagaggtgcatgtccgcattagtgcaccgccgattaagcatccgtgcttttatgggattgatacatcaacaaaagaagagttaattgcagccactcattcgattgaagagatgcgcaagcaaatgggtgcagactcgttatccttcttaagcttagaaggtcttgttaaaggggttggccgttcgaatgaagtgtcttcatgcggacaatgtttagcgtgctttaccggacaatacccgacagaaatttatcctgatacacttcatccacacgacaagcttttaccggtatag

SEQ ID NO: 30182 - protein, 473 aa, Bacillus halodurans C-125
MFAEIKGLNEECGVFAIWGHEDAAQVAYYGLHSLQHRGQEGAGIVVTDGHQLSVHKGLGLVNDVFNPDIFDSLKGKAAVGHVRYATAGGGGYANVQPLVFRSQIGSLAIAHNGNLVNANHLKNQLENQGSIFQSTSDTEVLAHLIKRSGYHHIREQLKSSLSMLKGAYAFAVMTERELMVALDPNGLRPLSIGRLGEAYVVASETCAFDVIGAEYVREVEPGELVTINDDGLTSERFVGEAARAICSMEYVYFARPDSNVDTINVHTARKNLGKQLAIEAPVEADVVTGVPDSSISAAIGYAEQSGIPYELGLIKNRYVGRTFIQPSQALREQGVKMKLSAVRGVVEGKRVVMIDDSIVRGTTSRRIVNMLREAGAKEVHVRISAPPIKHPCFYGIDTSTKEELIAATHSIEEMRKQMGADSLSFLSLEGLVKGVGRSNEVSSCGQCLACFTGQYPTEIYPDTLHPHDKLLPV

SEQ ID NO: 30183 - DNA, 1515 bp, Pasteurella multocida subsp. multocida str. Pm70
  CDS (1)..(1515): transl_table=11
atgtgtggtattgttggtattgttagccaaagcccagttaaccaatcaatttatgatgcgttaaccttattgcaacaccgcgggcaagacgccgccgggattgtaaccgtagatgatgaaaaccgattccgcttgcgtaaagcgaacgggttagtcagcgatgtatttgaacaagttcatatgttacgtttacaaggcaatgctggcattggacatgttcgttatcctactgctgggagctcaagtgtctctgaagcgcaacctttttatgtaaattcgccttatggcttaaccttagtgcataatggtaacttgaccaattcaagtgaattaaaagaaaagttatttcgtcgcgcgcgtcgccatgtaaataccaattcagattctgaattattactcaatatcttagccaatcaccttgatcacttcgaaaaataccaattagatccgcaagatgtatttagtgctgtcaaacaaacgcatcaggatattcgtggtgcttatgcttgtatcgccatgattattggtcatggtatggtcgcgtttcgcgatccgaacggtatccgtccattagtgttagggaaacgcgaggaaaatggcaaaacagagtatatgtttgcctccgaaagtatcgcattagatacagtgggttttgaatttgtacgagatgtacaacccggcgaagcgatttatgtcacgtttgaaggggaaatgtatgcccagcaatgtgctgacaaaccaacattaacaccttgtatttttgaatatgtctattttgcacgtccagactcctgcatcgatggggtttctgtttatgctgcccgtgttcatatgggacagcgtttaggtgaaaaaattgcacgggaatgggcggatgtggatgatattgatgtggtcattcctgtgcctgaaacctctaacgatattgctttacgtattgcgcgcgtgttaaataaaccgtatcgtcaaggttttgtgaaaaatcgctatgtggggcgtacgtttattatgccgggtcaggcattgcgagtcagttctgttagacgtaaactcaataccattgcttcagaatttaaagataagaatgtgttattagttgacgactcgattgtacgtggtaccacgtctgaacaaattgtcgaaatggcgagagcggcaggtgcgaagaaaatttattttgcctctgctgcaccggaaattcgttatccaaatgtgtatggtattgatatgccgaccaaaaatgaattgatcgcttatggtcgtgatgtagatgaaattgctaaattaattggtgtggataaattgattttccaagatttggatgcgttaaccggttctgtgcaacaagaaaatccaagtattcaagactttgattgttcggtgtttacaggggtttatgtgacgggtgatattacacctgaatatctggataatattgcagaacagcgtaatgatatcgccaagaaaaagcgtgaaaaagatgctaccaatcttgaaatgcacaatgaaaaataa

SEQ ID NO: 30184 - protein, 504 aa, Pasteurella multocida subsp. multocida str. Pm70
MCGIVGIVSQSPVNQSIYDALTLLQHRGQDAAGIVTVDDENRFRLRKANGLVSDVFEQVHMLRLQGNAGIGHVRYPTAGSSSVSEAQPFYVNSPYGLTLVHNGNLTNSSELKEKLFRRARRHVNTNSDSELLLNILANHLDHFEKYQLDPQDVFSAVKQTHQDIRGAYACIAMIIGHGMVAFRDPNGIRPLVLGKREENGKTEYMFASESIALDTVGFEFVRDVQPGEAIYVTFEGEMYAQQCADKPTLTPCIFEYVYFARPDSCIDGVSVYAARVHMGQRLGEKIAREWADVDDIDVVIPVPETSNDIALRIARVLNKPYRQGFVKNRYVGRTFIMPGQALRVSSVRRKLNTIASEFKDKNVLLVDDSIVRGTTSEQIVEMARAAGAKKIYFASAAPEIRYPNVYGIDMPTKNELIAYGRDVDEIAKLIGVDKLIFQDLDALTGSVQQENPSIQDFDCSVFTGVYVTGDITPEYLDNIAEQRNDIAKKKREKDATNLEMHNEK

SEQ ID NO: 30185 - DNA, 1416 bp, Methanocaldococcus jannaschii DSM 2661
  CDS (1)..(1416): transl_table=11
atgtgtgggatatttggaatctactcttatgaaaggttaaatgtagctaaaaaaatttattatgggttgtttgctttacagcatagagggcaggaaggggctggaattgctacaagtgatgggaaaaatatacactactataaaaatattggattagttacagatgtttttaaaaatgagacattacaaaacttatttggctatattggaattggacatgtaagatattcaacaacgggaggaaaggctgttgaaaactgtcagccgtttgtagttaaaagttcatttggtaatatagctatagcccataatggagatttagtaaattcagacgaattaagaagagaattagagatgaaggggcatatattcacttcttcaactgactctgaagttatagctcaacttttggttagagaattgttaaaaacatctgataagattgaggcaataaaaaatacattaaaaaagctcgttggagcttattcacttttaataatgtttaatgattccttaattgcagtaagagacccttggggctttaaaccattgtgtattggaagagatgagagcaatatctatatatcatctgaggattgtgcattaacaaccttagatgctgaatttgttaaagatattgagccaggagaaattatagaaattaaagacggggaaataatatctcataaattagattatggtgtttctgaatacaaccctgtgaatgtcgatgtgccatgtatatacagaggagcggcaacttgtatgtttgagtatgtgtattttgcaagacctgactcaacaattgatggtattagcgtctataaggttagaaagaggattggaaaaattttggctaaagaacatccagtagatgctgatgttgtttctccaatccccgattcaggagtcacatttgccttaggattttctgaagagtcagggattccatactatgaaggtttaataaagaacagatatgttggaagaacttttattcttccatcccaaaatgagagagaattggcagtaaggttaaaattaagtccagtaaaaagtgtattggaagggaagagggttgttttggttgatgatagtattgttagaggaacaacatcaagaagaattgtaaatatggttagaaaagctggagctaaggaggtgcatttaagaattggctgtcctaagattatatccccttgctattatggtatagatatggctactaaaaaggaacttattgcctcaaacaaaacagaagaagagatagggaaagctattggagttgattctattggatatttatcattagagggattagttaaagctataggtagaaaagatttatgtttagcttgtgtaactggaaaatatccaactgaagttaattttgaaaagatattggggagagaataa

SEQ ID NO: 30186 - protein, 471 aa, Methanocaldococcus jannaschii DSM 2661
MCGIFGIYSYERLNVAKKIYYGLFALQHRGQEGAGIATSDGKNIHYYKNIGLVTDVFKNETLQNLFGYIGIGHVRYSTTGGKAVENCQPFVVKSSFGNIAIAHNGDLVNSDELRRELEMKGHIFTSSTDSEVIAQLLVRELLKTSDKIEAIKNTLKKLVGAYSLLIMFNDSLIAVRDPWGFKPLCIGRDESNIYISSEDCALTTLDAEFVKDIEPGEIIEIKDGEIISHKLDYGVSEYNPVNVDVPCIYRGAATCMFEYVYFARPDSTIDGISVYKVRKRIGKILAKEHPVDADVVSPIPDSGVTFALGFSEESGIPYYEGLIKNRYVGRTFILPSQNERELAVRLKLSPVKSVLEGKRVVLVDDSIVRGTTSRRIVNMVRKAGAKEVHLRIGCPKIISPCYYGIDMATKKELIASNKTEEEIGKAIGVDSIGYLSLEGLVKAIGRKDLCLACVTGKYPTEVNFEKILGRE

SEQ ID NO: 30187 - DNA, 1506 bp, Pseudomonas aeruginosa PAO1
  CDS (1)..(1506): transl_table=11
atgtgtggcatcgtcggtatcgtgggcaagtcgaacgtcaatcaggcgctgtatgacgcgctcaccgtcctccaacatcgcggccaggacgctgccggtatcgtcacctgccatgacgataagctgtacctgcgcaaggacaacggcctggtccgcgacgtcttccagcagcgccacatgcagcgcctgatcggcagcgtcggcatcggccatgtgcgttacccgaccgccggcagctccagctcggcggaagcgcagccgttctacgtcaactcgccctacggcatcaccctggcgcacaacggcaacctgaccaatgtcgagcagttggccaaggaaatctacgaatccgacctgcgccacgtgaacaccaactccgattcggaagtgctgctcaacgtgttcgcccacgagctggcggtgcgcaacaagctgcagcccaccgaggaggacatcttcgccgcggtttcctgcgtgcacgaccgttgcgtcggcggctacgcggtggtggcgatgatcaccggccatggcatcgtcggtttccgcgaccccaatgcgatccgtccgatcgtcttcggccagcggcataccgagaacggcgtcgaatacatgatcgcctccgagagcgtggccctggacgtactcggcttcaccctgatccgcgacctggcgccgggcgaggcggtgtacatcaccgaggaaggcaagctctatacccgccagtgcgccaaggcaccgaagtacgcgccgtgcatcttcgagcacgtctacctggcgcgtccggattcgatcatggacggcatctcggtgtacaaggcgcgcctgcgcatgggcgagaagcttgccgacaagatcctccgcgagcgtcccgaccacgacatcgacgtggtcatcccgatcccggacaccagccgcaccgcggcgctggaactggccaaccggctcggcgtgaagttccgcgagggcttcgtcaagaaccgctacatcggccgcaccttcatcatgcccggccaggcggcgcggaagaaatccgtgcggcagaagctcaacgccatcgagctggagttccgcggcaagaacgtgatgctggtggatgactccatcgtccgcggcaccacctgcaagcagatcatccagatggcccgcgaggccggggcgaagaacgtctacttctgctccgccgcgccggccgtgcgctaccccaacgtctacggcatcgacatgccgagtgcgcacgagctgatcgcgcacaatcgcagcaccgaggacgtcagcaagctgatcggcgccgactggctggtctaccaggacctgcccgacctgatcgacgcggtcggcggcggcaagatcaagatcgatcacttcgactgcgccgtgttcgacggcgagtacgtgaccggcgacgtcaacgaggcctacctgaaccggatcgaacaggcgcgcaacgatgcgaccaaggccaagagccaggcggtcagcgcgatcatcgatctgtacaacgactga

SEQ ID NO: 30188 - protein, 501 aa, Pseudomonas aeruginosa PAO1
MCGIVGIVGKSNVNQALYDALTVLQHRGQDAAGIVTCHDDKLYLRKDNGLVRDVFQQRHMQRLIGSVGIGHVRYPTAGSSSSAEAQPFYVNSPYGITLAHNGNLTNVEQLAKEIYESDLRHVNTNSDSEVLLNVFAHELAVRNKLQPTEEDIFAAVSCVHDRCVGGYAVVAMITGHGIVGFRDPNAIRPIVFGQRHTENGVEYMIASESVALDVLGFTLIRDLAPGEAVYITEEGKLYTRQCAKAPKYAPCIFEHVYLARPDSIMDGISVYKARLRMGEKLADKILRERPDHDIDVVIPIPDTSRTAALELANRLGVKFREGFVKNRYIGRTFIMPGQAARKKSVRQKLNAIELEFRGKNVMLVDDSIVRGTTCKQIIQMAREAGAKNVYFCSAAPAVRYPNVYGIDMPSAHELIAHNRSTEDVSKLIGADWLVYQDLPDLIDAVGGGKIKIDHFDCAVFDGEYVTGDVNEAYLNRIEQARNDATKAKSQAVSAIIDLYND

SEQ ID NO: 30189 - DNA, 1500 bp, Lactococcus lactis subsp. lactis Il1403
  CDS (1)..(1500): transl_table=11
atgtttggcaaagaacagacgcttgatttaagagtgctggggaagaattcgtccaatgaaaatagttggtggcaacaacatccagatgacgaacgatctcatttaaatgaagaatgtggacttttcggtgttttgggacatcctgatgctgctcgcctgacctattttggacttcatgctctccaacatcgcgggcaagaaggcgcagggattttggtcaataataatggcaaactcaatcgtcatcgtggtctgggtctggtcacagaagttttccgtgacgaaaaagatttggaagagctgacaggctcgtcagccattggacacgtccgttatgccacggctggttcagcaaatatcaataatattcagcctttccagtttgaatttcatgacggagcacttggacttgcccacaatggaaatttaaccaacgcccaatcattgcgctgtgaacttgaaaaatctggggcaatcttttctagtaattcagacacggaaattctcatgcacttgattcgccgtagtcatcatccagaatttatgggcagagtcaaagaagcgctcaatacggtcaaaggtggctttgcctatctcattatgactgaaaactcaattgtcgcagcccttgatcctaatggatttcgaccactctcaatcggaaaaatgagcaatggtgcgctcgttgtggcctcagaaacctgtgcttttgatgtcgttggtgccacttggattcaagatgttcaacccggtgaaatcattgaaattaatgacgacggcattcatgtggaccaatttactgacagcaccaacatgaccatttgttcaatggaatacatctattttgcccgtcctgacagtaatattgctggagttaatgttcatactgccagaaaacgttcaggaaaaattttagcccaagaagcccaaattgatgctgatattgtcatcggtgtgcctaattcatcactcagtgccgcttcaggctacgctgaagaatctggcttgccttacgaaatgggcctgattaaaaatcagtatgtggcaagaaccttcattcaaccgactcaagaacttcgtgaacaaggcgttcgcatgaaattgagtgctgttcgaggtgttgtagaaggcaaacgtgtcattatggtggatgatagtattgtgcgtgggacaaccagccgtcgcattgtcaaactcctcaaagacgcaggcgccgctgaagttcatgtggcaatcgccagtcccgctctcaaatatccttgcttttatggcattgatattcaagatcgtgacgaactcatcgcagctacacacacgactgatgaaatcagagaagctatcggagcagatagtctgacctatctcagccagacaggacttgtcgaggcgattggtcatgataaactttgcttgtcatattttgatggcgaatatccaacgccgctttatgattatgaagctgactatttggaatcgttagcgaaaaatagcgtgaaatga

SEQ ID NO: 30190 - protein, 499 aa, Lactococcus lactis subsp. lactis Il1403
MFGKEQTLDLRVLGKNSSNENSWWQQHPDDERSHLNEECGLFGVLGHPDAARLTYFGLHALQHRGQEGAGILVNNNGKLNRHRGLGLVTEVFRDEKDLEELTGSSAIGHVRYATAGSANINNIQPFQFEFHDGALGLAHNGNLTNAQSLRCELEKSGAIFSSNSDTEILMHLIRRSHHPEFMGRVKEALNTVKGGFAYLIMTENSIVAALDPNGFRPLSIGKMSNGALVVASETCAFDVVGATWIQDVQPGEIIEINDDGIHVDQFTDSTNMTICSMEYIYFARPDSNIAGVNVHTARKRSGKILAQEAQIDADIVIGVPNSSLSAASGYAEESGLPYEMGLIKNQYVARTFIQPTQELREQGVRMKLSAVRGVVEGKRVIMVDDSIVRGTTSRRIVKLLKDAGAAEVHVAIASPALKYPCFYGIDIQDRDELIAATHTTDEIREAIGADSLTYLSQTGLVEAIGHDKLCLSYFDGEYPTPLYDYEADYLESLAKNSVK

SEQ ID NO: 30191 - DNA, 1545 bp, Neisseria meningitidis MC58
  CDS (1)..(1545): transl_table=11
atgtgcggcgtattaggtttggtcagtcatgaacccgtgaaccagcttctgtacgacggcttgcagatgttgcagcacagggggcaggatgcggcgggcattgcaacggcggaaggcggtaccttccatatgcacaaaggcaaaggcatggtgcgcgaagtgttccgcacacgcaatatgcgcgatttgaccggcaacgccggcatcgcccacgtccgttatcctactgcgggcaacgcaggcagcagcgcggaggcgcagcctttctacgtcagctcgccgttcggcatcgttttggcgcacaacggcaacctcaccaacactgccgaactgtatgaaaacgtgtgtaacaaacacctgcgccacgtcaacaccagctccgattccgaagtcttgctcaacgtattcgcgcacgaattacgccgcgaagtctctaaaaacgccgacccgcaccggctcaatgccgacaatattttcaacgccgttgcccaagtccaccgcctggtgcgcggcgcatacggtgtgattgccatgattgcgggctacggtatgctcgccttccgcgacccttacggcatccgcccgctggtattgggttcgcaaaccgacagcgaaggcagaaaatcctatgccgtcgcctccgaatccgtcgccttcaacgcgcttacctacgatttggaacgcgacatccggccgggcgaagcggtatttgtcggctttgacggcacaatgattgcccgccaatgcagcgaccgtgccaaactcagcccctgcctttttgaatatgtttattttgcccgccccgactctgtgattgacggcgtatccgtttaccaatcgcgcttggatatgggcgtgtcgctggcggaaaaaatcaaacgcgagctgcccgtggacggcatcgatgtcgtgatgcccattcccgacaccagccgccccagcgcgatggagcttgccgtccatctcgacaaaccctaccgcgagggtttgattaaaaaccgctatatcggccgcacctttattatgcccggacaggcgacgcgcaaaaaatccgtgcgccaaaaactcagcccgatggaaaccgaatttgcaggcaaaagcgtgttgctggtggacgactccatcgtgcgcgggacgaccagccgcgaaatcgtcgaaatggtacgcgcggcgggcgcgcgcaaagtctatatcgcctccgccgcgcccgaagtgcgctatcccaatgtgtacggcattgatatgcccacgcgcgaagagttgattgccaacgggcgcagcgcggcggaaatcgccgccgaaatcggcgcggacggcatcgtatttcaagacttgggcgatttggaagccgtcgtcaaagcactcaatccgaaaatcgaatccttcgattcgtcctgtttcaacggcatttatcagaccggcgacatcgatgatgcctacctcgaccgcctgtctgccgagaaatccggctgcggcggtctgaaaatccacccgagcaggatggaacacagcatcagcatcagcgatgcgggcgacgaagaataa

SEQ ID NO: 30192 - protein, 514 aa, Neisseria meningitidis MC58
MCGVLGLVSHEPVNQLLYDGLQMLQHRGQDAAGIATAEGGTFHMHKGKGMVREVFRTRNMRDLTGNAGIAHVRYPTAGNAGSSAEAQPFYVSSPFGIVLAHNGNLTNTAELYENVCNKHLRHVNTSSDSEVLLNVFAHELRREVSKNADPHRLNADNIFNAVAQVHRLVRGAYGVIAMIAGYGMLAFRDPYGIRPLVLGSQTDSEGRKSYAVASESVAFNALTYDLERDIRPGEAVFVGFDGTMIARQCSDRAKLSPCLFEYVYFARPDSVIDGVSVYQSRLDMGVSLAEKIKRELPVDGIDVVMPIPDTSRPSAMELAVHLDKPYREGLIKNRYIGRTFIMPGQATRKKSVRQKLSPMETEFAGKSVLLVDDSIVRGTTSREIVEMVRAAGARKVYIASAAPEVRYPNVYGIDMPTREELIANGRSAAEIAAEIGADGIVFQDLGDLEAVVKALNPKIESFDSSCFNGIYQTGDIDDAYLDRLSAEKSGCGGLKIHPSRMEHSISISDAGDEE

SEQ ID NO: 30193 - DNA, 1473 bp, Halobacterium sp. NRC-1
  CDS (1)..(1473): transl_table=11
atgtcaggcggccccgcggacggacccatgagtgaccatccaaccgagaaatgtggggtcgtcggtgcctcactgtcggcccgtgacgccgcgcttccgacgtactacgcgctgtacgccctccagcaccgcggccaggagtcggcgggcatcgtcgcccacgacggcttccagcaacaccaacacgtcggcatggggctggtgggtgacgccttcgacgaagccgacatcgacgcgctgcacggttcggccgccatcggccacgttcgctatccgaccgcggggagcgtcgacaagtcctgcgcgcagccgttctcggtgtcgttcaagggcggtgcgctcggcctgagccacaacggcaacctcgtcaacgccgacgagttgcgcgcggacctcgcggcaagcgggcacgcgttcaccagcgacggcgacaccgaggtcatcgcccacgacctcgcgcgcaacctcctcgacgccgacctcgtggacgccgtcgagcggaccatggagcgcatccacgggtcgtactcgctgaccatcatgcacgacgacaccgtgttgggcgtccgggacccacgggggaaccgcccgctggtgctggggaccgtcgaggacggctacgtcatcgccagcgagtccgccgcgatcgacaccatcggcggcgatgtcgtccgtgacgtccgtcccggcgaggcgatcgtcctcgacgacgacggcacggggttttccgcccaccagctcgtcgaccgcgacaccactgcccactgctttttcgagtacgtgtatttcgcgcgcccggattcggtcatcgacgacgaactcgtctacgaggtccggcgcaacctcggccgccaactgtggcacgagaccggcgtcgaaagcgatgtcgtggtgcccgtccccgactccgggcgggcgttcgcgtccggctacgccgacgccgccaccgaagacgggagcgacgtggagttcgccgaggggttgatgaaaaaccggtacgtcggccgcacgttcatcatgcccacccaggaggcccgcgagcgcgccgtccggctcaagctcaaccccatcaagtccaccgtcgaggggcagtcggtcacgatcatcgacgactccatcgtacggggcacgaccagcagccagctcgttgatctggtccgggacgcgggcgcaaccgaggtccacgtgcgcatcggcgccccccagatacaggccccgtgttacttcggcatcgacatggcgacccgcgaggaactcatcgccgccgaccggacggccgacgagatcgcggcggagatcggcgcggactcgctgtcgtatctcccgctgtccgcggtcacggcggccatcgggaagagcgaagccgacatgtgcgcggggtgtgtgaccggcgcgtacccatacgacgtcgacggcgaggcgaccgaccgggacgccgagcgcccgacagtcacgccgtccagcgacgactga

SEQ ID NO: 30194 - protein, 490 aa, Halobacterium sp. NRC-1
MSGGPADGPMSDHPTEKCGVVGASLSARDAALPTYYALYALQHRGQESAGIVAHDGFQQHQHVGMGLVGDAFDEADIDALHGSAAIGHVRYPTAGSVDKSCAQPFSVSFKGGALGLSHNGNLVNADELRADLAASGHAFTSDGDTEVIAHDLARNLLDADLVDAVERTMERIHGSYSLTIMHDDTVLGVRDPRGNRPLVLGTVEDGYVIASESAAIDTIGGDVVRDVRPGEAIVLDDDGTGFSAHQLVDRDTTAHCFFEYVYFARPDSVIDDELVYEVRRNLGRQLWHETGVESDVVVPVPDSGRAFASGYADAATEDGSDVEFAEGLMKNRYVGRTFIMPTQEARERAVRLKLNPIKSTVEGQSVTIIDDSIVRGTTSSQLVDLVRDAGATEVHVRIGAPQIQAPCYFGIDMATREELIAADRTADEIAAEIGADSLSYLPLSAVTAAIGKSEADMCAGCVTGAYPYDVDGEATDRDAERPTVTPSSDD

SEQ ID NO: 30195 - DNA, 1338 bp, Campylobacter jejuni subsp. jejuni NCTC 11168
  CDS (1)..(1338): transl_table=11
atgtgtgcagttgtaggagttatcaattcaaaaaatgctagcacttatgcgtattatgcgctttttgctatgcaacaccgtgggcaagaagcaagtggcattagtgtgagtaatggtaaaaatattaagactattaaagctaaaggtgaagtgagtcaaatttttaatcctgataatctaaaaactttagaaggtgaaatcgctataggccataatcgctattctacagcaggaaattcaagtttaaatgacgctcagcccatagcagctacttcggttttaggtgatattgctttagcgcataatggaaatttagtcaataaagaagaggtaagatcaagacttattcaagatggagctatttttcaaaccaatatggatacagaaaatgttgtccatcttatcgcaagaagtaagcaagaaagtctaaaagatagatttattgagagtttaaaagaatgtataggagcttattgttttgttttagcaagcaaagataaactttatgttgtaagagatcctcatggggtgcgtcctttgtctttagggcgtttaaaagatggaggctatatagttgctagtgaaacttgtgcttttgatcttatagaggctgaatttattcgtgatgttaaaccaggggaaatgcttatttttactcagggaaatgataaatttgaaagcatagaacttttttctcaaactcctagaatttgcgcttttgaatacatttattttgctagacctgatagtatagtagaaggcaaaagcgtgtatgaagtgcgtaaaaaaatgggcgaagctttagctaaaaaatttgcttataaagcagactttgtcgtgcctgtgccagatagtggagtaagtgcagctataggttttgcgcaatatttacaaatccctcttgaaatggcaatagtaagaaatcattatgtaggaagaacttttatagagccaactcaagagcttagaaatttaaaagtaaaattaaaacttaatcctatgcgtaaagttttagaaggcaaagaaatcgtagtcattgatgatagcttggtgcgtggcactacttctaaaaaaataatttctttgcttcgtgctgcaggagcgagcaaaatccatcttgccatagcttgtcctgagatcaaatttcctgatacttatggcatagatactccaacttttgaagaacttatcagtgcaaataaaaatgctgaagaagtgcgtgaatatgtagaagctgatacgctaagttttttaagcatagaagagctaactcaaagcataggcgatgaaaggaaatattctttaatcagttttgatggagattattttattaaataa

SEQ ID NO: 30196 - protein, 445 aa, Campylobacter jejuni subsp. jejuni NCTC 11168
MCAVVGVINSKNASTYAYYALFAMQHRGQEASGISVSNGKNIKTIKAKGEVSQIFNPDNLKTLEGEIAIGHNRYSTAGNSSLNDAQPIAATSVLGDIALAHNGNLVNKEEVRSRLIQDGAIFQTNMDTENVVHLIARSKQESLKDRFIESLKECIGAYCFVLASKDKLYVVRDPHGVRPLSLGRLKDGGYIVASETCAFDLIEAEFIRDVKPGEMLIFTQGNDKFESIELFSQTPRICAFEYIYFARPDSIVEGKSVYEVRKKMGEALAKKFAYKADFVVPVPDSGVSAAIGFAQYLQIPLEMAIVRNHYVGRTFIEPTQELRNLKVKLKLNPMRKVLEGKEIVVIDDSLVRGTTSKKIISLLRAAGASKIHLAIACPEIKFPDTYGIDTPTFEELISANKNAEEVREYVEADTLSFLSIEELTQSIGDERKYSLISFDGDYFIK

SEQ ID NO: 30197 - DNA, 1545 bp, Neisseria meningitidis Z2491
  CDS (1)..(1545): transl_table=11
atgtgcggcgtattaggtttggtcagtcatgaacccgtgaaccagcttctgtacgacggtttgcagatgttgcagcacagggggcaggatgcggcgggcattgcaacggcggaaggcggtaccttccatatgcacaaaggcaaaggcatggtgcgcgaagtgttccgcacacgcaatatgcgcgatttggtcggcaacgccggcatcgcccacgtccgttatcctactgcgggcaacgcgggcagcagcgcggaggcgcagcctttctacgtcagctcgccgttcggcatcgttttggcgcacaacggcaacctcaccaacacggccgaactttatgaaaacgtgtgcaacaaacacctgcgccacgtcaacaccagctccgattccgaagtcttgctcaacgtattcgcgcacgaattgcgccgcgaagtctctaaaaacgccgacccgcaccggctcaatgccgacaatattttcaacgccgttgccgaagtccaccgcctggtgcacggcgcatacggtgtggttgccatgattgcgggctacggtatgcttgccttccgcgacccttacggcatccgcccgctggtattgggttcgcaaaccgacagcgaaggcaggaaatcctatgccgtcgcctccgaatccgtcgccttcaacgcgcttgcctacgatttggaacgcgatatccggccgggcgaagcggtatttgtcggctttgacggcacaatcatcgcccgacaatgcagcgataaggccaaactcagcccctgcctttttgaatacgtctattttgcccgtcccgactccgtgattgacggcgtgtccgtttaccagtcgcgcttggatatgggcgtgtccttggcggaaaaaatcaaacgcgagctgcccgtggacggcatcgatgtcgtgatgcccatccccgacaccagccgccccagcgcgatggagcttgctgtccacctcaaaaagccttaccgcgaaggtttgattaaaaaccgctatatcggccgcacctttattatgcccggccaggcgacgcgcaaaaaatccgtgcgccaaaaactcagcccgatggaaaccgaatttgcaggcaaaagcgtgttgctggtggacgactccatcgtgcgcggtacgaccagccgtgaaatcgtcgaaatggtacgcgcggctggcgcgcgcaaagtctatatcgcctccgccgcgcccgaagtgcgctatcccaacgtatacggcatcgatatgcccacgcgcgaagagttgattgccaatgggcgcagcgcggcggaaatcgccgccgaaatcggcgcggacggcatcgtgtttcaagacttgggcgatttggaagccgtcgtcaaagcactcaacccgaaaatcgaatccttcgattcgtcctgtttcaacggcatttatcagaccggcgacatcgatgatgcctacctcgaccgcctgtctgccgagaaatccggctgcggcggtctgaaaatccacccgagcaggatggaacacagcatcagcatcagcgatgcgggcgacgaagaataa

SEQ ID NO: 30198 - protein, 514 aa, Neisseria meningitidis Z2491
MCGVLGLVSHEPVNQLLYDGLQMLQHRGQDAAGIATAEGGTFHMHKGKGMVREVFRTRNMRDLVGNAGIAHVRYPTAGNAGSSAEAQPFYVSSPFGIVLAHNGNLTNTAELYENVCNKHLRHVNTSSDSEVLLNVFAHELRREVSKNADPHRLNADNIFNAVAEVHRLVHGAYGVVAMIAGYGMLAFRDPYGIRPLVLGSQTDSEGRKSYAVASESVAFNALAYDLERDIRPGEAVFVGFDGTIIARQCSDKAKLSPCLFEYVYFARPDSVIDGVSVYQSRLDMGVSLAEKIKRELPVDGIDVVMPIPDTSRPSAMELAVHLKKPYREGLIKNRYIGRTFIMPGQATRKKSVRQKLSPMETEFAGKSVLLVDDSIVRGTTSREIVEMVRAAGARKVYIASAAPEVRYPNVYGIDMPTREELIANGRSAAEIAAEIGADGIVFQDLGDLEAVVKALNPKIESFDSSCFNGIYQTGDIDDAYLDRLSAEKSGCGGLKIHPSRMEHSISISDAGDEE

SEQ ID NO: 30199 - DNA, 1434 bp, Deinococcus radiodurans R1
  CDS (1)..(1434): transl_table=11
atgtctgaacacttccacgaacacgacctgaatttcgacaagccccgcgaggaatgcggcgttttcggcatctactctgcgcagcccaacgacctcgcgtggctgacctacctgggcctgttcgccctacaacaccgggggcaggaagcggcgggcatgtgcgtcagcgacggcgaccgctttcacgtcgagaaagacctggggctggtcacgcaggtgttcgacgagcggcggctcgacagcgtgcggctggcaggcgcgcaggtcagcatcgggcacgtgcgctactcgaccaccggctccaacctgcgcttcaacgcccagccgctgaccacccgcaccaacaagggcattctgggcatggcgcacaacggcaacttcgtcaacgcgctggaagtgcggcgcgagatgctggaagaaggcgccttgttcgccaccaccaacgacagcgaagtgatgctgaacctgattgcccgcgagagccgcatggacctcgtggaagcgacggcggcggccatgcagcgcctgcgcggcggctatgcctgcgtgctgatgagccgcagccagcttctcggctttcgcgacccgcacggtgttcggcccctggttatcgggcagcgggaggacggcgcgtgggtgctggcttccgaaccctgcgccctgtacgccatcggggcgcggctgattcgggatgtggcgcccggcgaactcgtctggattgaccgcgaagggctgcactccttgatggtcgaggcccgccagcccaccccctgctcgttcgagtggatttattttgcccgctccgacagccagctcgacggcatcgacacccacgagagccgcattcgcatgggccagcagctcgcccgcgaaaagccggtggaggccgacatcgtggtgcccgtgcccgactccggcatcggcgccgccatcgggtacgcccgcgagagcggcatcccgttcgactacggcctctacaaaaacccctacgcgggccgcacctttatcgcccccacgcaggaagcccgcgagctgaaggtcaagatgaagctctcccccacctccgccgtgcgcggcaagcgggtggtgctggtggacgactccatcgtgcgcggcaccaccagccgccagatcgtcaacctgctgcgcgacgcgggcgccaccgaagtgcacttccgcgtgtccagcccgcccatcactcacccgtgcttttacggcatcgacaccgccgcccgcaaggaactggtcgcctcgacgcacagcgtggacgaaatccgtgacctcatcggcgccgacaccctggccttcatcagcgaacaggggctgcgcaaggccatcggcggccctggcctctgctcggcgtgctttacgggggattacccggcaggcacaccgctgttgaatgatgtggataagttggcgctggaagtctag

SEQ ID NO: 30200 - protein, 477 aa, Deinococcus radiodurans R1
MSEHFHEHDLNFDKPREECGVFGIYSAQPNDLAWLTYLGLFALQHRGQEAAGMCVSDGDRFHVEKDLGLVTQVFDERRLDSVRLAGAQVSIGHVRYSTTGSNLRFNAQPLTTRTNKGILGMAHNGNFVNALEVRREMLEEGALFATTNDSEVMLNLIARESRMDLVEATAAAMQRLRGGYACVLMSRSQLLGFRDPHGVRPLVIGQREDGAWVLASEPCALYAIGARLIRDVAPGELVWIDREGLHSLMVEARQPTPCSFEWIYFARSDSQLDGIDTHESRIRMGQQLAREKPVEADIVVPVPDSGIGAAIGYARESGIPFDYGLYKNPYAGRTFIAPTQEARELKVKMKLSPTSAVRGKRVVLVDDSIVRGTTSRQIVNLLRDAGATEVHFRVSSPPITHPCFYGIDTAARKELVASTHSVDEIRDLIGADTLAFISEQGLRKAIGGPGLCSACFTGDYPAGTPLLNDVDKLALEV

SEQ ID NO: 30201 - DNA, 1458 bp, Xylella fastidiosa 9a5c
  CDS (1)..(1458): transl_table=11
atgtgtggtatcctcggtatcgttggcaatcaaaacgttgctggccaactctatgacggtttgactgttctgcagcatcgtggacaagatgctgcaggcattgccacggccagtggcactcgcttgcgcgttcaaaaggccaatggtttggtacgagacgtattcgacgagcagcgtatggcggtccttgatggctgtattgggattgctcattgccgttatccaactgctggttctgaggggatggatgaggcacaacctttttacgtcaactcaccgtatggcattgctctagcacataatggaaaccttatcaacacagaggcgctacaccaacaggtgttcgaagcggatcgacgtaacatcaacaccgactctgacagcgaggtattacttaacgtattcgcatatgagttagatgcgcagcgtatgctcactccagaagcggcaattcgtgctgtagcaggagtacatcgccgctgtaagggcggctatgccgtagtcagcatgatattagggctgggacttgttgcattccgcgatccacacggtatccgtccgttggtgctgggaaagcgtgtacataccgaaggtgatgaatatatggtcgcttccgaatcagctgcactcgatatcctagggtttatacgtatacgcgatgtacgtccaggtgaggctgtggtgattactgcacgtggcgaactgttttcagaggtctgtgctacacctaccaaccatgctccatgcattttcgagtacgtttacttcgcacgtccggattcgatgatcgataatatttcagtacataaggcgcgcatgcgtatgggtgtgaagttaggtgaaaagatcctgcgcttgcgcccgaatcacgatatcgacaccattattccgataccggatacctcgcgggatgcagcgctggaaatatctaacgtgctcggcgtaaagtatcgcgaaggtttcgttaaaaatcgctacgttggccgtacttttatcatgccgggacagggagagcgagttaagtcagtacgtcgtaaacttaacccaatccatctggagttccgaaaccgcgtggtgctgttgattgatgattcaattgttcgcggtaccaccagccgccagattgtccagatggtaagagatgctggtgcacgcaaggtgtacttagcaagtgctgcgcctcctgtgcgttatccaaatgtgtatggcattgatatgccagctgcagatgaattaatcgcacatgatcggactgagcaggaaatacaatcccttcttggctgcgactggttgatttaccaagatttagaggatctagaaaacgctgtgcgcgagggaaaccaagaaatcaagcaatttgattcctcgtgcttcaatggtcattacatcactggaattgaacggggctatttagatcgcatccgtcaactacgctccgatgaggtaaagcgaaaataa

SEQ ID NO: 30202 - protein, 485 aa, Xylella fastidiosa 9a5c
MCGILGIVGNQNVAGQLYDGLTVLQHRGQDAAGIATASGTRLRVQKANGLVRDVFDEQRMAVLDGCIGIAHCRYPTAGSEGMDEAQPFYVNSPYGIALAHNGNLINTEALHQQVFEADRRNINTDSDSEVLLNVFAYELDAQRMLTPEAAIRAVAGVHRRCKGGYAVVSMILGLGLVAFRDPHGIRPLVLGKRVHTEGDEYMVASESAALDILGFIRIRDVRPGEAVVITARGELFSEVCATPTNHAPCIFEYVYFARPDSMIDNISVHKARMRMGVKLGEKILRLRPNHDIDTIIPIPDTSRDAALEISNVLGVKYREGFVKNRYVGRTFIMPGQGERVKSVRRKLNPIHLEFRNRVVLLIDDSIVRGTTSRQIVQMVRDAGARKVYLASAAPPVRYPNVYGIDMPAADELIAHDRTEQEIQSLLGCDWLIYQDLEDLENAVREGNQEIKQFDSSCFNGHYITGIERGYLDRIRQLRSDEVKRK

SEQ ID NO: 30203 - DNA, 1353 bp, Sulfolobus solfataricus P2
  CDS (1)..(1353): transl_table=11
atggatagcatacgtgataaatgtggagtctttgctgtatctagccctaaagaagtaaatattcaactggtagtagagggaattagactacttcagcataggggtcaagaatctgcaggaatcgcatatgctgagaatggggaaatattgacgattaagggatctggacttgtagacgaagtatttaaggaaaatcttaataaatttataaaaaatggaataggtcatgtaagatattcaacaagtggaaaaagctcaattgaagaagcacagcctttaggcgactcaaaaatagtcgtggcgttcaatgggacaataagcaactattaccagtttggatcatttagggtagatactgaatttatatataagttctttaagcaaaaattggcctttcgctctatccctgatactgtaaaggaatttatgaaagttgtcgatggtggatactctgtagctattcttttgaatgatgaagagattgtagtatttagagatcctaaaggatttcatccagttgtattaggatttttagaaggatcattaatagtttcctcggaggattccgttattagacaactaggtgggagcgttttgaaacatattctaccaagcgaaatgataattatgaaaaatggcaaaatattatatgacaaagtaatctatgaggagaaaaattacgctacttgttccttcgaatatatatactttgcaagaccagattccaatatagatgggcattcagtttacttagctaggataaggttaggtgaattattagcagaaaaacacccagctaacggagatattgtagttccagtgccggactcatcaaggccaatagcgctgggcttttctagaaaaagtcacatacctttagaggaacctctagttagaacaatttcctctgtaaggtccttcataatgccaactcaagataagagaaatgaggtattagaagagaaatttggagtggttgcagatgcagtaagggggaaaagaatagttttaatagacgactcaatagttaggggaaatactatgaagagaataataactatgttacgtaaagccggcgccaaagaaattcatgtacgtataggatcacctatgataaaatacccttgttatatgggaatagactttcctaaaagagaagagttgattgcgcataataaatctgaaaaagaaataggaaatgagctgaacgctgattctattgaatttctaagtgtcgaagagatgttacaaggaataggtagaagagacttatgcaatgcatgcttttctgggatttatcctctcaaatttaactataattctacagagttagaaagaatatttgggaagtga

SEQ ID NO: 30204 - protein, 450 aa, Sulfolobus solfataricus P2
MDSIRDKCGVFAVSSPKEVNIQLVVEGIRLLQHRGQESAGIAYAENGEILTIKGSGLVDEVFKENLNKFIKNGIGHVRYSTSGKSSIEEAQPLGDSKIVVAFNGTISNYYQFGSFRVDTEFIYKFFKQKLAFRSIPDTVKEFMKVVDGGYSVAILLNDEEIVVFRDPKGFHPVVLGFLEGSLIVSSEDSVIRQLGGSVLKHILPSEMIIMKNGKILYDKVIYEEKNYATCSFEYIYFARPDSNIDGHSVYLARIRLGELLAEKHPANGDIVVPVPDSSRPIALGFSRKSHIPLEEPLVRTISSVRSFIMPTQDKRNEVLEEKFGVVADAVRGKRIVLIDDSIVRGNTMKRIITMLRKAGAKEIHVRIGSPMIKYPCYMGIDFPKREELIAHNKSEKEIGNELNADSIEFLSVEEMLQGIGRRDLCNACFSGIYPLKFNYNSTELERIFGK

SEQ ID NO: 30205 - DNA, 1215 bp, Sulfolobus solfataricus P2
  CDS (1)..(1215): transl_table=11
gtgatattaatggctggaatactaggtatattagcgttcgatgatgtatggaatgtatctagatttttatattatggtctaataggcttgcaacatagaggatattctaaaagtggaatagcaatattgaacaagcagaggaatatatttactaaactagagaacgtagcgcctgaggatttagaaattaaagacttgaatggatgggctggaataggttatgctggaatcagaaatagttatcccataacaatagataatggtgctatagtcgttgatgggatgatagatgataacaatgttcttaaccatgtcataagagagccagaaaatgcaatagatgatattaaaaagccgatctcgttcatagccattagtaaagacggccagttaatagcctatagagacgaactaggacttaagccgttaagcataggtggatttggattcgatttagcagttatttcctccgaaccaacgtcaatgtttgtaataggggctgagttcaaaagggaaattaatccgggagagttagtgatcgttgacaaatatcatattgaatccaaacaggtgagaatacctagaaaatcgtattgtactatagagtacgtataccaagctagaatagacagtatgatcaacgaaagagaaatctatgacctaagagtgaaaataggggaagaattagccttagaatatccaataaatgctgattcagtaataggagttccagaaaccgcattacctttcgcaataggctattccaagaaattaaatataccattagacttaggctttacgaggacagggagcccaataaggacaatgttatcttctgatgctttcctaaaaatagttggggtccaacttaagctaaacccaataaaaagtgcagtaaaaggaaagagaataattctaatagatgattctatggtcaccggaactacccttaaaaacactatatttaacttgagaaaattgggcgcaaaggaaatccacgtgctgataggaagccctaaattagtctcacaatgtccgtacggagttgaagtccccgacgaaaaagaattgatctcagctaatcttaacgacgaaactatagcgagggttttaggtgcagactctatacactggttaagcatagaaggattgttcaaagccattgggcatagggatctctgcttaggatgtatgactaaaaaatatccatggtga

SEQ ID NO: 30206 - protein, 404 aa, Sulfolobus solfataricus P2
MILMAGILGILAFDDVWNVSRFLYYGLIGLQHRGYSKSGIAILNKQRNIFTKLENVAPEDLEIKDLNGWAGIGYAGIRNSYPITIDNGAIVVDGMIDDNNVLNHVIREPENAIDDIKKPISFIAISKDGQLIAYRDELGLKPLSIGGFGFDLAVISSEPTSMFVIGAEFKREINPGELVIVDKYHIESKQVRIPRKSYCTIEYVYQARIDSMINEREIYDLRVKIGEELALEYPINADSVIGVPETALPFAIGYSKKLNIPLDLGFTRTGSPIRTMLSSDAFLKIVGVQLKLNPIKSAVKGKRIILIDDSMVTGTTLKNTIFNLRKLGAKEIHVLIGSPKLVSQCPYGVEVPDEKELISANLNDETIARVLGADSIHWLSIEGLFKAIGHRDLCLGCMTKKYPW

SEQ ID NO: 30207 - DNA, 1428 bp, Clostridium acetobutylicum ATCC 824
  CDS (1)..(1428): transl_table=11
atgataaaagaacagtgcgcagctgaaaatgaagatatggataagttcaaagaagaatgcggtgtatttggaattttttcaaataaagatatagatgcttctagactaacttactacggtttatatgctcttcaacacaggggacaggagagtgcaggcattgctgtatccaatggaaaagaactttgtgtttataaaaatatggggcttgtagcagatgtgttcaatcctgaaattatagattcattggttggaagctctgccataggtcatgttagatactcgacaacaggtggaagtaatgcaaacaatgctcagcctataatgagtaattttaaattagggtctattgctattgctcataatggtaacctagttaatgctgatgttataagagaacttctacaggatggcggcactatgttccaaacttccattgatactgaagttatcttgaatcttatagctagagctgctaaaaagggaatagagaaagcagttgtggatgcaattcaagcaatcaaaggttcatacgctattgtaattctcacaaaggataaattaataggagttagagatccaaatggtataagaccactttgtattgggaaaattgatgatagctatataatttgttctgaaagttgtgcactggatactgtaggtgctgagtttgttagagatgtaaatcctggagaaatagtaatagttgataaggacggacttagaagtataaattttgcagaaaaaacaaagtgcgaaacctgtgcttttgaatatatttattttgctagacctgacagtgtaatagatggaatagatgtaaataaatcaagagaacttgctggagaacaattatttaaggattctcctgtagaggcagacatagtaattggagtacctgattcaggaataccagcggcaattggttacgctagagcttctgggataccgtatactttggggctgataaaaaataaatacataggtagaacctttatagctccaacacaggaacttagggaaaaagctgtatctgttaagctgaatcctgtgaagtcaataatagagggaaaaagagttgttttaatagatgactccatagttagaggaactacaagcaagagacttgtggatattatacgtaaagctggagcaaaagaagtacattttagggtgtcttcacctatagtaaaatttccatgctactttggaatagatactccttatagaaaagacctcattggtgcacataaaacagttgaagaaataagagattttataggagcagatagtttgggatatttaagtatagacgctcttttaaaaacccttggaaaagataaaaaattttgtcttggatgctttaatggtgtatatccagtgtcagcaccagttgaggctgataaggatagacttgaaacttaa

SEQ ID NO: 30208 - protein, 475 aa, Clostridium acetobutylicum ATCC 824
MIKEQCAAENEDMDKFKEECGVFGIFSNKDIDASRLTYYGLYALQHRGQESAGIAVSNGKELCVYKNMGLVADVFNPEIIDSLVGSSAIGHVRYSTTGGSNANNAQPIMSNFKLGSIAIAHNGNLVNADVIRELLQDGGTMFQTSIDTEVILNLIARAAKKGIEKAVVDAIQAIKGSYAIVILTKDKLIGVRDPNGIRPLCIGKIDDSYIICSESCALDTVGAEFVRDVNPGEIVIVDKDGLRSINFAEKTKCETCAFEYIYFARPDSVIDGIDVNKSRELAGEQLFKDSPVEADIVIGVPDSGIPAAIGYARASGIPYTLGLIKNKYIGRTFIAPTQELREKAVSVKLNPVKSIIEGKRVVLIDDSIVRGTTSKRLVDIIRKAGAKEVHFRVSSPIVKFPCYFGIDTPYRKDLIGAHKTVEEIRDFIGADSLGYLSIDALLKTLGKDKKFCLGCFNGVYPVSAPVEADKDRLET

SEQ ID NO: 30209 - DNA, 1443 bp, Streptococcus pneumoniae R6
  CDS (1)..(1443): transl_table=11
atgacatacgaagtaaaatctcttaatgaagaatgtggtgttttcggtatttggggacatccagatgctgctaagttgacctattttggactccacagtcttcaacaccgtggtcaggagggggcaggaatcctctccaatgatcaaggacaactgaagcggcatcgcgatatgggtcttctatcagaagtcttcagaaatcctgctaacttagataaattgacgggaactggtgcgattgggcatgtgcgttacgcgactgctggcgaagcttctgtagataatatccagcccttcctcttccgttttcacgatatgcagtttggcttggctcataatggaaatctgaccaatgcagcctctctcaagaaagaactggaacaaagaggagcaattttcagcgcgacttcggactctgaaatcttggctcacctcattcgtcgcagtcataatcctagcctgatgggcaaaatcaaggaagcgctcagccttgtcaaaggtggttttgcctatatcttgctgtttgaggacaagttgattgcggctcttgacccaaatggattccgaccgctttcgattggtaaaatggctaatggagcagttgttgtatcttctgaaacctgtgcttttgaggtcattggtgccgagtggattcgtgatttgaagccaggtgagattgtgatcattgatgacgagggcattcagtatgacagctatacagatgatacccagttggcggtttgttctatggagtatatctactttgctcgccctgattctaatatccacggtgtcaatgtccatacggcacgtaagagaatgggagcgcaattggcgcgagaatttaagcatgaggcagatattgtagttggtgtgcccaattcttccctaagcgcggctatgggatttgcggaagaagcaggcttaccaaatgaaatgggtctgatcaaaaaccaatacacccagcgaacttttatccaaccgactcaagaattgcgggagcaaggagtgcggatgaaactgtctgctgtttcgggtgttgtcaaaggcaaacgtgtggtcatggtggatgattccattgtacgtggaacaacctctcgtcgtatcgttcagctcttgaaagaagcgggtgcgactgaggttcacgttgccattggaagtcctgcactagcgtatccatgtttctacgggattgatatccagacccgtcaggagctgattgcagccaatcatacggtcgaagaaactcgccaaatcattggtgcggacagtatgacttatctttcaattgatggcttgattgagtcgattggtatcgaaacagatgcgccgaacggtggtctctgtgtcgcttactttgacggtgactacccaacgcctctctatgactacgaagaagactatcgtagaagtttggaagaaaagaccagtttttacaagtag

SEQ ID NO: 30210 - protein, 480 aa, Streptococcus pneumoniae R6
MTYEVKSLNEECGVFGIWGHPDAAKLTYFGLHSLQHRGQEGAGILSNDQGQLKRHRDMGLLSEVFRNPANLDKLTGTGAIGHVRYATAGEASVDNIQPFLFRFHDMQFGLAHNGNLTNAASLKKELEQRGAIFSATSDSEILAHLIRRSHNPSLMGKIKEALSLVKGGFAYILLFEDKLIAALDPNGFRPLSIGKMANGAVVVSSETCAFEVIGAEWIRDLKPGEIVIIDDEGIQYDSYTDDTQLAVCSMEYIYFARPDSNIHGVNVHTARKRMGAQLAREFKHEADIVVGVPNSSLSAAMGFAEEAGLPNEMGLIKNQYTQRTFIQPTQELREQGVRMKLSAVSGVVKGKRVVMVDDSIVRGTTSRRIVQLLKEAGATEVHVAIGSPALAYPCFYGIDIQTRQELIAANHTVEETRQIIGADSMTYLSIDGLIESIGIETDAPNGGLCVAYFDGDYPTPLYDYEEDYRRSLEEKTSFYK

SEQ ID NO: 30211 - DNA, 1332 bp, Sulfolobus tokodaii str. 7
  CDS (1)..(1332): transl_table=11
atgaaggttaaagaacactgcggtattgttggagtttatgctgataattctccaatgatttcttacgaatccctaaaattattacaacataggggacaagaatcagcaggaattacttacagaaaagatgggagtttagttaccatgaaaggcttgggtttagttgaagaggcattagatcctaggcttcttcctaatgcgaaactatcaataggtcatgttagatattcaactaccggtaaaggttcacttgacgaggctcaacctttaagtaacggtaaaattgctatagcatttaatggtacaataactaattattttaagttcggaacttctaccgatactgaatttattcttaaggttctctcggaggcgcctaacattaaagaaggaattagaaggttagttgacttagctgacggtgcatactcactcgtagttttaactaatgaaggagaacttatcggctttagagatcctaaaggattccgtcctctggtcttaggtaaaattaataacggttatataattgcttcagaagattccgtaatcagacaattaggaggtaagcctttaagagatgtaaaacctggagaaatgatatacattaaagatggtgaaattgaaagcgaagttatttctagggatcgtgtaagtttttgctcatttgagtacatctattttgccagacccgattctataattgatggtgtgtctgtttataactctaggataaagctaggagaaattttagctgaaaatcatggagttgatgcagatgtagctataccagttccagaatcctcaattccgattgcaataggattctctaggaaatcaaagattcctatggaatacggtttgattagaacactcgtagcaaagaggtcttttatcatgcctacacaagataaaagaaatgctgtactagaagagaaatttggtatagtcaaaagtgtagtagaaaataagaaagttgttgtcattgatgactcaatcgttagaggaaatactatgagaaaaattgtaagaatgataagggataatggtgctaaggaagttcatgtaagaataggctctccaaaagtaaaatatccttgttatatgggtatagattttccattatctaaagaactaatagctagtgagaaagatgaaaaagaaatagctaagtatattggtgctgattcagttgagttcttaacagttgaagaaatgattaaagccataggaagacctgatttatgtcatgcatgtttttctggagtttatccccttaaattttcatataatttgcaagtattagaatctatatttaaaaaggtgagttaa

SEQ ID NO: 30212 - protein, 443 aa, Sulfolobus tokodaii str. 7
MKVKEHCGIVGVYADNSPMISYESLKLLQHRGQESAGITYRKDGSLVTMKGLGLVEEALDPRLLPNAKLSIGHVRYSTTGKGSLDEAQPLSNGKIAIAFNGTITNYFKFGTSTDTEFILKVLSEAPNIKEGIRRLVDLADGAYSLVVLTNEGELIGFRDPKGFRPLVLGKINNGYIIASEDSVIRQLGGKPLRDVKPGEMIYIKDGEIESEVISRDRVSFCSFEYIYFARPDSIIDGVSVYNSRIKLGEILAENHGVDADVAIPVPESSIPIAIGFSRKSKIPMEYGLIRTLVAKRSFIMPTQDKRNAVLEEKFGIVKSVVENKKVVVIDDSIVRGNTMRKIVRMIRDNGAKEVHVRIGSPKVKYPCYMGIDFPLSKELIASEKDEKEIAKYIGADSVEFLTVEEMIKAIGRPDLCHACFSGVYPLKFSYNLQVLESIFKKVS

SEQ ID NO: 30213 - DNA, 1491 bp, Sinorhizobium meliloti 1021
  CDS (1)..(1491): transl_table=11
atgaccgatctcagatccagcgaaatccatgacgaactcgacggcgacaccctccatgaggagtgcggcgttttcggcattctcggccatccggacgccgccgcgctgacggcgctcggcctgcacgctctccagcatcgagggcaggaagccgccggtatcgtcaccttcgacgggcggcagttctattcggagcgccggatgggtctcgtcggcgaccactataccgatcccacgacgctcgcgaagctgcccggttcgatgtcgatcggccatgtacgctattccaccaccggtgagacggtcctgcgcaacgtccagccgctgtttgccgagctgcaggaaggcggaatcgcaatcgcgcacaacggcaacttcacgaacggcctgacgctgcggcgccagatcatcgcagacggtgccatctgtcagtcgacatccgacaccgaagtcgtgctgcacctgatcgcgcggtcgaaacacgtctcttccagcgatcgcttcgccgacgctatcgcccaggtcgaaggcggctattcgatgctggctctgacccgcaccaagctgatcgccgcccgcgacccgaacggcattcgcccgctcgtcatgggcgaactcgacggcaagccgatcttctgctcggagacctgcgcgctggatatcatcggcgccaaattcgttcgcgatatcgagaacggtgaaatcgtcatctgcgaaattcagccggacgggtcgatcaccatcgatgcccgcaagccgcagaatccgctgccggaacgcctttgccttttcgagtacgtctatttcgcccggccggattcggtcgtcggcggccgcaacgtctacgtcgcccgcaagaacatgggcaagaacctcgccatcgaggcccccgtcgaggcggatgtcgtggtgcccgttccggacggcggtacgccggctgcaatcggctatgcgcaggaaagcggcatccccttcgagctcggcatcatccgcaatcactatgtcgggcggaccttcatcgagccgacgcagcagattcgcgccttcggcgtcaagctcaagcattctgcgaaccgggcgatgatcgccggcaagcgcgtcgtgctcgtcgacgattccatcgtccgcggcaccacttcggtcaagatcgtccagatgatgcgcgaggcaggcgcccgcgaggtgcatgtgcgcgtcgcgagcccgatgatcttccacccggatttctacggcatcgacacgcccgaccgtgacaagctgctcgccaaccagcatgccgacctcgcctcgatgtgtcgcttcatcggcgccgattctctcgaattcctctcgatcgacgggctttatcgtgccgtcggcggcgagaagcgcgacccgcaggcgccgcagttcaccgatcactatttcaccggggactacccgacccgccttctcgaccagggggcagcgagcaacgttcgcaaactctcggttctcgccagcaacggataa

SEQ ID NO: 30214 - protein, 496 aa, Sinorhizobium meliloti 1021
MTDLRSSEIHDELDGDTLHEECGVFGILGHPDAAALTALGLHALQHRGQEAAGIVTFDGRQFYSERRMGLVGDHYTDPTTLAKLPGSMSIGHVRYSTTGETVLRNVQPLFAELQEGGIAIAHNGNFTNGLTLRRQIIADGAICQSTSDTEVVLHLIARSKHVSSSDRFADAIAQVEGGYSMLALTRTKLIAARDPNGIRPLVMGELDGKPIFCSETCALDIIGAKFVRDIENGEIVICEIQPDGSITIDARKPQNPLPERLCLFEYVYFARPDSVVGGRNVYVARKNMGKNLAIEAPVEADVVVPVPDGGTPAAIGYAQESGIPFELGIIRNHYVGRTFIEPTQQIRAFGVKLKHSANRAMIAGKRVVLVDDSIVRGTTSVKIVQMMREAGAREVHVRVASPMIFHPDFYGIDTPDRDKLLANQHADLASMCRFIGADSLEFLSIDGLYRAVGGEKRDPQAPQFTDHYFTGDYPTRLLDQGAASNVRKLSVLASNG

SEQ ID NO: 30215 - DNA, 1425 bp, Thermoplasma acidophilum DSM 1728
  CDS (1)..(1425): transl_table=11
gtggattccctgcccccaggatcagatcctatagatgggcaaaagccaagtgaagactgtgctgttgtgggctttaagggtaggatcaacgcctatgagcccataataaccgcactgcgtacactgcagcacagaggtcaagaatcagccggtatggctgtttttgatggcagaaaaactgtcctgaagaagggtcgtggccttgtaaccgacgttttcaatcctgcaacggatagcataaagggcaaggtcggggttggccatacccgttattctacagccggttccaaggacgttatcgatgctggtccattcgttataaattcccaggttggattcatctctctttcccataacggcgaaatcgtcaacgcggatgagctgaaggaggagatgaagaaggaaggcgtaaattttcagagtgattcagacaccgaggtactgctcgcagagctttcaagaaacatttcaaagtacggcctgaaaaaaggttttgaggtgtctatgaacaccctcaggggggcctatgcctgcgcagtgggcataaatgacaggctcttcgccatgagggacccaaacggaataaggcccctcatcgtaggaaagaatgcggatggatacataatagccagtgaaagctgtgccatagatgcacttgatgggacgatcataaggaatgttgaacccggcgaggtcgttgaactgacagatgacggcctgaagaccatagcacttcacgaaggagagaagaccgcacactgtatgtttgaatacgtatacttctcaaggcctgacagcaccatagatggcataaatgtgtatatggccagggtcaaaatgggcatgatgcttgccaaggagagccccgtggaggccgacatggtcatacctgtccccgattccggtagatcgcaggccatcgggttctcgatgcagtcaggcataccctacaccgaaggcttgatgaagaacaggtattccgaaagaactttcataatgcctacacaaagcgacagaaaggccgcgatcaggctgaagctgaaccccgtcagggaagtcatatctggtaagaggattgtgctggtcgatgatagcatcgtaaggggaaacaccatgcgattcatcgtgagcatgatgagaaagtatggtgcgaaggaggttcatgttcgcataggttcgccacacataattgcaccttgctatttcggcgtggatatgaagacaaaggatcagttcatagcacgcggaaaaacggatgcagagataaacagcgagataggagctgattcgctggcattcctctccatagatggcctcaaggaagccattggccttgatgagaataatctgtgtcttggatgtctgaccggcacctatcccatagacatatcgaaaaaacttgcggagaagatcacgcagtattga

SEQ ID NO: 30216 - protein, 474 aa, Thermoplasma acidophilum DSM 1728
MDSLPPGSDPIDGQKPSEDCAVVGFKGRINAYEPIITALRTLQHRGQESAGMAVFDGRKTVLKKGRGLVTDVFNPATDSIKGKVGVGHTRYSTAGSKDVIDAGPFVINSQVGFISLSHNGEIVNADELKEEMKKEGVNFQSDSDTEVLLAELSRNISKYGLKKGFEVSMNTLRGAYACAVGINDRLFAMRDPNGIRPLIVGKNADGYIIASESCAIDALDGTIIRNVEPGEVVELTDDGLKTIALHEGEKTAHCMFEYVYFSRPDSTIDGINVYMARVKMGMMLAKESPVEADMVIPVPDSGRSQAIGFSMQSGIPYTEGLMKNRYSERTFIMPTQSDRKAAIRLKLNPVREVISGKRIVLVDDSIVRGNTMRFIVSMMRKYGAKEVHVRIGSPHIIAPCYFGVDMKTKDQFIARGKTDAEINSEIGADSLAFLSIDGLKEAIGLDENNLCLGCLTGTYPIDISKKLAEKITQY

SEQ ID NO: 30217 - DNA, 1503 bp, Caulobacter crescentus CB15
  CDS (1)..(1503): transl_table=11
atgaccttcctgggccagtcgactgaccgctattcctcgagcccctggcgggacccggaggacgacagcctgcgtctggaatgcggcgtgttcggcgtgttcggcgtgcgtgacgccgccgccatcgccgcgctgggcctccacgctttgcagcaccgcggccaggaggcctgcggcatcgccgccttcgacggcaatcgcttccacactgagcggcacatggggcatgtcggcgacgccttcaccggcgccgacctcgtccagcgcctgccgggcaacatggccatcggccacacgcgctattcgacggccggcggcagcttcatccgcaacgtccagccgatgttcgccgaccttgagaccggcggcgtcgcgatcgctcacaacggcaacctgaccaacttcctgaccctgcgcgagcgtctggtgcaggaaggcgcgatcttccagtcgacctcggactccgaagcgatccttcacctgatcgcgcgctcgcggaaggccaagatcgtcgatcgcttcgtcgatgcgatcagccagatcgagggcggctacgccctggtggcgatcaccaacaagaagatgatcggcgtgcgcgatccgctgggcatccgcccgctggtgctgggtgatctggacggcaagccggtgctggcgtctgagacctgcgcgctcgacatgatcggcgcccgcttcgtgcgcgacatcgaacatggcgagatggtggtgatcgaggagaccggtatcacctcgaccaagccgttccagaccgccccggcgcgcccctgcgtgttcgagtatgtctatttcgcccgtcccgacagcgtcgtgaacggtcgctcggtctatggcgtgcgcaagcgcatgggcatgaacctggccaaggaaaccggcgtcgaggccgatgtcgtggtgcccgtgcccgacagcggcgtgccggccgcgctcggctacgcccagcagagcggcctgccgttcgagatgggcatcatccgcaaccactatgtgggccgcaccttcatccagcccacccagggcgtgcgcgaactgggcgtgcgcatgaagcacagccccaatcgcgcggtcctcgcgggcaagcgcgtcgtcctgatcgacgactcgatcgtgcgcggcaccacctcgctgaagatcgtccgcatggtccgcgaagccggcgccaaggaggtccacctccgctcggccagcccgccgatcaagtggcccgacttctacggcatcgacatgcccgagcgtgagcagctgctggccgccaacaagtcgctggaagagatggcccggttcctggaggtcgactcgctgggcttcctgtccgtggacggtctctacgacgccctggaagcgggtcagcgcgacccggcgaccccgcagttcaccgatcactacttcaccggcgactatccgacccgcctgacggaccgcgagatcgccgagggtcgcaacgaaaccaacgacaagcagctttcgctgctggtcagcgcgtga

SEQ ID NO: 30218 - protein, 500 aa, Caulobacter crescentus CB15
MTFLGQSTDRYSSSPWRDPEDDSLRLECGVFGVFGVRDAAAIAALGLHALQHRGQEACGIAAFDGNRFHTERHMGHVGDAFTGADLVQRLPGNMAIGHTRYSTAGGSFIRNVQPMFADLETGGVAIAHNGNLTNFLTLRERLVQEGAIFQSTSDSEAILHLIARSRKAKIVDRFVDAISQIEGGYALVAITNKKMIGVRDPLGIRPLVLGDLDGKPVLASETCALDMIGARFVRDIEHGEMVVIEETGITSTKPFQTAPARPCVFEYVYFARPDSVVNGRSVYGVRKRMGMNLAKETGVEADVVVPVPDSGVPAALGYAQQSGLPFEMGIIRNHYVGRTFIQPTQGVRELGVRMKHSPNRAVLAGKRVVLIDDSIVRGTTSLKIVRMVREAGAKEVHLRSASPPIKWPDFYGIDMPEREQLLAANKSLEEMARFLEVDSLGFLSVDGLYDALEAGQRDPATPQFTDHYFTGDYPTRLTDREIAEGRNETNDKQLSLLVSA

SEQ ID NO: 30219 - DNA, 1518 bp, Haemophilus influenzae Rd KW20
  CDS (1)..(1518): transl_table=11
atgtgtggtattgtcggtattgttagccaaagtccggttaatgaatctatttatgcagcattaacccttttgcaacatcgtggacaagatgcggcaggtattgtaacggttgatgatgaaaaccgttttcgcttacgtaaagctaatggtttagtcagtgatgtgtttcatcaagaacatatgctacgattgcaaggaaatgctggattggggcatgttcgctatcctacagcggggagttctagcgtctcagaggcacagcctttttatgtgaattctccctatggtgtcactttagtgcataacggcaacttaaccaactcagtggagttaaaagaaaaggtctttaaaactgctcgccgccatgtaaacactaattcagattccgaacttcttcttaatattctcgccaatcacctcgatcacattcctcaagatcacctcgatccacaagatattttctatgctgttcgtaaaactcacaaggatgttcgcggtgcttatgcttgtttagcgatgattattgggcatggcatggttgcgtttcgtgatccttttggcattcgtcctttggtgttgggtaaacgcgaggaaaatggcaaaaccgattatatgtttgcgtctgaaacagtggctttagatattgtaggtttcgaatttgtgcgtgatattgctgcaggcgaagctgtttatgtgacgtttgatggcgagctttattcacaacaatgtgctgaaagtgcggtgttaaatccttgtatttttgagtatgtttattttgcacgcccagattcaacgattgatggcgtctctgtttatgctgcgcgtgttcacatgggcgaaaaacttggacaaaaaattgcaaaagaatgggctgatgaaattgataatattgatgtggtgattcccgttcctgaaacttcaacagatattgcgttacaaatagctcgtgtactagggaagccttatcgccaaggatttgtgaaaaatcgctatgttggccgtacctttattatgccaggacaagcacagcgtattagttcggttcgtcgtaaattgaataccattaaagctgaatttaaagataaaaacgtgttattggtagacgattctattgttcgtggcacaacctctgagcaaattgttgaaatggctcgctcagctggtgcgaagaaaatttacttcgcctcggctgctccagaaattcgttatccgaatgtatatggtattgatatgccgagtcgcgatgaactgatcgcttatggacgaaatgttgatgaaattgcagaattaattggcgtagataaattaattttccaagatctgaccgcacttactgaatctgttcaattggaaaacccagccattcaaggttttgattgttctgttttcacaggcgaatatattacaggcgatattagccctgaatatttagagaaaatcgcaactcaacgcaatgataacgcaaagaagaaacgagaaaaacaagcatccaatcttgaaatttacaatgaacaataa

SEQ ID NO: 30220 - protein, 505 aa, Haemophilus influenzae Rd KW20
MCGIVGIVSQSPVNESIYAALTLLQHRGQDAAGIVTVDDENRFRLRKANGLVSDVFHQEHMLRLQGNAGLGHVRYPTAGSSSVSEAQPFYVNSPYGVTLVHNGNLTNSVELKEKVFKTARRHVNTNSDSELLLNILANHLDHIPQDHLDPQDIFYAVRKTHKDVRGAYACLAMIIGHGMVAFRDPFGIRPLVLGKREENGKTDYMFASETVALDIVGFEFVRDIAAGEAVYVTFDGELYSQQCAESAVLNPCIFEYVYFARPDSTIDGVSVYAARVHMGEKLGQKIAKEWADEIDNIDVVIPVPETSTDIALQIARVLGKPYRQGFVKNRYVGRTFIMPGQAQRISSVRRKLNTIKAEFKDKNVLLVDDSIVRGTTSEQIVEMARSAGAKKIYFASAAPEIRYPNVYGIDMPSRDELIAYGRNVDEIAELIGVDKLIFQDLTALTESVQLENPAIQGFDCSVFTGEYITGDISPEYLEKIATQRNDNAKKKREKQASNLEIYNEQ

SEQ ID NO: 30221 - DNA, 1428 bp, Listeria monocytogenes EGD-e
  CDS (1)..(1428): transl_table=11
atgcttgctgaagtaaaaggacttaacgaagaatgtggtatttttggtatttgggatcatcctaatgcagcggaaatcacctattatgggttgcatagtttacaacatcgcggtcaagaaggtgccggaattgtttcgacagacggcgaaatactaaaaggtcaccgaaatctcggccttttagcagacgtatttaaacatggtgaactagatgatttaaaaggtaaagcagccattggccatgttcgatacgcgacagctggtcaaaaaaacttagggaacgtacaaccatttttatttcactttcatagttcttctttagcacttgcgcataacgggaatttggttaatgcgaaaagtttacgccgtgaactagaagaagaaggcgctatttttcaaacgagttcggatacagaagtgttagcgcatttaattaaacgtagccatacaggggattttgtggaagatttaaaagtggctttgaacaaggttaagggtggctttgcgtacatgcttctgacggaagatacgatgtatgctgcacttgatccgaatggttttagaccgctttcgattggtcgcattggtgattcttacgtagttgcttcagaaacatgtgcttttgaaacggttggcgctgaatttgttcgagacgtggagccaggcgaactaattattattaatgatgacggacttcggattgaaaaatttacggaaaatgtgaagcattcgatttgtagtatggagtatatttattttgctcgaccagactctaatatcgctgggattaatgtccactcagctagaaaacgttctgggaaaaggctagcgaaagaagcatttattgatgccgatgttgttacaggtgtgccagattcgagtatttctgcggcgattggttatgcggaagaggctggacttccatacgagcttggcctcatcaaaaatagatatgtggcaagaacctttatccaaccatcgcaagaactcagagagcaaggggttagaatgaagctttcggcggtgcgtggggttgtggaagggaaacgtgttgtcatgattgatgattcgattgtgcgcgggacgacgagtaaacgtattgtgcaacttttgcgggaagcgggagcagcggaagttcatgtgagaatagcttcaccgccacttgcttacccttgtttttacggtattgatattcaaacgcgaaatgaattaatcgcatctaattattctgtcgatgaaatttgtcggattattggggctgattctttagagtatttgagtgaagagggtttagtagattccattggtagaccttatccgaacgaaccatacgggggactttgtatggcttatttcaacggcgattacccaacccctttatacgattatgaagcggaatatttagcgagcttagaagcagaaaaataa

SEQ ID NO: 30222 - protein, 475 aa, Listeria monocytogenes EGD-e
MLAEVKGLNEECGIFGIWDHPNAAEITYYGLHSLQHRGQEGAGIVSTDGEILKGHRNLGLLADVFKHGELDDLKGKAAIGHVRYATAGQKNLGNVQPFLFHFHSSSLALAHNGNLVNAKSLRRELEEEGAIFQTSSDTEVLAHLIKRSHTGDFVEDLKVALNKVKGGFAYMLLTEDTMYAALDPNGFRPLSIGRIGDSYVVASETCAFETVGAEFVRDVEPGELIIINDDGLRIEKFTENVKHSICSMEYIYFARPDSNIAGINVHSARKRSGKRLAKEAFIDADVVTGVPDSSISAAIGYAEEAGLPYELGLIKNRYVARTFIQPSQELREQGVRMKLSAVRGVVEGKRVVMIDDSIVRGTTSKRIVQLLREAGAAEVHVRIASPPLAYPCFYGIDIQTRNELIASNYSVDEICRIIGADSLEYLSEEGLVDSIGRPYPNEPYGGLCMAYFNGDYPTPLYDYEAEYLASLEAEK

SEQ ID NO: 30223 - DNA, 1428 bp, Listeria innocua Clip11262
  CDS (1)..(1428): transl_table=11
atgcttgctgaagtaaaaggacttaatgaagaatgtggtatttttggtatttgggatcatcctaatgcagcggaaatcacttactatgggttgcatagtttacaacatcgcggtcaagaaggtgccggaattgtttcaacagacggagaaacgttaaaagggcatcggaatcttgggcttttagcagatgtatttaagcacggtgaactagacgatttaaaaggtaaggcagcaattggccacgttcgctatgcaacagctggtcaaaaaaacttaggaaatgtacaaccatttttatttcattttcacagttcttcacttgcacttgcgcataatggaaatttagtgaatgcgaagactttacgccgcgaattagaagaagaaggagctatctttcaaacaagttcggacacggaagtattagcgcatttaattaaacgcagccatactggtgattttgtagaagatttaaaagtagctttaaacaaggtcaaaggtggctttgcatatatgctgcttacagaagatacaatgtatgccgcgcttgatccaaatggctttagaccgctttcgattggtcgaattggcgattcttatgtagttgcttctgaaacttgtgcttttgaaacggttggtgctgaatttgtccgtgatgtggagccaggtgaactgattattattaataatgacggactgcggattgaaaaatttacggaaaatgtgacgcattcgatttgtagtatggaatatatttattttgctcgtccggactctaatattgctggaattaatgttcactcagctagaaagcgttctgggaaaagacttgcaaaagaagcatttattgatgcggatgtagtgacaggtgtgccggattcaagtatttctgcggcgattgggtatgcagaagaagccggactgccgtacgaacttggtctcatcaaaaatagatatgtggcaagaacttttattcagccatcgcaagaacttagggaacaaggggttagaatgaagctttctgcggtgcgaggagttgtggaaggtaaacgagttgtcatgattgatgattccatcgttcgcgggacgacaagtaaacgcattgtccagcttttacgtgaagcgggcgcggcggaagttcatgtgagaattgcttctccaccacttgcttatccttgtttttatggaattgatattcaaacacgaaatgaattgattgcttctaattattctgttgatgaaatttgccgtattattggcgcagattctttagagtatttgagtgaagaaggtttagtagattccattggcaaaccttatccgaatgaaccttatgggggactttgtatggcttattttaacggggattatccgacccctttatacgattatgaagcagaatatttagcgagcttagaagcagaaaaataa

SEQ ID NO: 30224 - protein, 475 aa, Listeria innocua Clip11262
MLAEVKGLNEECGIFGIWDHPNAAEITYYGLHSLQHRGQEGAGIVSTDGETLKGHRNLGLLADVFKHGELDDLKGKAAIGHVRYATAGQKNLGNVQPFLFHFHSSSLALAHNGNLVNAKTLRRELEEEGAIFQTSSDTEVLAHLIKRSHTGDFVEDLKVALNKVKGGFAYMLLTEDTMYAALDPNGFRPLSIGRIGDSYVVASETCAFETVGAEFVRDVEPGELIIINNDGLRIEKFTENVTHSICSMEYIYFARPDSNIAGINVHSARKRSGKRLAKEAFIDADVVTGVPDSSISAAIGYAEEAGLPYELGLIKNRYVARTFIQPSQELREQGVRMKLSAVRGVVEGKRVVMIDDSIVRGTTSKRIVQLLREAGAAEVHVRIASPPLAYPCFYGIDIQTRNELIASNYSVDEICRIIGADSLEYLSEEGLVDSIGKPYPNEPYGGLCMAYFNGDYPTPLYDYEAEYLASLEAEK

SEQ ID NO: 30225 - DNA, 1500 bp, Nostoc sp. PCC 7120
  CDS (1)..(1500): transl_table=11
atgattcccattgattccgtcactccggatgagtaccctaatcagactaacaacccaattgatagtcaagaaaatcgtcctgacaagccagaagaggcttgtggagttttcggcatttacgccccaggagaaaatgttgcaaaactgacctactttggattgtatgccctgcaacatcggggtcaagaatcagctggcattgccacgtttgagggtacaacagttcacctgcataaagacatgggtttggtttctcaagtctttaatgagtcgattttagaagagttgcctggtgatatcggcgttggtcatacccgttactctaccactggttccagccgcaaagttaatgcccagcctgctgtcctagacactcgtttaggcaagctagctctagcacataatggtaatttagtcaatactgtgaagttgcgccaagagttagttaatagcaactgcaacctagtgacaaccacagactcagaaatgattgcttttgcgatcgctcaagcagtcaacgcaggtgcggactggttagatggggcgattcaagcattccatcgttgcgagggagcttttagcttagtgattggcacacctgttggtgtgatgggagtgcgtgacaccaacggcattcgtcctctggtaattgggattttgcctggtaatcctgtgcgctatgttttatcctcggaaacttgtggtttagacattattggcgctgaatttctacgagatgtagaaccaggtgaagtagtttggattaccgaaaaaggtttagcttcctaccactggagtcaaaagccagaacgaagattgtgtattttcgagatgatttattttgctcgtcccgatagccaaatgcacaacgagagtttgtacagttatcggatgcgtttaggaaggcaactagcagccgaatcctacgtagatgctgatattgtctttggtgtacctgattctggtattcctgctgctattggattttcccaggcttctggtgttgcctacggtgaagggttaattaagaatcgctatgttggtcgcacctttattcagccaacccaaaccatgcgggagtcggggattaagatgaaactcaaccccctcaaagatgtgctggcgggtaaaagagtgattatcgttgatgactccattgtcagaggtactactagccgcaaactagttaaagctttacgtgatgctggtgcagccgaagtacatatgcggatttcttccccaccagtaactcatccttgtttctacggaattgatactgattctcaagaccagctaattgctgctactaagtcagtagaagagattgccaagcaattagaagtagaaagcctggcctatctcagttgggatgggatgttagaagcaaccagagaagacaaaaatagtttctgttctgcctgttttacaggtgattaccctgttggtattcctgaacaggtgaaacgcgctaagttgattttagaaaaggtagtagtttag

SEQ ID NO: 30226 - protein, 499 aa, Nostoc sp. PCC 7120
MIPIDSVTPDEYPNQTNNPIDSQENRPDKPEEACGVFGIYAPGENVAKLTYFGLYALQHRGQESAGIATFEGTTVHLHKDMGLVSQVFNESILEELPGDIGVGHTRYSTTGSSRKVNAQPAVLDTRLGKLALAHNGNLVNTVKLRQELVNSNCNLVTTTDSEMIAFAIAQAVNAGADWLDGAIQAFHRCEGAFSLVIGTPVGVMGVRDTNGIRPLVIGILPGNPVRYVLSSETCGLDIIGAEFLRDVEPGEVVWITEKGLASYHWSQKPERRLCIFEMIYFARPDSQMHNESLYSYRMRLGRQLAAESYVDADIVFGVPDSGIPAAIGFSQASGVAYGEGLIKNRYVGRTFIQPTQTMRESGIKMKLNPLKDVLAGKRVIIVDDSIVRGTTSRKLVKALRDAGAAEVHMRISSPPVTHPCFYGIDTDSQDQLIAATKSVEEIAKQLEVESLAYLSWDGMLEATREDKNSFCSACFTGDYPVGIPEQVKRAKLILEKVVV

SEQ ID NO: 30227 - DNA, 1443 bp, Caenorhabditis elegans
  CDS (1)..(1443)
atgtgtggtatatttgggattgttgccgctggaaattatgagcatttgaatgttcttgctgcaaatggattggctgctcttcaacacagaggaactgaatcaacaggactcgttggttcagatggaatcactcgagaccacgtggaaattatcaaaggtcatggacttgtccgagatgtgattactgaagataatatctcaagaatgaatgggcaatcgataataattggtcataataggtattcaactgcaggaaagaagaagtctggaatcaattgtgtacaaccatttgtggtatatactgcaatgggtactgtagcaattgctcataatggagaattggttgatgcgaaacaaaaaagaaaggaagtacttcatgaaggtgttggtttatcaactgacactgactcagagcttattgctcaaatgattgcaaaagcgattgctctgaatgtaaaatgcaagtatggacaagagatgggtgatattacaagagagctcgcagtaacaatgtctgcactaaacatgtcatattctctactagtaatgacatttgatagactatacgcaattcgtgatccatttggaaatcgtccactttgtgttggtactgtatattctaaaaatggaaatccagaagcattcattgcatcttctgaatcttgtgcatttcctgcaaatgctaaattagatttcgaagtgagaccaggagaaattgtggaattatcgacaggaggaatcaagtcggtgtggcagatgaaaccgaatactcctctggctatgtgcatattcgaatatgtctattttgcacgaaatgattcagaaattgaaggacaacaagtacaaactgttcgtgaagaatgtggaaaaacgatggctcttgaagatgatctagaagcagatattgttggaaatgttccagattcttcgctgagtgcagcaattggatacgcttctcagtctggaatcacatatgaacctgttttacacagaaattcatatgttggaagatcatttatagaaccaaatgatgagatgagacaaaatgcgattaaaatgaaatttggagtattgaagaaaaagattcatggacaaaggattgtgttagtagatgattcaattgtacgtggaaatacgatgagaactttggtaaaaatgttaagagatgctggagcaaaagaggttcatctacgaattgcttccccgcctgtaaaattcccatgttttatgggaatcaacattccaaccacaaaggaattgattgctgccgaaaaaacaattccagaaatctgccaatttgttggagccgattcagtacggtatctttcggttgacggtttagtttcgtctgttcaaaaaggaatcgaacgagctgccaacttctctccaggacattgcaccgcatgtctcactggaaaatatccagttgctatcgatttataa

SEQ ID NO: 30228 - protein, 480 aa, Caenorhabditis elegans
MCGIFGIVAAGNYEHLNVLAANGLAALQHRGTESTGLVGSDGITRDHVEIIKGHGLVRDVITEDNISRMNGQSIIIGHNRYSTAGKKKSGINCVQPFVVYTAMGTVAIAHNGELVDAKQKRKEVLHEGVGLSTDTDSELIAQMIAKAIALNVKCKYGQEMGDITRELAVTMSALNMSYSLLVMTFDRLYAIRDPFGNRPLCVGTVYSKNGNPEAFIASSESCAFPANAKLDFEVRPGEIVELSTGGIKSVWQMKPNTPLAMCIFEYVYFARNDSEIEGQQVQTVREECGKTMALEDDLEADIVGNVPDSSLSAAIGYASQSGITYEPVLHRNSYVGRSFIEPNDEMRQNAIKMKFGVLKKKIHGQRIVLVDDSIVRGNTMRTLVKMLRDAGAKEVHLRIASPPVKFPCFMGINIPTTKELIAAEKTIPEICQFVGADSVRYLSVDGLVSSVQKGIERAANFSPGHCTACLTGKYPVAIDL

SEQ ID NO: 30229 - DNA, 1536 bp, Ralstonia solanacearum GMI1000
  CDS (1)..(1536): transl_table=11
atgtgcggtatcgttggggtggtttcggccacgcccgtcaatcagctgatctacgacagcctgctgctgctgcagcaccgggggcaggacgcggcgggcattgccaccgcggccggcagcaccttccacatgcacaaggccaacggcatggtgcgcgacgtgttccgcacgcgcaacatgcgcggcctgccgggcaccatcggcatcggccaggtgcgctatccgaccgccggctccgccagcgaggaagaggcccagccgttctatgtcagcgcaccgttcggcatcgtgctggctcacaacggcaacctgaccaactccgagcagctgcgcgaagagatgttccggcgcgaccgccgccacatcaacacgcattccgactccgaagtgctgctcaacgtgctggccgacgaactgcagcgcgccagcaacgacatcgcgttgtcgcccgaggccatcttcaaggcggtggccggcatgcatcgccgcgtgcgcggctcgtacgccatcgtgtcgcagatcgccggctacggcatgctggccgtgcgcgacccgttcggcatccgtccgctggcgctgggcagccaggaaacgccggacggcgtcgagtggatggtggcctccgaatcggtggcgctggaaggcatcggcttcaagttcgagcgcgatgtggcgccgggcgaagccatcttcgtcgacctcgaaggccagctgcacaccaagcagtgcgcggatcatccggtcctgacgccctgcatcttcgaatacgtctatctggcgcggccggactcgcgcatggacggcgcgtccgtgtacgacgcgcgcctgcgcatgggcgattacctggccgagaagatcaagcgcgaggtgaccgacccgatcgacgtggtgatgccgatccccgattcgagccggccggcggccatgcaggtcgccaactgcctgggcgtgccgtaccgggaaggcttcttcaagaaccgctacgtgggccgcaccttcatcatgccgggccaggcggtgcgcaagaaatcggtgcgccagaagctgaacgccatggcgatcgagttcaagggcaagaacgtgctgatcgtcgacgattccatcgtgcgcggcaccacgtcgtcggagatcgtgcagatggcgcgcgatgcgggcgcgaagaaggtgatcttcgcctcggcggcgccgccggtgaagttccccaacgtgtacggcatcgacatgcccacgcgcagcgaactggtcgcgcacggtcgcacgcacgacgagatcgcccggatcatcggcgccgaccagctcgtctaccaggacgtggaagacatgaagcgcgcggtgcgcgacgtcaacccggcgctgcgcgatttcgaggcatcgtgcttcgacggccactacgtgaccggcgatatcgacgaagcgtatctcgaccggctggaagcgtcgcgcaacagcgcggcggcctgcgcggcccgcgacagcgcgcagaacgacaatccgcgcacgcagctgcacttgcagccgtcggccgtcaacgagtaa

SEQ ID NO: 30230 - protein, 511 aa, Ralstonia solanacearum GMI1000
MCGIVGVVSATPVNQLIYDSLLLLQHRGQDAAGIATAAGSTFHMHKANGMVRDVFRTRNMRGLPGTIGIGQVRYPTAGSASEEEAQPFYVSAPFGIVLAHNGNLTNSEQLREEMFRRDRRHINTHSDSEVLLNVLADELQRASNDIALSPEAIFKAVAGMHRRVRGSYAIVSQIAGYGMLAVRDPFGIRPLALGSQETPDGVEWMVASESVALEGIGFKFERDVAPGEAIFVDLEGQLHTKQCADHPVLTPCIFEYVYLARPDSRMDGASVYDARLRMGDYLAEKIKREVTDPIDVVMPIPDSSRPAAMQVANCLGVPYREGFFKNRYVGRTFIMPGQAVRKKSVRQKLNAMAIEFKGKNVLIVDDSIVRGTTSSEIVQMARDAGAKKVIFASAAPPVKFPNVYGIDMPTRSELVAHGRTHDEIARIIGADQLVYQDVEDMKRAVRDVNPALRDFEASCFDGHYVTGDIDEAYLDRLEASRNSAAACAARDSAQNDNPRTQLHLQPSAVNE

SEQ ID NO: 30231 - DNA, 1644 bp, Drosophila melanogaster
  CDS (1)..(1644)
atgatggcgcaaagtgattctggaaattgctgtgccaagcttaataaagatgagtgctgccagaagacaaaggatgtgatcttgagcggcgtatctcccaaaatgtttcccgacaaaatctacaagtctgttcaacccaaaggagaggatgccaccggaatgacctgcgaatgcggtgtttttgcagccatcgcttgcggggattacccaacacaactggacatagcacagatgatctgcctcggtctggtggctctgcagcatcgtggccaggagtcggcgggaatagtgaccagtttgggcaagtcctccaagaatttcagcgtacacaagggcatgggcatgatcaacaatctgttcaatgacgaggcgatcaggaagttaaagggtaacctgggaataggacacacccggtattccacggccgcagcctcggaagttgtgaactgccagccgtttgtggtgcacactgcccatggagcactggccattgcccacaatggtgagctagtgaactgcgagtccctgaggagggaggtcctggagcgaggagtgggcctgtctacgcacagtgacagtgaacttattgcccaatccctgtgctgtgcaccagaggatgtgtcggagcacgatggacccaattggccggccagaattcgccatttcatgaccctggctccactctcctactccctggtcgtgatgcacaaggataagatctacgctgtccgcgattcctatggcaatagaccgctgtgcttgggaaaaatcgtgcccgttgatgcaggacatgcgaatatcaatgaccaactggccgagggttgggtggtcagtagtgaaagctgcggattcctctccatcggagccagatatgttcgcgaggtggagcccggtgagatcatcgagctgtcacgaaatggttatagaaccgtggatatcgttgaaagaccggactataagcgcatggcattctgcatctttgagtacgtctactttgcccgcagtgattccatgttcgagggtcagatggtttactcagcccgcctgcaatgtggtcgccagttggccagggaatcgccattagatgcggatttggtcagctcggttccggaatcgggcacagcagctgcccatggttatgccagggagtcgggactgccattcggggaagttctctgcaagaatcgctatgtgggccgcacgttcatccaaccctcgacgagattgcgacagttgggcgtggccaaaaagtttggtgccctggctcaaaatgtcgagggcaagcggatcgtgctagtcgatgactccatagtgaggggaaataccattggaccgattatcaaactcctgcgagatgccggcgccaccgaggtgcacattcgcattgccagtcctccgctgcaatatccctgctacatgggtatcaatatacccactcgtgaggagctaatagccaacaaattgaatgcggatcagctggcggatcacgtgggtgcggatagtctggcctatttgagtgtggagggtctggtcaaggccgtccagatgaacaaggcccatgtgaatccactcaaagctggctactgcaccgcttgcctaacgggcgagtatcctggcggattgccggaggagctcagctggtag

SEQ ID NO: 30232 - protein, 547 aa, Drosophila melanogaster
MMAQSDSGNCCAKLNKDECCQKTKDVILSGVSPKMFPDKIYKSVQPKGEDATGMTCECGVFAAIACGDYPTQLDIAQMICLGLVALQHRGQESAGIVTSLGKSSKNFSVHKGMGMINNLFNDEAIRKLKGNLGIGHTRYSTAAASEVVNCQPFVVHTAHGALAIAHNGELVNCESLRREVLERGVGLSTHSDSELIAQSLCCAPEDVSEHDGPNWPARIRHFMTLAPLSYSLVVMHKDKIYAVRDSYGNRPLCLGKIVPVDAGHANINDQLAEGWVVSSESCGFLSIGARYVREVEPGEIIELSRNGYRTVDIVERPDYKRMAFCIFEYVYFARSDSMFEGQMVYSARLQCGRQLARESPLDADLVSSVPESGTAAAHGYARESGLPFGEVLCKNRYVGRTFIQPSTRLRQLGVAKKFGALAQNVEGKRIVLVDDSIVRGNTIGPIIKLLRDAGATEVHIRIASPPLQYPCYMGINIPTREELIANKLNADQLADHVGADSLAYLSVEGLVKAVQMNKAHVNPLKAGYCTACLTGEYPGGLPEELSW

SEQ ID NO: 30233 - DNA, 1509 bp, Agrobacterium tumefaciens str. C58
  CDS (1)..(1509): transl_table=11
atgattgagccgctttcgcattccccgttttctgggtccactttcaaggaagagatcgatggcgatacgctgcatgaagaatgcggcgttttcggcattctcggccatgacgatgcctcggcgctgaccgctctcggcctgcatgcgcttcagcatcgcggccaggaagcagccggcatcgtctcctttgatggcaagcgcttccatcaggagcgccatatgggcctcgtcggcgatcattataccgatccggcaacccttgcccgcctgcccggctccatcgcgattggccacacccgttattccacgacaggcgaagtggcgatgcgcaatgtgcagccgctgtttgccgagctggaagaaggcggcatttcgattgcccataacggcaatttcaccaacggcctgacgctgcgccgccagatcatcgccaccggcgccatctgtcagtcgacatcggataccgaagtcgtgctgcatctcatcgcccgttcacgccactcttccaccgccgatcgtttcatcgatgctatcaggcagatggaaggcggttattcgatgctggcgatgacgcggaccaagctgatcgccgcccgcgacccgatcggcatccgcccgctggtcatgggagagcttgatggcaagccgatcttctgctcggaaacctgtgctctcgacatcatcggcgcgaaattcgtgcgcgacgtggaaaacggcgaagtcatcatctgcgaaatccagcctgacggttctatcaccatcgatgcccgcaagccctcgaagccgcagccggagcgtctctgcctgttcgaatatgtctatttcgcccgtcccgattccgtcgtcggcggccgcaacgtctatacgacgcgcaagaacatgggcatgaaccttgccaaggaagcgccgctggaagccgatgtcgtggttccggttcccgatggcggcacgccggcagcgctcggttttgcgcaggcaagcggtattcccttcgaatacggcatcatccgcaaccattatgtcggtcgcaccttcattgagccgacacagcagatccgcgctttcggcgtcaagctcaagcattccgccaaccgggcgatgatcgaaggcaagcgcgtggtgctggtggatgattccatcgtgcgcggcacgacttcggtgaagatcgtgcagatgatccgcgaggcgggcgccaaggaagtgcatatccgcgtcgccagcccgatgatcttccatccggatttctacggcatcgacacgcctgacgctgataagctgctcgccaaccaatatgccgatgtggacgccatggcgaaattcattggtgccgattcgctggctttcctgtcgattgacgggctgtaccgcgccgttggcggtgaaaaccgcaaccacgcgcgcccgcagttcaccgaccattatttcaccggcgattatccgacccgtcttctcgaccagaacggcgaggccatgggcagcaagatttccatgctggccagcaacggctga

SEQ ID NO: 30234 - protein, 502 aa, Agrobacterium tumefaciens str. C58
MIEPLSHSPFSGSTFKEEIDGDTLHEECGVFGILGHDDASALTALGLHALQHRGQEAAGIVSFDGKRFHQERHMGLVGDHYTDPATLARLPGSIAIGHTRYSTTGEVAMRNVQPLFAELEEGGISIAHNGNFTNGLTLRRQIIATGAICQSTSDTEVVLHLIARSRHSSTADRFIDAIRQMEGGYSMLAMTRTKLIAARDPIGIRPLVMGELDGKPIFCSETCALDIIGAKFVRDVENGEVIICEIQPDGSITIDARKPSKPQPERLCLFEYVYFARPDSVVGGRNVYTTRKNMGMNLAKEAPLEADVVVPVPDGGTPAALGFAQASGIPFEYGIIRNHYVGRTFIEPTQQIRAFGVKLKHSANRAMIEGKRVVLVDDSIVRGTTSVKIVQMIREAGAKEVHIRVASPMIFHPDFYGIDTPDADKLLANQYADVDAMAKFIGADSLAFLSIDGLYRAVGGENRNHARPQFTDHYFTGDYPTRLLDQNGEAMGSKISMLASNG

SEQ ID NO: 30235 - DNA, 1551 bp, Brucella melitensis 16M
  CDS (1)..(1551): transl_table=11
gtgcctccgcttttccgcgatatgcttaagttgcctctgcaatcgaaaggccttgcggcaatgaccagccattcttctgaaaatgccccctttatgctggatgatgacaccctgcatgaagaatgtggtgtattcggcattctgggccatgaggatgcggctgcgctgaccgcgctcggcctgcatgcgctccagcatcgcggtcaggaagccgccggcattgtttcctatcataatcgccgtttccattccgaacgccatatgggcctcgtcggcgaccatttcaccgatgcggcaacactgaaccgcctgccgggcaaccgcgccatcggccatgtgcgttattccacaaccggcgagacgatcctgcgcaatgtacagccgctgtttgcggaactggaagtcggcggcatcgccattgcccataacggcaatttcaccaatggcattacgctgcgcaaacagttgattgcttccggcgcgatcttccaggcaacgtcggatacggaagtcgtgctgcacatgattgcccgttcgcggcactcctcctcaaccgaccgtttcgtggaagcgatccgccaggttgaaggcggctatgccatgctggcgcttacccgcaccaagctgatcgccgcgcgcgatcccatcggcattcgcccgctcgtcatgggcgagctggacggcaagccgatcttctgctcggaaacctgcgctctcgatattatcggcgcgaaatatattcgcgacgtcgagaatggcgaagtggtagtctgcgaaatccagaaggatggctccatcaccacccgatccatcaagccggaaaatccgcagccggagcggctgtgcctttttgaatatgtttatttcgcacggccggattcggtagtgggtggccgcagcgtctatgtggcgcgcaagaacatgggcatgaaccttgccgccgaggcgggcgtggatgccgatgtggtcgtgcccgtaccggatggcggtacgccggcagcgctgggctttgcgcaggcaagcggtattccgtttgaatatggcatcatccgcaaccattatgtgggccgcaccttcattgagcctacacagcagatccgcgcgcttggcgtgaagctgaaacattcagccaatcgcgctatgattgaaggcaagcgggtcgttctggtggatgattccatcgtgcgcggcaccacctcggtcaagatcgttcagatgatccgcgacgcaggcgcaaccgaagtccatatgcgcgtggcaagcccgatgatcttccacccggatttttacggtatcgacaccccccatgccgataagctgctggccaaccagcacgaaagcctcgaatccatgtgccgctacatcggcgccgattcgctggccttcctttccatcgacgggctctacaaggccgttggcggaaagccgcgtgatccaaaggcgccgaccttcaccgatcactatttcacgggcgagtatccgacccgccttctggatcaggaaggcgaaagcaacgtccacaccttgtcgctgctcgccagcaacggctga

SEQ ID NO: 30236 - protein, 516 aa, Brucella melitensis 16M
MPPLFRDMLKLPLQSKGLAAMTSHSSENAPFMLDDDTLHEECGVFGILGHEDAAALTALGLHALQHRGQEAAGIVSYHNRRFHSERHMGLVGDHFTDAATLNRLPGNRAIGHVRYSTTGETILRNVQPLFAELEVGGIAIAHNGNFTNGITLRKQLIASGAIFQATSDTEVVLHMIARSRHSSSTDRFVEAIRQVEGGYAMLALTRTKLIAARDPIGIRPLVMGELDGKPIFCSETCALDIIGAKYIRDVENGEVVVCEIQKDGSITTRSIKPENPQPERLCLFEYVYFARPDSVVGGRSVYVARKNMGMNLAAEAGVDADVVVPVPDGGTPAALGFAQASGIPFEYGIIRNHYVGRTFIEPTQQIRALGVKLKHSANRAMIEGKRVVLVDDSIVRGTTSVKIVQMIRDAGATEVHMRVASPMIFHPDFYGIDTPHADKLLANQHESLESMCRYIGADSLAFLSIDGLYKAVGGKPRDPKAPTFTDHYFTGEYPTRLLDQEGESNVHTLSLLASNG

SEQ ID NO: 30237 - DNA, 1263 bp, Pyrobaculum aerophilum str. IM2
  CDS (1)..(1263): transl_table=11
atgtgcggcataggcggcgcctggggcggcagggccggggagagggttaggcgcatggccccctggctcatgcaccggggacatgagggggtggggtatgcgtatatgaaaggaggggagattgccctgggggagccccgggacgacgcagagggggccttggtgcacaccagatacagcacctcgggggagtacggagtgcaactacagccagtcctcgccaagtatagagatttagaaatcgccgtggtcttcaacgggacagtagttaactacaagagactcggcgtggagagccccagttttgacggcgacgcgcttgccaaggccttggcgagggagatatgggagcggggagttgagcagggggttataagcgtatactctaaaatcgtcggcgcggccaccctcctggccttgaccccctggggccttctggccgtgagagatccgcgggggattaggccgctggcctaccgtctctacggagagggggtggccttctcttcagagaccgtggcgctgggaggcgggcaggaggtggccccgggcctagccgtgttgtacggcaagaggatggccttttggaaaatacccccaggagaggccaaaatatgcgccatggagctagtctacttcgcccacccagcctctattctgggcaaccgcctcgtggccgacgtgaggagggcattggggagggccctcgcagaggtggagacccacaacttcgacgtagtggcctacgtccccgagactgcgaggactgcggcggaggccttcgccgaggcgctgggaaagccgctggtagacgccgtggtgaagaacaggtttgcggggcgggtcttcatcacgccgcctcacctccgaaaccccggcgatgcctttcgggctgtgccccagctggtagagggcagaagggttgcccttgtggacgactcgttgataagaggcacaaacattaggacggtggtgagattgctgaaggaggcgggagccagggaggtacacgtgaggatagcgtcgccccccgtgaaatggccctgcttcttcggcatggacttccagacaaggagggagcttgtagctcacaaacgcgacgtggaggcaataagggcgtacataggcgcggacagcctcatatacctacccctcgaaaagtttagacagatcctgggaagcgcctgctacggctgcttcaccggggagtacccggtccagataaacgtcgaggaggcggaggtaagtacgcgcggcgcttag

SEQ ID NO: 30238 - protein, 420 aa, Pyrobaculum aerophilum str. IM2
MCGIGGAWGGRAGERVRRMAPWLMHRGHEGVGYAYMKGGEIALGEPRDDAEGALVHTRYSTSGEYGVQLQPVLAKYRDLEIAVVFNGTVVNYKRLGVESPSFDGDALAKALAREIWERGVEQGVISVYSKIVGAATLLALTPWGLLAVRDPRGIRPLAYRLYGEGVAFSSETVALGGGQEVAPGLAVLYGKRMAFWKIPPGEAKICAMELVYFAHPASILGNRLVADVRRALGRALAEVETHNFDVVAYVPETARTAAEAFAEALGKPLVDAVVKNRFAGRVFITPPHLRNPGDAFRAVPQLVEGRRVALVDDSLIRGTNIRTVVRLLKEAGAREVHVRIASPPVKWPCFFGMDFQTRRELVAHKRDVEAIRAYIGADSLIYLPLEKFRQILGSACYGCFTGEYPVQINVEEAEVSTRGA

SEQ ID NO: 30239 - DNA, 1446 bp, Clostridium perfringens str. 13
  CDS (1)..(1446): transl_table=11
atggtgaagccaaattttgatattatggatccacaaaatgataaattcaaagatgaatgcggagtttttggagttttcgcaaataaaccaatagatgttgcttctataaattattatggactttatgctcttcaacatagaggacaagaaagtgctggcattgcagtagcaaatggagaagatataaaagttcataaggggttaggtgttttaacggaagcctttgaagctgaagatttaaagagacttagagaatttaatggttatatatcaataggacatgttagatattctacagcgggagctaaaactgttgaaaatgcacaacctttagttagtaatactaaacttggtcctatatctactgctcataatggtaatttagttaatgcagatgtaataagaagtcttttagaggatgggggacaagttttccatactagtgttgattctgaggtgattacaagcttagttgctagaggagctaaaaaagggattgagagggctgtaattgatgctatatcagcggttaaaggttctttcgctatggtaataatgactaaggataagctaataggtataagagatccacatggaattagacctttatgcttaggaaaatttgaagagggatatatattaacttcagaaagttgtgctttagacacaattggagcagagtttgtgagagatataaaaccaggagaaatcgtggttatagataatgatgggattaaaagttatagatattcagaaaatactgtttgccaaacctgtgcctttgaatatatatactttgcaagaccagattcagtaattgatggtttagatgttcaaactacaagggttaagcaaggagaaatattatttaaagaatatccaatagatgctgatattgtggtagctgtaccagattcaggaataccagctgctatgggatatgctaaggcttcaggaattccttatgaggttggatttgtgaaaaatagatatataggaagaacatttatatcaccatcacaagaaattagggagagagctgtagctgtaaagcttaatcctttaaaagttaatgtaaatggaaagagagttattttaatagacgattctattgttagaggaacaacttctaaacatttaattgaatctttaagaagagctggtgctaaggaagttcattttctagttgcatcaccaatggttaaatatccatgttattttggcattgatacaccatatagaagtcagttaattggagcaagtagaagtgtagaagaaattagagagatgataggttgtgattctctagggtatttaagtttagaaggaatgtacgaaagttttgaaggtagaagaaatttctgtgtaggatgctttagtggggtttatccagttgcagcgcctatggaagctttagaggataatcttgaaagggtggagaattaa

SEQ ID NO: 30240 - protein, 481 aa, Clostridium perfringens str. 13
MVKPNFDIMDPQNDKFKDECGVFGVFANKPIDVASINYYGLYALQHRGQESAGIAVANGEDIKVHKGLGVLTEAFEAEDLKRLREFNGYISIGHVRYSTAGAKTVENAQPLVSNTKLGPISTAHNGNLVNADVIRSLLEDGGQVFHTSVDSEVITSLVARGAKKGIERAVIDAISAVKGSFAMVIMTKDKLIGIRDPHGIRPLCLGKFEEGYILTSESCALDTIGAEFVRDIKPGEIVVIDNDGIKSYRYSENTVCQTCAFEYIYFARPDSVIDGLDVQTTRVKQGEILFKEYPIDADIVVAVPDSGIPAAMGYAKASGIPYEVGFVKNRYIGRTFISPSQEIRERAVAVKLNPLKVNVNGKRVILIDDSIVRGTTSKHLIESLRRAGAKEVHFLVASPMVKYPCYFGIDTPYRSQLIGASRSVEEIREMIGCDSLGYLSLEGMYESFEGRRNFCVGCFSGVYPVAAPMEALEDNLERVEN

SEQ ID NO: 30241 - DNA, 1350 bp, Pyrococcus furiosus DSM 3638
  CDS (1)..(1350): transl_table=11
gtgaggggtgaaagcatagtgattagggagaaatgtggtatatttgcggcatatgctgataatgctcctgagaaggcttattactctctgttatcactccagcatagaggtcaggagggagctggaattactttttgggaaaatggtatcaagacgataaagggaattgggcttgtccctgaagtttttaaagggggaatagagtcgaaatcaagccttgcaattggacatgtgagatattctacttttggctcccttacggaagttcagcccattgaagttaaatgttgcaattataagcttgcaatagctcacaatgggactcttacaaactatctgccattaagagagaagtatgaaagtgagggcttcaagtttaactccactatagacacagagctaattggagtggcctttttgaaacattacaaagagctcggagatgaattcaaggcaatggaagaagtttttaatgaagttaggggagcttattctgtggcaattctctttgatggaaagataatcgtggcgagagatcccgctggttttagacctttagcttatggagaaggagatggtttttatttcgcttctgagaactcaggtttgagaatgtttacaaataagattagagatgtctttccaggcgaagtttttgttgttgaagagggtgaaatttatagtaaagttctgaagaaacttcctcatagccattgtgtttttgaatatatttactttgcaagacctgatagcaatatagagggggtaagtgtttacttggcaaggtataggatgggagttgaattagcaagagaaagcccagctcctggagatgttgttatagctgttcccgattctggaaggacagcggcccttggttttgcccatgaaagtggaattccttatatggaaggacttataaagaaccgttatattgggagaacttttatcatgcccagcggaagggagcttaaagttaagctaaagctttctcctgtaagggaggtcattgagggaaaaagggtggttttggttgatgattcaatagttagaggaacgaccataaagagaatagtaaagatgattagagatgcaggggctgaggaagttcatgtaagaatttcttcacctccaattagatatccatgctacatggggatagatattccaactaggcatgagcttattgcagcatggagaactgtcgaggatataagaagagaaattggagctgattctttagcttatttgagcatagaaggccttaaaagagctgtaggaatagaggatctttgcatggcctgcttaactggtcattatcccgagtgggcctttgactttgagttatga

SEQ ID NO: 30242 - protein, 449 aa, Pyrococcus furiosus DSM 3638
MRGESIVIREKCGIFAAYADNAPEKAYYSLLSLQHRGQEGAGITFWENGIKTIKGIGLVPEVFKGGIESKSSLAIGHVRYSTFGSLTEVQPIEVKCCNYKLAIAHNGTLTNYLPLREKYESEGFKFNSTIDTELIGVAFLKHYKELGDEFKAMEEVFNEVRGAYSVAILFDGKIIVARDPAGFRPLAYGEGDGFYFASENSGLRMFTNKIRDVFPGEVFVVEEGEIYSKVLKKLPHSHCVFEYIYFARPDSNIEGVSVYLARYRMGVELARESPAPGDVVIAVPDSGRTAALGFAHESGIPYMEGLIKNRYIGRTFIMPSGRELKVKLKLSPVREVIEGKRVVLVDDSIVRGTTIKRIVKMIRDAGAEEVHVRISSPPIRYPCYMGIDIPTRHELIAAWRTVEDIRREIGADSLAYLSIEGLKRAVGIEDLCMACLTGHYPEWAFDFEL

SEQ ID NO: 30243 - DNA, 1347 bp, Fusobacterium nucleatum subsp. nucleatum ATCC 25586
  CDS (1)..(1347): transl_table=11
atgggaatattagctttacattcaaaaaaagttagaaatgatttagtgggaatcgcatattatggaatgtatgctttacaacatagaggacaagcaggagcaggatatactatctgtgactctaaaactaataatgaagtaagaataaaaactattaaaaatgtaggacttgtatcagatgtatttaaagttgaagattttcaaaaatttattggaactatcttaatagctcatacaagatatggtagtaaaaatacagtttcttcaagaaattgtcaacctgttggtggagaatctgctatgggttatatatctcttgtacataatggtgacatatcaaatcaagctgaattgaaacaagaattattaaacaatggttctttattccaaacagcaatagatactgaaattatactaaaacttttaagtatcaatggtaaatatggttataaagaagcagttttaaaaacagttaaaaaattaaaaggttgttttactcttggaataataataaatgataaacttataggagttcgtgatcctgaaggattaagaccattatgtctaggtagaatagttgaaaatgatatgtatgttctggcttctgaaacttgtgcattagatgctattggtgcagaatttgtgagagatatagaagcaggagaaatggtagttatagatgacaatggagtggaaagcataaaatataaggaaagtagtaaaaaagcaagttcatttgaatatatttattttggaagaccagatagtgttatagatggaattagtgtttacgattttagacatcaaacgggaaaatgcttatatgaacaaaatccgatagaagctgatattgttattggtgttcctgattcaggtgttccagcagcaataggatattctgaagcaagtggaataccctattcagcagcacttttaaaaaataaatatgtaggtagaacatttattgctcctgtacaagaattgagagagagagcagtaaaagttaaattgaatcctattaaagaattaattaagggaaaaagagttgtagttatagatgactctattgttcgtggaacaacttctaaaaaattaatagatattttatttgaagcaggagcaaaagaagttcactttagatcagcttcaccagttgttattgaagaatcatattttggagtaaatatagatcctaataataagttaatgggaagctatatgagtattgaagaaattagaaaagtaataggagcaacaacattggactatctttcattaaaaaatttaaagaaaattttaaatggtggagaagatttttatatgggttgctttaaggaggatgaataa

SEQ ID NO: 30244 - protein, 448 aa, Fusobacterium nucleatum subsp. nucleatum ATCC 25586
MGILALHSKKVRNDLVGIAYYGMYALQHRGQAGAGYTICDSKTNNEVRIKTIKNVGLVSDVFKVEDFQKFIGTILIAHTRYGSKNTVSSRNCQPVGGESAMGYISLVHNGDISNQAELKQELLNNGSLFQTAIDTEIILKLLSINGKYGYKEAVLKTVKKLKGCFTLGIIINDKLIGVRDPEGLRPLCLGRIVENDMYVLASETCALDAIGAEFVRDIEAGEMVVIDDNGVESIKYKESSKKASSFEYIYFGRPDSVIDGISVYDFRHQTGKCLYEQNPIEADIVIGVPDSGVPAAIGYSEASGIPYSAALLKNKYVGRTFIAPVQELRERAVKVKLNPIKELIKGKRVVVIDDSIVRGTTSKKLIDILFEAGAKEVHFRSASPVVIEESYFGVNIDPNNKLMGSYMSIEEIRKVIGATTLDYLSLKNLKKILNGGEDFYMGCFKEDE

SEQ ID NO: 30245 - DNA, 1455 bp, Streptococcus pyogenes MGAS8232
  CDS (1)..(1455): transl_table=11
atgacatacgaagtaaaatctctaaatgaagaatgtggagtctttggtatctgggggcatcctcaggcagctcaagtcacttactttgggcttcatagccttcaacatcgcggtcaagaaggagctggtattgtttcaaatgacaatgggaaactctatggttatcgaaatgttgggcttctttctgaagtttttaagaatcaatctgaattagataatttaactgggaatgcggctattggacatgttcggtatgctactgcaggttctgcagatattcgcaatattcagccttttctttataaatttcatgacgggcaatttgctttatgccataatggtaatttgacaaatgctatttccttaaggaaagaattagaaaagcaaggtgcaattttcaatgcctcctcagatactgaaattttaatgcatttgattcgtcgaagccataactcaaatttcatgggaaaggtaaaagaagctctaaatacagtaaagggtggctttgcctatctactgatgacagaaaataaattaattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggcgaagttattcttatagacgatagtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggtcttgtaaaaaatcagtatacgcagcgaacctttattcaaccgacacaagaattaagggaacaaggtgttcgaatgaaactatcagcggtatctggtgttgtcaaaggaaagcgcgttgttatgattgatgactcaattgtaagaggaacgacttctagaaggattgtcggattattaagagaagcaggagctagtgaagtacatgttgctatagctagtccagaattaaagtatccttgtttttatggtattgatattcaaacaagacgagaattaatttcagcaaatcacgctgttgacgaagtgtgtgatattattggcgcagatagtctgacctatctctcattagatgggttgattgaatcaattggactcgaaacaaaagcaccaaatggtggtttatgcgtagcttactttgatgggcattatccaacaccgctttatgattatgaagaagaatacctcagaagtttagaagagaaaacaagtttttatattcaaaaagtgaaataa

SEQ ID NO: 30246 - protein, 484 aa, Streptococcus pyogenes MGAS8232
MTYEVKSLNEECGVFGIWGHPQAAQVTYFGLHSLQHRGQEGAGIVSNDNGKLYGYRNVGLLSEVFKNQSELDNLTGNAAIGHVRYATAGSADIRNIQPFLYKFHDGQFALCHNGNLTNAISLRKELEKQGAIFNASSDTEILMHLIRRSHNSNFMGKVKEALNTVKGGFAYLLMTENKLIAALDPNAFRPLSIGQMQNGAWVISSETCAFEVVGAKWVRDVEPGEVILIDDSGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGASEVHVAIASPELKYPCFYGIDIQTRRELISANHAVDEVCDIIGADSLTYLSLDGLIESIGLETKAPNGGLCVAYFDGHYPTPLYDYEEEYLRSLEEKTSFYIQKVK

SEQ ID NO: 30247 - DNA, 1356 bp, Methanopyrus kandleri AV19
  CDS (1)..(1356): transl_table=11
ttgtgcggggtttccggctgttacctgcttaaggaaaacgaggcgggcgtttataattacctcatcctccatgcgaaccagcacaggggccaagagtcggccggaatctgcgtgtacgatggactccgactggtcgggaagaagggcatgggcctagtgaccgaagtcttcgatcggcccgacctgcggaagctctcgggtccagtgggtatcggccacgtcaggtactcgacgactggcgcttccgagctcgtcaacgcccaaccgttcaaagtggggtactcgaagggcgagctggctttggcccacaacggagacatcgtgaactccgaagagctaaggcgggagctcgtttccgacggacatgctttcgtttcggagactgattcggaggtcatcgcccgactgctcgcggtcgctctcaccgagaccgacgatatgttcgaggcgttcgaggacgttatggaacggttggtaggctcgtactccctgaccgtgataacgagtcacggtgacctaatcgcggtccgagatccctggggattccgaccactgtgcctgggatgggacgaacgtggcttcttcgtttcctccgagacggtaggtctggacgtgttaggtgtggaggaacgccgcgagctggaacgtggcgaggtagtttggattcgggagggcgacgtcgaaagtaaagtcgtgagaagggaacgcaaggccgtctgtatgttcgagttcgtgtacttcgcacggccggattccatcatcgaaggcaggtgcgtgtacgaatgtcggaagtgcatgggtaagcgactcgccgaggaggccccggtcgagtgcgatctggtggttcccgtcccggattcgggtcggacggcggcgctgggatacgcggagtcgttgggggtccctatggaagagggactgatcaaaaatcggtacgtgggtaggacgttcatcatgccggagcaggaggagcgcgtacggagcatccgggtaaagctgaaccccatccgggaggtgatcaaagggtgctcgctggcagtagtggacgacagcatcgtacgtggaaacacctctcgacaaatagtggaaatgctgcgggatgccggggcccgtgaggttcacatgaggatcgcgtcacctcccgtggtgtccccttgttactacgggatcgacatggccacgaaggaggagctaatagccgcagacctcgatgttccagagatctgtgagaaaatctcggcagactcgctggcttacctgtctctagaaggtctcgtcgagtcgatcagattgaagaaacgggagctgtgcgtgggttgcctcacgggggagtaccccaccccggtccccgaatga

SEQ ID NO: 30248 - protein, 451 aa, Methanopyrus kandleri AV19
MCGVSGCYLLKENEAGVYNYLILHANQHRGQESAGICVYDGLRLVGKKGMGLVTEVFDRPDLRKLSGPVGIGHVRYSTTGASELVNAQPFKVGYSKGELALAHNGDIVNSEELRRELVSDGHAFVSETDSEVIARLLAVALTETDDMFEAFEDVMERLVGSYSLTVITSHGDLIAVRDPWGFRPLCLGWDERGFFVSSETVGLDVLGVEERRELERGEVVWIREGDVESKVVRRERKAVCMFEFVYFARPDSIIEGRCVYECRKCMGKRLAEEAPVECDLVVPVPDSGRTAALGYAESLGVPMEEGLIKNRYVGRTFIMPEQEERVRSIRVKLNPIREVIKGCSLAVVDDSIVRGNTSRQIVEMLRDAGAREVHMRIASPPVVSPCYYGIDMATKEELIAADLDVPEICEKISADSLAYLSLEGLVESIRLKKRELCVGCLTGEYPTPVPE

SEQ ID NO: 30249 - DNA, 1455 bp, Methanosarcina acetivorans C2A
  CDS (1)..(1455): transl_table=11
ctgcaccggaggtcaagattgaaagaagaatgcggagttgcaggcataatcctccctgacgacaggtctcagtcaaatactgtcgcattcaagctttactatgccctgtacgccctccagcataggggacaggaatctacgggtataatggtgcatgatgggacatctcccctctccatcaagggtatggggcttgtgccggacgtgtacaacaaggattctctggggcgccttatagggaatgcaggagtcggacacgtccgctactctacgactggcgggtcaaggattgaaaattgtcagccttttatccttaatttcaagggtggaacagttgccattgcccataacgggaatctggtaaatgcaagagcgctcaaagacgagctggaaaacgaaggccgaatttttataagtaattccgataccgaggttatcggtcacctgcttgtgaaggaactgataaggcacgatcctatcgagtctatcaggaatgtaatgcgcaagcttgttggatcttattctcttgttatcttcatcaacggtgttgtgtacgctgtcagggaccccttcggcctcaagcccctctgttttggagaagttgacggcggatatggaatattttcggaaagtgttgctattgataccctgaacggcacccttatccgggatgtcaggccaggcgaggtaatggtctttacgagttcaggctttgagagccaccagctcacaaatgagccccacccggcacattgtgtttttgagtttatttactttgcaagacccgattccgtcatagacggcaaactcgtctacaagatccgggaaagaatcggaagagagcttgcccgtgagcatgatgttgaagcggatatcgtttctcctgtccctgactcgggaattacgtctgcaatcggctatgcaagagagtccggaatcatgtatctggaaggtcttatgaagaaccgctacatagggcgcacatttattcttccgggacaggacctgcgcgaaactgcagttcggctcaagatgaacgccattcaggaaaacgtcaaaggaaagcgtgtagtccttgtcgatgacagcattgtccgcggcacaacttcccggcgtatcatagatatggtcaggaaggcaggtgcgtcagaagtccatgcaagggtcggaagtccggcaattattgccccctgctatctcgggatcgatatggcaacccggcaggaacttattgcctcatacaagactataaaagaggttgaagggctaataaatgccgactctctcggttatctcagcattgaagggctcatgagagctcttgagtgcgataagaacgatatgtgcatcggctgccttacaggtgagtatcctgtagacatccccggcgagaaatgcagaaaaaagcagtcccgccttgatgatttcagtaaggacgcaagttcctctaagtaa

SEQ ID NO: 30250 - protein, 484 aa, Methanosarcina acetivorans C2A
MHRRSRLKEECGVAGIILPDDRSQSNTVAFKLYYALYALQHRGQESTGIMVHDGTSPLSIKGMGLVPDVYNKDSLGRLIGNAGVGHVRYSTTGGSRIENCQPFILNFKGGTVAIAHNGNLVNARALKDELENEGRIFISNSDTEVIGHLLVKELIRHDPIESIRNVMRKLVGSYSLVIFINGVVYAVRDPFGLKPLCFGEVDGGYGIFSESVAIDTLNGTLIRDVRPGEVMVFTSSGFESHQLTNEPHPAHCVFEFIYFARPDSVIDGKLVYKIRERIGRELAREHDVEADIVSPVPDSGITSAIGYARESGIMYLEGLMKNRYIGRTFILPGQDLRETAVRLKMNAIQENVKGKRVVLVDDSIVRGTTSRRIIDMVRKAGASEVHARVGSPAIIAPCYLGIDMATRQELIASYKTIKEVEGLINADSLGYLSIEGLMRALECDKNDMCIGCLTGEYPVDIPGEKCRKKQSRLDDFSKDASSSK

SEQ ID NO: 30251 - DNA, 1398 bp, Thermoanaerobacter tengcongensis MB4
  CDS (1)..(1398): transl_table=11
atgggaaatggagagaaattaaaagaggaatgtggtgtttttggtgcctttagtttgtccacttcagttacttcttatatctattatggcttacaagccttgcagcacagagggcaggaaagttcaggtatagctatttatgatggcgaaaaaataaattgtattaaggggttgggacttgtcagcgaggtctttaataaggagaatttaaagacattagaggggaaaatggggataggccatgtaaggtattctactacaggcagcaataacattataaatgctcaacccctcgttgctaattttaaaaacaaatatatggctcttgcccataatggcaatttgataaacgcagaagagttaagatgcctattggaggaggatggtagaatatttcaaactacaactgatagtgaaataattctccatctaattgcaaaaaattttcaagaaaacttaatcggagctcttttagaaacaatgaaacaaataaaaggttcatatgctttggtgattttaacagacaataaattaatagggataagagacgtaaacagtataaggcctctttgcataggtaaaaaagatgacacttatttcttatcttctgagtcttgtgcttttgacgtaataggagcagaattgatacgagatgtggaagcaggtgaaatagttataattgatgaaaaaggtatagattctgttaagttagaagtaaaagaaaaaaagaagccttgtgtttttgaatacatctattttgctagacctgacagtgtcatagatggaaaaagtgtttattttacacgattggagatggggaaaagattagctgaagaagcacctgtagatgcagacttggtagtaccagttccagattcaggtattgctgctgcaagaggctattctctcaaaacagggataccaatgggggaaggacttataaaaaataaatacattggaaggacttttattgctcccgaccaaagggatagagagacaggcgtgaggataaagctaaatgtcttaaaagaattggttcaaggcaaaaggatagttttaatagatgattcaattgttagaggcacaactatgaaaagattagtgagtctactaaaaaatggcggagcaaaagaagtccatgtgaggataagttcaccccctgttaaatattcttgctactttggaattgatactccgacaaaaaaagaactgatagcggcgaggatgtcagttgaagagatgtgcaaattaataggagctgacagcctacagtttttaagtattgaagggcttataaaaagtgtaggacttaaatctatttgcacaggttgctttgatggcaattatcctatgtatgttccaaaagaaagaagtaaatatctttttgagaaaaaataa

SEQ ID NO: 30252 - protein, 465 aa, Thermoanaerobacter tengcongensis MB4
MGNGEKLKEECGVFGAFSLSTSVTSYIYYGLQALQHRGQESSGIAIYDGEKINCIKGLGLVSEVFNKENLKTLEGKMGIGHVRYSTTGSNNIINAQPLVANFKNKYMALAHNGNLINAEELRCLLEEDGRIFQTTTDSEIILHLIAKNFQENLIGALLETMKQIKGSYALVILTDNKLIGIRDVNSIRPLCIGKKDDTYFLSSESCAFDVIGAELIRDVEAGEIVIIDEKGIDSVKLEVKEKKKPCVFEYIYFARPDSVIDGKSVYFTRLEMGKRLAEEAPVDADLVVPVPDSGIAAARGYSLKTGIPMGEGLIKNKYIGRTFIAPDQRDRETGVRIKLNVLKELVQGKRIVLIDDSIVRGTTMKRLVSLLKNGGAKEVHVRISSPPVKYSCYFGIDTPTKKELIAARMSVEEMCKLIGADSLQFLSIEGLIKSVGLKSICTGCFDGNYPMYVPKERSKYLFEKK

SEQ ID NO: 30253 - DNA, 1593 bp, Streptomyces coelicolor A3(2)
  CDS (1)..(1593): transl_table=11
gtgatccatgagtggtcccgtatccccaattcggaccagtggtcgatctcgcctacactcgaaggcgtgccacgtggtgacggtcgactcaatcacgatctgcttcccggcgagaagggcccccaggacgcttgcggcgtcttcggtgtctgggctccgggcgaagaggtcgcaaagctcacgtacttcgggctgtacgccctccagcatcggggccaggaatccgcgggaatcgcggtcagcaacggctcccagatcctcgtcttcaaggacatgggcctggtgtcccaggtcttcgacgagacctcgctcggttcgctccagggtcacatcgcggtcggtcacgcccgctactcgaccaccggtgcctccgtgtgggagaacgcccagccgacgttccgtgccaccgcgcagggttccatcgcgctcgggcacaacggcaacctcgtcaacaccgcccagctcgccgggctggtggccgacctgccgaagcaggacggccgctccacccgggtcgcggcgaccaacgacaccgacctgatcaccgcgctgctcgcgggccaggtcgacgacgacggcaagccgctgaccgtcgaggaggcggccggcaaggtgctgccccaggtgcgcggcgccttctccctcgtcttcatggacgagcacaccctctacgccgcccgcgacccgcagggcatccgcccgctggtcctcggccgcctggagcgcggctgggtggtcgcctccgagtccgccgccctggacatctgcggcgcctcctacgtccgggagatcgagccgggcgagttcgtcgccatcgacgagaacggcctgcggacatcgcgattcgcagaagcgaagcccaagggctgtgtcttcgagtacgtgtacctggcccgcccggacaccgacatcgccggccgcaacgtctacctctcgcgtgtcgagatgggccgcaagctggcgaaggaggcccccgcggaggccgatctcgtcatagcgaccccggaatccggcacccccgccgcgatcggctacgccgaggcctccggcatccccttcggcaacggcctggtgaagaacgcctatgtcggccggaccttcatccagccctcacagaccatccgccagctgggcatccgcctgaagctgaatcccctgaaggaagtcatcaagggcaagcggctggtcgtcgtcgacgactccatcgtccgcggcaacacccagcgggccctggtccgcatgctccgcgaggcgggcgccgccgagatccacatccggatctcgtccccgcccgtgaagtggccctgcttcttcggcatcgacttcgccacccgcgccgagctgatcgccaacggcatgagcgtcgaggagatcggcacctcgatgggcgccgactccctggcgtacatctccatcgacggcatgatcgaggcgaccaccatcgccaagcccaacctgtgccgcgcctgcttcgacggcgagtacccgatggagcttcccgaccccgagctgctcggcaagcagctcctggagaccgagctggccgccgggcccgccggtacggccgccgccgacgccatccgtcgcccgtag

SEQ ID NO: 30254 - protein, 530 aa, Streptomyces coelicolor A3(2)
MIHEWSRIPNSDQWSISPTLEGVPRGDGRLNHDLLPGEKGPQDACGVFGVWAPGEEVAKLTYFGLYALQHRGQESAGIAVSNGSQILVFKDMGLVSQVFDETSLGSLQGHIAVGHARYSTTGASVWENAQPTFRATAQGSIALGHNGNLVNTAQLAGLVADLPKQDGRSTRVAATNDTDLITALLAGQVDDDGKPLTVEEAAGKVLPQVRGAFSLVFMDEHTLYAARDPQGIRPLVLGRLERGWVVASESAALDICGASYVREIEPGEFVAIDENGLRTSRFAEAKPKGCVFEYVYLARPDTDIAGRNVYLSRVEMGRKLAKEAPAEADLVIATPESGTPAAIGYAEASGIPFGNGLVKNAYVGRTFIQPSQTIRQLGIRLKLNPLKEVIKGKRLVVVDDSIVRGNTQRALVRMLREAGAAEIHIRISSPPVKWPCFFGIDFATRAELIANGMSVEEIGTSMGADSLAYISIDGMIEATTIAKPNLCRACFDGEYPMELPDPELLGKQLLETELAAGPAGTAAADAIRRP

SEQ ID NO: 30255 - DNA, 1458 bp, Methanosarcina mazei Go1
  CDS (1)..(1458): transl_table=11
ttgaaagaagagtgcggggttgcaggcataattttgcctgatgacagacccgcgtcaaatgctgtcgcattcaagctttattatgccctttatgcccttcagcacagaggacaggaatcgacaggcataatggtgcacaacggctcatgtccgctttccatcaaaggaatggggcttgtacctgatgtatataacaaagattccctcgggcgtctggtcggtaatgcaggagtcgggcatgtccgttactccacaactggcgggtcaaagattgaaaactgtcagccttttatcctgaacttcaagggcggaacagttgccattgctcataatgggaatctggtaaatgcaagggaactgaaggatgagctggaaaatgaaggcagaatttttatcagtgattcagatactgaagttattggccatctgcttgtaaaagaactgataaaacacgaacctatcgagtctatcaggactgtaatgcgcaagcttgttggctcttactctcttgtcattttcattaacggtgttatctacgccgtaagggatcctttcggttttaagccactctgttttggagaagttgacggcggatacggagtattttccgagagcgtagccattgacaccctgaacggcacccttataagggacgtcaaaccaggcgaggtcatggtctttacaggctcaggttttgaaagccaccagctcgcaaatgaaccgcatccggcacattgcgtttttgagttcatttactttgcaaggccagactccgttatagacggcaagcttgtctataaagtaagggaaagaatcggaagggagcttgcccgcgaacatcatgtagacgcagacatcgtgtctcctgtccctgactccggaatcacttccgcaatcggctatgcaagggaatcaggtataatgtacctggaagggctcatgaagaaccgttatatcgggcgcaccttcattcttccgggacaggacctgcgtgaaactgcagttcggcttaagatgaacgctattcaggacaatatcaaaggcaaacgtgttgtcctggtagatgacagcattgtccgcgggactacctcgaggcgtatcatagatatggtcaggaaggcaggcgcgtcagaagtccacgcaagggtcggaagcccggcaattattgccccctgctacctgggaatcgatatggcaacccggcaggaacttatcgcttcatacaagaccataaaagaggtcgaagggctgataagtgctgattctctcggctacctcagcatcgacgggcttatgagagcacttgagtgcgacaagaacgacatgtgcattggctgccttacaggagaatatcctgtagagatcccgggcgagaaatgcagaaagaaacagacccgtctggacgatttcagtaaggctgaaagatcctctcaggcagtatctccggacagcctttaa

SEQ ID NO: 30256 - protein, 485 aa, Methanosarcina mazei Go1
MKEECGVAGIILPDDRPASNAVAFKLYYALYALQHRGQESTGIMVHNGSCPLSIKGMGLVPDVYNKDSLGRLVGNAGVGHVRYSTTGGSKIENCQPFILNFKGGTVAIAHNGNLVNARELKDELENEGRIFISDSDTEVIGHLLVKELIKHEPIESIRTVMRKLVGSYSLVIFINGVIYAVRDPFGFKPLCFGEVDGGYGVFSESVAIDTLNGTLIRDVKPGEVMVFTGSGFESHQLANEPHPAHCVFEFIYFARPDSVIDGKLVYKVRERIGRELAREHHVDADIVSPVPDSGITSAIGYARESGIMYLEGLMKNRYIGRTFILPGQDLRETAVRLKMNAIQDNIKGKRVVLVDDSIVRGTTSRRIIDMVRKAGASEVHARVGSPAIIAPCYLGIDMATRQELIASYKTIKEVEGLISADSLGYLSIDGLMRALECDKNDMCIGCLTGEYPVEIPGEKCRKKQTRLDDFSKAERSSQAVSPDSL

SEQ ID NO: 30257 - DNA, 1467 bp, Xanthomonas axonopodis pv. citri str. 306
  CDS (1)..(1467): transl_table=11
atgtgtggcatcgtcggtattgtcggcaaccagaacgtcgccgggcagctgtatgacggcctgaccgtcctgcagcatcgtgggcaggacgccgcaggcatcgccaccgcagatggcacgcgcctgcgcgtgcagaaggccaacggcctggtgcgcgacgtcttcgacgaaaagaagatggcggtgctggaaggccgcgtcggcatcgcgcattgccgctacccgaccgcaggttcggaaggcatggacgaggcgcagccgttctacgtcaactcgccctacggcatcgcgctggcgcacaacggcaacctgatcaacaccgaggccttgcgccaacaggtgttcgaagccgaccgccgcaatatcaataccgattcggacagcgaagtgctgttgaacgtgttcgcctacgagctggacgcgcagcgcatgcttacccccgaagcggcgatccgcgcggtggccggcgtgcaccgccgttgcaagggcggctacgcggtggtcagcgtggtgctgggcctgggcctggtggcgttccgcgatccgcacggcatccgcccgctggtgctgggcaagcgcgagcatgccgaaggcaccgaatacatcgtgtcctccgaatcggcagcgctggatatcctcggctaccagcgcgtgcgcgacgtgcgcccgggcgaagcgctggtgatcaccgcgcgcggcgaactgttctcggaagtctgcgcggcaccgaccaacaacgcgccgtgcattttcgagtacgtgtatttcgcgcgccccgattcgatgatcgacaacatctcggtgcacaaggcgcgcatgcgcatgggcctgaagctgggcgaaaagatcctgcgcctgcgcccggaccatgacatcgacaccatcattccgatcccggacacctcgcgcgatgtggcgttggagatgtccaacgtgctcggcgtgaagtaccgcgagggcttcgtcaagaatcgctacgtgggccgcaccttcatcatgccggggcagggcgaacggcagaaatcggtacgtcgcaagctcaatccgatccatctggaatttcgtaaccgcgtggtgctgctggtggacgattccatcgtgcgcggcaccaccagccggcagatcgtgcagatggcgcgcgatgccggtgcgcgcaaggtgtacctggcctccgccgcgccgccggtgcgctaccccaacatctacggcatcgacatgccggccgccgaagagctcatcgcgcatggccgcagcgagctggaaatccaggagttcctgggctgcgactggctgatctaccaggatctggaagacctggaagtggcggtgcgcgaaggtaatccggacatcaagcagttcgattcttcgtgcttcaacggcgagtacatcaccggtatcgaaccggggtatttcgaacgcatccagcagctgcgctcggacgatgccaagaagcgtcgccgcgcctga

SEQ ID NO: 30258 - protein, 488 aa, Xanthomonas axonopodis pv. citri str. 306
MCGIVGIVGNQNVAGQLYDGLTVLQHRGQDAAGIATADGTRLRVQKANGLVRDVFDEKKMAVLEGRVGIAHCRYPTAGSEGMDEAQPFYVNSPYGIALAHNGNLINTEALRQQVFEADRRNINTDSDSEVLLNVFAYELDAQRMLTPEAAIRAVAGVHRRCKGGYAVVSVVLGLGLVAFRDPHGIRPLVLGKREHAEGTEYIVSSESAALDILGYQRVRDVRPGEALVITARGELFSEVCAAPTNNAPCIFEYVYFARPDSMIDNISVHKARMRMGLKLGEKILRLRPDHDIDTIIPIPDTSRDVALEMSNVLGVKYREGFVKNRYVGRTFIMPGQGERQKSVRRKLNPIHLEFRNRVVLLVDDSIVRGTTSRQIVQMARDAGARKVYLASAAPPVRYPNIYGIDMPAAEELIAHGRSELEIQEFLGCDWLIYQDLEDLEVAVREGNPDIKQFDSSCFNGEYITGIEPGYFERIQQLRSDDAKKRRRA

SEQ ID NO: 30259 - DNA, 1494 bp, Chlorobium tepidum TLS
  CDS (1)..(1494): transl_table=11
atgtgcggagttttcggcgtttttaattcaaaaactcccgccgaagataccttttacggcctctactcgctacaacaccgaggacaggaagccgcaggtatcgtcgttgccgaatacaacaaggccaagaaaaagaccctgttcaagcagcataaagggctggggctggtatccgaagttttcaaggacgaacagattttcgagaacctgagcggatacgcagcaatcggccataaccgctactccaccaccggcgcctccaaatcgaacaacaatatccagcccttctccctcacctaccgctccggcagcctcgccatcgcccacaacggaaacctgaccaattcgagagttttgcgcaaggagctgaccgaagagggcgtaattttccaggcctcatcggataccgaaatcatcccgcaccttgccgcgcgcagcaaggaaaaagagccactgcaccagatttacgatgcattgcggcaggtagaaggagctttttcgatcgtgattctggccaacaaccagatgattgcggcgcgagacccttacggcgtgcgccccttggctctcggcaagaaaatcgatcccgcaaccggtgagctggcctacgtcgtagcgagcgaaacctgtgctttcgacatcatcaaggccgagtacatccgcgacatcgaaccgggtgaaatcctcctgatcgaccacctcgccgtggacaacgaaaagccggtttcgctctaccttccacctgtcgagcgcaaagcccgctgcatcttcgagtatgtctatttcgcccgcccggacagcttcatctttcggcactcggttgacaaggtgcgccggaacctcggcaagaacctggccagggaatcaacgatcgaacgagaccccaacgacaaggagctggccgtagtcagcgtgccagactcctcgaacacggctgcgctcggcttcgtcagagaaagcaacaaactcggcaagcctgcgcgcttcgagcacggcctgatccgcaaccactatgttggccgcacctttattcagccaggcattcagagccgtgaaatcaaggttcgctcgaaatacaacatcgtgcgcggcgtcatgcagggccgcccaatcatcctcgtcgatgactcgatcgtgcgcggcacaacggccaagatgctcatcaagctggttcgcgaggccaatccgaaagagattcacctgcacatcagctcaccaccgatcaccaatccctgcttttacggcatggacttcccctccaagcgccaactgctcacgcacatgcttgctgacgccgagcacgagctgggcgatatcgaaaaaatcagggagtacatcggcgtggattcactgagatatctctccatgcagggcctcctgaacagcgtaccggaattcgagggcgaaacctgcagctactgcactgcctgcttcagcggcgactaccccatcccgatcgccgacgccacgaccgacaaggaagagaacgactaa

SEQ ID NO: 30260 - protein, 497 aa, Chlorobium tepidum TLS
MCGVFGVFNSKTPAEDTFYGLYSLQHRGQEAAGIVVAEYNKAKKKTLFKQHKGLGLVSEVFKDEQIFENLSGYAAIGHNRYSTTGASKSNNNIQPFSLTYRSGSLAIAHNGNLTNSRVLRKELTEEGVIFQASSDTEIIPHLAARSKEKEPLHQIYDALRQVEGAFSIVILANNQMIAARDPYGVRPLALGKKIDPATGELAYVVASETCAFDIIKAEYIRDIEPGEILLIDHLAVDNEKPVSLYLPPVERKARCIFEYVYFARPDSFIFRHSVDKVRRNLGKNLARESTIERDPNDKELAVVSVPDSSNTAALGFVRESNKLGKPARFEHGLIRNHYVGRTFIQPGIQSREIKVRSKYNIVRGVMQGRPIILVDDSIVRGTTAKMLIKLVREANPKEIHLHISSPPITNPCFYGMDFPSKRQLLTHMLADAEHELGDIEKIREYIGVDSLRYLSMQGLLNSVPEFEGETCSYCTACFSGDYPIPIADATTDKEEND

SEQ ID NO: 30261 - DNA, 1449 bp, Thermosynechococcus elongatus BP-1
  CDS (1)..(1449): transl_table=11
atgacagaacaacaatttgcggataagccggaagaggcctgtggggtatttggggtttatgcccccggggcggatgtggctcgcctcacctactttggtctctatgccctgcaacaccgaggtcaggaatccgctggaattgctacatttgccggtgacaccgtccactgtcacaaggatatgggtttggtgtcccaagtctttgacgaagagattttgggacggctggtgggagatttggctgtgggccacaaccgctactcaaccacgggttccagtcgcattgtcaacgcccaaccagtggtggtagacactcgtttaggacctttggccttagcccacaacggcaacttagtgaatacctacgccctgcgggaacaggtgctggcctgtgatgcgccgacggcggtgttggcgagcacaaccgattctgaactcattgcctgggcgatcgcccaagcggtggccaccggtcaatcctgggcagaggggatgattacagcggctcaacagtgccaaggggcttttagtttagtaatgggtaccccagcgggattgtttggactgcgggatgcccacggcatccgtcccttagtcattggccgcttgatgacagaagggacgccccactatgtccttgcttcggagacctgcgccctcgatattattggtgccgactatgtgcgggatgtggagccgggggaactggtgcacattactccggaagggattggcagtgtgcagtgggcagagtctcaacggaagctgtgtatctttgagatgatttactttgcccgtcccgatagtgtcatgcagcgggagagcctctatagctatcggcagcgcttgggttatcagttgggtcgtgaagctcccgccgatgccgacgtggtgattgctgtgcctgattctggggtgccagcggccattggcttttcccaagcaactggggtaccctatgccgaaggcttgattaaaagtcgctacgtggggcggacatttattcagcccacccagtcgatgcgggagtcgggaattcgcatgaagctgaatccactgccagatgtgctgatgggtcagcgggtggtgattgtggatgactcgattgtgcggggcaccactagccgcaaaattgtcaaggcgctgcgggatgccggtgctgtggaagtccacatgcgcatttcttcgccccctgttacccacccctgcttctatggcatcgataccgatacccaagatcagctgattgctgccaccaagtctgtgcctgaaattgccgctcagattggcgtggattccctcagttacctcagttggcaggggatgattgccgccacctacgatacgggcgatcgcttctgttccgcctgttttaccggcaactacccgattagcatccccgagccagtgaaacggcaaaagttggtgcttgagcaacttccccaatga

SEQ ID NO: 30262 - protein, 482 aa, Thermosynechococcus elongatus BP-1
MTEQQFADKPEEACGVFGVYAPGADVARLTYFGLYALQHRGQESAGIATFAGDTVHCHKDMGLVSQVFDEEILGRLVGDLAVGHNRYSTTGSSRIVNAQPVVVDTRLGPLALAHNGNLVNTYALREQVLACDAPTAVLASTTDSELIAWAIAQAVATGQSWAEGMITAAQQCQGAFSLVMGTPAGLFGLRDAHGIRPLVIGRLMTEGTPHYVLASETCALDIIGADYVRDVEPGELVHITPEGIGSVQWAESQRKLCIFEMIYFARPDSVMQRESLYSYRQRLGYQLGREAPADADVVIAVPDSGVPAAIGFSQATGVPYAEGLIKSRYVGRTFIQPTQSMRESGIRMKLNPLPDVLMGQRVVIVDDSIVRGTTSRKIVKALRDAGAVEVHMRISSPPVTHPCFYGIDTDTQDQLIAATKSVPEIAAQIGVDSLSYLSWQGMIAATYDTGDRFCSACFTGNYPISIPEPVKRQKLVLEQLPQ

SEQ ID NO: 30263 - DNA, 1455 bp, Streptococcus agalactiae 2603V/R
  CDS (1)..(1455): transl_table=11
atgacatacgaagtaaaatctctaaatgaagaatgtggagtctttggtatctgggggtatcctcaggcagctcaagtcacttactttgggcttcatagccttcaacatcgcggtcaagaaggagctggtattatttcaaatgataatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgatgggcaatttgctttatgtcataatggtaatttgacaaatgctatttcctcaaggaaagaattagaaaagcaaggtgcaattttcaatgcctcctcagatactgaaattttaatgcatttgattcgtcgaagccataacccaagttttatggggaaggtaaaagaagctttaagcactgtaaagggaggtttcgcctatctactgatgacagaagataaattaattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggtgaagttattcttatagacgatagtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggccttgtaaaaaatcagtatacgcagcgaacctttattcaaccgacacaagaattaagggaacaaggtgttcgaatgaaattatcagcggtatctggtgttgtcaaaggaaagcgcgttgttatgattgatgactcaattgtaagaggaacgacttctagaaggattgtaggattattaagagaagcaggagctactgaagtacatgttgctatagctagtccagaattaaagtatccttgtttttatggaattgatattcaaacaagacgagaattaatttcagcaaatcacgctgttgacgaagtgtgtgatattattggcgcagatagtctaacttatctatcaatcgatgggttaattaaatcaattggactcgaaacaaaagcaccaaatggtggtttatgcgtagcttactttgatggacattatccaacaccgctttatgattatgaagaagaatacctcagaagtttagaagaaaaaacaagtttttatattcaaaaagtgaaataa

SEQ ID NO: 30264 - protein, 484 aa, Streptococcus agalactiae 2603V/R
MTYEVKSLNEECGVFGIWGYPQAAQVTYFGLHSLQHRGQEGAGIISNDNGKLYGYRNVGLLSEVFKNQSELDNLTGNAAIGHVRYATAGSADIRNIQPFLYKFHDGQFALCHNGNLTNAISSRKELEKQGAIFNASSDTEILMHLIRRSHNPSFMGKVKEALSTVKGGFAYLLMTEDKLIAALDPNAFRPLSIGQMQNGAWVISSETCAFEVVGAKWVRDVEPGEVILIDDSGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGATEVHVAIASPELKYPCFYGIDIQTRRELISANHAVDEVCDIIGADSLTYLSIDGLIKSIGLETKAPNGGLCVAYFDGHYPTPLYDYEEEYLRSLEEKTSFYIQKVK

SEQ ID NO: 30265 - DNA, 1407 bp, Oceanobacillus iheyensis HTE831
  CDS (1)..(1407): transl_table=11
atgcttgctgaaatcaaaggcataaatgaagaatgtggtgtttttggcatctggggtcacgaaaaagcagctgaattaacttattatggcttacattccatgcaacatcgaggacaagaaggtgctggggttgttgttaatacgggtagcgaactaaaaggacataaaggtttgggtcttgtaaatgatgtgttcaaacgagttaaatttgatgacttggaaggaagtgtagcagtagggcacgtccggtatgcgacacaaggtgggagaggcattgaaaatgtccaacctttattatttcagtcacaaactggcggaatggcgctagcacataatggtaatctgatgaacgcacatgaactgcgtggcgaattagaaggagaaggaagcatattacaaacctcttcggatacggaagtcttagctcatttaattaaacgtagtggagaagtaacagaggactctatagctcgtgcactgaatcgtgtagtcggtgcatacgcatatatcatactgcaagaagataaaatgtttgcagcacttgatccttcaggtattcgtccactttctattggtagattgggagatgcttatgtgatagcttccgagacgtgtgcttttgaccaaattggtgcaacatttgaacgagaagtgcttccaggggaattgatcacaattagtgatgaagggatgacctctactcgatttgcaccaagagacaagcgacgaatgtgtgcaatggaatatgtctacctttctagaccagatagtgatgtgaactatgtgaatgtccatgcgtcgagaaaacaaatggggaaagagttagcgaaagaatcatccgttgatgcggatatcgttgtcggtgtacctgattctagtatttctgctgcaatcggctatgcggaagaaagtggactcccttatgaaatgggcatcataaaaaatcgttatgtcggacgtacctttatccaaccatctcaagaactcagagaattaggggtgaagatgaagctttcacctgttcgaagcattattgaaggaaaacgagttgttatgattgatgattcaattgtacgtgggacaacaagccgacgcattgttcagatgttacgagaagcgggtgcaaaagagattcatgttcggatagcttctccagcgattcaaaatccatgttattacggaattgatatgtctactaaaaaagaattaattggagccaattattctgttgatgaaatcaatggaattataggctcagatacgctagcttatttatcagaaaaagggttggaaaaagcaatcgtaaaagacaaaacgattaatcaaggtgtttgtatggcttgtatgactggcaaatacccagtaaaacaagacggtgaattggaaattcattatacaagttgttaa

SEQ ID NO: 30266 - protein, 468 aa, Oceanobacillus iheyensis HTE831
MLAEIKGINEECGVFGIWGHEKAAELTYYGLHSMQHRGQEGAGVVVNTGSELKGHKGLGLVNDVFKRVKFDDLEGSVAVGHVRYATQGGRGIENVQPLLFQSQTGGMALAHNGNLMNAHELRGELEGEGSILQTSSDTEVLAHLIKRSGEVTEDSIARALNRVVGAYAYIILQEDKMFAALDPSGIRPLSIGRLGDAYVIASETCAFDQIGATFEREVLPGELITISDEGMTSTRFAPRDKRRMCAMEYVYLSRPDSDVNYVNVHASRKQMGKELAKESSVDADIVVGVPDSSISAAIGYAEESGLPYEMGIIKNRYVGRTFIQPSQELRELGVKMKLSPVRSIIEGKRVVMIDDSIVRGTTSRRIVQMLREAGAKEIHVRIASPAIQNPCYYGIDMSTKKELIGANYSVDEINGIIGSDTLAYLSEKGLEKAIVKDKTINQGVCMACMTGKYPVKQDGELEIHYTSC

SEQ ID NO: 30267 - DNA, 1512 bp, Bifidobacterium longum NCC2705
  CDS (1)..(1512): transl_table=11
ttgtcggctgaactcgaagacattcacgaggaatgtggcatcttcggcgtatggggccaccccgacgcctcacgactcacctattttggcctgcacgcgctgcagcatcgcggtcaggaaggtgccggcatcgtctccaacgataacggtcatctcatcggtcatcgcggactcggcctgctcacccaggtgttcggcgatgagcgcgaaatcgaacgactgaagggcaattgcgccatcggccacgtgcgttacgcaacggccggctcgggcaccacggacaacatccagccgttcatcttccgcttccatgacggcgacgtggctctgtgccataacggcaacctgacgaactgcccgtcactgcgccgcaagcttgaagacgaaggcgccatcttccattcgaactccgacaccgaagtgctgatgcacttgattcgccgttcgatgcagcgcacctttatggacaagctcaaggaagcgctcaacacggtgcatggcggtttcgcctacctgctgatgaccgaagacgccatgatcggcgcactcgacccgaacggcttccgcccgctctccctcggcaagatgaagaacggcgcctacgtgctcgcctccgaaacctgcgcactggatgtcgtcggcgccgagctggtgcgtaacattcgcccgggtgaaatcgtggtggtcaacgatcacggctacaagatcgtgcagtacaccaacaacacgcagctggccatctgctcgatggagtacatctacttcgcccgcccggattccgatatctatggcgtcaacgtgcactccgcccgcaagcgcatgggcgcacgtctcgccgccgaatccccggtggaggccgatatggttatcggcgtgccgaactcctcattgtccgccgcatccggctatgcggaagcagcaggcctgcccaacgaaatgggtctaatcaaaaaccagtatgtggcccgcaccttcattcagcccacgcaagaactgcgcgagcagggtgtgcgtatgaagctctctgctgtgcgcagcgtggttaaaggcaagcgcgttatcgttatcgatgattccatcgtgcgcggcaccacgtccaagcgcatcgtgcagctgctcaaggaagccggcgccgctgaagtgcatatgcgcatcagctccccgccgctgaagtacccctgcttctatggcatcgatatctccaccaccaaggaactcatcgcagccaagatgagcgtggaggaaatccgtgaatacatcggcgcggattccttggcctacctttcgctcgacggtctggtcgaatccatcggactgaacgccgacgccccatacggtggcctgtgcgtcgcctacttcaacggcgactaccccactgcgctcgacgactacgaggccgacttcctgaagtccctcacgcccgaggaccgtgtgcgtctgcctgaattcgcgctgtacaagagcaagtacatcggcaacgagtacaacaccgtgcagccggacgccgaatag

SEQ ID NO: 30268 - protein, 503 aa, Bifidobacterium longum NCC2705
MSAELEDIHEECGIFGVWGHPDASRLTYFGLHALQHRGQEGAGIVSNDNGHLIGHRGLGLLTQVFGDEREIERLKGNCAIGHVRYATAGSGTTDNIQPFIFRFHDGDVALCHNGNLTNCPSLRRKLEDEGAIFHSNSDTEVLMHLIRRSMQRTFMDKLKEALNTVHGGFAYLLMTEDAMIGALDPNGFRPLSLGKMKNGAYVLASETCALDVVGAELVRNIRPGEIVVVNDHGYKIVQYTNNTQLAICSMEYIYFARPDSDIYGVNVHSARKRMGARLAAESPVEADMVIGVPNSSLSAASGYAEAAGLPNEMGLIKNQYVARTFIQPTQELREQGVRMKLSAVRSVVKGKRVIVIDDSIVRGTTSKRIVQLLKEAGAAEVHMRISSPPLKYPCFYGIDISTTKELIAAKMSVEEIREYIGADSLAYLSLDGLVESIGLNADAPYGGLCVAYFNGDYPTALDDYEADFLKSLTPEDRVRLPEFALYKSKYIGNEYNTVQPDAE

SEQ ID NO: 30269 - DNA, 1515 bp, Shewanella oneidensis MR-1
  CDS (1)..(1515): transl_table=11
atgtgtggtatcgtcggaatagttggccaatcatcggttaatcagaccatttatgatgcactgactgtgcttcaacacagaggtcaggatgcggcaggtattgtcaccgttgatcgtggtgctttcagactacgtaaagccaatggtctagtcaaagacgtatttgaagtcaaacacatgcagcgcctacagggcaatgcgggtattggccatgtacgttatcctactgctggcagttccagtgcgtcagaagcgcagcctttctatgttaactcgccatttgggatttcattggcccataacggtaacttaaccaacacacttgaattggccgaaggcctgatcaaaaaacgtcgccatgtgaacaccacatctgactcagaggtgttgttaaacctgcttgccgatgaactgcaaaaaaccacgagcctcgatctgaccgctgacgaagtgtttgacactatcgctaaggttcatgagcaggcccgtggcgcctatgccgtagtggccatgatcattggtcaaggtttagtcgcatttcgcgatcctttcggcattcgccctttggtactaggtaaacatgaaacgccaactggcactgaatacatggtcgcctctgagagcgtggccctcgatgccgtaggctttgaagtcatgcgcgatgtggcaccaggtgaggcgatttatatttcccttgatggcaatctttacacccgccaatgtgcaaaagagccaagctattcaccttgtatcttcgaatttgtatatttcgctcgccctgattccaccatcgataatgtctctgtttacgctagccgcgtgaatatgggggctaagcttggtgagaagattaagaaagaatggtacgaccatgatatcgatgtggtgatccctattccggaaacctcatgcgatatcgcgctggaaatcgcacgctgcatggatttgccttatcgccaaggttttgtgaagaaccgttatatcggccgtacctttattatgcctggccaacaggaacgtaagaaatcagtacgccgtaaactcaatgccatcaataccgagtttaaaggtaaaaatgtcctgttagtcgatgactctatcgtgcgcggcaccacctctgagcaaattattgagatggcccgtgaagcaggggcgaagaaagtatactttgcctccgcggcgccggaaatccgcttcccgaacgtgtatggtatcgatatgccaacgtcgaacgagcttatcgcccacggtcgtgatgccgatgaaattgctaaactgattggtgccgatggcattatcttccaaaatctgccggatctgattgaagcggtaagaatggaaaatcctgagatcaaacgttttgaaacctcagtgtttgacggacattacatcaccaacgatgttgatcaatcctatcttgatcatttaacgcagcttcgtaacgatgatgccaaagctgaccgtaataaggatattggtactaaccttgagttgcacaacgtctgccatccctag

SEQ ID NO: 30270 - protein, 504 aa, Shewanella oneidensis MR-1
MCGIVGIVGQSSVNQTIYDALTVLQHRGQDAAGIVTVDRGAFRLRKANGLVKDVFEVKHMQRLQGNAGIGHVRYPTAGSSSASEAQPFYVNSPFGISLAHNGNLTNTLELAEGLIKKRRHVNTTSDSEVLLNLLADELQKTTSLDLTADEVFDTIAKVHEQARGAYAVVAMIIGQGLVAFRDPFGIRPLVLGKHETPTGTEYMVASESVALDAVGFEVMRDVAPGEAIYISLDGNLYTRQCAKEPSYSPCIFEFVYFARPDSTIDNVSVYASRVNMGAKLGEKIKKEWYDHDIDVVIPIPETSCDIALEIARCMDLPYRQGFVKNRYIGRTFIMPGQQERKKSVRRKLNAINTEFKGKNVLLVDDSIVRGTTSEQIIEMAREAGAKKVYFASAAPEIRFPNVYGIDMPTSNELIAHGRDADEIAKLIGADGIIFQNLPDLIEAVRMENPEIKRFETSVFDGHYITNDVDQSYLDHLTQLRNDDAKADRNKDIGTNLELHNVCHP

SEQ ID NO: 30271 - DNA, 1440 bp, Streptococcus mutans UA159
  CDS (1)..(1440): transl_table=11
atgacatacgaagtaaaatctctcaacgaagaatgtggggtcttcggtatctggggacatcctcaagcagctcaagtcacttattttggactgcatagtctgcaacaccgtggtcaagaaggtgctggcattctgacaaatgatgctggcaaattgatacgacatcgtgatacaggattaatttcagaagttttcaaaaatccagctaatttggaaaaattaacaggtcaggctgctattgggcatgtccgttatgcaacggctggagaagcctccattgataatatccagcctttccattttaagttttacgatatggaatttggtctggcacataacggtaacctgactaatacgaaaaccctgaagaaagaattagaacataacggcgctatcttctcttcttcatctgatacggaaattctggctcatcttattcgccgcagccataatccaagctttatgggtaaggttaaggaagcgctcaatacggtcaaaggtggttttgcctatcttctgatgatggaagataagctgattgcagctcttgatccaaacggttttcgtccgctttctattggtaaaatggcaaatggtgccatcgttgtttccagcgaaacctgtgcctttgaagtggtgggtgccgagtggattcgtgatgtcaagccgggtgaagtggttatcattgataatagtggtatccagtacgacacttacacgacagatacgcagttggctatttgttcaatggaatacatctactttgcccgtcctgactcaaatattcacggggtcaatgtccacactgctcgtaaacgtatgggagcacagttggcgcgtgagttcaaacatgaggcagacattgtggtcggtgtacctaattcctcactcagcgcagctatgggcttcgccgaagaatcaggactgccaaatgaaatgggtcttatcaaaaatcaatacacccaacgaacctttatccagccaacgcaggaactgcgtgagcaaggggttcgcatgaaactttctgccgtatctggagtggttaaaggcaaacgtgtcgtcatgattgatgactccatcgtgcgtgggacaacctcacgtcgtatcgttcagctcttgaaagaagctggtgctacagaggttcacgtggctatcggtagcccagcgctggcctatccatgtttctatgggattgatattcaaacacggcgtgaattgattgcggctaatcattctgttgaagaaacacgccagattatcggtgcggatagcctaacttacttgtctattgacggtttgattgactctatcggacttgaaacagatgccccaaacggcggtctctgtgttgcttactttgatggcaagtacccaacaccgctttacgattacgaagaagagtatcgtagaagcttggatgagaaggttagcttttattga

SEQ ID NO: 30272 - protein, 479 aa, Streptococcus mutans UA159
MTYEVKSLNEECGVFGIWGHPQAAQVTYFGLHSLQHRGQEGAGILTNDAGKLIRHRDTGLISEVFKNPANLEKLTGQAAIGHVRYATAGEASIDNIQPFHFKFYDMEFGLAHNGNLTNTKTLKKELEHNGAIFSSSSDTEILAHLIRRSHNPSFMGKVKEALNTVKGGFAYLLMMEDKLIAALDPNGFRPLSIGKMANGAIVVSSETCAFEVVGAEWIRDVKPGEVVIIDNSGIQYDTYTTDTQLAICSMEYIYFARPDSNIHGVNVHTARKRMGAQLAREFKHEADIVVGVPNSSLSAAMGFAEESGLPNEMGLIKNQYTQRTFIQPTQELREQGVRMKLSAVSGVVKGKRVVMIDDSIVRGTTSRRIVQLLKEAGATEVHVAIGSPALAYPCFYGIDIQTRRELIAANHSVEETRQIIGADSLTYLSIDGLIDSIGLETDAPNGGLCVAYFDGKYPTPLYDYEEEYRRSLDEKVSFY

SEQ ID NO: 30273 - DNA, 1413 bp, Drosophila melanogaster
  CDS (1)..(1413)
atgatctgcctcggtctggtggctctgcagcatcgtggccaggagtcggcgggaatagtgaccagtttgggcaagtcctccaagaatttcagcgtacacaagggcatgggcatgatcaacaatctgttcaatgacgaggcgatcaggaagttaaagggtaacctgggaataggacacacccggtattccacggccgcagcctcggaagttgtgaactgccagccgtttgtggtgcacactgcccatggagcactggccattgcccacaatggtgagctagtgaactgcgagtccctgaggagggaggtcctggagcgaggagtgggcctgtctacgcacagtgacagtgaacttattgcccaatccctgtgctgtgcaccagaggatgtgtcggagcacgatggacccaattggccggccagaattcgccatttcatgaccctggctccactctcctactccctggtcgtgatgcacaaggataagatctacgctgtccgcgattcctatggcaatagaccgctgtgcttgggaaaaatcgtgcccgttgatgcaggacatgcgaatatcaatgaccaactggccgagggttgggtggtcagtagtgaaagctgcggattcctctccatcggagccagatatgttcgcgaggtggagcccggtgagatcatcgagctgtcacgaaatggttatagaaccgtggatatcgttgaaagaccggactataagcgcatggcattctgcatctttgagtacgtctactttgcccgcagtgattccatgttcgagggtcagatggtttactcagcccgcctgcaatgtggtcgccagttggccagggaatcgccattagatgcggatttggtcagctcggttccggaatcgggcacagcagctgcccatggttatgccagggagtcgggactgccattcggggaagttctctgcaagaatcgctatgtgggccgcacgttcatccaaccctcgacgagattgcgacagttgggcgtggccaaaaagtttggtgccctggctcaaaatgtcgagggcaagcggatcgtgctagtcgatgactccatagtgaggggaaataccattggaccgattatcaaactcctgcgagatgccggcgccaccgaggtgcacattcgcattgccagtcctccgctgcaatatccctgctacatgggtatcaatatacccactcgtgaggagctaatagccaacaaattgaatgcggatcagctggcggatcacgtgggtgcggatagtctggcctatttgagtgtggagggtctggtcaaggccgtccagatgaacaaggcccatgtgaatccactcaaagctggctactgcaccgcttgcctaacgggcgagtatcctggcggattgccggaggagctcagctggtag

SEQ ID NO: 30274 - protein, 470 aa, Drosophila melanogaster
MICLGLVALQHRGQESAGIVTSLGKSSKNFSVHKGMGMINNLFNDEAIRKLKGNLGIGHTRYSTAAASEVVNCQPFVVHTAHGALAIAHNGELVNCESLRREVLERGVGLSTHSDSELIAQSLCCAPEDVSEHDGPNWPARIRHFMTLAPLSYSLVVMHKDKIYAVRDSYGNRPLCLGKIVPVDAGHANINDQLAEGWVVSSESCGFLSIGARYVREVEPGEIIELSRNGYRTVDIVERPDYKRMAFCIFEYVYFARSDSMFEGQMVYSARLQCGRQLARESPLDADLVSSVPESGTAAAHGYARESGLPFGEVLCKNRYVGRTFIQPSTRLRQLGVAKKFGALAQNVEGKRIVLVDDSIVRGNTIGPIIKLLRDAGATEVHIRIASPPLQYPCYMGINIPTREELIANKLNADQLADHVGADSLAYLSVEGLVKAVQMNKAHVNPLKAGYCTACLTGEYPGGLPEELSW

SEQ ID NO: 30275 - DNA, 1455 bp, Streptococcus agalactiae NEM316
  CDS (1)..(1455): transl_table=11
atgacatacgaagtaaaatctctaaatgaagaatgtggagtctttggtatctgggggcatcctcaggcagctcaagtcacttactttgggcttcatagccttcaacatcgcggtcaagaaggtgctggtattgtttcgaatgataatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgacgggcaatttgctttatgccataatggtaatttgacaaatgctatttctttaaggaaagaattagaaaagcaaggtgcaattttcaatgcctcctcagatactgaaattttgatgcacttgattcgtcgaagccataacccaagttttatggggaaggtaaaagaagctttaagcactgtaaagggaggcttcgcctatctactgatgacagaagataaattaattgctgctcttgaccctaatgcctttcgtcctttgtcaattggacaaatgcaaaatggtgcttgggttatttccagtgagacctgtgcttttgaggtggtaggcgcaaaatgggttagagatgttgaacctggcgaagttatccttatagacgatagtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggtcttgtaaaaaatcagtatacgcagcgaacctttattcaaccgacacaagaattaagggaacaaggtgttcgaatgaaactatcagcggtatctggtgttgtcaaaggaaagcgcgttgttatgattgatgactcaattgtaagaggaacgacttctagaaggattgtcggattattaagagaagcaggagctagtgaagtacatgttgctatagctagtccagaattaaagtatccttgtttttatggtattgatattcaaacaagacgagaattaatttcagcaaatcacgctgctgacgaagtgtgtgatattattggcgcagatagtctgacttatctctcactagatgggttgattgaatcaattggactcgaaacaaaagcaccaaatggtggtttatgcgtagcttactttgatggacattatccaacgccgctttatgattatgaagaagaatacctcagaagtttagaagaaaaaacaagtttttatattcaaaaagtgaaataa

SEQ ID NO: 30276 - protein, 484 aa, Streptococcus agalactiae NEM316
MTYEVKSLNEECGVFGIWGHPQAAQVTYFGLHSLQHRGQEGAGIVSNDNGKLYGYRNVGLLSEVFKNQSELDNLTGNAAIGHVRYATAGSADIRNIQPFLYKFHDGQFALCHNGNLTNAISLRKELEKQGAIFNASSDTEILMHLIRRSHNPSFMGKVKEALSTVKGGFAYLLMTEDKLIAALDPNAFRPLSIGQMQNGAWVISSETCAFEVVGAKWVRDVEPGEVILIDDSGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGASEVHVAIASPELKYPCFYGIDIQTRRELISANHAADEVCDIIGADSLTYLSLDGLIESIGLETKAPNGGLCVAYFDGHYPTPLYDYEEEYLRSLEEKTSFYIQKVK

SEQ ID NO: 30277 - DNA, 1533 bp, Corynebacterium efficiens YS-314
  CDS (1)..(1533): transl_table=11
atgcatgtggcacaacttgatcagcacacatcccccggttctgtcgtgaactacccctacgatgatcacaacgaacagtccccgcaggaggaatgcggagtgttcggtgtctgggctccaggtgaagaggtggccaagctcacctacttcggtctgtttgccctgcagcaccgtgggcaggaggccgccggcattgcggtaggggacggcgaacagatcctggtgttcaaagacctcggtctggtatcccaggtcttcgacgaacccatcctggagtccctgcagggggacatcgccatcgggcacacccggtacaccaccgcgggcggcaactcctgggagaacgcccagccgatgttccgcatggccccggacggcaccgatgtggcgctgggtcacaacggcaacctcatcaaccatgtgcagctgcgcgagaaggcgaccgaactcggcctcgtcgacccgcagcagaagccttccgacaccgatgtgctgaccgcgctgctggccaacggcatcggtgacggtgatgatctcttcgaatccgcccggaagctcctccccgaggtcaggggggcctactgcctgaccttcaccgatggccacaccctctacgccgcccgtgacccctacggcatccgaccgctgtccatcggacgtctcgcccgtggctgggtggttgcctccgagacctccgccctggatatcgtcggtgcttcgctggtgcgtgaggtggagcccggtgagctcatcgccatcgatgaatccgggctgcgttccacccgttttgcagagaccaaccgcaaggcctgcgtcttcgaatatgtctacctagcccgccccgactcggtgatcaagggacgcaacgtcaatgaggtccgtctggagatcgggcgcaccctggcacgggaagccccggccgagggtgatctggtcatcccgacacctgattccggcacccctgcggcggtggggttcgcccaggcctccggcatccccttcgggcagggcatggtgaagaacgcctatgtgggacgcaccttcatccagccgtccgacaccctgcgtcagttgggcatccgcctgaagctgaacccactgcgcgaggtcatcgcaggaaaacgcctcgtggtggtcgatgattccattgtgcgtggcaacacccagcgcgcggtgatccgcatgctgcgtgaggccggggccgccgaggtccatgtgcgcatcgcctccccgccggtgaaatggccgtgtttctacggcattgacttcgccacccccggtgagctcatcgccaatgcggtcaccagtgacaacgaggaggagatggtggaggctgtccgctccgccatcggcgctgattcactcggttatgtctccatcgacgggatggtggcatccaccaccaagcccgtggaggaactgtgcctggcatgtttcaacgggcactatcccatgggattgcccgaggccaaccccaatgccgagctggtgttcaagatgcaggccggcaggcaggataagatcgggacctag

SEQ ID NO: 30278 - protein, 510 aa, Corynebacterium efficiens YS-314
MHVAQLDQHTSPGSVVNYPYDDHNEQSPQEECGVFGVWAPGEEVAKLTYFGLFALQHRGQEAAGIAVGDGEQILVFKDLGLVSQVFDEPILESLQGDIAIGHTRYTTAGGNSWENAQPMFRMAPDGTDVALGHNGNLINHVQLREKATELGLVDPQQKPSDTDVLTALLANGIGDGDDLFESARKLLPEVRGAYCLTFTDGHTLYAARDPYGIRPLSIGRLARGWVVASETSALDIVGASLVREVEPGELIAIDESGLRSTRFAETNRKACVFEYVYLARPDSVIKGRNVNEVRLEIGRTLAREAPAEGDLVIPTPDSGTPAAVGFAQASGIPFGQGMVKNAYVGRTFIQPSDTLRQLGIRLKLNPLREVIAGKRLVVVDDSIVRGNTQRAVIRMLREAGAAEVHVRIASPPVKWPCFYGIDFATPGELIANAVTSDNEEEMVEAVRSAIGADSLGYVSIDGMVASTTKPVEELCLACFNGHYPMGLPEANPNAELVFKMQAGRQDKIGT

SEQ ID NO: 30279 - DNA, 1506 bp, Pseudomonas putida KT2440
  CDS (1)..(1506): transl_table=11
atgtgtggcatcgtcggtatcgtcggtaagtcgaacgtcaatcaggcgctgtatgacgcgcttacggtcctccagcaccgcggccaggacgctgccggtatcgtgaccagccatgacggccggttgttcctgcgcaaggataatggcctggtgcgcgacgtgttccagcagcgccacatgcagcgcctggttggcaacatcggtatcggccacgtgcgctacccgactgcgggcagctcgacctcggccgaggcccagccgttctacgtcaactcgccttacggcatcaccctggctcacaacggcaacctgaccaatgtcgagcagttggccaaggagatctacgagtccgacctgcgccacgtcaacaccaactccgactcggaagtgctgctgaacgtgttcgcccatgagctggcagtgcgcggcaagctgcagccgaccgaagaagacgtgttcgctgcggtctcccatgtgcacagccgctgcgttggcggttacgccgtggtggccatgatcaccggctacggcatcgtcggtttccgcgacccccatggcattcgcccggtggtgttcggtcagcgtcacaccgacgaaggtgtggaatacatgatcgcctcggaaagcgtcgccctggacgtgctcggcttcaccctgatccgcgacctggcgccgggcgaagcggtgtacatcaccgaagaaggccagttgttcaccaagcagtgcgccgaatcgccaaagttgcagccgtgcatcttcgagcacgtctacctggcgcgtccggactcgatcatcgatggggtctcggtgtacaaggcgcgtctgcgcatgggtgaaaagctggccgacaagatcatgcgcgagcgccccgatcatgatatcgacgtggtcatcccgatcccggataccagtcgtactgccgcgctggaactggccaaccggttgggcgtcaagttccgcgaaggtttcgtcaagaaccgttacatcggccgtaccttcatcatgcccggccaggccgcgcgcaagaagtcggtgcgtcagaagctcaacgccatcgagctggagttccgcggcaagaatgtgatgctggtggacgactcgatcgtgcgcggcaccacctgcaagcagatcatccagatggcccgcgaagccggcgccaagaatgtctacttctgctccgcagcgcctgcagtacgctaccccaacgtctacggcatcgacatgccgagtgttcacgaactgatcgcccacaaccgcaccaccgaacaggtgggtgagttgattggcgccgattggctggtctatcaggacctgccagacctgatcgactcggtcggcggcggcaagatcaagatcgagcagttcgattgtgcggtgttcaacggcgagtacgtcactggcgatatcgacgaagcctacctcgaccgcatcgagcaggcccgtaacgacttggccaaggtcaagaaccaggccgtcagcgcgatcatcgacctttacaacaactga

SEQ ID NO: 30280 - protein, 501 aa, Pseudomonas putida KT2440
MCGIVGIVGKSNVNQALYDALTVLQHRGQDAAGIVTSHDGRLFLRKDNGLVRDVFQQRHMQRLVGNIGIGHVRYPTAGSSTSAEAQPFYVNSPYGITLAHNGNLTNVEQLAKEIYESDLRHVNTNSDSEVLLNVFAHELAVRGKLQPTEEDVFAAVSHVHSRCVGGYAVVAMITGYGIVGFRDPHGIRPVVFGQRHTDEGVEYMIASESVALDVLGFTLIRDLAPGEAVYITEEGQLFTKQCAESPKLQPCIFEHVYLARPDSIIDGVSVYKARLRMGEKLADKIMRERPDHDIDVVIPIPDTSRTAALELANRLGVKFREGFVKNRYIGRTFIMPGQAARKKSVRQKLNAIELEFRGKNVMLVDDSIVRGTTCKQIIQMAREAGAKNVYFCSAAPAVRYPNVYGIDMPSVHELIAHNRTTEQVGELIGADWLVYQDLPDLIDSVGGGKIKIEQFDCAVFNGEYVTGDIDEAYLDRIEQARNDLAKVKNQAVSAIIDLYNN

SEQ ID NO: 30281 - DNA, 1524 bp, Bradyrhizobium japonicum USDA 110
  CDS (1)..(1524): transl_table=11
atgcgacaccctgaccaggacgcccaacttgatctcgatccaaaagccggtttgagcccggccgcgctagagcttcaggacgatctggagggggatacgctccgcgaggaatgcggcgtattcggcatctacggccaccccgacgccgccgccatcaccgccctcggcctccacgcccttcagcaccgcggccaggaagccgccggcatcgtctcctatgacggcagccgctttcacagcgaacgccgcctcggcctcgtcggcgacactttctcccgccgcgaggtgatcgaccgcctgcccggcaacatggcggtcggccatgtccgctactccaccaccggcgcgaccatcctgcgcaacgtgcagccgctgttcgccgaactcaacgccggcggccttgcggtcgcccataacggcaacctcaccaacggcctgacgctgcgccgcgagctcgtgaggaacggcgcgatgatgcagtcgaccaccgacaccgaggtgatcctgcacctcgtcgcgcgctcccggcgcagccgcttcatcgagcgctatatcgacgcgctgcgcgagatcgagggcgcctatgcgctggtctcgctgaccaacaagaagctggtcggcgcgcgcgacccgcgcggcatccgccccctggtgctcggtgagctcgatggctgcccgatcctgacgtcggagacctgcgcgctcgacatcatcggcgcgcgcttcatccgcgacatcgagccgggcgaagtcatcgtgttcgacgagaacggccaggacatccacaagccgttcccgccgatggcgccgcgtccctgcatcttcgaatacatctatttctcccgtccggattccatcgtccacggccgctcggtctacgaggtgcgcaaggcctttggtgcgcagctcgcgcgcgagagccacgtgccgatcgacgtcgtcgtgccggtgccggattccggcgtgcccgccgctgtcggctacagccagcattccggcgtgccgttcgagctcggcatcatccgcaaccactatgtcggccgcaccttcatccagccgacgcaggcaatccgcgaatccggcgtgcgcatgaagcattcggccaaccgcgccgcgatcgaaggcaagcgcatcatcctgatcgacgactcgctggtgcgcggcaccacctcgaagaagatcgtgcgcatgatgcgcgatgcaggcgcgaaggaagtgcatttccgcctcgcctcgccgccgatcctctatcccgattattacggcatcgacctgccggaccgcggcggcctgctggccgcaacgcattcgctggaggaaatgcgggagatcattggcgccgactcgctcgccttcctgtcgatcgacggcatgtaccgcgccatgggcgagcccggccgcgacccggccaatccgaagttctcggatcactgcttcaccggggcgtatccgacccacctcaccgaccagacccagaccgagcagcagccccggcaattgtcgctgctggcggaggcgagctga

SEQ ID NO: 30282 - protein, 507 aa, Bradyrhizobium japonicum USDA 110
MRHPDQDAQLDLDPKAGLSPAALELQDDLEGDTLREECGVFGIYGHPDAAAITALGLHALQHRGQEAAGIVSYDGSRFHSERRLGLVGDTFSRREVIDRLPGNMAVGHVRYSTTGATILRNVQPLFAELNAGGLAVAHNGNLTNGLTLRRELVRNGAMMQSTTDTEVILHLVARSRRSRFIERYIDALREIEGAYALVSLTNKKLVGARDPRGIRPLVLGELDGCPILTSETCALDIIGARFIRDIEPGEVIVFDENGQDIHKPFPPMAPRPCIFEYIYFSRPDSIVHGRSVYEVRKAFGAQLARESHVPIDVVVPVPDSGVPAAVGYSQHSGVPFELGIIRNHYVGRTFIQPTQAIRESGVRMKHSANRAAIEGKRIILIDDSLVRGTTSKKIVRMMRDAGAKEVHFRLASPPILYPDYYGIDLPDRGGLLAATHSLEEMREIIGADSLAFLSIDGMYRAMGEPGRDPANPKFSDHCFTGAYPTHLTDQTQTEQQPRQLSLLAEAS

SEQ ID NO: 30283 - DNA, 1458 bp, Xylella fastidiosa Temecula1
  CDS (1)..(1458): transl_table=11
atgtgcggtatcctcggtatcgttggcaatcaaaacgttgctggccaactctatgacggtttgactgttttgcaacatcgtggacaagatgctgcaggcattgccacggccagtggcactcgcttgcgcgttcaaaaggccaatggtttggtacgagacgtattcgatgagcagcgtatggcggtccttgatgggtgtattgggattgctcattgccgttatccaactgctggttctgaggggatggatgaggcacaacctttttacgtcaactcaccgtacggcattgctctagcacataatggaaaccttatcaacacagaggcgctacaccaacaggtgttcgaagcggatcgacgtaacatcaacaccgactctgacagcgaagtattacttaacgtattcgcatatgagttagatgcgcagcgtatgctcactccagaagcggcaattcgtgctgtagcaggagtacatcgccgctgtaagggcggctacgccgtagtgagcatgatattagggctgggacttgttgcattccgcgatccacacggtatccgtccgttggtgctgggaaagcgtgtacataccgaaggtgatgaatatatggtcgcttccgaatcagctgcactcgatatcctagggtttatacgtatacgcgatgtacgtccaggtgaggctgtggtgattactgcacgtggcgaactgttttcagaggtctgtgctacacctaccaaccatactccatgcattttcgagtacgtttacttcgcacgtccggattcgatgatcgataatatttcagtacataaggcacgcatgcgtatgggtgtgaagttaggtgaaaagatcctgcgcttgcgcccgaatcacgatatcgacaccattattccgataccggatacctcgcgggatgcagcgctggaaatatctaacgtgctcggcgtaaagtatcgcgaaggtttcgttaaaaatcgctacgttggccgtacttttatcatgccgggacagggagagcgagttaagtcagtacgtcgtaaacttaacccaatccatctggagttccgaaaccgcgtggtgctgttgattgatgattcaattgttcgcggtaccaccagccgccagattgtccagatggtaagagatgctggtgcacgcaaggtgtacttagcaagtgctgcgccacctgtgcgttatccaaatgtgtatggcattgatatgccagctgcagatgaattaatcgcacatgatcggactgagcaggaaatacaatcccttcttggctgcgattggttgatttaccaagatttagaggatctagaaaacgctgtgcgtgagggaaaccaagaaatcaagcaatttgattcctcatgcttcaatggtcattacatcactggaattgaacggggctatttagatcgcatccgtcaactacgctccgatgaggtaaagcgaaaataa

SEQ ID NO: 30284 - protein, 485 aa, Xylella fastidiosa Temecula1
MCGILGIVGNQNVAGQLYDGLTVLQHRGQDAAGIATASGTRLRVQKANGLVRDVFDEQRMAVLDGCIGIAHCRYPTAGSEGMDEAQPFYVNSPYGIALAHNGNLINTEALHQQVFEADRRNINTDSDSEVLLNVFAYELDAQRMLTPEAAIRAVAGVHRRCKGGYAVVSMILGLGLVAFRDPHGIRPLVLGKRVHTEGDEYMVASESAALDILGFIRIRDVRPGEAVVITARGELFSEVCATPTNHTPCIFEYVYFARPDSMIDNISVHKARMRMGVKLGEKILRLRPNHDIDTIIPIPDTSRDAALEISNVLGVKYREGFVKNRYVGRTFIMPGQGERVKSVRRKLNPIHLEFRNRVVLLIDDSIVRGTTSRQIVQMVRDAGARKVYLASAAPPVRYPNVYGIDMPAADELIAHDRTEQEIQSLLGCDWLIYQDLEDLENAVREGNQEIKQFDSSCFNGHYITGIERGYLDRIRQLRSDEVKRK

SEQ ID NO: 30285 - DNA, 1398 bp, Clostridium tetani E88
  CDS (1)..(1398): transl_table=11
atggaatggaacaatttaaaagaagataaatttaaagatgaatgtggagtttttggaatatttactggcgaagaaagagaaataggagtaataaattattatggactctttgcattacaacataggggacaagatagtgcaggaatggtagtatcaaatggagaaaaatttatatttcataaagatataggtcttgttgaagatgtgtttagttatgataaattaaataagtttaaggggatatgtggaataggtcatgttaaatattccagttgtaaaaatggagatttagataacgtacagcctgtacttggcaaggctaagctaggatcaattgctatagctcataatgggagtttagtaaatgcaaaaatagtaaaagaattattagaagaggcaggaattgtttttcaaactaatgtagaatcagaagtagtattaaatttaatagctaggtcaaataaaaaagaattagaagatgctttaatagaagctttacaaagtataaaaggatcttatgcaatgcttttaatgacacaggataaattaattggattaagagatcctaaaggtataagacctctttgcataggaaaacttgatgataattatgttatttcatctgaaagctgtgctataaatgctataggtggagagtttataagggatgtagaaccaggagaaatggtaattgtagataaaggtggattaaaaagcttaagatttgcagagaaaacaaagggaagcatatgtgcttttgaatatatatattttgcaagaccagatagctctattgataatataagtgtttatgaatatagggttaaatctggagaagaactttacaaagaatgccctgttgatgcagatattgtagtgggagttccagactcaggaatacctgctgccataggatattcaaaagcttcaggcattccctatggcatagggtttgtaaaaaataaatatataggaagaagttttatagaacctactcaagaaatgagagaaagagcggttttagtgaaattaaacccgttaaaatataatgttgagggaaaaagagttgtaattatagacgattctatagtaaggggaactactagtaaaaaacttataagttctataagacgagctggagcaaaggaagttcattttatgtcagcatcaccaatggttaagtttccttgttatttaggtattgatactcctaataaagaagatttaatggcatctaattataacatagatgaaataaaggaaatgataggagcggacagtgtaggctatttaagtattgaaggactcacaagagctttaggatgtgaaaattgtaaaaaagaattttgcttaggatgttttagtggagaatatccagtatctatacctaaagaatga

SEQ ID NO: 30286 - protein, 465 aa, Clostridium tetani E88
MEWNNLKEDKFKDECGVFGIFTGEEREIGVINYYGLFALQHRGQDSAGMVVSNGEKFIFHKDIGLVEDVFSYDKLNKFKGICGIGHVKYSSCKNGDLDNVQPVLGKAKLGSIAIAHNGSLVNAKIVKELLEEAGIVFQTNVESEVVLNLIARSNKKELEDALIEALQSIKGSYAMLLMTQDKLIGLRDPKGIRPLCIGKLDDNYVISSESCAINAIGGEFIRDVEPGEMVIVDKGGLKSLRFAEKTKGSICAFEYIYFARPDSSIDNISVYEYRVKSGEELYKECPVDADIVVGVPDSGIPAAIGYSKASGIPYGIGFVKNKYIGRSFIEPTQEMRERAVLVKLNPLKYNVEGKRVVIIDDSIVRGTTSKKLISSIRRAGAKEVHFMSASPMVKFPCYLGIDTPNKEDLMASNYNIDEIKEMIGADSVGYLSIEGLTRALGCENCKKEFCLGCFSGEYPVSIPKE

SEQ ID NO: 30287 - DNA, 1455 bp, Lactobacillus plantarum WCFS1
  CDS (1)..(1455): transl_table=11
atgcctactgaagtaagaagtctgaatgaagaatgtggcgtctttggggtttggggctcgccggacgccgcccaattaacgtactttgggctccatgcgttacaacaccgggggcaagaaggagccggtatcacggcgaatgatcacggcaaactgcagacggaacgcggactagggttgttggctgatgtctttcgggacccacggcggttggcacgtttgacgggtcaagctgcagtcggccatgtacgttatgccacggctggtaatcatggattggaaaacattcaacccttgagttttaattttagcgactcacagtttgcactcgcacataacggcaatttgacgaatgcggtgacactgcggcgacggttggaacagcatggtgccatttttcatgctagttctgatagtgagattttaatgcatctgattcgacgcagccccgcagcaacgttaacggaacaggttaaggatgctttacgtcaagtccacggaggctttgcttacttactactaacgaatgattgtttgattgccgctttggatcctaacgggttacgaccattagtcgtcggtcagttacccacgggcgggtacgtcgtttgtagtgaaacttgcgcgcttgatacgattggtgcgacgtttgttcaagatgttcagccgggagaattgttaacgatcgatgatcatggcttgacgatcgaccattatacgactgatacacagttggcgatttgttcaatggagtttatctactttgcacgtccagattctgatattcacggcgtcaacgtccattctgcacgtaaacgaatgggtgctcagctcgctgttgaacagcccgtggacgccgacattgttgtcggggtacccaattcatctttatcagcggcgaccggctatgcggaagcgagtggcctgccttacgagatgggattaattaaaaatcaatattcgtcacggacctttattcagccgacccaagcattgcgagaacagggggttcggatgaagctttcagcggtcaaaggtgttgtcgctggtaaacgagtcgtcttaatcgatgattcgattgtacgtggtaccaccagtcggcggatcgtcaaattattgaaagatgcgggtgcaaagtcagttcatttacgaattgcatcgccaccattacgctatccatgtttttacggtatcgatattcaatcgactaatgaattgattgcggctcagcaaacgattcgggagatgtgtcagacgtttggtgcggactcacttggttttctcagtgaacagggcgtcgttgatgcagttggcttgtcgaccaccgaaccgtatggtggactatgcatggcctattttaatggggattatccaacggccctgtatgattaccaagccgagtatgatgcggaaattgcgcaattacaagccaatcatgaaggggtgatcaagtga

SEQ ID NO: 30288 - protein, 484 aa, Lactobacillus plantarum WCFS1
MPTEVRSLNEECGVFGVWGSPDAAQLTYFGLHALQHRGQEGAGITANDHGKLQTERGLGLLADVFRDPRRLARLTGQAAVGHVRYATAGNHGLENIQPLSFNFSDSQFALAHNGNLTNAVTLRRRLEQHGAIFHASSDSEILMHLIRRSPAATLTEQVKDALRQVHGGFAYLLLTNDCLIAALDPNGLRPLVVGQLPTGGYVVCSETCALDTIGATFVQDVQPGELLTIDDHGLTIDHYTTDTQLAICSMEFIYFARPDSDIHGVNVHSARKRMGAQLAVEQPVDADIVVGVPNSSLSAATGYAEASGLPYEMGLIKNQYSSRTFIQPTQALREQGVRMKLSAVKGVVAGKRVVLIDDSIVRGTTSRRIVKLLKDAGAKSVHLRIASPPLRYPCFYGIDIQSTNELIAAQQTIREMCQTFGADSLGFLSEQGVVDAVGLSTTEPYGGLCMAYFNGDYPTALYDYQAEYDAEIAQLQANHEGVIK

SEQ ID NO: 30289 - DNA, 1515 bp, Tropheryma whipplei str. Twist
  CDS (1)..(1515): transl_table=11
gtgaatttggaacactattcgcgggacagtgtcctgcgaggtgatggcgcaaaaatgtgtggcatagtcgggctaatcggttcagagccagccaatcaggctatatacgacagcctcttgcttttgcagcatcgcggccaggactcaaccggaatagcgaccgatgaatcaggaatattgcacctcaggaaagcaagaggttatgttcgtgaagctttccgcaccaggcatatgcgatccttgcttggccgggttggccttgggcatgtcaggtacgctactcagggaagtgtatcaagcgaagaagaggcacagccattctatgtaaatgctccgtatggtattgcaatggtgcacaatggcaatctaacaaatgcaagcaagctcagtaaagagctgttccatacagatcgcagacaccttaacacgtcgagcgacacagaggttttaataaatgtttttgccaacgaactgcaacagagtgtctcaggttttgaattgtcaccagatcaaatttttagtgccgtttcgcgcgtgcataaacgagtcgaggggtcgtatgcggttgttgcgctaatagctggcaccggaattttggctttcagagatccgttcggaataagacctttggtattgggagcccgcgaaagcaaatttacttccaataccgagtggataatagcgagtgaatcagttgtccttgaggcgcaaggatataaactgctaagagattttgctccgggtgaggctgtatttataacgcaacagggcgagatttttatgacccaatgcgcccaaaatccacaactaaatccctgcgccttcgaatatgtttatctagcgagacccgattccgttatgaatggcgtatcggtttatgaggcacgcttgcgccttggtgacactttatctacaactatcaaacaacagatgccttgcgggaacattgatgttgttatgcccatcccagattcatcgcgcccagcggcgttacaggtctcaagaaatcttggcatagagtatcgggaagggtttttaaagaaccgatacgttggccgaactttcataatgccaggacaactccagcgcaagaaaagcgttaggcagaagctgaatgccatgggtctcgaattccgcggtaaaaatgtcctgattgttgacgattcaattgtgcgtggtacaacctcaaaggagattattcacatggctcgcagtgctggggcaaatcaggtattctttacttctgccgcgccgcctgttcgataccaaaatgtttttggaatcaacatgccaacaagctctgagcttgttgcgcacaaccggcaactacaagaaattcgtcaatacatagacgccgaccgcctcatataccaaagtattgaagatatgcgacgcgcgatcatgcatggtggtgagttcaagcgacttgaggattcgtgcttttcaggcgaatacgtgacagggcgagttacccaggagtacctggactgggttgaaaacacgcagtccagctaa

SEQ ID NO: 30290 - protein, 504 aa, Tropheryma whipplei str. Twist
MNLEHYSRDSVLRGDGAKMCGIVGLIGSEPANQAIYDSLLLLQHRGQDSTGIATDESGILHLRKARGYVREAFRTRHMRSLLGRVGLGHVRYATQGSVSSEEEAQPFYVNAPYGIAMVHNGNLTNASKLSKELFHTDRRHLNTSSDTEVLINVFANELQQSVSGFELSPDQIFSAVSRVHKRVEGSYAVVALIAGTGILAFRDPFGIRPLVLGARESKFTSNTEWIIASESVVLEAQGYKLLRDFAPGEAVFITQQGEIFMTQCAQNPQLNPCAFEYVYLARPDSVMNGVSVYEARLRLGDTLSTTIKQQMPCGNIDVVMPIPDSSRPAALQVSRNLGIEYREGFLKNRYVGRTFIMPGQLQRKKSVRQKLNAMGLEFRGKNVLIVDDSIVRGTTSKEIIHMARSAGANQVFFTSAAPPVRYQNVFGINMPTSSELVAHNRQLQEIRQYIDADRLIYQSIEDMRRAIMHGGEFKRLEDSCFSGEYVTGRVTQEYLDWVENTQSS

SEQ ID NO: 30291 - DNA, 1461 bp, Tropheryma whipplei TW08/27
  CDS (1)..(1461): transl_table=11
atgtgtggcatagtcgggctaatcggttcagagccagccaatcaggctatatacgacagcctcttgcttttgcagcatcgcggccaggactcaaccggaatagcgaccgatgaatcaggaatattgcacctcaggaaagcaagaggttatgttcgtgaagctttccgcaccaggcatatgcgatccttgcttggccgggttggccttgggcatgtcaggtacgctactcagggaagtgtatcaagcgaagaagaggcacagccattctatgtaaatgctccgtatggtattgcaatggtgcacaatggcaatctaacaaatgcaagaaagctcagtaaagagctgttccatacagatcgcagacaccttaacacgtcgagcgacacagaggttttaataaatgtttttgccaacgaactgcaacagagtgtctcaggttttgaattgtcaccagatcaaatttttagtgccgtttcgcgcgtgcataaacgagtcgaggggtcgtatgcggttgttgcgctaatagctggcaccggaattttggctttcagagatccgttcggaataagacctttggtattgggagcccgcgaaagcaaatttacttccaataccgagtggataatagcgagtgaatcagttgtccttgaggcgcaaggatataaactgctaagagattttgctccgggtgaggctgtatttataacgcaacagggcgagatttttatgacccaatgcgcccaaaatccacaactaaatccctgcgccttcgaatatgtttatctagcgagacccgattccgttatgaatggcgtatcggtttatgaggcacgcttgcgccttggtgacactttatctacaactatcaaacaacagatgccttgcgggaacattgatgttgttatgcccatcccagattcatcgcgcccagcggcgttacaggtctcaagaaatcttggcatagagtatcgggaagggtttttaaagaaccgatacgttggccgaactttcataatgccaggacaactccagcgcaagaaaagcgttaggcagaagctgaatgccatgggtctcgaattccgcggtaaaaatgtcctgattgttgacgattcaattgtgcgtggtacaacctcaaaggagattattcacatggctcgcagtgctggggcaaatcaggtattctttacttctgccgcgccgcctgttcgataccaaaatgtttttggaatcaacatgccaacaagctctgagcttgttgcgcacaaccggcaactacaagaaattcgtcaatacatagacgccgaccgcctcatataccaaagtattgaagatatgcgacgcgcgatcatgcatggtggtgagttcaagcgacttgaggattcgtgcttttcaggcgaatacgtgacagggcgagttacccaggagtacctggactgggttgaaaacacgcagtccagctaa

SEQ ID NO: 30292 - protein, 486 aa, Tropheryma whipplei TW08/27
MCGIVGLIGSEPANQAIYDSLLLLQHRGQDSTGIATDESGILHLRKARGYVREAFRTRHMRSLLGRVGLGHVRYATQGSVSSEEEAQPFYVNAPYGIAMVHNGNLTNARKLSKELFHTDRRHLNTSSDTEVLINVFANELQQSVSGFELSPDQIFSAVSRVHKRVEGSYAVVALIAGTGILAFRDPFGIRPLVLGARESKFTSNTEWIIASESVVLEAQGYKLLRDFAPGEAVFITQQGEIFMTQCAQNPQLNPCAFEYVYLARPDSVMNGVSVYEARLRLGDTLSTTIKQQMPCGNIDVVMPIPDSSRPAALQVSRNLGIEYREGFLKNRYVGRTFIMPGQLQRKKSVRQKLNAMGLEFRGKNVLIVDDSIVRGTTSKEIIHMARSAGANQVFFTSAAPPVRYQNVFGINMPTSSELVAHNRQLQEIRQYIDADRLIYQSIEDMRRAIMHGGEFKRLEDSCFSGEYVTGRVTQEYLDWVENTQSS

SEQ ID NO: 30293 - DNA, 1509 bp, Pseudomonas syringae pv. tomato str. DC3000
  CDS (1)..(1509): transl_table=11
atgtgtggcatcgtcggtatcgtcggcaagtcgaacgtcaatcaggcgctgtatgacgcgcttaccgtcctccagcaccgcggccaggacgctgccggtatcgtaaccagccacgatggccggttattcctgcgcaaggacaacggattggtgcgtgatgtgtttcatcagcgccatatgcagcgcctggtcgggcatatgggcatcggtcatgtgcgttatccaacggcgggcagttcgacttcggccgaagcccagccgttctacgtcaactcgccttacggcatcacgttggcgcataacggcaacctcaccaacgttgagcaactggccaaggagatttacgaatccgacctgcgccatgtgaacaccaattccgattcggaagtgctgctcaacgtttttgcccatgaactggccgtgcgcggcaagttgcagccgaccgaagaagatatcttcgcggccgtgaccgacgtgcaccatcgctgccgtggcggctatgcggtcgtggcaatgatcaccggctacggcatcgtcggtttccgtgacccggatgccattcgtcctatcgtgttcggccagcgtcatactgacgaaggtgtcgagtacatgatcgcgtcggaaagcgtctcgctggacgtgctgggcttcaccctgattcgcgacctggcaccgggcgaagcggtctacatcaccgaagacggcaagctgcacacccgtcagtgtgcggccaaccccaagtatgcgccgtgcatcttcgagcacgtctatctggcacgtccggactcgatcatcgatggcatctcggtctacaaggcgcgtctgcgcatgggcgagaagctggctgacaagatcttgcgcgagcgcccggatcacgacatcgatgtggtcatccccattccagacaccagccgtaccgctgcgctggaactggccaaccacctgggcgtcaagtttcgcgaaggtttcgtcaagaaccgctacatcggccggaccttcatcatgccgggtcaggcagcgcgcaaaaagtctgttcgccagaagctcaacgcaatcgagctggaatttcgcggcaagaatgtgatgctggtggatgactccattgtgcgtggcacgacctgcaagcagatcatccagatggcccgcgaagccggtgccaagaatgtctacttctgttcggctgccccggcagtgcgttaccccaacgtctacggcatcgacatgccgagtgctcacgagctgatcgctcacaaccgttccacccaggacgtggccgacctcatcggtgccgactggctggtctatcaggatctgaatgacctgatcgaagcggtcagtggcagcaagaagatcaagatcgacaacttcgactgctcggttttcgacggcaagtacgtgaccggtgacatcgacgagcactacctgaacaggatcgagagcgcgcgcaacgacgcctccaagatcaagacccaggcagtgagtgcgatcatcgatctgtacaacaactaa

SEQ ID NO: 30294 - protein, 502 aa, Pseudomonas syringae pv. tomato str. DC3000
MCGIVGIVGKSNVNQALYDALTVLQHRGQDAAGIVTSHDGRLFLRKDNGLVRDVFHQRHMQRLVGHMGIGHVRYPTAGSSTSAEAQPFYVNSPYGITLAHNGNLTNVEQLAKEIYESDLRHVNTNSDSEVLLNVFAHELAVRGKLQPTEEDIFAAVTDVHHRCRGGYAVVAMITGYGIVGFRDPDAIRPIVFGQRHTDEGVEYMIASESVSLDVLGFTLIRDLAPGEAVYITEDGKLHTRQCAANPKYAPCIFEHVYLARPDSIIDGISVYKARLRMGEKLADKILRERPDHDIDVVIPIPDTSRTAALELANHLGVKFREGFVKNRYIGRTFIMPGQAARKKSVRQKLNAIELEFRGKNVMLVDDSIVRGTTCKQIIQMAREAGAKNVYFCSAAPAVRYPNVYGIDMPSAHELIAHNRSTQDVADLIGADWLVYQDLNDLIEAVSGSKKIKIDNFDCSVFDGKYVTGDIDEHYLNRIESARNDASKIKTQAVSAIIDLYNN

SEQ ID NO: 30295 - DNA, 1410 bp, Bacteroides thetaiotaomicron VPI-5482
  CDS (1)..(1410): transl_table=11
atgggaggttttttcggaacagtctcgaaatcgagttgcgtgactgatttattctatggtacagattataactcacatctgggtacaaagcggggcggactcgcgacttatagtcaggagaaaggatttattcgctccattcacaatctggaaagtacatatttccgatccaagtttgaaggagagcttgataaatttaaaggcaatgccggcataggcattatcagcgacacagatgcacaacccattatcatcaattcccacctcggccgcttcgccatcgtcacagtcgctaaaatatcgaatatccaggaactggaagaagaccttctcaaccaaaatatgcacttcgccgaacttagttcgagcaacaccaatcaaacggaactcatcgcactgcttatcatacaaggaagaaccttcaccgaaggtatcgagaacgtattcaaacatatcaagggttcttgttctctgctgattctgacagaggatggcagtattatcgcggctcgtgaccaatggggacgtactccggtggtgatcggcaagaaagatggtgcgtatgccgctaccagcgagtcatccagtttcccgaatctggattatgaaatcgaaaagtatctgggaccgggggaaatagtacgcatgtatcccgatcatatcgagcagcttcgccaaccgaatgaaggaatgcagatttgttctttcctttgggtgtattatggtttcccgacctcttgttatgagggcaaaaatgtagaggaagtccgtttcaccagtggaatgaagatgggacagaaggacgaatcggaagtggattgtgcctgtggtatccctgattcgggagtaggtatggcgttgggttatgcggaaggtaaaggagttccttatcatcgtgccatttcaaaatatacaccgacatggcctcgtagcttcacacccagcaatcaggaaatgcgttcgctggttgcaaagatgaagctaattccgaatcgtgccatgcttcagggaaagcgtctgctgttttgtgatgattcgattgtgcgtggaacacagttgcgtgataatgtgaagattctatatgattatggagcgaaagaggtacatatgcgtatcgcttgccctccgttgatctatgcctgtccgtttgtgggtttctcggcttctaagaatgctttggagttgattacccgtcgtattattaaagaactggaaggcgatgagaataagaatctggagaaatacgccactacggggtctcccgaatacgagaaaatggttagtatcatagccgagcgtttcggactgacttcattgaaattcaacacgcttgagactttgattgaagctatcgggctgccgaaatgtaaagtgtgtacgcattgttttgatggtagcagtcacttttaa

SEQ ID NO: 30296 - protein, 469 aa, Bacteroides thetaiotaomicron VPI-5482
MGGFFGTVSKSSCVTDLFYGTDYNSHLGTKRGGLATYSQEKGFIRSIHNLESTYFRSKFEGELDKFKGNAGIGIISDTDAQPIIINSHLGRFAIVTVAKISNIQELEEDLLNQNMHFAELSSSNTNQTELIALLIIQGRTFTEGIENVFKHIKGSCSLLILTEDGSIIAARDQWGRTPVVIGKKDGAYAATSESSSFPNLDYEIEKYLGPGEIVRMYPDHIEQLRQPNEGMQICSFLWVYYGFPTSCYEGKNVEEVRFTSGMKMGQKDESEVDCACGIPDSGVGMALGYAEGKGVPYHRAISKYTPTWPRSFTPSNQEMRSLVAKMKLIPNRAMLQGKRLLFCDDSIVRGTQLRDNVKILYDYGAKEVHMRIACPPLIYACPFVGFSASKNALELITRRIIKELEGDENKNLEKYATTGSPEYEKMVSIIAERFGLTSLKFNTLETLIEAIGLPKCKVCTHCFDGSSHF

SEQ ID NO: 30297 - DNA, 1440 bp, Enterococcus faecalis V583
  CDS (1)..(1440): transl_table=11
atgtcttatgaagcaaaaagcttaaatgaagagtgtggtattttcggtatttggggtcatcctgatgcggcacaagtgacctattttggcttacacagcttgcagcatcgaggccaagaaggcgcgggaattgtggcgaacaattctgggaaattagatggccaccgtgatttaggtttattagcagaagtattccaaaagcaagaacaactgaatgcgttagaaggaacggcggctattggtcatgtacgctatgcaaccgctggtacgggtagcgtggataatattcagccatttttatttaaattttatgatagtcaaattgggttagcacacaatggcaatttgacaaatgccaaacgtttacgaaaacaactagaaagagaaggcgctatttttcattccaattcagacactgaaattttaatgcacttgattcgaaaaagcactgctgcctcgtttctcgataaattaaaagagagcttgaatttggttaagggtggctttgcttatcttttattaacagaaacgatgatgattgctgcactggatcccaacggctttcgccctctctccatcggacaaatgaacaatggggcgtacgttgtggcatccgaaacgtgtgcattagaaacagttggggctcgctttattcaagatgtggcgcctggtgaagtagtcatcatttctgatgaaggcttgaaaatagaggttttcactacggaagtccaaccggcaatttgtgcaatggaatatatttattttgcacgaccagattcaaatattgccggagttaatgtgcatacagctcgtaaaagaatggggaagaacttggcaatcgaaagtccagtcgcagctgatatggtaattggtgtaccgaactcgtcattgtctgcagctagcggctatgcagaagaagcacagataccttacgaactaggtttagtaaaaaatcaatatgtcgctcgaacattcatccagccgacacaagaattaagagaacaaggtgtccgtatgaaactatcggcagttcgtggcgtggtcaaaggaaaaaaagtcattttagtagatgattcgattgttcgcgggaccactattcggcgcattattcatttattaaaagaagcagaagcgcaagaagttcatgtcagaattgcttcaccaccattaaaatatccgtgtttttatggcattgatatacagacgcgggacgaactaattgcggcaaactattcaattgaagaaatcaaagagcagattggcgcagattcgctggcttttttgagtgaagcagggctgattgatgggattcaattaaattatgatgctccttattctgggctgtgtatggcttactttaatggagactatccaacgcctttgtatgattatgaagaacaatatcaagcatccttgaaaaaagaaactaggaggaattga

SEQ ID NO: 30298 - protein, 479 aa, Enterococcus faecalis V583
MSYEAKSLNEECGIFGIWGHPDAAQVTYFGLHSLQHRGQEGAGIVANNSGKLDGHRDLGLLAEVFQKQEQLNALEGTAAIGHVRYATAGTGSVDNIQPFLFKFYDSQIGLAHNGNLTNAKRLRKQLEREGAIFHSNSDTEILMHLIRKSTAASFLDKLKESLNLVKGGFAYLLLTETMMIAALDPNGFRPLSIGQMNNGAYVVASETCALETVGARFIQDVAPGEVVIISDEGLKIEVFTTEVQPAICAMEYIYFARPDSNIAGVNVHTARKRMGKNLAIESPVAADMVIGVPNSSLSAASGYAEEAQIPYELGLVKNQYVARTFIQPTQELREQGVRMKLSAVRGVVKGKKVILVDDSIVRGTTIRRIIHLLKEAEAQEVHVRIASPPLKYPCFYGIDIQTRDELIAANYSIEEIKEQIGADSLAFLSEAGLIDGIQLNYDAPYSGLCMAYFNGDYPTPLYDYEEQYQASLKKETRRN

SEQ ID NO: 30299 - DNA, 1521 bp, Coxiella burnetii RSA 493
  CDS (1)..(1521): transl_table=11
atgtgcggaatcgtcggtattattgccaatggcatcgttaatcaggccctttacgacgccttaaccatattgcaacaccgcggacaagatgcggctgggattatgacaagcgatggtgagcgtgtttttttgcgaaaatcgaatgggttagttcgcgatgcgattcgcgagccacacatgctgcatttagtgggtaatatgggcattggccatgttcgttatcccacggcgggatcagaaagtcctgcagaatcgcaaccgttttatgtcaattcgccttacggtttgagtctggtgcacaatggtaatttagttaatgttaaagaattaactaacgatttgattcgtagcgacttgcgccatttaaacaccacttctgattcggaaattttattgaatgtcgttgcacatgaattacagcattatggtggcgttcaactctcgcctaagcaattgtttaaagccatgacaaaagtgtatgaaagggtggaaggcgcgtttgcggctgtaatgattattacgggttatggtgttatcggatttcgcgaccctcacgctatccgtcctttagtttatgggcgccgcgataacggtaacgggccggaatatatgttggcttcggaaagcattgctttagatgcactgggttttgaactcattgacgatgtgggtcccggagaagttatttatttcgatcgtgaggggagcgttcatcgagaacgatgtgccaaacaagtgagccattctccttgcatttttgaatatatttatttagcgcgtcctgattctattattgatggtgtcccggtttaccaagcacgttctggtatgggtgaaagtctagcgcaaaaaatattacgggagcgtcccgaccacggtatcgatgtcgtgattcctatccccgacacgagtcggaacgcggcgcaggcattggcgcgcgccttagatgttccttattcagaaggttttgtaaaaaaccgttacatcggacggacatttattatgccggggcaagcgaagcggcgaagttctgttcggttaaaattaaatgccattaaagctgaatttgccaataaaaccgttttattagtggatgattccattgtgcgaggcaccacttctaaagaaattatccaaatggcgcgcgacgtgggcgctaaaaaggtgtatttcgcttctgcggctcctgaagtgcgctaccccaatgtctatggaattgatatgcctaccgctgatgaattaattgctcacaataaatcgactgaagaggtgatgcactcaattggcgctgattggctagtctatcaaaatttggaagatgtctatcaagcgataaacgacgctatgggctcgcgtaagccaaaaattgaacgatttgaagattctgtttttaccggagattatattgctggtaatattacaaaagaatatttggccgagttggccgaatcccgtaacgatgccgctaaaatgaaaaagcgggcattaaacgaacaggaagaggcgaacggattgttatga

SEQ ID NO: 30300 - protein, 506 aa, Coxiella burnetii RSA 493
MCGIVGIIANGIVNQALYDALTILQHRGQDAAGIMTSDGERVFLRKSNGLVRDAIREPHMLHLVGNMGIGHVRYPTAGSESPAESQPFYVNSPYGLSLVHNGNLVNVKELTNDLIRSDLRHLNTTSDSEILLNVVAHELQHYGGVQLSPKQLFKAMTKVYERVEGAFAAVMIITGYGVIGFRDPHAIRPLVYGRRDNGNGPEYMLASESIALDALGFELIDDVGPGEVIYFDREGSVHRERCAKQVSHSPCIFEYIYLARPDSIIDGVPVYQARSGMGESLAQKILRERPDHGIDVVIPIPDTSRNAAQALARALDVPYSEGFVKNRYIGRTFIMPGQAKRRSSVRLKLNAIKAEFANKTVLLVDDSIVRGTTSKEIIQMARDVGAKKVYFASAAPEVRYPNVYGIDMPTADELIAHNKSTEEVMHSIGADWLVYQNLEDVYQAINDAMGSRKPKIERFEDSVFTGDYIAGNITKEYLAELAESRNDAAKMKKRALNEQEEANGLL

SEQ ID NO: 30301 - DNA, 1581 bp, Streptomyces avermitilis MA-4680
  CDS (1)..(1581): transl_table=11
ttgcagaacgcaccggattcggaacggtgcacgatctcgcctacactcggtggcgtgccacgtggtgacggtcgactcaatcatgatctgctccccggtgagaaaggcccccaggacgcttgtggcgtcttcggtgtctgggctccgggcgaagaggtcgccaagctcacttacttcgggctctacgccctccagcatcggggccaggaatccgcgggtatcgcggtcagcaatggctcccagatcctcgtcttcaaggacatgggtctcgtgtcccaggtcttcgacgagacctctctcggttcgctccagggtcatatcgcggtcggtcacgcccgctactcgaccaccggtgcctccgtctgggagaacgcccagccgacgttccgcgccaccgcgcacggttcgatcgcgctcgggcacaacggcaacctggtcaacacggcgcagctcgccgagatggtcgccgacctccccaaggagaacgggcgctccccgaaggtcgcggccaccaacgacacggacctcgtcaccgcgctcctcgcgggccagcgggacgacgagggccagccgctgaccatcgaggaggcggccgccaaggtcctcccgcaggtccagggcgccttcagcctcgtcttcatgaacgagcacaccctctacgcggcccgcgacccgcagggcatccgcccgttggtcctcggccgcctcgagcgcggctgggtcatcgcctcggagtccgccgccctcgacatctgcggcgccagctacgtccgcgagatcgagccgggcgagttcgtcgccatcgacgagaacggccttcgcagctcccgattcgcggaagcgaagcccaagggctgtgtcttcgagtacgtgtacctggcccgtcccgacacggacatcgccggccgcaacgtgtacctcagccgggtcgagatgggccgtcgcctcgccaaggaggcgcccgccgaggccgacctggtgatagcgacgccggagtccggcacccccgccgcgatcggttacgcggaggcctccggcattccgttcggcgccggcctggtgaagaacgcgtatgtcggccggaccttcatccagccctcgcagacgatccgccagctcggcatccgcctcaagctgaacccgctcaaggaagtcatcaagggcaagcgcctggtcgtcgtcgacgactcgatcgtgcgcggcaacacccagcgcgcgctggtgcggatgctccgcgaagcgggtgcggcggaagtccacatccggatttcctcgccccccgtgaagtggccctgcttcttcggcatcgacttcgccacccgtgccgagctgatcgccaacggcatgacgatcgaggagatcggtacctcgctgggcgccgactccctctcgtacatctccatcgacggcatgatcgaggcgaccacgatcgccaagcccaacctctgccgggcctgcttcgacggcgagtacccgatggatctccccgaccccgaactgctgggcaagcagcttctggagaccgagctggcggcgggtcccgccgccacggccgcggccgacgcgatccgtcgcccctga

SEQ ID NO: 30302 - protein, 526 aa, Streptomyces avermitilis MA-4680
MQNAPDSERCTISPTLGGVPRGDGRLNHDLLPGEKGPQDACGVFGVWAPGEEVAKLTYFGLYALQHRGQESAGIAVSNGSQILVFKDMGLVSQVFDETSLGSLQGHIAVGHARYSTTGASVWENAQPTFRATAHGSIALGHNGNLVNTAQLAEMVADLPKENGRSPKVAATNDTDLVTALLAGQRDDEGQPLTIEEAAAKVLPQVQGAFSLVFMNEHTLYAARDPQGIRPLVLGRLERGWVIASESAALDICGASYVREIEPGEFVAIDENGLRSSRFAEAKPKGCVFEYVYLARPDTDIAGRNVYLSRVEMGRRLAKEAPAEADLVIATPESGTPAAIGYAEASGIPFGAGLVKNAYVGRTFIQPSQTIRQLGIRLKLNPLKEVIKGKRLVVVDDSIVRGNTQRALVRMLREAGAAEVHIRISSPPVKWPCFFGIDFATRAELIANGMTIEEIGTSLGADSLSYISIDGMIEATTIAKPNLCRACFDGEYPMDLPDPELLGKQLLETELAAGPAATAAADAIRRP

SEQ ID NO: 30303 - DNA, 1416 bp, Bacillus cereus ATCC 14579
  CDS (1)..(1416): transl_table=11
atgcttgctgaaataaaggggttaaacgaagaatgtggcgttttcggaatttgggggcatgaaaatgcagcacaagtttcatactacggattgcacagtttacagcaccgtgggcaagaaggcgcaggcattgtcgtaaataatggggaaaaaatcgtcggtcacaaggggttaggtttaatatcagaagtgttttcaagaggtgagctagaaggattaaatggaaaatcagcgatcggacatgtacgatatgcaacagctggtggaagtgaagttgctaacgttcaaccattgttgttccgtttttccgatcatagtatggcgttagctcataacggaaatttaattaacgcaaaaatgcttcgtcgtgaattagaagcagagggcagtatttttcaaactagttcagatacagaagtacttttacatcttattaaacgtagtacgaaagattctttaattgaaagtgtaaaagaagctttaaacaaagtgaaaggtgcgtttgcgtatcttttactaactggaaatgaaatgatcgttgcattagatccgaatgggttccgtccgctttcaattggaaagatgggggatgcttacgttgtagcatctgaaacatgtgcttttgatgtagtaggtgcaacatacattcgtgatgtagaaccgggtgaattacttatcattaatgatgaaggaattcacgtagatcgtttcacaaacgatgtagaacatgcaatttgtagtatggaatacatttactttgcacgaccagattctaatattgcaggcgttaacgttcatgcagcacgtaagaatatggggaaacgtttagcggcagaagctcctattgaagcagatgttgttactggtgtaccagactctagtatttcagctgcgattggctatgcggaggcgacaggtattccatatgagttaggattaattaaaaatcgttacgttggacgtacgtttattcaaccttctcaggaactgcgagagcaaggggttaagatgaaactttccgcagtaagaggtgtagttgaagggaaacgagttgttatgattgatgactctatcgtaagaggaacgacaagtaaacgaattgttcgtatgcttcgtgaagctggagcgacagaagttcacgtaagaattgcttcaccacctctgaaatatccatgtttctatggcattgatattcaaacgagaaaagaattaattgcagcaaatcatacagtagaagaaatccgtgaaatgatcggagcagattctttaacatttttaagcgaagatggattagtagatgcaattggacgtccatatgaagggaaatatggtggcctatgcatggcttactttaatggggactatccaacagctctttatgattatgagcaagagcttttagaaagtatgaaataa

SEQ ID NO: 30304 - protein, 471 aa, Bacillus cereus ATCC 14579
MLAEIKGLNEECGVFGIWGHENAAQVSYYGLHSLQHRGQEGAGIVVNNGEKIVGHKGLGLISEVFSRGELEGLNGKSAIGHVRYATAGGSEVANVQPLLFRFSDHSMALAHNGNLINAKMLRRELEAEGSIFQTSSDTEVLLHLIKRSTKDSLIESVKEALNKVKGAFAYLLLTGNEMIVALDPNGFRPLSIGKMGDAYVVASETCAFDVVGATYIRDVEPGELLIINDEGIHVDRFTNDVEHAICSMEYIYFARPDSNIAGVNVHAARKNMGKRLAAEAPIEADVVTGVPDSSISAAIGYAEATGIPYELGLIKNRYVGRTFIQPSQELREQGVKMKLSAVRGVVEGKRVVMIDDSIVRGTTSKRIVRMLREAGATEVHVRIASPPLKYPCFYGIDIQTRKELIAANHTVEEIREMIGADSLTFLSEDGLVDAIGRPYEGKYGGLCMAYFNGDYPTALYDYEQELLESMK

SEQ ID NO: 30305 - DNA, 1518 bp, Nitrosomonas europaea ATCC 19718
  CDS (1)..(1518): transl_table=11
atgtgtggaattttaggcgtggtagcccggtcacccgccaatcagttgctctatgatggtctgttgatgctgcagcaccgtggtcaggatgctgccggtatcgttactgcacaaggtaacagctttcacatgcataaaggtctcggtctggtacgggatgttttccgtacccgggatatgcgtgcgctgccggggtacatgggaatcggccatgtacgctaccccacggcgggatcttcaacctctcctgctgaagcacagcctttttacgtaaattccccgtttggtatcgtgctggcccataacggtaatctgaccaatgcggaaaccctcaatcaggaactgtttcttgcagaccggcgtcacgtcaatacgcattccgattcagaagtattgctgaatgtactggcgcacgagttgcaggaacgtgccgtcggttatcagcttgacctggctgagattttctcggcagtagccggtgtacacgaacgctgtcagggtgcctatgccgttattgccatgattgcaggctatggtctgctcgcattccgcgatccgtacggaatcaggccgctcgtgttcggttcagtagaaacagatgcgggtaccgagtacatggtggcttccgagagtgttgcgttggatacgctgggttttcgtctcatccgcgatgttgctcccggggaagccatttttatcgatatggaagggcatttctacagtcatcagtgcgctgctctacccagcctgaatccctgtatttttgagtacgtttatctcgcccggcctgattcgatgctggatggaatatcggtttatgaaacccgcctcaacatgggtatcaatctggcggacaagatcagtacttccatgcaacatctcgatatcgatgtcgtcattccgattccggaatccagccgtccgagtgccatgcagcttgccaaccgtcttgggatcagtttcagggaagggttcgtcaagaatcgttatgtgggcagaacctttattatgccaggccagcaacaacgccggaaatcggtcaggcagaagctgaatgcgatcgaaatagaatttcgcggcaagaatatcctgctggtcgatgattccatcgtgcgtggaaccaccagtcgggaaatcgtccagatggcgcgtgaggctggtgccaacaaagtttactttgcttcggccgcacccccggtacgttttcctaatgtttacggtatcgatatgccaactcgtcaggaactgattgcaacagatcgaaccgatgaggaaatatgtcgtgaaatcggtgcggattatctggtttatcagaatctggatgcgctcaggcaggcaatcactcagatcgatccacagatcaggcattttgaaacatcctgtttcgatggacgatacatcgcaggcaatatcactcaggaatatctctgcagaatcgagtcacaacgcaacaatcccggcctgtctcagggtgagcgtactactcagcttgatttagctctgttatcaacggattaa

SEQ ID NO: 30306 - protein, 505 aa, Nitrosomonas europaea ATCC 19718
MCGILGVVARSPANQLLYDGLLMLQHRGQDAAGIVTAQGNSFHMHKGLGLVRDVFRTRDMRALPGYMGIGHVRYPTAGSSTSPAEAQPFYVNSPFGIVLAHNGNLTNAETLNQELFLADRRHVNTHSDSEVLLNVLAHELQERAVGYQLDLAEIFSAVAGVHERCQGAYAVIAMIAGYGLLAFRDPYGIRPLVFGSVETDAGTEYMVASESVALDTLGFRLIRDVAPGEAIFIDMEGHFYSHQCAALPSLNPCIFEYVYLARPDSMLDGISVYETRLNMGINLADKISTSMQHLDIDVVIPIPESSRPSAMQLANRLGISFREGFVKNRYVGRTFIMPGQQQRRKSVRQKLNAIEIEFRGKNILLVDDSIVRGTTSREIVQMAREAGANKVYFASAAPPVRFPNVYGIDMPTRQELIATDRTDEEICREIGADYLVYQNLDALRQAITQIDPQIRHFETSCFDGRYIAGNITQEYLCRIESQRNNPGLSQGERTTQLDLALLSTD

SEQ ID NO: 30307 - DNA, 1425 bp, Helicobacter hepaticus ATCC 51449
  CDS (1)..(1425): transl_table=11
atggaaagctggaacgaagagtgcgccattgtgggcgtatataatgttgataatgcagcactcttaagctattattcactctttgcaatgcagcatagggggcaggaagcaagtgggatttccgcaagtaatggcacaaaaatcacaactatcaaaaatactggtttagtaactaaaatttttacacaaaagcgacttgataaattgcaaggtcgctcaagtattggacacaatcgctattcaactgcaggtgaagattctataaatgacacacaacctatttttgcacgatatgatttaggcgaaatggcaatcgcacataatgggaatctcacaaatgccaaagaagtgcgcgagatgcttattaaagagggaacaatattccaaagctatcttgatactgaaaatctcattcatctgattgcacgaagtaaaaaaacatcgcttactgatagaatcattgatgctttaagctacattgatggagcgtattgctttgtatttctttcacggagcaaaatgtttgctattcgtgataggtatggattgcgcccacttagcttaggcaaaatacaaaacgaagacggaagcacaggctatgttgtagcgagtgaaagttgtgcatttgaccttataggtgcggaatttgtccgagatgtcaaagcaggtgagatgattatttttgatggagcgtatgcctttcaagattctcaacccaaaagtattcaagtctttgaaccaaaaccgcatttttgcgtatttgaatacatatattttgcacgtcctgatagcaatgtgtttggacataatgtctatcaagcacgcaaacaaatgggtatagagcttgctaaagaacatcaaattcaagcagatatggtaattcctgtgccagattctggtgtggctgcagctattggttatagtaagcaaagcggaattgattttgagctaggatttatccgcaatcactatgtaggaaggacatttattgagccaacgcagcaagagagagagcttaaagttcgccttaaactcaaccctatcagagaacttatagctaataaagatattattgtcattgatgattctgtggttagaggcacgacaagtaagcaaattattaaaatcttgcgtcaagcgggggcaagaaaaattcatctacttattagctctccgcctacgatttcgccgtgcttttatggtatagatacgcccaataaggagcaactcatttgtgctaataaaagtattgaagaagtgtgtaagcatatcggtgcagattctctaggttttctctcccttagcggtttgaccaaaagtataggcgaaaacaattctttatgcaaagcgtgttttgatggacattatattgatgattataccacaggtgcagcaatccctgccgctttaaaatcctctcattaa

SEQ ID NO: 30308 - protein, 474 aa, Helicobacter hepaticus ATCC 51449
MESWNEECAIVGVYNVDNAALLSYYSLFAMQHRGQEASGISASNGTKITTIKNTGLVTKIFTQKRLDKLQGRSSIGHNRYSTAGEDSINDTQPIFARYDLGEMAIAHNGNLTNAKEVREMLIKEGTIFQSYLDTENLIHLIARSKKTSLTDRIIDALSYIDGAYCFVFLSRSKMFAIRDRYGLRPLSLGKIQNEDGSTGYVVASESCAFDLIGAEFVRDVKAGEMIIFDGAYAFQDSQPKSIQVFEPKPHFCVFEYIYFARPDSNVFGHNVYQARKQMGIELAKEHQIQADMVIPVPDSGVAAAIGYSKQSGIDFELGFIRNHYVGRTFIEPTQQERELKVRLKLNPIRELIANKDIIVIDDSVVRGTTSKQIIKILRQAGARKIHLLISSPPTISPCFYGIDTPNKEQLICANKSIEEVCKHIGADSLGFLSLSGLTKSIGENNSLCKACFDGHYIDDYTTGAAIPAALKSSH

SEQ ID NO: 30309 - DNA, 1614 bp, Rhodopirellula baltica SH 1
  CDS (1)..(1614): transl_table=11
atggctgaattgaatcacgaatgcggcgttgccgcgatctaccacctttctggtcgcgggcgcagcccggtgtgcacggacgatggaccgcgacaaatttcgcgtctgttgccccgcatgttgctcgacatccaaaatcgcgggcagcttgccgctgggatgtccacgttcgaccccgatcgtcccgcgctgctgaaaacgcggcgtgatgtcggaacggtgacggaagtcttccgcctgaatcatcgggccaaagccgaatcgttgatgaaatcgctggccggtcgcgccgccatcggacacgttcgctacgccacctgtggcgccgatgaccggaactacgctcaacctttcgagcgacggcatatccataaacgcaaatggttcagcttctgcttcaatggccaactggccaattacacccttttgaagcagcggttgctcgccgatggcgatcaccacttggcactcgacaccgacaccgaaatcattctccacgagatcgctcgattgctatcgcagtcgcaggaacgagtcgactggatcgacgtcctgaaacaggtcacggccggtttcgacggtgcctactcaatggcattgttgaccgcagaaggtgagatgttggtcgctcgcgacccattgggcatcaaaccgatgtgctacatccacgaaggcccgctgtttgcctgtgccagcgaaagcgtcgctcttttgaatctcgggttcgaaccagatcaaattcgatcgttgcctcctggtcatgcgatcttgattgatcctgacgaaggtttccggatggaacgattcgcggaacccgaaacgcccaaacactgcttctttgaatggatctatttcgccaacgtcgccagcacgctggacgaccgaagcgtctatctttcgcgaaccaacttgggtcgtgaactggccaccgcggaacgtgagttcggtcgagttccgttggacgatccagacacgatcattgtgccggttcctgacaccagcaaagctgccgcagactcgatggcctatgaattatcgatcccatgccgcgaaggcttgatccgcaaccgatatgccgggcggacattcatcgaaggcggtcgcgctcgcaaagcaaaggcggcggcaaagtacacgccgcttcgcgaagtcttgcaagggaaacgagtcatcctggtggaggactccatcgttcgaagcacgaccatgaacgcgttgctggatcgtattcgtgacgttggtggcgcgaaggaaatccacgttcgcgtggcttgcccgccgatcgttgctccgtgcttctacggaatcgacatgagcacgatcgatcaattgatcgcgccgaagtacttctcgttgaccggtgaactggacgaagaatcgcagcaacggatggccgacgatctcggtgctgattcgctgcaatacttgccagtatccgcaatcgcacgagccatcaacttgccggaggaacacctctgtcaggcttgcgtgacgggcaaatacccaacgcctatcggccagcacctgtatcagattgcatgcgacaatcgtggggcgagagtcaacaatcagcgaacctacgagcaactcgctgcggctgttgccggacagtga

SEQ ID NO: 30310 - protein, 537 aa, Rhodopirellula baltica SH 1
MAELNHECGVAAIYHLSGRGRSPVCTDDGPRQISRLLPRMLLDIQNRGQLAAGMSTFDPDRPALLKTRRDVGTVTEVFRLNHRAKAESLMKSLAGRAAIGHVRYATCGADDRNYAQPFERRHIHKRKWFSFCFNGQLANYTLLKQRLLADGDHHLALDTDTEIILHEIARLLSQSQERVDWIDVLKQVTAGFDGAYSMALLTAEGEMLVARDPLGIKPMCYIHEGPLFACASESVALLNLGFEPDQIRSLPPGHAILIDPDEGFRMERFAEPETPKHCFFEWIYFANVASTLDDRSVYLSRTNLGRELATAEREFGRVPLDDPDTIIVPVPDTSKAAADSMAYELSIPCREGLIRNRYAGRTFIEGGRARKAKAAAKYTPLREVLQGKRVILVEDSIVRSTTMNALLDRIRDVGGAKEIHVRVACPPIVAPCFYGIDMSTIDQLIAPKYFSLTGELDEESQQRMADDLGADSLQYLPVSAIARAINLPEEHLCQACVTGKYPTPIGQHLYQIACDNRGARVNNQRTYEQLAAAVAGQ

SEQ ID NO: 30311 - DNA, 1413 bp, Wigglesworthia glossinidia endosymbiont of Glossina brevipalpis
  CDS (1)..(1413): transl_table=11
atgtgcggtgttattggaatttctggggttaattcaatttctcaatctatttatgatgctttaacagttttgcagcatcgtgggcaagattccgctggaattacaacgatagataagtttaattgttttcgtgtgcataaatctagtggattagtgaaagatgtttttaaaccaaatgatataaaatatttaaaaggtaaaatgggaattggtcatgtacgttatcccactaccagagaaaaaaatatatatgaagcccaaccactatatgtaaactctccttttggaattactttagctcacaatggtaatataataaatacaaaatttttaaaaaaacaattgttcgaaactcagagaaggcatataaatacaaattcagattctgaaattttattaaatatttttgcatctgaattaaatcaattccataattatcctttgcattatgaaaatattttttcagcaataaaaaatacacataaaagagtaaaaggagcatattcttgtgtaggaatgattataggacatgggttatttgcatttagagacccttatggaattagaccattagtattaggggaacgtactctttcatgcaaaaaagagtacataatagcatctgaaacagttgctttagatatattaggatttaaacatttacgtgatgttgctccaggagagggggtgttattaactaacagtggaaagcttttgaccaagcagtgttctttaacttcaaactattgcccttgtttatttgaatatatttatttttctagaccagattctattatagacaagatatctgtttacacagctagaatgaaaatgggacaaattttaggaaaaaaaatatctagagaatggaaaaatttgaatattgatgctgtaattcctataccagaaacatcttgtgatgtagcattagaaatagctcgaatattaaaaataccatataggcaaggatttgtgaaaaatagatatgtcggaagaacatttataatgtctaatccaagcattagaaaaaaatcaataagatataaatttaatgtaaataaagctgaattttacaaaaaacaagtactcttggtagatgattcgattgtaagaggaaatacatctaagcaaattgtagaaatggcaagagatgcaggtgcaaatagcgtatatttagcatcagcttctccggaaattagatttcccaacatatatggaattgatataccagattcagaagaactaatagcacatcaaaaatcattaaatgatataagaatatcgattaaagctgatgctttaatttttcaaaatcttaatgatttagaaaaatcccttaaaaaatttaatccaaaaataaaaaattttgaatcgtccatatttaatggaatatatccaacttctttaatataa

SEQ ID NO: 30312 - protein, 470 aa, Wigglesworthia glossinidia endosymbiont of Glossina brevipalpis
MCGVIGISGVNSISQSIYDALTVLQHRGQDSAGITTIDKFNCFRVHKSSGLVKDVFKPNDIKYLKGKMGIGHVRYPTTREKNIYEAQPLYVNSPFGITLAHNGNIINTKFLKKQLFETQRRHINTNSDSEILLNIFASELNQFHNYPLHYENIFSAIKNTHKRVKGAYSCVGMIIGHGLFAFRDPYGIRPLVLGERTLSCKKEYIIASETVALDILGFKHLRDVAPGEGVLLTNSGKLLTKQCSLTSNYCPCLFEYIYFSRPDSIIDKISVYTARMKMGQILGKKISREWKNLNIDAVIPIPETSCDVALEIARILKIPYRQGFVKNRYVGRTFIMSNPSIRKKSIRYKFNVNKAEFYKKQVLLVDDSIVRGNTSKQIVEMARDAGANSVYLASASPEIRFPNIYGIDIPDSEELIAHQKSLNDIRISIKADALIFQNLNDLEKSLKKFNPKIKNFESSIFNGIYPTSLI

SEQ ID NO: 30313 - DNA, 1458 bp, Prochlorococcus marinus subsp. marinus str. CCMP1375
  CDS (1)..(1458): transl_table=11
atgtgtggaatagtaggaatagtttctaataatcaaattaatcaaaagatttatgatagtttgcttttattacagcatagagggcaggactcaacaggaatagcaacgatggaaggaagtgtttttcacttacataaatctaagggtcaagttaaagaagcatatagaacaagagacatgagaattctgaccggcaatattggaattggtcatgtaaggtatgctacttcaggagaggcacatcgagaagatgaagcacaacctttttatgtaaatgcaccttatggaattattcttgtacacaatggaaatttgacaaatacgcgtgaattagaaaaagaactttttagtattgatagaagacatacgaattcctctagtgatacagaaatgcttttaaatgtattggcaactgaaattcagtctgaaaattatggaagttcattatctcccgaacatattttttctgctatatcatcattacataaaagagtagaaggtacatattcagcaattgcaatgattgctggttatggattacttgcttttagagatccatatggaataagacctttagtcttaggtaaaagagttttagataatggtaaaaccgaatggattgttgcaagtgaatctttggtattagaaaataatgattttgatgtagtacgagatgttgtacctggtgaagctatttttatttctaatgaaggagaattttattcaaaacagtgtgctgataatccacaattgtttccttgttcttttgaatatgtttatttggctcgaccagattctgtaatgaatggtatttctgtatatgaagctagattaaggatgggagattatcttgccaagacaattcaggaacaaattacttcgggcgaaattgatgtagttatgccaattcctgattcttctagaccatctgcgatgcaggttgcaagacaattaggtcttgagtatagagaaggattttttaagaatcgttatgtaggaaggacttttattatgcctggtcaggcacaaagaaagaaatctgtacgtcaaaaacttaatgcgatgagtagtgagtttaaaggaaaaaatgtattattagtcgatgattctatagttcgtggaactacatctcgagagattgtacaaatggcaaaattagcaggagctaataaagtaacctttacttctgcggcgcctccgatacgttttcctcatgtttatggtattaatatgccatcaaagatggagttaattgctcatgataaatctattgatcaaatacaagaaactttattggcagatggtttggtatatcaaaaaatatctgatttagagcaatctattttaaaaggttctcaagtgaaaaatcttgacctttcttgctttaatggtgaatatgtaactggaaaggttactgaagaatatttagcttgggtcggatctaaatattcttcttaa

SEQ ID NO: 30314 - protein, 485 aa, Prochlorococcus marinus subsp. marinus str. CCMP1375
MCGIVGIVSNNQINQKIYDSLLLLQHRGQDSTGIATMEGSVFHLHKSKGQVKEAYRTRDMRILTGNIGIGHVRYATSGEAHREDEAQPFYVNAPYGIILVHNGNLTNTRELEKELFSIDRRHTNSSSDTEMLLNVLATEIQSENYGSSLSPEHIFSAISSLHKRVEGTYSAIAMIAGYGLLAFRDPYGIRPLVLGKRVLDNGKTEWIVASESLVLENNDFDVVRDVVPGEAIFISNEGEFYSKQCADNPQLFPCSFEYVYLARPDSVMNGISVYEARLRMGDYLAKTIQEQITSGEIDVVMPIPDSSRPSAMQVARQLGLEYREGFFKNRYVGRTFIMPGQAQRKKSVRQKLNAMSSEFKGKNVLLVDDSIVRGTTSREIVQMAKLAGANKVTFTSAAPPIRFPHVYGINMPSKMELIAHDKSIDQIQETLLADGLVYQKISDLEQSILKGSQVKNLDLSCFNGEYVTGKVTEEYLAWVGSKYSS

SEQ ID NO: 30315 - DNA, 1521 bp, Bordetella parapertussis 12822
  CDS (1)..(1521): transl_table=11
atgtgtggaatcgtcggtgtcattgggcgcgggccggtcaaccagctgctctatgacagcttgctgctgctgcaacaccgggggcaggacgcggcgggcatcgccacgctgcagggcaaccacttcaacatgtacaaggcgcacggcctggtgcgcgatgtgttccgtacccgcaacatgcgcgcgctgccgggcaccagcggcgtgggccaggtgcgctatcccaccgccggctccagcgccagcgaggaagaggcgcagccgttctacgtcaatgcgccgttcggcatcatgttcgcccacaacggcaacctgaccaactggcgcgagctgcgcgagtcgctctaccgcgccgaccgccgccacatcaataccaattccgattccgaagtgctgctcaatgtgctggcgcacgagctgcaatcggccgccagcggcgtgtcgctcgacgatgacacgatctttcgcgctgtctccgcggtgcaccagcgcgtcaagggcgcctacgccgtggtggcgcagatctcgggctacggcatgctggcgtttcgcgatccccacggcatccggccgctgtgcatcggccgccaggagaccgaggaaggcgtggaatggatggccgcctcggaatccgtggcgctagaaggcagcggttttgccttcgtgcgcgacgtcgagcccggcgaggcgatattcgtcgacctcgacggccgcatgaccagccgccagtgcgccgacaatgcgcaactggtgccgtgtatcttcgagtacgtgtactttgcccgccccgattcgctgatcgacggcgtctcggtgtacgacgcgcgcctgcgcatgggcgaatacctggccgacaaggtcgcgcgcagcatgcgcctgggcgatatcgacgtggtgatgccgattcccgactcgtcgcgtccggccgccatgcagctggcgcaccggctggggctggactatcgcgaaggcctgatcaagaaccgctacgtgggccgtacgttcatcatgccgggccaggcggtgcgccgcaaatcggtgcgccagaaactgaacgccatcggcatggaattcaagggcaagaacgtgctgctggtcgacgattccatcgtgcgcggcaccaccagccgcgagatcgtcgacatggcgcgcgcggccggcgccaacaaggtgtatttcgcctccgcggcgcctccggtgcgattccccaacgtgtacggcatcgacatgccgacccagaaggaactgatcgccaccggccgcaccgatgacgaaatcgcccgcaccatcggcgccgacgcgctgatctaccaggacctgcaggacatgcagcaggcggtgcgtgacatcaatccgcgcctgagccgcttcgaggcatcgtgtttcgacggcgagtacgtgaccggcgacatcaccgccgaatacctggcccgcctgggccagtcgcgcgacagcagcgccggcgacgaagaggccggcggcctgcagttcaacatgggctacgcggccaacgacgcctga

SEQ ID NO: 30316 - protein, 506 aa, Bordetella parapertussis 12822
MCGIVGVIGRGPVNQLLYDSLLLLQHRGQDAAGIATLQGNHFNMYKAHGLVRDVFRTRNMRALPGTSGVGQVRYPTAGSSASEEEAQPFYVNAPFGIMFAHNGNLTNWRELRESLYRADRRHINTNSDSEVLLNVLAHELQSAASGVSLDDDTIFRAVSAVHQRVKGAYAVVAQISGYGMLAFRDPHGIRPLCIGRQETEEGVEWMAASESVALEGSGFAFVRDVEPGEAIFVDLDGRMTSRQCADNAQLVPCIFEYVYFARPDSLIDGVSVYDARLRMGEYLADKVARSMRLGDIDVVMPIPDSSRPAAMQLAHRLGLDYREGLIKNRYVGRTFIMPGQAVRRKSVRQKLNAIGMEFKGKNVLLVDDSIVRGTTSREIVDMARAAGANKVYFASAAPPVRFPNVYGIDMPTQKELIATGRTDDEIARTIGADALIYQDLQDMQQAVRDINPRLSRFEASCFDGEYVTGDITAEYLARLGQSRDSSAGDEEAGGLQFNMGYAANDA

SEQ ID NO: 30317 - DNA, 1521 bp, Bordetella bronchiseptica RB50
  CDS (1)..(1521): transl_table=11
atgtgtggaatcgtcggggtcattgggcgcgggccggtcaaccagctgctctatgacagcttgctgctgctgcaacaccgggggcaggacgcggcgggcatcgccacgctgcagggcaaccacttcaacatgtacaaggcgcacggcctggtgcgcgatgtgttccgtacccgcaacatgcgcgcgctgccgggcaccagcggcgtgggccaggtgcgctatcccaccgccggctccagcgccagcgaggaagaggcgcagccgttctacgtcaatgcgccgttcggcatcatgttcgcccacaacggcaacctgaccaactggcgcgagctgcgcgagtcgctctaccgcgtcgaccgccgccacatcaataccaattccgattccgaagtgctgctcaatgtgctggcgcacgagctgcaatcggccgccagcggcgtgtcgctcgacgatgacacgatctttcgcgccgtctccgcggtgcaccagcgcgtcaagggcgcctacgccgtggtggcgcagatctcgggctacggcatgctggcgtttcgcgatccccacggcatccggccgctgtgcatcggccgccaggagaccgaggaaggcgtggaatggatggccgcctcggaatccgtggcgctggaaggcagcggttttgccttcgtgcgcgacgtcgagcccggcgaggcgatattcgtcgacctcgacggccgcatgaccagccgccagtgcgccgacaatgcgcaactggtgccgtgtatcttcgagtacgtgtactttgcccgccccgattcgctgatcgacggcgtctcggtgtacgacgcgcgcctgcgcatgggcgaatacctggccgacaaggtcgcgcgcagcatgcgcctgggcgatatcgacgtggtgatgccgattcccgactcgtcgcgcccggccgccatgcagctggcgcaccggctggggctggactatcgcgaaggcctgatcaagaaccgctacgtgggccgtacgttcatcatgccgggccaggcggtgcgccgcaaatcggtgcgccagaaactgaacgccatcggcatggaattcaagggcaagaacgtgctgctggtcgacgattccatcgtgcgcggcaccaccagccgcgagatcgtcgacatggcgcgcgcggccggcgccaacaaggtgtatttcgcctccgcggcgcctccggtgcggttccccaacgtgtacggcatcgacatgccgacccagaaggaactgatcgccaccggccgcaccgatgacgaaatcgcccgcaccatcggcgccgacgcgctgatctaccaggacctgcaggacatgcagcaggcggtgcgtgacatcaatccgcgcctgagccgcttcgaggcatcgtgtttcgacggcgagtacgtgaccggcgacatcaccgccgaatacctggcccgcctgggccagtcgcgcgacagcagcgccggcgacgaagaggccggcggcctgcagttcaacatgggctacgcggccaacgacgcctga

SEQ ID NO: 30318 - protein, 506 aa, Bordetella bronchiseptica RB50
MCGIVGVIGRGPVNQLLYDSLLLLQHRGQDAAGIATLQGNHFNMYKAHGLVRDVFRTRNMRALPGTSGVGQVRYPTAGSSASEEEAQPFYVNAPFGIMFAHNGNLTNWRELRESLYRVDRRHINTNSDSEVLLNVLAHELQSAASGVSLDDDTIFRAVSAVHQRVKGAYAVVAQISGYGMLAFRDPHGIRPLCIGRQETEEGVEWMAASESVALEGSGFAFVRDVEPGEAIFVDLDGRMTSRQCADNAQLVPCIFEYVYFARPDSLIDGVSVYDARLRMGEYLADKVARSMRLGDIDVVMPIPDSSRPAAMQLAHRLGLDYREGLIKNRYVGRTFIMPGQAVRRKSVRQKLNAIGMEFKGKNVLLVDDSIVRGTTSREIVDMARAAGANKVYFASAAPPVRFPNVYGIDMPTQKELIATGRTDDEIARTIGADALIYQDLQDMQQAVRDINPRLSRFEASCFDGEYVTGDITAEYLARLGQSRDSSAGDEEAGGLQFNMGYAANDA

SEQ ID NO: 30319 - DNA, 1461 bp, Prochlorococcus marinus subsp. pastoris str. CCMP1986
  CDS (1)..(1461): transl_table=11
atgtgtggaattgttggaattgtttcttgtgatgatgtaaatcaacagatttatgacagtcttttgctacttcagcatagaggtcaagattcaactggaatagctacaatggaaaatactgtttttcatatacataaagctaaaggacaagtaaatactgcttatagaacaagagatatgagaaatttaataggaaaaattggtttagggcatgttaggtacgcaactaaaggttcagcagaaagtgttgaagaagcacaacctttctatgttaatgctccttatggaatagttttgattcataatggaaaccttactaatacaagagacctagagaaacaattatttaatgtagataaacgccatactaattcttcaagtgatactgaaatgttgttaaacatattcgccactgaattacaagaacagatccataatcaagatctagagccagatataatttttaatgcagttaaaaatttacataaaagaattcaaggttcatatgcttcaattgctttaatttcagggcatggtttattagcttttagagatccttttggtataaggcctttagtaattggaaaaagaatttctcttattactcaaaaggaagagtggatggtagctagtgagtctttagtattagaaaataatgattatcatgttgttagagatgtggaacctggcgaggcaatttttataaccaataatggtgaatttttttcaaagcaatgctcagaaaacccaaggttatttccttgtgcttttgaatatgtttatttagctagaccagattcagtgatgaatggaatttcagtttatcaagcacgtttgaaaatgggtgattatttagctgaaacaattaagcaatcaatacagtgtggggatgtcgatgtggtaatgcctattcctgattcttcacgtcctgcggcaatgcaagttgctaggcagttggggatagagtatagagaaggtttttttaaaaatagatacgttggaagaactttcataatgcctggccatcaaaaacgtaaacaatctgtaaggcaaaagttgaatgctatgagtacagaatttaaaaataaaaatgtactaatagtcgatgattctatagtgagaggaactacatcaaaacaaatagtgcaaatggcaaaagatgctggtgcaaataaagttttttttacttcagcagctcctccagttagatatcctcatgtttatggaattaatatgcctaatagagatgaattaattgctcatgatagatcaataattgaaatagcagaaaagcttgaaatagatcatcttgtatatcaaagtgttgaaaatttgagaaaatctataattaatgattctcccattcaagaattagaaatgagttgttttactggttcttatgttactgggacggtaaatcaagaatatttaaaatgggttgaaaatgaatataattcttaa

SEQ ID NO: 30320 - protein, 486 aa, Prochlorococcus marinus subsp. pastoris str. CCMP1986
MCGIVGIVSCDDVNQQIYDSLLLLQHRGQDSTGIATMENTVFHIHKAKGQVNTAYRTRDMRNLIGKIGLGHVRYATKGSAESVEEAQPFYVNAPYGIVLIHNGNLTNTRDLEKQLFNVDKRHTNSSSDTEMLLNIFATELQEQIHNQDLEPDIIFNAVKNLHKRIQGSYASIALISGHGLLAFRDPFGIRPLVIGKRISLITQKEEWMVASESLVLENNDYHVVRDVEPGEAIFITNNGEFFSKQCSENPRLFPCAFEYVYLARPDSVMNGISVYQARLKMGDYLAETIKQSIQCGDVDVVMPIPDSSRPAAMQVARQLGIEYREGFFKNRYVGRTFIMPGHQKRKQSVRQKLNAMSTEFKNKNVLIVDDSIVRGTTSKQIVQMAKDAGANKVFFTSAAPPVRYPHVYGINMPNRDELIAHDRSIIEIAEKLEIDHLVYQSVENLRKSIINDSPIQELEMSCFTGSYVTGTVNQEYLKWVENEYNS

SEQ ID NO: 30321 - DNA, 1458 bp, Prochlorococcus marinus str. MIT 9313
  CDS (1)..(1458): transl_table=11
atgtgtggcattgttggcattgtttctactgcgctggtcaatcagcagatctatgacagcttgctgcttctacagcatcggggtcaggactctactggcatagccaccatggatggcagtgtttttcacttgcacaaggcaagggggcaagtgcgggaggcctatcgcacacgtgatatgcgttccttaatcggtaatattggtcttggtcatgttagatatgcaacaaagggtgcagctgagcgagaagaagaagcacaaccattttatgtgaatgctccttacggaatcattcttattcataacggtaaccttactaatactcgagagcttgatcgcgacttgttcaatattgatcgtcgccacacaaattcaaagagtgatacggagatgttgcttaatgttctagctactgaattgcaattgaaaatttatggcagtgatcttactccagatcaggtatttgatgctgttacatctgtacatcaacgagtagaaggttcttatacatctattgctttgattgcagggcacggtcttcttgcctttcgtgatccgtttggcattaggccattggtacttggtaaacgtaagtctttagaaggtgctgatgagtggattgtcgctagtgagtcattggtattagagaatggtgattatgagattgttagggatgttgatcctggtgaggcgattttcattactcaaaatggcgagctttattcacgtcagtgtgcgaagaatccgcgtcttgtgccatgttcatttgagtatgtttatcttgctcgacctgattcagtgatgagtggaatctcggtttatgaggctcgattaaggatgggggatcgtcttgcagaaactattgaaaagtacacgccatctggagatatagatgttgtgatgccaattcctgactcttcacggcctgctgctatgcaagtggctagacagcttgggattgaatatcgtgagggcttttttaaaaatcgttatgtaggccgtacatttatcatgcctggacaagctcaacgtaagaaatctgttagacaaaagttaaatgctatgggaacagaatttaaaggtaagaatgttttaattgtggatgattcaattgtacgtggtacgacttcgaaggagatagtacaaatggctcgagttgctggtgcgaataaagtcacgtttacctctgcagcaccaccagtgcggtattcacatgtttatggtataaatatgccaaatcgtcatgagctgattgcttataatcgcactattcctgaaatctcttctgaactttcaacggatcacatggtctatcaagaggttgctgatctagaagcagcaattgttgaaggttcaggtgtttctgaacttgagctttcttgttttaccggagagtatattacagggacagttacttctgaatatctcgattggatagaacgcacacaattgtcttga

SEQ ID NO: 30322 - protein, 485 aa, Prochlorococcus marinus str. MIT 9313
MCGIVGIVSTALVNQQIYDSLLLLQHRGQDSTGIATMDGSVFHLHKARGQVREAYRTRDMRSLIGNIGLGHVRYATKGAAEREEEAQPFYVNAPYGIILIHNGNLTNTRELDRDLFNIDRRHTNSKSDTEMLLNVLATELQLKIYGSDLTPDQVFDAVTSVHQRVEGSYTSIALIAGHGLLAFRDPFGIRPLVLGKRKSLEGADEWIVASESLVLENGDYEIVRDVDPGEAIFITQNGELYSRQCAKNPRLVPCSFEYVYLARPDSVMSGISVYEARLRMGDRLAETIEKYTPSGDIDVVMPIPDSSRPAAMQVARQLGIEYREGFFKNRYVGRTFIMPGQAQRKKSVRQKLNAMGTEFKGKNVLIVDDSIVRGTTSKEIVQMARVAGANKVTFTSAAPPVRYSHVYGINMPNRHELIAYNRTIPEISSELSTDHMVYQEVADLEAAIVEGSGVSELELSCFTGEYITGTVTSEYLDWIERTQLS

SEQ ID NO: 30323 - DNA, 1506 bp, Synechococcus sp. WH 8102
  CDS (1)..(1506): transl_table=11
gtgaggcagaatcctgaaggaagtctgaagtcgaggcgctcagtgcatgtgctgaaggcagagcgtcccgatcggatggaagaggcctgcggtgtcttcgccgttctggccggggaacaaccggtggcgaacctggcttatttcggtctgtatgccctgcagcatcgaggccaggaatcggctggcatcgcggtgttcaacgaaggcaaggttcgccttcataaggacatgggcctggtcagccaggtgtttgaccaggacgtgctggcccgcatgcctggagacctggccatcggccacaaccgctactccaccacgggcagcagccgggtgtgcaatgcccagcctgtggtgttgatgacgcggctgggggcctttgctttggcccacaacggcaacctggtgaatgcccgcgaattgcgggagttggtggacgacggacaggcggagttcacctcaacaacggattcggaactgatcgccttcgctgtgcagcaggcggtggatcgtgggctcgactggtcagatgccatagaggccgcgctcaagctgtgtcggggtgcgttcagccttgccatcggaacgccggatggtctgtttgctgtacgcgacggtcatggcatccgtcctttggtgttcggcacgctgggggatccagccactggtcattgggtggtgagcagtgagacctgtggcttggagatcatcggcgcccgctatgtcgatgatgtccagcccggtgaattggtccggtttgaactcggatcagcagagcctcagcgtcggcgttggagtgaggaaccgaaccgcctgtgcgtgttcgagatgatttatttcgccaggccggacagtcagttcttcggcgagtccctctacagctaccgccagcgcattggacgaacccttgctcgcgagtcgtgcgtggaggctgatctggtgatcggtgtcccagattccggcattcctgcagccattggtttttctcaggaaagtggcatcccctacggcgatggtctgatcaagaaccgttatgtcggccgtactttcatccagcccacccaggcgatgcgggaagcgggcattcgggtgaaactcaaccctctgccggatgtgctggccggaaagcgcttgatcgtgattgatgactcgatcgtgcgtggcaccaccagccgcaaattggtggtggcgttacgggatgccggtgccactgaagtgcacatgcggatcagttcgcctccggtgacgcatccctgcttttacgggatcgacaccgacacccaggatcaactgatcgccgctcagatgacccttgagcagatcaaggatcacctcaaagtggattctctggcttacctcagcaaggaaggaatgctcgaggctgcgaaggctgagtccggccatttctgcagcgcctgttttgacgggcaatacccgatccccatggatcagacgttgctgtccagcaaattgatgatggagcctgcggggattgctgcgacgtcttga

SEQ ID NO: 30324 - protein, 501 aa, Synechococcus sp. WH 8102
MRQNPEGSLKSRRSVHVLKAERPDRMEEACGVFAVLAGEQPVANLAYFGLYALQHRGQESAGIAVFNEGKVRLHKDMGLVSQVFDQDVLARMPGDLAIGHNRYSTTGSSRVCNAQPVVLMTRLGAFALAHNGNLVNARELRELVDDGQAEFTSTTDSELIAFAVQQAVDRGLDWSDAIEAALKLCRGAFSLAIGTPDGLFAVRDGHGIRPLVFGTLGDPATGHWVVSSETCGLEIIGARYVDDVQPGELVRFELGSAEPQRRRWSEEPNRLCVFEMIYFARPDSQFFGESLYSYRQRIGRTLARESCVEADLVIGVPDSGIPAAIGFSQESGIPYGDGLIKNRYVGRTFIQPTQAMREAGIRVKLNPLPDVLAGKRLIVIDDSIVRGTTSRKLVVALRDAGATEVHMRISSPPVTHPCFYGIDTDTQDQLIAAQMTLEQIKDHLKVDSLAYLSKEGMLEAAKAESGHFCSACFDGQYPIPMDQTLLSSKLMMEPAGIAATS

SEQ ID NO: 30325 - DNA, 1377 bp, Wolinella succinogenes DSM 1740
  CDS (1)..(1377): transl_table=11
gtggaaacattgagagattggaacgaagagtgcgcggttgtaggggtttataacgctgatacagcggcgagtgtggcctactattcactattttcaatgcagcatcgagggcaggaggcgagcggaattagcagctctacaggtgagaaactcatcaccatcaaggatcgagggctggtgacggcagtttttggagatgataagctcaaaaaactcaaagggcgatcggccgtaggtcacaaccgctactccacggcgggagaagattctattttggatgcccagcctgtatttgcgcgatatgatttgggtgaaatcgcgattgtgcataatggcaatctgaccaatgccaagcagattcgagaggatttgatccaaaaaggggcaatcttccagagctttatggatacggagaatctcatccatctcatcgctaaaagccaaaaagagaagctcattgatcgaatcattgacgcggtgcacaaaatagagggggcctactctctgatctttttaagtcgcaaaaagatgttcgcgattagagatccacatggttttaggcctttgagtttagggcgtatcaaaaacagcgatggtagttttggctatatggtcgcgagtgaaacctgcgcctttgatcttgtgggggcagagtatattcgagatgttgagccaggcgaaatgctcgtgtttgaggcagaaggagagccaagaagctacaaaatttttgaaaaacaacctcgtccctgtatttttgaatttgtctattttgctagacccgatagccgtgtgtttggacacaatgtctatgaggtacgcaaaaacatgggacaagagctcgctagagagaaacccattgaagcagacatggtgattcctgtgcctgatagcggggtggctgcagccattggatatgcaagagagagcgggattccttttgagcttggaattgttcgtaaccattatgtgggaagaacctttattgagcccacgcaacagagccgagagctaaaagtcaaactcaaactcaaccccattaaggagctcatccagggcaagcgtctcattgtgattgatgatagcatcgtgagagggacaactagtcggcagatcgtgagaatcttgcgtgcagcgggcgctaaagaggttcatatgaagatcagctcccctcccactatctccccttgctactatggggtcgatacgcctgataaatctcagctcatctgcgccaatatgacgctagaggagacctgccgctttatcgaagccgattctctctctttcctctctcttgaggggcttagacgcagtattcaatgcgatgagcgagagcttttttgtcaagcatgctttgacggaaaatatatagtctaa

SEQ ID NO: 30326 - protein, 458 aa, Wolinella succinogenes DSM 1740
METLRDWNEECAVVGVYNADTAASVAYYSLFSMQHRGQEASGISSSTGEKLITIKDRGLVTAVFGDDKLKKLKGRSAVGHNRYSTAGEDSILDAQPVFARYDLGEIAIVHNGNLTNAKQIREDLIQKGAIFQSFMDTENLIHLIAKSQKEKLIDRIIDAVHKIEGAYSLIFLSRKKMFAIRDPHGFRPLSLGRIKNSDGSFGYMVASETCAFDLVGAEYIRDVEPGEMLVFEAEGEPRSYKIFEKQPRPCIFEFVYFARPDSRVFGHNVYEVRKNMGQELAREKPIEADMVIPVPDSGVAAAIGYARESGIPFELGIVRNHYVGRTFIEPTQQSRELKVKLKLNPIKELIQGKRLIVIDDSIVRGTTSRQIVRILRAAGAKEVHMKISSPPTISPCYYGVDTPDKSQLICANMTLEETCRFIEADSLSFLSLEGLRRSIQCDERELFCQACFDGKYIV

SEQ ID NO: 30327 - DNA, 1437 bp, Gloeobacter violaceus PCC 7421
  CDS (1)..(1437): transl_table=11
atgacctacgctgcaccctctgctcccgacaagcctgaggaggcttgcggggtcttcggcatcctggcgccgggcgaagccgtcgccaaattgacctacttcggtctgttcgcgctccagcatcgcggccaggagtccgcggggatcgctgtgctcgacggcgaccgtctaacgatgcacaaggacatgggtctggtctcccaggtctttgacgaggcactgctaaacgagctgcaggggcaattggccgtgggccacacccgctactcgaccaccggctccagccgcaaggtaaacgcccagccggtcgtctcccgcacgcgcctcggtccggtcgtcctcgcccacaacggcaacctggtcaacgccgcccagttgcgcgaagagttgctcgcccgcgagcacaccctgctggccaccaccgattccgaagagattgtccacgccatcggcgaggcggtcgacgacggcaagggttgggtcgaggggaccgttcacgccctcaagcgctgccgcggcgccttcagcctggtgatcggcaccccggcggggctgatgggcacccgcgacgccaacggcgtgcgtccgctggtcatcggcaccctcaagggccgctacgtgctcgcgagtgagacctgcgccctcagcatcatcggtgcgaaatacctgcgcgacgtcgagcccggcgaactggtgttcatcaccgaatcgggcctggagtcccaccactgggcgaaacccgaaccgcggatgtgcatctttgagatgatctattttgcccgccccgattcgcgcgtgaacgccgagagcctctacacctaccgcgagcgcctgggcgagatcctcgctcaggaggcccctgtggaggcggacgtcgtcatcccggtccccgactcgggtacccccgccgccatcggctacgcccgcgcctccggcattctcttccagcaaggtctcatcaagaatcactacgtaggccgcacgttcatccaacccacccagacgatgcgcgaggcgggcatcaagatgaagctcaatccgttgcccgacgtcatcgaaggcaagcggatcgtaatcgtcgacgattcgatcgtgcgcggcaccaccagccgcaagattgtccaggccctgcgcgacagcggtgcgcgcgaggtgcacatgcgtatctcctcgcccccggtcacccatccctgtttctacggcatcgacaccgactcgcaggaccagttgattgccgccaccaagagcgtggatgaaattgcccggcacatcgaggtggacagccttgcctacttgagtgtcgaagggatgctcaaggcgacccgcaccgacggccagggcttttgcaccgcctgcttcaccggcgattacccgattccgattcctgatgcgatccgccgcaccaaactggtgctcgaaaaaaccgcagccagctga

SEQ ID NO: 30328 - protein, 478 aa, Gloeobacter violaceus PCC 7421
MTYAAPSAPDKPEEACGVFGILAPGEAVAKLTYFGLFALQHRGQESAGIAVLDGDRLTMHKDMGLVSQVFDEALLNELQGQLAVGHTRYSTTGSSRKVNAQPVVSRTRLGPVVLAHNGNLVNAAQLREELLAREHTLLATTDSEEIVHAIGEAVDDGKGWVEGTVHALKRCRGAFSLVIGTPAGLMGTRDANGVRPLVIGTLKGRYVLASETCALSIIGAKYLRDVEPGELVFITESGLESHHWAKPEPRMCIFEMIYFARPDSRVNAESLYTYRERLGEILAQEAPVEADVVIPVPDSGTPAAIGYARASGILFQQGLIKNHYVGRTFIQPTQTMREAGIKMKLNPLPDVIEGKRIVIVDDSIVRGTTSRKIVQALRDSGAREVHMRISSPPVTHPCFYGIDTDSQDQLIAATKSVDEIARHIEVDSLAYLSVEGMLKATRTDGQGFCTACFTGDYPIPIPDAIRRTKLVLEKTAAS

SEQ ID NO: 30329 - DNA, 1518 bp, Photorhabdus luminescens subsp. laumondii TTO1
  CDS (1)..(1518): transl_table=11
atgtgcggtattgttggtatcgtcggttttacaccggttaaccagtcgatttatgatgcgttgacggtgcttcagcaccgtgggcaagatgctgcgggcattgctactattgatggtaacaatggatttcgtttacgcaaagccaatggcttagtgagagacgtgtttgaagcccggcatatgctgcgtttacagggaacgattgggattggtcatgttcgctatccgacagcgggcagttccagtgcatcggaagctcaaccgttttatgtgaactctccatttggtattacattgacacacaatggtaatttgacgaatgctcatgagttgaagaaaaagttgtttgagaatgcccgtcgccatgtgaatactacgtcagattctgagattttgctcaacgtttttgccagtgaactggattgctcccagcattatccattggtgcctgacaatatttttgcggcagtagcggcaatgcataaacaggtgagtggtgcttatgcctgcattgcgatgattattggtcatgggttagttgctttccgtgatccgcatggtattcgtccgttggttttaggtaagcgcactttggatgatggccgtaatgagtatatggtcgcttctgaaagcgttgcattagatacgctaggctttgaattcctgcgggatgttgcatcaggtgaagcgatttatattactgaacaaggtcagttatttactcgtcaatgtgctgaaaatccttctctgactccctgtttatttgaatttgtctatttggctcgcccagattcctttattgataaaatttcggtttataacgcccgcatacggatggggcataagctaggggcgaaaattgcccgcgaatgggaagacttacatattgatgtggttattccaatccccgaaacatcttgcgatgttgcgttagaaattgcgcgcatactcggtaaaccctatcgtcagggatttgtgaaaaaccgttatgttggccggacatttatcatgcctgggcaacaggaacgccggaaatcagtccgccgtaaattgaatgctaatcgcgcagaattccgtgataaaaatgtgctattggtggatgattctattgtgcgtggtacaacgtcagaacagattgtcgatatggctcgtgaagccggcgcgaagagagtttatcttgcttcggcagcaccggaagtacgtttcccgaatgtttatggcattgatatgcccaatgcaaatgaactgattgctcatgggcgtgaagtggatgaaattcgccaacttattggtgcagatgcattgatatttcaggatttaactgatctgatcgacgctgttcgtgaagaaaacccggatgttgacgggtttgagagttcagtattcaatggtgtttatgttaccaaagacgttgaccagacttatctctattatctggagaatctgcgtaaagacgatgaagtaaaactgaataatcagaatgaagttgaaaatctggatatctataatgaaggttga

SEQ ID NO: 30330 - protein, 505 aa, Photorhabdus luminescens subsp. laumondii TTO1
MCGIVGIVGFTPVNQSIYDALTVLQHRGQDAAGIATIDGNNGFRLRKANGLVRDVFEARHMLRLQGTIGIGHVRYPTAGSSSASEAQPFYVNSPFGITLTHNGNLTNAHELKKKLFENARRHVNTTSDSEILLNVFASELDCSQHYPLVPDNIFAAVAAMHKQVSGAYACIAMIIGHGLVAFRDPHGIRPLVLGKRTLDDGRNEYMVASESVALDTLGFEFLRDVASGEAIYITEQGQLFTRQCAENPSLTPCLFEFVYLARPDSFIDKISVYNARIRMGHKLGAKIAREWEDLHIDVVIPIPETSCDVALEIARILGKPYRQGFVKNRYVGRTFIMPGQQERRKSVRRKLNANRAEFRDKNVLLVDDSIVRGTTSEQIVDMAREAGAKRVYLASAAPEVRFPNVYGIDMPNANELIAHGREVDEIRQLIGADALIFQDLTDLIDAVREENPDVDGFESSVFNGVYVTKDVDQTYLYYLENLRKDDEVKLNNQNEVENLDIYNEG

SEQ ID NO: 30331 - DNA, 1515 bp, Vibrio vulnificus YJ016
  CDS (1)..(1515): transl_table=11
atgtgtggtattgttggaatcgtgggcacaacccctgtaaaccagtcaatttatgacgcgttaacagtgttacagcatcgtggccaagatgccgctggtatttgtaccatagaaagcaatcgttttcgtctgcgtaaggcaaacggtctggtcaaagatgtgtttgaagcaaaacacatgcaacgtcttcaaggcaacgtcggcattggtcatgtacgctatccaacggccggtagttcaagtgcttcagaagcacagcctttctacgttaactcgccatttggcattagcttagcgcacaacggcaacctgactaacgcgcatgaagttcgtcagaaattgttcgaaaaagatcgccgccatgtgaataccacctcagactccgaagttcttcttaacgttcttgctcatgaaattgatacagtaaaaggcaacgttactgccgatgatgtcttccgagccatcgccaatgtccatcgtaccattcgtggtgcttacgccgttacagcgatgatcatcggtcacggtatgattgcctttcgcgacccacatggtattcgtccactttgcttaggtaagcgcgaagagaacggacaaacggaatacatggtggcgtcagaatcagtagcgctggatgcggttggctttgattttgtgcgtgacgtcgcaccaggtgaagcgatttacgcgacttttgacggtgaactctttaccaagcagtgtgctgacaatccaaaactcaacccgtgcatttttgagttcgtttactttgcacgccctgattcgtttatcgacaaaatttctgtctatagtgcgcgagtcgaaatgggtaaaaagttgggtgagcgtattaaagaagagtacgccgatcttgatattgacgttgtcattcccattccagagacctcttgtgatatcgcactgcaaatcgctcaagcgattgataagccgtaccgccaagggtttgttaaaaaccgctatgttggccgtacctttatcatgccgggccagcaattgcgtaaaaaatcggtacgtcgcaagctcaatgccattcgctctgaattcaaagataagaatgtactgttagtggacgactcaattgtacgtggcaccacttctgagcaaattatcgaaatggcgagagactcaggcgcgaagaaagtgtttattgtctctgctgcacccgaggtgcgtttcccgaacgtttacggcattgatatgccaagcgcaactgagcttattgctcatggacgagataacgagacgatctgtaagctgattggtgctgacgcgctgattttccaaaaactggaagatttagtggatgcggtgggcttgggtaaccttgatattaccaagtttgatacttcggtgtttaacggcgaatacgtgacgggtgatattgatcagcaatacctcgatttcctagattcgatgcgtaacgatgatgcaaaggttcagcgcgagattcaacaagatctggctaacctagagttgcataacgaaggtgcgtaa

SEQ ID NO: 30332 - protein, 504 aa, Vibrio vulnificus YJ016
MCGIVGIVGTTPVNQSIYDALTVLQHRGQDAAGICTIESNRFRLRKANGLVKDVFEAKHMQRLQGNVGIGHVRYPTAGSSSASEAQPFYVNSPFGISLAHNGNLTNAHEVRQKLFEKDRRHVNTTSDSEVLLNVLAHEIDTVKGNVTADDVFRAIANVHRTIRGAYAVTAMIIGHGMIAFRDPHGIRPLCLGKREENGQTEYMVASESVALDAVGFDFVRDVAPGEAIYATFDGELFTKQCADNPKLNPCIFEFVYFARPDSFIDKISVYSARVEMGKKLGERIKEEYADLDIDVVIPIPETSCDIALQIAQAIDKPYRQGFVKNRYVGRTFIMPGQQLRKKSVRRKLNAIRSEFKDKNVLLVDDSIVRGTTSEQIIEMARDSGAKKVFIVSAAPEVRFPNVYGIDMPSATELIAHGRDNETICKLIGADALIFQKLEDLVDAVGLGNLDITKFDTSVFNGEYVTGDIDQQYLDFLDSMRNDDAKVQREIQQDLANLELHNEGA

SEQ ID NO: 30333 - DNA, 1482 bp, Corynebacterium diphtheriae NCTC 13129
  CDS (1)..(1482): transl_table=11
ttgacagaccttgacgaccgcggcgaacagtctccgcgcgaggaatgtggcgtttttggtgtgtgggctccaggcgaagaagtatccaagctcacctattttggacttttcgccctgcagcaccgtggacaagaagctgcgggaatcgccgtaggtgacggcgatcaagtcgtggtatttaaagacttggggcttgtgtcccaggtgtttgacgaacctaccttggaatccctcagcggagacgtggccatcggccacacccgctattccaccgcaggtggagtgatgtgggaaaactcccaaccaatgttccgtgtaaccccagaaggaaccgatgtggcgctgtgccacaacggcaatctggtgaactacctcgagctcatggcagaagccgccgagcacgatttggtaaaacctgacactgagccctccgattccgatgtgatgacagccctgctggcacacggagtatcggagggtacatctttgcttgattccgcccgagcactcctgccgcgtatgcgtggtgcgttctgcttgacctttaccgatggtcacaccatgtatgctgctcgtgacccatggggcgttcgccctctcgtactgggtcgtctcgagcgcggctgggtggttgcctcagaaacgtgtgcactcgacatcgtgggtgcgtcgtttgttcgcgagatcgagccaggtgagctcgttgctatcgacggcgccggcatccgtagcgaacgttttgcacaaccgcaacgcaaaacctgtgtttttgagtatgtgtaccttgctcgcccagactccacaatccacggccgcaacgtcaacgcaacccgtatggagatcggacgaaggctagcacaggaatcgcctatcgacggcgaccttgtcatcccagtcccagaatccggcaaccccgctgcggtgggttacgcccaagaatcgaagattcctttcggtcaaggattggtgaaaaacgcctacgttggccgcacctttattcagccgtcgcaaaccctgcgccagctgggtattcgcctcaagctcaacccgctgcgtgaggtaatccaaggaaagcgcctgatcgttgtagatgattccattgtgcgtggcaacacccagcgagccctgatccgcatgctgcgtgaagccggtgccgccgaggttcacgtgcgtatcgcctcgccacctgtgaagtggccatgcttctacggcatcgactttgcaagccccggcgaactgatcgccaacgctgtcaccggcgataacgaagccgaggttgtacagtcagtctgtaccgcccttggcgcagattctttgggatacgcctctaccgacgccatgatcgaagccactcagcagtcccgcgccgaactatgttgtgcatgtttcgacggcgaataccccatcggtatgcctgccggaaacaagaacgcagagcttgtttctgcgatgaaacgcagctcgtgcgcaagcctcgactaa

SEQ ID NO: 30334 - protein, 493 aa, Corynebacterium diphtheriae NCTC 13129
MTDLDDRGEQSPREECGVFGVWAPGEEVSKLTYFGLFALQHRGQEAAGIAVGDGDQVVVFKDLGLVSQVFDEPTLESLSGDVAIGHTRYSTAGGVMWENSQPMFRVTPEGTDVALCHNGNLVNYLELMAEAAEHDLVKPDTEPSDSDVMTALLAHGVSEGTSLLDSARALLPRMRGAFCLTFTDGHTMYAARDPWGVRPLVLGRLERGWVVASETCALDIVGASFVREIEPGELVAIDGAGIRSERFAQPQRKTCVFEYVYLARPDSTIHGRNVNATRMEIGRRLAQESPIDGDLVIPVPESGNPAAVGYAQESKIPFGQGLVKNAYVGRTFIQPSQTLRQLGIRLKLNPLREVIQGKRLIVVDDSIVRGNTQRALIRMLREAGAAEVHVRIASPPVKWPCFYGIDFASPGELIANAVTGDNEAEVVQSVCTALGADSLGYASTDAMIEATQQSRAELCCACFDGEYPIGMPAGNKNAELVSAMKRSSCASLD

SEQ ID NO: 30335 - DNA, 1530 bp, Rhodopseudomonas palustris CGA009
  CDS (1)..(1530): transl_table=11
atggacgcgatgctcagctcttccgacgacgccgcaacgcccgcttcggacgctcgcgaccaacacatcctcgacgataccgttttcgataccgatggtgacacgctgcgcgaagagtgcggcgtgttcggcattttcggacaccccgatgccgccgcgatcaccgcgctcggcctgcacgccctgcagcaccgcggtcaggaagccgccggcatcgtctcgttcgacaacggccggtttcattccgagcgccgcctcggcctggtcggcgacaccttctcccgcgccgacgtaatcgcgcggctgccgggcaattcggcgatcggccacgtccgctattcgaccaccggcgagaccattctgcgcaacgtgcagccgctgttcgccgagctcaatgccggcggcttcgcggtcggtcacaacggcaacctcaccaacggcctcaccctgcgccgtgagctgatccgcagcggcgcgatcatgcagtcgaccaccgacaccgaagtgatcctgcatctggtcgcgcactccaagaagacccgcttcatcgagcgcttcatcgagtcgctccgcgctctggaaggcgcctactcgctggtgtcgctgaccaacaagaagctggtcggcgcccgcgatccgctcggcatccgcccgcttgtgctcggcgaactcgacggctgcccgatcctggcgtcggagacctgtgcgctcgacatcatcggcgcgcattacgtccgcgacgtcgaacccggcgaagtcatcgtgttcgaccgacacggcgtcaccagccacaagccgttcccgccgcagccgccccgcccctgcatcttcgagtacatctacttcgcgcgcccggattcggtggtcggcggccgttcggtgtacgacgtccgcaaggcgttcggcgcccagctcgcgctcgagagccacgtcgaatccgacgttgtcgtcccggtgccggattccggcgttccggcggcgatcggctattcgcggcagtcgggcgtgccgttcgaactcggcatcatccgcaaccactatgtcggccgcaccttcattcagccgacccagagcgtgcgcgaactcggcgtgcggatgaagcactcggcgaaccgcgccgcgatcgaaggcaagcggatcgtgctgatcgacgacagcctcgtccgcggcacgacctcgaagaagatcgtgaagatgatgcgcgatgccggcgcccgcgaggtgcatttccgcatcgcctcgccgccgatcacccacccggactactacggcatcgacaccccggaccgcgccggcctgctggccgcgacgcattcgctcgaagagatgcgcgacctgatcggcgccgacacgctcgccttcctgtcggtcgatggcatctatcgcgcgatgggcgaaccgggccgcgatccggcgttgccgaagttcaccgaccactgctttaccggtgactatccgaccggcctcaccgatctcaatcagaccgagtcggcgccgcggcaattgtcgctgctggccgaggcgagctga

SEQ ID NO: 30336 - protein, 509 aa, Rhodopseudomonas palustris CGA009
MDAMLSSSDDAATPASDARDQHILDDTVFDTDGDTLREECGVFGIFGHPDAAAITALGLHALQHRGQEAAGIVSFDNGRFHSERRLGLVGDTFSRADVIARLPGNSAIGHVRYSTTGETILRNVQPLFAELNAGGFAVGHNGNLTNGLTLRRELIRSGAIMQSTTDTEVILHLVAHSKKTRFIERFIESLRALEGAYSLVSLTNKKLVGARDPLGIRPLVLGELDGCPILASETCALDIIGAHYVRDVEPGEVIVFDRHGVTSHKPFPPQPPRPCIFEYIYFARPDSVVGGRSVYDVRKAFGAQLALESHVESDVVVPVPDSGVPAAIGYSRQSGVPFELGIIRNHYVGRTFIQPTQSVRELGVRMKHSANRAAIEGKRIVLIDDSLVRGTTSKKIVKMMRDAGAREVHFRIASPPITHPDYYGIDTPDRAGLLAATHSLEEMRDLIGADTLAFLSVDGIYRAMGEPGRDPALPKFTDHCFTGDYPTGLTDLNQTESAPRQLSLLAEAS

SEQ ID NO: 30337 - DNA, 1404 bp, Geobacter sulfurreducens PCA
  CDS (1)..(1404): transl_table=11
atgatgaagctctacagaccaacggaagagtgcggcattttcggtatctacggccaccctgaggcggccaatctgacgtacctgggcctttacgcccttcagcaccggggacaggaagcctgcggcatcgtctcctcggacggccgcagcctctacacccaccggagcatggggcttgtggcggatgtcttcggcaatcaggaaatcttcggcaatcttcccggtgaatccgccatcgggcacgtgcgctactccaccaccggcgactcggtcctcaagaacgtgcagcccatcaaggtcgactactccaggggctccattgccattgcccacaacggcaacctggtgaacgcccagtacatcaaggacgagttggaggcctggggttccattttccagaccactatggacacggaggtgatcctccacctgctggccacttccaagcatagttccctggaggaccggatcatcgatgccctcgggcggatcaagggggcctactgtcttctgttcctgacggaaacccgcatggtggctgcccgcgatccccacggcttccgccccctctgtctcggcaagctcggcgatgcctgggtggttgcgtccgagagctgtgccttggacctgatcgaggccgaatttgtcagggagatcgagccgggcgagatcgtggtcattaccaaggacgggctcacctcccattttccgcataagaagatcgaaccggctccttgtattttcgagttcgtctacttcgctcgcccagattcgtacatcttcggcaagaacgtctaccaggtacgcaaggacttcgggcgccaactctgccgcgagcaccgcatcgatgccgatatcgtcatcccggttcccgattcgggtgttcccgcagccctgggttatgcccaggaggcgggtattccctttgagctcgggcttatccgcaaccattacgtgggccgtaccttcattgagccccagcagtcgatccggcattttggtgtcaagatcaagctcaatccggtgcgggaggtgctgaagggaaagcgggtggtggtcatcgacgactctatcgtcagaggcaccacgtcccgcaagatcgtgaaaatggtacgcaacgccggcgcatccgaggttcacgttcgcatctcgtcgccccccacgagctatccatgctactacggcattgacacccccacccgcaaagaacttatctcctcgtcccataccatcgaggaaatccgcaagtacataaccgccgattcactgggctacctttcggaggaagggctgctccaggccgtgggcgccggcagcaatcccttctgcaaagcctgtttctccggcggctacccgatcacattcccgcgcctcatggccgaaccccaactggatcttttctga

SEQ ID NO: 30338 - protein, 467 aa, Geobacter sulfurreducens PCA
MMKLYRPTEECGIFGIYGHPEAANLTYLGLYALQHRGQEACGIVSSDGRSLYTHRSMGLVADVFGNQEIFGNLPGESAIGHVRYSTTGDSVLKNVQPIKVDYSRGSIAIAHNGNLVNAQYIKDELEAWGSIFQTTMDTEVILHLLATSKHSSLEDRIIDALGRIKGAYCLLFLTETRMVAARDPHGFRPLCLGKLGDAWVVASESCALDLIEAEFVREIEPGEIVVITKDGLTSHFPHKKIEPAPCIFEFVYFARPDSYIFGKNVYQVRKDFGRQLCREHRIDADIVIPVPDSGVPAALGYAQEAGIPFELGLIRNHYVGRTFIEPQQSIRHFGVKIKLNPVREVLKGKRVVVIDDSIVRGTTSRKIVKMVRNAGASEVHVRISSPPTSYPCYYGIDTPTRKELISSSHTIEEIRKYITADSLGYLSEEGLLQAVGAGSNPFCKACFSGGYPITFPRLMAEPQLDLF

SEQ ID NO: 30339 - DNA, 1656 bp, Mycobacterium avium subsp. paratuberculosis K-10
  CDS (1)..(1656): transl_table=11
ctgaagtgcaggtttaccccggcgggccgggatttcgccggtcaacacgcccggcggattcggcggcgcggccgcgctgcccgtagactccgttacgtcaccaaccgttccccggggagccgcccaatcgtgaccgtcgccgaacccgagcaggacttcaacgcaccccgcgaggaatgcggtgtattcggggtctgggccccgggcgaggaagtcgccaaactcacctactacggcctctacgcgctgcagcatcgcgggcaggaggccgccggcatcgccgtcgccgacggatcccaagtgctggtgttcaaggacctgggcctggtcagccaggtgttcgacgagcagacgctggccgcgatgcagggccacgtcgccatcgggcactgccgctactccaccaccggcgacaccacctgggagaacgcccagccggtgttccgcaacaccgccgcgggcaccggggttgccttggggcacaacggaaatctggtcaacaccgccgagctggccgcgcgggcccgcgacgcggggctgatcgccaagcgcgcgccggccccggcgaccaccgactccgacatcctgggcgcgctgctggcgcacggcgccgccgactccacgttggagcaggccgcgctggacctgctgccgacggtgcgcggcgccttctgtctgaccttcatggacgagaacacgctctatgcgtgccgcgatccgcatggggtgcggccactttcgctgggacggctggaccgcggctgggtggtggcctccgagaccgccgcgctcgacatcgtcggcgcctcgttcgtgcgcgacatcgaaccgggcgaactgctggcgatcgacgccgacggggtgcgctccacccggttcgccaatcccacccccaagggctgcgtcttcgagtacgtctatttggcgagaccggacagcaccatcgccggccggtccgtgcacgccacccgggtcgagatcggccggcggctggcccgggaacgccccgtcgaggccgacctggtgatcggggtgcccgagtcgggcacccccgccgccgtcggctacgcccaggaatccggcatcccctacgggcaggggctgatgaagaacgcctacgtggggcgcaccttcatccagccgtcgcagaccatccgtcaactcggtatccggctcaagctcaacccacttcgcgaggtgatccgcggcaaacggctcatcgtcgtcgacgactccatcgtgcgcggcaacactcagcgggcgctgctgcggatgctgcgcgaggccggcgccgtcgaggtgcacgtgcgcatcgcgtcaccgccggtcaaatggccctgcttctacggcatcgacttcccgtcgccggccgaactgatcgccaacgcggtcgaggacaaacacgagatgctcgaggcggtgcggcacgccatcggcgccgactcgctgggctacatctcgctgcgtggcctgatcgcagcctccgagcagccggcgtcgcggctgtgcaccgcctgcttcgacggccagtacccgatcgaactgcccggcgagacggcgttgggcaagaacgtcatcgagcacatgctcgccaacgcggcccggggcgccgggctcgacgacctggcggccgacgaagtgcccgtcgtccactga

SEQ ID NO: 30340 - protein, 551 aa, Mycobacterium avium subsp. paratuberculosis K-10
MKCRFTPAGRDFAGQHARRIRRRGRAARRLRYVTNRSPGSRPIVTVAEPEQDFNAPREECGVFGVWAPGEEVAKLTYYGLYALQHRGQEAAGIAVADGSQVLVFKDLGLVSQVFDEQTLAAMQGHVAIGHCRYSTTGDTTWENAQPVFRNTAAGTGVALGHNGNLVNTAELAARARDAGLIAKRAPAPATTDSDILGALLAHGAADSTLEQAALDLLPTVRGAFCLTFMDENTLYACRDPHGVRPLSLGRLDRGWVVASETAALDIVGASFVRDIEPGELLAIDADGVRSTRFANPTPKGCVFEYVYLARPDSTIAGRSVHATRVEIGRRLARERPVEADLVIGVPESGTPAAVGYAQESGIPYGQGLMKNAYVGRTFIQPSQTIRQLGIRLKLNPLREVIRGKRLIVVDDSIVRGNTQRALLRMLREAGAVEVHVRIASPPVKWPCFYGIDFPSPAELIANAVEDKHEMLEAVRHAIGADSLGYISLRGLIAASEQPASRLCTACFDGQYPIELPGETALGKNVIEHMLANAARGAGLDDLAADEVPVVH

SEQ ID NO: 30341 - DNA, 1386 bp, Wolbachia endosymbiont of Drosophila melanogaster
  CDS (1)..(1386): transl_table=11
atgctagatgaaatgcgtgaggaatgtggggtatttggcataagttgcaaccaaagtgctgcttttaactctatacttgctctccacgctttgcagcatagaggtcaagagtcttttggcgtagtaaccagtaacaacgataagctgcactcttatcactttcaaggtcaagtgagcagcgtatttgatgatatagatgaaataaagaaatccttacctggagattgtgcaataggtcatgttcgatactcaacaagtggtaataagtttggagtgcagcccatgtttagcaaaagtggcaaatttggggatttcgccatagcacataatggtaatttaattaatatttctccgatacgcgaacaattgattaaacaagagtgcgtttttcagtcagatattgatacagaagtagtagtgcatctgacagcaagcggtgaaaaagatagctttttagagagttttatatatgcattaaagcaaatacaaggtgcttattcttttgttgcaatcaatcaagaagtagttattggagtacgtgattcatctggaatcaggcctcttgttttaggaaagttaaacggttcttacgttcttgcatctgaaacttgtgctcttgatataataaatgcagagtttgttagagaaatagaaccaggcgaattagttaccatcagttcgggtagtaagctagcctcaatgtttcctttcccacagcaaaaatcaagtttttgtatttttgaatacgtttatttttcaagaccagacagcataatggagaataggtctatatacgatacaagaaaagaaataggaagaatacttgcagaagagagcccaccaaaaaacaatgtagatatggttgtaccaatacctgattctggaatacctgcagctattggatatgcaaagcattcaggattacctatggaactgggaataattcgtaatcattacataggaagaacttttatacaaccaaccgctgaagtacgtaaagttagaataaaattaaaattcaatgctaataagcacactttgaaaggtaaaaacataattttaatagatgatagtatagtgcgtggtagtacgttaacaaatataatagttatgctaaaggatgcaggagtaaaagagattcacctcaaaatttcaagcccaccaattaagcattcttgtttttatggaatagatacgccagagtgcaaagatttaattgctgcaaataaatctgtagaggaaattaaggaagttataggagtagatagcctagccttcttgagtattgatggattatatcaggctgttaaaggagaagtgcgtaacaatgctacaccacaatattgtgatgcttgtttcactggtgattatccaattggcaaatag

SEQ ID NO: 30342 - protein, 461 aa, Wolbachia endosymbiont of Drosophila melanogaster
MLDEMREECGVFGISCNQSAAFNSILALHALQHRGQESFGVVTSNNDKLHSYHFQGQVSSVFDDIDEIKKSLPGDCAIGHVRYSTSGNKFGVQPMFSKSGKFGDFAIAHNGNLINISPIREQLIKQECVFQSDIDTEVVVHLTASGEKDSFLESFIYALKQIQGAYSFVAINQEVVIGVRDSSGIRPLVLGKLNGSYVLASETCALDIINAEFVREIEPGELVTISSGSKLASMFPFPQQKSSFCIFEYVYFSRPDSIMENRSIYDTRKEIGRILAEESPPKNNVDMVVPIPDSGIPAAIGYAKHSGLPMELGIIRNHYIGRTFIQPTAEVRKVRIKLKFNANKHTLKGKNIILIDDSIVRGSTLTNIIVMLKDAGVKEIHLKISSPPIKHSCFYGIDTPECKDLIAANKSVEEIKEVIGVDSLAFLSIDGLYQAVKGEVRNNATPQYCDACFTGDYPIGK

SEQ ID NO: 30343 - DNA, 1464 bp, Treponema denticola ATCC 35405
  CDS (1)..(1464): transl_table=11
atgagcaaggatgatatttttaaatcgagtttaggggaagaatgcgggatcgcagctgtctgggattcaaactcctataagacggaaaatcccgaaaggctgcctttcaggccggatgacgctgcccgctcggttttttatgctcttttttctcttcaacacaggggacaagaagcggccggaatggctgtttcaaacggaaaacatatccgagtcttcaaaaaaccgggccttgtttccaacatttttaccgaacacgatatatcgaatctccaaggttatgctgccatcggccacacccgctactcgactaccggttcttcttcttttggaaatatccagcccttttatatagaaacaatgtacgggcctatagcccttgctcataacggaaaccttgtaaacgccccgcatttaaggcaaaaacttttggaaagaggggtggggctttcttctacctccgataccgaagttatgattatgatgcttgccgctgccaaaggcgattcttgggcggagcgtatagcttcatgtatgagagaatgggaaggagctttttcgattgccgttttaacggttgaaggaatttacatagccagagacccttggggcttcagacctctttgtgtcggaagttttcaggaaggggtatcggttgcggcaagcgaatcttgtgctcttttaacattgggctgtagggatgttactgaggtaaaagccggtgagattctaaagcttgtcgataacggagccgagctttgtatgcgcattccgcctaaggagcctctttctccatgtatttttgagtatgtctattttgcccgccccgactcggtttggaacaatgcttcggttcacgtatcccgtgtaaatttcggcaaggagcttgcaaaaagctccccagttgaggccgacatagttatagctattcccgattcgtcccgttcggcagccataggctactctcaagaatcgggcattccctatgatgagggtttttcaaaaaaccgctacataggacgcacctttattcagcctacccaaaaattgcgtgaccaaggcgttgcgatgaaattcaatgttctctctgaagctgtcgaaggaaaacgcatcgtagtggtcgatgacagtattgtccgcggaagcaccatgggacccttaatcaaaatgcttaggggagcaggtgcaaaagaagttcatatcagaatatcttctcctccggtacgatactcctgttttatgggtgtagatatgggagaccctgaaaacctcatcgcccacaaaaaatcggttgaagaaatcagggaacacatcggtgcagactccttagtctatctatcccaagaaagtatgctcaaggcgatgaaggatgccggagcaaacacccacttttgctgtgcctgctttgacggaaagtaccccgtcgatgtcagcggcgccgccgataaaaacagctttgagtaa

SEQ ID NO: 30344 - protein, 487 aa, Treponema denticola ATCC 35405
MSKDDIFKSSLGEECGIAAVWDSNSYKTENPERLPFRPDDAARSVFYALFSLQHRGQEAAGMAVSNGKHIRVFKKPGLVSNIFTEHDISNLQGYAAIGHTRYSTTGSSSFGNIQPFYIETMYGPIALAHNGNLVNAPHLRQKLLERGVGLSSTSDTEVMIMMLAAAKGDSWAERIASCMREWEGAFSIAVLTVEGIYIARDPWGFRPLCVGSFQEGVSVAASESCALLTLGCRDVTEVKAGEILKLVDNGAELCMRIPPKEPLSPCIFEYVYFARPDSVWNNASVHVSRVNFGKELAKSSPVEADIVIAIPDSSRSAAIGYSQESGIPYDEGFSKNRYIGRTFIQPTQKLRDQGVAMKFNVLSEAVEGKRIVVVDDSIVRGSTMGPLIKMLRGAGAKEVHIRISSPPVRYSCFMGVDMGDPENLIAHKKSVEEIREHIGADSLVYLSQESMLKAMKDAGANTHFCCACFDGKYPVDVSGAADKNSFE

SEQ ID NO: 30345 - DNA, 1416 bp, Bacillus cereus ATCC 10987
  CDS (1)..(1416): transl_table=11
atgcttgctgaaataaaggggttaaacgaagaatgtggcgttttcggaatttgggggcatgaaaatgcggcacaagtttcatattacggattgcacagtttacagcaccgtgggcaagaaggcgcaggcattgtcgtaaataatggagaaaaaatcgtcggtcacaaggggttaggtttaatatcggaagtgttttcaagaggagagctagaaggattgaacgggaaatcagcaatcggacacgtacgatacgcgacggctggtggaagtgaagtggctaacgttcaaccattactattccgtttttctgatcatagtatggcattagctcataacgggaatttaattaatgcaaaaatgcttcgccgcgaattagaggcagagggaagtatttttcaaacaagttcagatacagaagtacttttacaccttattaaacgtagtacgaaaggttcgttaattgaaagtgtaaaagaagctctaaataaagtgaaaggtgcgtttgcatatcttttactaactggaaatgaaatgattgttgcgctagatccaaatggattccgtcccctttcaattggaaagatgggagatgcttacgttgtagcatcagaaacatgtgcttttgatgtagtaggtgcaacatacattcgtgatgtagaaccgggtgaattacttatcattaatgatgatggaattcacgtagatcgttttacaaatgatgtagaacatgcaatttgcagtatggaatacatttacttcgcacgcccagattcaaatatcgctggtgttaacgtccatgcagcacgtaaaaacatggggaaacgtttggcggcagaagctcctattgaagctgatgttgttactggtgtaccagactctagcatttcagcagcaattggttatgcggaggcgacaggtattccatatgagttaggattaattaaaaatcgttacgttggacgtacgtttattcaaccttctcaggaactgcgagagcaaggggttaagatgaagctttcagcagtaagaggtgtagttgaaggaaaacgagttgttatgattgatgattctatcgtacgaggaacaacgagtaaacgaattgttcgtatgcttcgcgaggctggagcgacagaagttcacgtaagaatagcttcaccacctttgaaatatccatgtttctatggcattgatattcaaacgagaaaagaattaattgcagcaaatcatacggtagaagaaattcgtgaaatgatcggtgcagactcattaacatttttaagtgaagatggattagtagatgcaattggacgtccatatgaagggaaatacggtggcctatgtatggcgtacttcaatggagattatccaacagctctttatgattatgagcaagagcttttagaaagtatgaaataa

SEQ ID NO: 30346 - protein, 471 aa, Bacillus cereus ATCC 10987
MLAEIKGLNEECGVFGIWGHENAAQVSYYGLHSLQHRGQEGAGIVVNNGEKIVGHKGLGLISEVFSRGELEGLNGKSAIGHVRYATAGGSEVANVQPLLFRFSDHSMALAHNGNLINAKMLRRELEAEGSIFQTSSDTEVLLHLIKRSTKGSLIESVKEALNKVKGAFAYLLLTGNEMIVALDPNGFRPLSIGKMGDAYVVASETCAFDVVGATYIRDVEPGELLIINDDGIHVDRFTNDVEHAICSMEYIYFARPDSNIAGVNVHAARKNMGKRLAAEAPIEADVVTGVPDSSISAAIGYAEATGIPYELGLIKNRYVGRTFIQPSQELREQGVKMKLSAVRGVVEGKRVVMIDDSIVRGTTSKRIVRMLREAGATEVHVRIASPPLKYPCFYGIDIQTRKELIAANHTVEEIREMIGADSLTFLSEDGLVDAIGRPYEGKYGGLCMAYFNGDYPTALYDYEQELLESMK

SEQ ID NO: 30347 - DNA, 1533 bp, Eremothecium gossypii
  CDS (1)..(1533)
atgtgtggcatattaggcgttgtgctagccgatcagtcgaaggtggtcgcccctgagttgtttgatggctcactgttcttacagcatcgcggtcaagatgctgccgggattgctacgtgcggccccggtgggcgcttgtaccaatgtaagggcaatggtatggcacgggacgtgttcacgcaagctcggatgtcagggttggttggctctatggggattgcacacctgagatatcccactgcaggctccagtgcgaactcagaagcgcagccattctatgtgaatagtccctacggaatttgcatgagtcataatggtaatctggtgaacacgatgtctctacgtagatatcttgatgaagacgttcaccgtcatattaacacggacagcgattctgagctactgcttaatatatttgccgcggagctggaaaagtacaacaaatatcgtgtgaacaacgatgatatattttgtgctctagagggtgtttacaaacgttgtcgcggtggctatgcttgtgttggcatgttggcgggatatggattgtttggtttccgggaccccaatgggatcaggccgctattgtttggtgagcgcgtcaacgatgacggcaccatggactacatgctagcgtccgaaagtgtcgttcttaaggcccaccgcttccaaaacatacgtgatattcttcccggccaagccgtcattatccctaaaacgtgcggctccagtccaccagagttccggcaggtagtgccaattgaggcctacaaaccggacttgtttgagtacgtgtatttcgctcgtgctgacagcgttctggacggtatttccgtttaccatacacgcctgttgatgggtatcaaacttgccgagaacatcaaaaaacagatcgatctggacgaaattgacgttgttgtatctgttcctgacactgcacgtacctgtgcattggagtgtgccaaccatttaaacaaaccttatcgcgaaggatttgtcaagaacagatatgttggaagaacatttatcatgccaaaccaaaaagagcgagtatcttctgtgcgccgcaagttgaacccaatgaactcagaatttaaagacaagcgcgtgctgattgtcgatgattccattgtgcgaggtaccacttccaaagagattgttaacatggcgaaggaatccggtgctgccaaggtctactttgcctctgcagcgccagcaattcgtttcaatcacatctacgggattgacctagcagatactaagcagcttgtcgcctacaacagaactgttgaagaaatcactgcggagctgggctgtgaccgcgtcatctatcaatctttggatgacctcatcgactgttgcaagacagacatcatctcagaatttgaagttggagttttcactggtaactacgttacaggtgttgaggatgtgtacttgcaggaattagaacgttgccgcgctcttaataactcgaataagggtgaagcgaaggccgaggttgatattggtctctacaattctgccgactattag

SEQ ID NO: 30348 - protein, 510 aa, Eremothecium gossypii
MCGILGVVLADQSKVVAPELFDGSLFLQHRGQDAAGIATCGPGGRLYQCKGNGMARDVFTQARMSGLVGSMGIAHLRYPTAGSSANSEAQPFYVNSPYGICMSHNGNLVNTMSLRRYLDEDVHRHINTDSDSELLLNIFAAELEKYNKYRVNNDDIFCALEGVYKRCRGGYACVGMLAGYGLFGFRDPNGIRPLLFGERVNDDGTMDYMLASESVVLKAHRFQNIRDILPGQAVIIPKTCGSSPPEFRQVVPIEAYKPDLFEYVYFARADSVLDGISVYHTRLLMGIKLAENIKKQIDLDEIDVVVSVPDTARTCALECANHLNKPYREGFVKNRYVGRTFIMPNQKERVSSVRRKLNPMNSEFKDKRVLIVDDSIVRGTTSKEIVNMAKESGAAKVYFASAAPAIRFNHIYGIDLADTKQLVAYNRTVEEITAELGCDRVIYQSLDDLIDCCKTDIISEFEVGVFTGNYVTGVEDVYLQELERCRALNNSNKGEAKAEVDIGLYNSADY

SEQ ID NO: 30349 - DNA, 1380 bp, Methanococcus maripaludis S2
  CDS (1)..(1380): transl_table=11
atgtgtggtatctttggaatttattctcatgaaaaaagtaacattgtaaaaaaagtgtactatggtctttacgcacttcaacacagggggcaagagggtgctggaattgctgttgggaacggtaaagaaataggattctataagggattgggattggttccagaagtattttcaaacaaggaattacaaaatttgtacggacacattggcgttggccatgtaaggtactctacaaccggcagaaatacaattgaaaactgtcagccatttgttgtaaacagttcttttggaaaaattgcaattactcacaatggggatattgtaaattcaaaagaattaaaacatgaactcgaaaaaaagggacatatctttgtttctacaacagattccgaagttattgctcaacttttggttcgagaacttttaaaaaatgatgacattattactgcagttacaaacgtgacgcaaaaattaaatggtgcttactctcttttaattatctatgacgatacattgattgcaataagggatccaaacggatttaagccgttatgcattggaaaagatgacggagcatactattttagttccgaaagctgtgctcttgacattgttgatgttgaatttgaaagggacgttgctcctggagaaatggttgtcgtagataaaaatggacttaacacctacaaactaccaaatgcaaaagaaaaagcatcttcctgcatgtttgaatacgtttattttgcaagacctgattcagtaattgatggagtaagcgtttacgaagtaagaagaaacattggaaaaattttagcaagggaagctcctgaagaagttgatattgtatccccagttcctgattctggaattattttttcgcaaggatacaccgaagaagcagaagttccttactacgaagctttaattaaaaataggtatattggaagaacatttatccttccaacgcaggaagaacgagatcttgcggtaagattgaagttaaaccctgtaaaataccttttaaaagataaaaaggtcatgttgattgatgacagtattgttcgtggaactacatctggaaaaataatgaagatggctaaaaaagcgggtgcaaaaaaggttcacttaagaatcggatccccaagaattatttcaccatgtttttatggaatagacatggctacaacaaaggaattaattgcaaactcaaaaactgacgaagaaatagctgaaatgatcggtgcagattcagttgcatatttaagtattgaaggattagtcgaagcaattggaagagatgacctttgtttagcatgtttaaacgaagaatatccaacagacgtttcctgtaaatttgaatgcggaaattgcaaaaaataa

SEQ ID NO: 30350 - protein, 459 aa, Methanococcus maripaludis S2
MCGIFGIYSHEKSNIVKKVYYGLYALQHRGQEGAGIAVGNGKEIGFYKGLGLVPEVFSNKELQNLYGHIGVGHVRYSTTGRNTIENCQPFVVNSSFGKIAITHNGDIVNSKELKHELEKKGHIFVSTTDSEVIAQLLVRELLKNDDIITAVTNVTQKLNGAYSLLIIYDDTLIAIRDPNGFKPLCIGKDDGAYYFSSESCALDIVDVEFERDVAPGEMVVVDKNGLNTYKLPNAKEKASSCMFEYVYFARPDSVIDGVSVYEVRRNIGKILAREAPEEVDIVSPVPDSGIIFSQGYTEEAEVPYYEALIKNRYIGRTFILPTQEERDLAVRLKLNPVKYLLKDKKVMLIDDSIVRGTTSGKIMKMAKKAGAKKVHLRIGSPRIISPCFYGIDMATTKELIANSKTDEEIAEMIGADSVAYLSIEGLVEAIGRDDLCLACLNEEYPTDVSCKFECGNCKK

SEQ ID NO: 30351 - DNA, 1527 bp, Xenopus tropicalis
  CDS (1)..(1527)
atggagtttgaggagctggggatacgggaggagtgcggtgtgttcggctgcatagcggcggggagctggcctacccagctggatgtgccccatgtcatcaccctgggattggttggactgcagcacaggggacaagagagtgctggcattgtaacaagtgatgggagctcggtgccaacatataaaatgcacaagggcatgggtatggttaaccacgtgttcagtgaagagagtctgaagaaattgcacatgagtaacctgggtattggccacaccagatactccaccagtgggaattctgccttagaaaactgccagccctttgtggttgaaacgttacatggaaagattgctgtagcacataatggggagctggtcaatgctgctcggctcaagcgaaaggtcatgcgtcacggcgtgggcctctccaccagttcagacagtgagctgatcacacagctgctggccttcactccgccacaggaggaagatcacactgctgattggattgcacgcattagaaacttaatgaatgagacaccgacatcatactcgctgcttgtcatgcataatgacgtcatatatgccatacgtgatccttatgggaaccggcctctctgcattgggcgcctgatgcctgtcaacaatgaaggaagaggaaagcgctctgctgagactgagggctgggtggtgtcatccgaatcctgcagctttttatctattggtgctgagtattaccgggaaatcctgccaggagaaatcgtaaagatttcaagagaaggagttcagaccctggatattgtgccgagaacaaatggagacccatctgccttctgcatctttgaatatgtctattttgcacgacctgattcaatttttgaagggcagatggtgtattcggtgagacggagatgtgggcagcagctagccatagaagctccagtagaagctgatctggtcagcacagtgccagaatctgcaaccccagcagcattaggctatgcagaaaagtgtggtcttcagtatgtggaggtgctgtgtaagaatcgctatgtaggacgaacgtttatccagcccaatatgaggttacggcagctgggagtggccaaaaagtttggagtcctctcagataactttgttggcaagcgagtggttctgattgatgattctattgtgagagggaatacgatctcccctatcataaagctgctcagggactctggagccaaagaggttcacattcgagtagcatcgccacctataaaatatccatgttacatgggaataaatattcccacaaaagaggagttgatagcaaatagaccagagtttaatgacttggctggttatattggtgcagacagtgttgtttacctctcagtggagggacttacggcggcggtccgggagggtgtcaaggccttcaaggatgagcagaatggaataaacggcaaaacaaaatcatcatctcatggtcactgcaccgcctgtctcacaggagaatatccagtggagctggagtggtga

SEQ ID NO: 30352 - protein, 508 aa, Xenopus tropicalis
MEFEELGIREECGVFGCIAAGSWPTQLDVPHVITLGLVGLQHRGQESAGIVTSDGSSVPTYKMHKGMGMVNHVFSEESLKKLHMSNLGIGHTRYSTSGNSALENCQPFVVETLHGKIAVAHNGELVNAARLKRKVMRHGVGLSTSSDSELITQLLAFTPPQEEDHTADWIARIRNLMNETPTSYSLLVMHNDVIYAIRDPYGNRPLCIGRLMPVNNEGRGKRSAETEGWVVSSESCSFLSIGAEYYREILPGEIVKISREGVQTLDIVPRTNGDPSAFCIFEYVYFARPDSIFEGQMVYSVRRRCGQQLAIEAPVEADLVSTVPESATPAALGYAEKCGLQYVEVLCKNRYVGRTFIQPNMRLRQLGVAKKFGVLSDNFVGKRVVLIDDSIVRGNTISPIIKLLRDSGAKEVHIRVASPPIKYPCYMGINIPTKEELIANRPEFNDLAGYIGADSVVYLSVEGLTAAVREGVKAFKDEQNGINGKTKSSSHGHCTACLTGEYPVELEW

SEQ ID NO: 30353 - DNA, 1641 bp, Neurospora crassa
  CDS (1)..(1641)
atgtgtggtattctcgcccttatcctcgcggataccgatgcgtcggacgcctctgccgatttgcacgagagcttgtactatcttcaacaccgtggtcaagatgcctgtggtatcgcgacctgtggttctggaggtagaatctttcagtgcaagggcaatggcatggcctccaaggtctttgacgacggcaagcgcacggtagaccttcccggctacatgggcattgcccatcttcgttacccgactgccggaactagctctagcgccgagagtcagcctttttacgtcaactcgccctacggcatctgcttcgcgcacaacggtaacctcatcaacgctcccgccctgcgcagctatctcgaccaagaggcccatcgtcatgtgaacaccgactcggacagcgagctgatgctcaacgtctttgccaacgccctgaacgagaccggcaaggcccgtgtcaacaccgacgacatcttcagtgccctcaagaagacgtacgagaggtgccaaggtggctgggccgtcactgctatgattgctggcttcggtatcttcgccttccgtgatcaatacggcatccgccccctcattatgggatcgcgtccctccagcaccctcgaaggcggtatcgactacatgttcgcttccgagagcattgctcttcgtcagctgggcttcagcaacttccaggatatcctcccgggacaagccgtgttcatccaaaagaacgggcagcctcaattccaccaggttgttgagcaaaaggcttactcccccgatatcttcgagtacgtttacttcgcccgcccggataccatcatggatggaatctccgtgcaccgcagcaggcagaacatgggcgtgaagcttgccaacaaggtcaaggagatcctcggagaggagggtgtcaaggagattgatgtgatcattcccgtcccggagaccagtaatactgccgctgccgtggtatcagagcagcttcggaaacccttctctaacggtttcgtcaagaaccgttacgtctaccgcaccttcatcttgcccggtcagaaggccaggcaaaagagcgtccggagaaagctcagcgccatggagtccgagttcaaggaccgtgtcgtcctgctcgtggacgactccattgtccgtggcaccaccagtagggagattgtgagcatggctcgtgaggctggtgcccgcaaggttatctttgctagctgtgctcctcccatcatctacccccacatttacggtatcgatctcgcttctccacaggagctcatcgcccacgagaagacaagaagcgacatcgccaagcacatcaatgccgatgatgtcatttaccaggaccttgccgaccttaaggcggcctgtactgaggcctctcctgatcaccagaagatcaccgactttgaagtgggtgtgttctgcggcaaataccagaccgacatccctgaaggttacttcgaccacctgaacgagagccgtggcacgaagcggaaggccgccgttgtgaacggcaccaacaaggtcttggtcgccaatagcggcccggtcaatgtttttacacccgaaccccctgcgctcatggagaaccccgagaacaggcaggatatcagcatccacaacattgccaactcctaa

SEQ ID NO: 30354 - protein, 546 aa, Neurospora crassa
MCGILALILADTDASDASADLHESLYYLQHRGQDACGIATCGSGGRIFQCKGNGMASKVFDDGKRTVDLPGYMGIAHLRYPTAGTSSSAESQPFYVNSPYGICFAHNGNLINAPALRSYLDQEAHRHVNTDSDSELMLNVFANALNETGKARVNTDDIFSALKKTYERCQGGWAVTAMIAGFGIFAFRDQYGIRPLIMGSRPSSTLEGGIDYMFASESIALRQLGFSNFQDILPGQAVFIQKNGQPQFHQVVEQKAYSPDIFEYVYFARPDTIMDGISVHRSRQNMGVKLANKVKEILGEEGVKEIDVIIPVPETSNTAAAVVSEQLRKPFSNGFVKNRYVYRTFILPGQKARQKSVRRKLSAMESEFKDRVVLLVDDSIVRGTTSREIVSMAREAGARKVIFASCAPPIIYPHIYGIDLASPQELIAHEKTRSDIAKHINADDVIYQDLADLKAACTEASPDHQKITDFEVGVFCGKYQTDIPEGYFDHLNESRGTKRKAAVVNGTNKVLVANSGPVNVFTPEPPALMENPENRQDISIHNIANS

SEQ ID NO: 30355 - DNA, 1578 bp, Apis mellifera
  CDS (1)..(1578)
atgcaaacaaactcttgtaatcggataatatctcaggaaaataaaagagttaaagcattccaaaataaattgagagatgaaataataactggtcttacacatgaatgtggagtttttggatgtattgctgcaggtgattggccatctcaaattgatgttgctcaagtaatttgtttgggtttagtagcattacaacatagaggtcaagaaagtgcaggtattgttacaagtgagggtgtatgttcgaaatcttttcatgtccataagggcatgggtatgattaataacatttttaatgatgaaaacatgaaaaaactaaatggaaatcttggaattggtcatactagatatagtacaagtgcagcaagtgaagaagttaattgtcaaccatttgtggttcatacagcacatggagcattagcagttgctcacaatggagaattagtaaatacagaatcattgagaaaaatggtattaggacgtggagtaggtttatcaacatattcagattctgaattaataacacaagcactttgtttaaatcctcctgaaggtgaagttaatggtccagattggccagcacgaataaaacaccttatgcaattagcaccattatcatattcattagtaattatgcagagagacaagatatatggtgttagagatccttatggaaatcgcccattatgtcttggaaaaattgttcctattggtaatttgggaaatgaatcagatgatgatgatgaagctgaaggttgggttatatcatctgaatcatgtggctttttaagtattggagcacgatatgtgcgtgaagtatttcctggagagattgtagaattgacacgggagggtataaaaactattgatattgttgatagaccagataaaaagcctcaagcattctgcatttttgaatatgtttattttgcacgtagtgatagtatttttgaaggacaaatggtttattctgttcgaatgcaatgtggtcgagaacttgctttagaatctccaatagaagcagatatagttagttcagtacctgaatctggaactgcagcagcacatggatatgccagacagtctcaaataccgtttgcggaagtattatgcaaaaatagatatgttggtagaacatttattcaacctagtacacgactcagacaacttggtgtagcaaagaaatttggagctttatcagaaaatgtaaaaggaaaaaaattaattcttatagatgattcaattgttagaggaaatactattggacctattattaagttacttcgtgatgcaggagcaaaagaagttcatattaggatagcttctcctccattaaaatatccttgctatatgggaattaacattccaactagagaagagttaattgctaataaattggataatgtaaaattagcaaaacatgttggagctgatagcttaacatatctttcagtagatggacttgtaaaagctgtaagatttggtatggataatcgtgaaagcagttatattggtcattgtactgcttgtttaacaggagattatcctgatgaacttcctagtaatttagattggtaa

SEQ ID NO: 30356 - protein, 525 aa, Apis mellifera
MQTNSCNRIISQENKRVKAFQNKLRDEIITGLTHECGVFGCIAAGDWPSQIDVAQVICLGLVALQHRGQESAGIVTSEGVCSKSFHVHKGMGMINNIFNDENMKKLNGNLGIGHTRYSTSAASEEVNCQPFVVHTAHGALAVAHNGELVNTESLRKMVLGRGVGLSTYSDSELITQALCLNPPEGEVNGPDWPARIKHLMQLAPLSYSLVIMQRDKIYGVRDPYGNRPLCLGKIVPIGNLGNESDDDDEAEGWVISSESCGFLSIGARYVREVFPGEIVELTREGIKTIDIVDRPDKKPQAFCIFEYVYFARSDSIFEGQMVYSVRMQCGRELALESPIEADIVSSVPESGTAAAHGYARQSQIPFAEVLCKNRYVGRTFIQPSTRLRQLGVAKKFGALSENVKGKKLILIDDSIVRGNTIGPIIKLLRDAGAKEVHIRIASPPLKYPCYMGINIPTREELIANKLDNVKLAKHVGADSLTYLSVDGLVKAVRFGMDNRESSYIGHCTACLTGDYPDELPSNLDW

SEQ ID NO: 30357 - DNA, 1473 bp, Leptospira interrogans serovar Copenhageni str. Fiocruz L1-130
  CDS (1)..(1473): transl_table=11
atgagtcgaattcccgataaatccagaataagaagacaagcccaggatgacaaaccaaaagaggaatgtgcgatttttggtatatttaattcatcggaggcttctaatttcacctatttaggtctttactcgatgcaacatcgggggcaggaatcgagcggaatcgtttcttcggacggggaacacttatatcgttatgctggaatgggcttggtggctcatatctttacggaaaccaaattaaaggaactgcaaggaaatgcggctatcggccacaatcgatattctacaactggggcttcttttttaagaaatgctcagcctcttcgagtagaatcccacttaggagccgtttctttggctcataatggaaatttggttaattcttgggaacttagaagccaactcgaaaaagaaggaagtatctttcagactacgattgattccgaagtaattgttcatctaatggctcgttctggagaaacggactttctttctgctctttcttccgctcttaaaaaagtaagaggggcatattcacttgtaattcttacaaaaacccaattgattgcagtcagagatccaaatgggtttcgtcctttagtgatgggtcgtcgagaagacggatcgatcgtatttgcttcggaaacctgtgcgtttgatattacggatacgaaatatgaaagagatgtagaaccgggcgagatgatcgtagttgataagaatggaatgaattcttattatccgtttccaaaagcttccccgagtctttgtatttttgagtatatctatttcgcaagacccgattctagtatctttggagagtcggtttataaagttcgaaagaatttaggaagatttttagctagagaattacccgttccagcggatgtagtcattccagttccggactctgccaacatagctgcgttaggttatgcagaagaatctggaatttcttatcaatctggtttgatccgttctcattacatcggtagaacttttatagagccggatcagaaaattcgggattttggagctaagattaaatacaatgtagttcgaaacgtagtcgaaggaaaaagggtgatcgtagttgacgattcgattatgagaggaacgacgagtcgaaaaatcatcaaaatgattcgaaatgctggcgctaaagaaattcatcttagagtttctgcacctcctactatatcaccttgttattatggaatcgatattcctactcataacgaattgatcgcggcgactcacacgatcgaagaaattcgaaagtatttaagagtggatagtatcgcttatctttccgtcgagtctatgaaccgtgccgtaatggatcataaaggtggtgggttttgtaacgcgtgttttacggctcaatacccagtggagtttcagagcgagttaggaaaccagaaaagtctttttaaagaatatcaagtggaagaaagggtcgtttattga

SEQ ID NO: 30358 - protein, 490 aa, Leptospira interrogans serovar Copenhageni str. Fiocruz L1-130
MSRIPDKSRIRRQAQDDKPKEECAIFGIFNSSEASNFTYLGLYSMQHRGQESSGIVSSDGEHLYRYAGMGLVAHIFTETKLKELQGNAAIGHNRYSTTGASFLRNAQPLRVESHLGAVSLAHNGNLVNSWELRSQLEKEGSIFQTTIDSEVIVHLMARSGETDFLSALSSALKKVRGAYSLVILTKTQLIAVRDPNGFRPLVMGRREDGSIVFASETCAFDITDTKYERDVEPGEMIVVDKNGMNSYYPFPKASPSLCIFEYIYFARPDSSIFGESVYKVRKNLGRFLARELPVPADVVIPVPDSANIAALGYAEESGISYQSGLIRSHYIGRTFIEPDQKIRDFGAKIKYNVVRNVVEGKRVIVVDDSIMRGTTSRKIIKMIRNAGAKEIHLRVSAPPTISPCYYGIDIPTHNELIAATHTIEEIRKYLRVDSIAYLSVESMNRAVMDHKGGGFCNACFTAQYPVEFQSELGNQKSLFKEYQVEERVVY

SEQ ID NO: 30359 - DNA, 1392 bp, Thermus thermophilus HB27
  CDS (1)..(1392): transl_table=11
atggataagccccaggaggagtgcggcatcctcgggctttggagcgaaggccccgtggacgtggcggggcttctccacctcggcctcctcgccctgcagcacaggggccaggaggcggcggggatggcggtcacggacggcaaagcgttcctggtggaaaaggacctgggcctcgtgaaccaggtcttcaccgaggagcgcctggggaagctccgccttccggaggcccgcctgggcatcgcccacacccgctactccaccacgggctccaacctgcgcatcaacgcccagcccctcaccgcccgcaccgcccacggggtcttggccatcgcccacaacggcaacttcaccaacgccaagctcctccgcgaccggctcctcctggagggggccaccttccagagcacctcggacaccgaggtgatgctcctcctcctcgcccgcatgggccacctccccctccccgaggccgccgcccaggccatgcggctccttcagggggggtattccatcctcctcatgaaccgcaagaccctcctcgccctccgcgacccccacggggtgaggcccctcgtcctcggcaaggccccctggggctacgccttcgcctccgagcccccggccctcctcctcatgggggcggagtacgtgcgggacgtgcgccccggggaggtggtctgggtggaggagggaaggctccaaagcctccaggccctccccccagagcccgccccctgcgcttttgagtggatctacttcgcccggcccgacagcgtcctggacggcaccgaggcctacgaggcccgggtgaggatggggatggagctcttccgggaggcccccgcagaggccgacctcgtggtccccgtccccgactcgggcatcggggccgccgtgggctacgccaaggcgagcgggctccccctggagttcggcctctacaagaacccctacgccgggcgcaccttcatccagcccacccaggagctccgcgacctgaagacgaggctcaagctctcccccacgggggcggtgaagggcaagcgggtggtcctggtggacgactccatcgtccggggcaccacgagccgccgcatcgtgcgcatgctcaaggaggcgggggccctcgaggtccacttccgcgtctctagcccccccatccgcttcccctgctactacggcatagacaccgcggcccgcaaggagctcatcgccgcggagaagagcgtggaggagatccaggcctacatcggggcggactctttggccttcctctcggaggagggggtcaagcgggccatcgggcggcccgtctgcctcgcctgcttcaacgggcgctacccggcgggggtgcccgaggagggggaaaagctcgccctagagcttctctag

SEQ ID NO: 30360 - protein, 463 aa, Thermus thermophilus HB27
MDKPQEECGILGLWSEGPVDVAGLLHLGLLALQHRGQEAAGMAVTDGKAFLVEKDLGLVNQVFTEERLGKLRLPEARLGIAHTRYSTTGSNLRINAQPLTARTAHGVLAIAHNGNFTNAKLLRDRLLLEGATFQSTSDTEVMLLLLARMGHLPLPEAAAQAMRLLQGGYSILLMNRKTLLALRDPHGVRPLVLGKAPWGYAFASEPPALLLMGAEYVRDVRPGEVVWVEEGRLQSLQALPPEPAPCAFEWIYFARPDSVLDGTEAYEARVRMGMELFREAPAEADLVVPVPDSGIGAAVGYAKASGLPLEFGLYKNPYAGRTFIQPTQELRDLKTRLKLSPTGAVKGKRVVLVDDSIVRGTTSRRIVRMLKEAGALEVHFRVSSPPIRFPCYYGIDTAARKELIAAEKSVEEIQAYIGADSLAFLSEEGVKRAIGRPVCLACFNGRYPAGVPEEGEKLALELL

SEQ ID NO: 30361 - DNA, 1389 bp, Desulfovibrio vulgaris subsp. vulgaris str. Hildenborough
  CDS (1)..(1389): transl_table=11
atgatccggcattactgcggcatcttcggcatctacaaccatgccgaggccgcccgtctttcctacttcggcctctacgccctgcaacaccgcgggcaggagagcgccggcatcgtgacgtgggacggacagaaactgcgtgaacaccgcggcatgggtctcgtgcccgaggtcttcaacgaacgccacctcggcaaggaactcaagggcgacatcgccatcgggcatatccggtactccaccacgggcgcgtcgctcatccgcaacgcgcagccgttcatcgtgcgctacaagggtctcgagatcgccatcgcgcacaacggcaacctcgtgaacacgctggaattgcggcgcgaactggaggaacagggctccatcttccagacctccatcgacagcgaggtgttcgtgcacctcatcgcccgcaacctcaacgggcatacgctcgaagaggccgtcatggcggcatgccgcaaggtgaaaggggcctacgccctgctcatcctcgccaacaacaagctcatcgccgtacgcgacccgcacgggttccgtccgctggcgctgggccgcgtggcgggtgcgcatgtgttcgcgtccgagacgtgcgccttcgacctgctggaagcagagttcatacgctcgctcgacccgggcgagatggtggtcatcgaagatacgaaggtgcaaagctacaagattgagaccgaagcccccacacgccagtgcatcttcgagctcatctacttcgcacggcccgactcgctggtcttcggtgaagacgtgtaccagtgccgcaagcgcatggggcaggaactggcccgcgaatcggcccccgatgtggacttcgtgatgcccttcccggactcgggggtctacagcgccgtcggcttcgcgcaggagtcggggctgccctacgaacacgccatgatccgcaaccactatgtggggcgcaccttcatccagccctcgcaggacatgcgcgacttcagcgtccgggtgaagatcaacccggtgaagagcatgatcaagggcaagcgcatctgcatcgtggacgactccatcgtgcgcggaaccaccatccggacgcgcgtgaagaaactgcgagaactgggtgcgcgtgaagtccacttcagggtgagctgcccgcccatcaagttcccgtgcttctacggcatcgacttcgcctccaagggcgaactcatcgccgccaatcatagcgtatccgaaatcgaacgcttcatcggcatcgattcgctgcactacatcaccatcgaagggctgctgcgctcggtctcgcatcccgagaactactgtctcgcgtgcttcaccggcgactatcccatcccttgcgccggtggcggcaaactctgccttgaatgcggctgctag

SEQ ID NO: 30362 - protein, 462 aa, Desulfovibrio vulgaris subsp. vulgaris str. Hildenborough
MIRHYCGIFGIYNHAEAARLSYFGLYALQHRGQESAGIVTWDGQKLREHRGMGLVPEVFNERHLGKELKGDIAIGHIRYSTTGASLIRNAQPFIVRYKGLEIAIAHNGNLVNTLELRRELEEQGSIFQTSIDSEVFVHLIARNLNGHTLEEAVMAACRKVKGAYALLILANNKLIAVRDPHGFRPLALGRVAGAHVFASETCAFDLLEAEFIRSLDPGEMVVIEDTKVQSYKIETEAPTRQCIFELIYFARPDSLVFGEDVYQCRKRMGQELARESAPDVDFVMPFPDSGVYSAVGFAQESGLPYEHAMIRNHYVGRTFIQPSQDMRDFSVRVKINPVKSMIKGKRICIVDDSIVRGTTIRTRVKKLRELGAREVHFRVSCPPIKFPCFYGIDFASKGELIAANHSVSEIERFIGIDSLHYITIEGLLRSVSHPENYCLACFTGDYPIPCAGGGKLCLECGC

SEQ ID NO: 30363 - DNA, 1428 bp, Listeria monocytogenes str. 4b F2365
  CDS (1)..(1428): transl_table=11
atgcttgctgaagtaaaaggacttaacgaagaatgtggtatttttggtatttgggatcatcctaatgcagcggaaatcacctattatgggttgcatagtttacaacatcgcggtcaagaaggtgccggaattgtttcgacagacggtgaaacactaaaaggtcaccgaaatctcggccttttagcagatgtatttaagcatggtgaactagacgatttaaaaggtaaagcagccattggccacgttcgatatgcgacagctggtcaaaaaaacttagggaacgtacaaccatttttatttcactttcatagttcttctttagcacttgcgcataatggaaatttggttaatgcgaaaagtttacgccgtgaactagaagaagaaggcgctatttttcaaacgagttcggatacagaagtgttagcgcatttaattaaacgtagccatacaggtgattttgtggaagatttaaaagtggctttgaacaaggttaagggtggctttgcgtacatgcttctgacggaagacacgatgtatgcggcgcttgacccgaatggttttagaccgctttcgataggtcgcattggtgattcttacgtagttgcttcggaaacatgtgcctttgaaacggttggcgctgagtttgtccgcgatgtggagccaggtgaactaattattattaatgatgacgggcttcgaattgaaaaattcacggaaaatgtgacgcattcgatttgcagtatggaatacatttattttgcgcgacctgactctaatattgctggaattaatgtccactcggcaagaaaacgttctgggaaaagattagcaaaagaggcttttattgatgcagatgtggttacaggtgtaccagattccagtatttctgcagcgattggttatgcggaggaagctggtcttccttacgaacttggtctcatcaaaaatagatatgtggcaagaacttttatccagccatcacaagaacttagggaacaaggcgttagaatgaaactttctgccgtgcgcggggttgtggaaggaaaacgcgttgtcatgattgatgattcgattgttcgcgggacgacaagtaaacgcattgtccagcttttacgtgaagcaggagcggcggaagttcatgtaagaatcgcttctccaccacttgcttatccttgtttttatggaattgatatccaaacgcgaaatgaattaatcgcttctaattattctgttgatgaaatttgtcggattattggggctgattctttagagtatttgagtgaagaaggtttagtagattccattggcagaccttatccgaacgaaccttacgggggactttgtatggcttatttcaacggcgattacccaacccctttatatgattatgaagcggaatatttagcgagcttagaagcagaaaaataa

SEQ ID NO: 30364 - protein, 475 aa, Listeria monocytogenes str. 4b F2365
MLAEVKGLNEECGIFGIWDHPNAAEITYYGLHSLQHRGQEGAGIVSTDGETLKGHRNLGLLADVFKHGELDDLKGKAAIGHVRYATAGQKNLGNVQPFLFHFHSSSLALAHNGNLVNAKSLRRELEEEGAIFQTSSDTEVLAHLIKRSHTGDFVEDLKVALNKVKGGFAYMLLTEDTMYAALDPNGFRPLSIGRIGDSYVVASETCAFETVGAEFVRDVEPGELIIINDDGLRIEKFTENVTHSICSMEYIYFARPDSNIAGINVHSARKRSGKRLAKEAFIDADVVTGVPDSSISAAIGYAEEAGLPYELGLIKNRYVARTFIQPSQELREQGVRMKLSAVRGVVEGKRVVMIDDSIVRGTTSKRIVQLLREAGAAEVHVRIASPPLAYPCFYGIDIQTRNELIASNYSVDEICRIIGADSLEYLSEEGLVDSIGRPYPNEPYGGLCMAYFNGDYPTPLYDYEAEYLASLEAEK

SEQ ID NO: 30365 - DNA, 1383 bp, Picrophilus torridus DSM 9790
  CDS (1)..(1383): transl_table=11
gtggattcccagccccaagaatcagacattacaactgggcaaaaagtaaatgaggattgtgccgtcatcggcttttccggcggcggcgtatattcaagtattatagccggtctcaggtcattgcagcatcgcggccaggagagctctggaataataacatacgatggaaagatccacgttaaaaagggtatgggtcttgtcagtgaggtttttaaaaatgccgatccaatgcctggaattgttggtataggccataacaggtattcaacctcgggatcaaagggcatagaaaatgcaggtccttttgttatatcatgctcccttggatacataggcataacacataatggtgagataacaaatgagcatgaactaagggaggaattaaagcatgatggatacatcttcacaagctccagtgatacagaggtaatgttaatagaatttgtcaaggagatatcaagatatggaatcaatgagggtattaaaaggggcatggagcgtttaaagggcgcatatgctgcagtattaatgataaatgacaggctttatgccataagggataagtttggttttaggcccctggtccttggcagaacatttaatggttatataatagcatcagagacctgtgccattgatgcattatctggagagacaataaaaaatgttgaacccggtgaggttatagaggtttttaacaattcttacaaaaccatttttaaattagatggtgacgtctcacactgcatgtttgaatacgtttactttgccagacctgacagtataatagacaatatagaggtctttcaggccagggtcaggatgggcatgaggcttgccgttgaatcgcctgttgatgccgatgtcgttgttcctgttccggactctggaagggcccaggcgcttggcttttcaaaggccacgggaataccatacagcgagggtcttataaagaacagatattcagaaaggacatttataatgcccgatcaaaaaagcaggcttgcagcaataaagataaaattgaatgcaataaaatcagaaatatcaaataaaaggatagtccttgttgatgacagcatagtacgtggaaatacaatgaaatacatagttaaaattgtcagggatgccggggccagtgaggttcatgttagaataagctctccaccgataaccgcaccatgcttctatggtgttgatatgaagacaaagaatgaattcatagctgcaaataaaacaatagaaagtataaaaaatgagataggtgcggattccctggcgtacctgtcaatagatggtcttaaacaggccataggaataaaaagcatatgcattagctgtttaacaggtatctatccagagtatgttccattatcttaa

SEQ ID NO: 30366 - protein, 460 aa, Picrophilus torridus DSM 9790
MDSQPQESDITTGQKVNEDCAVIGFSGGGVYSSIIAGLRSLQHRGQESSGIITYDGKIHVKKGMGLVSEVFKNADPMPGIVGIGHNRYSTSGSKGIENAGPFVISCSLGYIGITHNGEITNEHELREELKHDGYIFTSSSDTEVMLIEFVKEISRYGINEGIKRGMERLKGAYAAVLMINDRLYAIRDKFGFRPLVLGRTFNGYIIASETCAIDALSGETIKNVEPGEVIEVFNNSYKTIFKLDGDVSHCMFEYVYFARPDSIIDNIEVFQARVRMGMRLAVESPVDADVVVPVPDSGRAQALGFSKATGIPYSEGLIKNRYSERTFIMPDQKSRLAAIKIKLNAIKSEISNKRIVLVDDSIVRGNTMKYIVKIVRDAGASEVHVRISSPPITAPCFYGVDMKTKNEFIAANKTIESIKNEIGADSLAYLSIDGLKQAIGIKSICISCLTGIYPEYVPLS

SEQ ID NO: 30367 - DNA, 1416 bp, Bacillus anthracis str. Sterne
  CDS (1)..(1416): transl_table=11
atgcttgctgaaataaaggggttaaacgaagaatgtggcgtattcggaatttgggggcatgaaaatgcggcacaagtttcatactacggattgcacagtttacagcaccgtgggcaagaaggcgcaggcattgtcgtaaataatggggaaaaaatcgtcggtcacaaggggttaggtttaatatcggaagtgttttcaagaggtgagctagaaggattgaatggaaaatcagcaatcgggcatgtacgatacgcgacggctggtggaagtgaagtagctaacgttcaaccattattattccgtttttctgatcatagtatggcattagctcacaacggaaatttaattaatgcaaaaatgcttcgccgcgaattagaggcagagggaagtatttttcaaacaagttcagatacagaagtacttttacatcttattaaacgtagtacgaaagattcgttaattgaaagtgtaaaagaggctttaaataaagtgaaaggtgcgtttgcgtatcttttactaactggaaatgaaatgatcgttgcgttagatccgaatggtttccgtcctctttcaattggaaagatgggtgatgcttacgttgtagcatcagaaacatgtgctttcgatgtagtaggtgcaacatacattcgtgatgtagaaccgggtgaattacttatcatcaatgatgaaggaattcacgtagatcgttttacaaatgaagtagatcatgcaatttgtagtatggaatacatttactttgcacgaccagattctaatattgctggtattaacgtccatgcagcacgtaaaaacatgggaaaacgtttggcggcagaagctcctattgaagctgatgttgttactggtgtgccagactctagtatttcggcagcaattggttatgcggaggcgacaggtattccatatgagttaggattaattaaaaatcgttacgttggacgtacatttattcaaccttctcaagaactgcgcgagcaaggggttaagatgaagctttcagcagtaagaggggtagttgaaggaaaacgagttgttatgattgacgattctatcgtaagaggaacaacaagtaaacgaattgttcgcatgcttcgcgaggctggagcgacagaagttcacgtaagaattgcttcaccacctctgaaatatccatgcttctatggtattgatattcaaacgagaaaagaattaattgcagcaaatcatacggtagaagaaattcgtgaaatgatcggtgcagactcattaacatttttaagtgaagatggattagtagatgcaattggacgtccatatgaagggaaatatggcggcctatgtatggcttactttaatggggactatccaacagctctttatgattatgagcaagagcttttagaaagtatgaaataa

SEQ ID NO: 30368 - protein, 471 aa, Bacillus anthracis str. Sterne
MLAEIKGLNEECGVFGIWGHENAAQVSYYGLHSLQHRGQEGAGIVVNNGEKIVGHKGLGLISEVFSRGELEGLNGKSAIGHVRYATAGGSEVANVQPLLFRFSDHSMALAHNGNLINAKMLRRELEAEGSIFQTSSDTEVLLHLIKRSTKDSLIESVKEALNKVKGAFAYLLLTGNEMIVALDPNGFRPLSIGKMGDAYVVASETCAFDVVGATYIRDVEPGELLIINDEGIHVDRFTNEVDHAICSMEYIYFARPDSNIAGINVHAARKNMGKRLAAEAPIEADVVTGVPDSSISAAIGYAEATGIPYELGLIKNRYVGRTFIQPSQELREQGVKMKLSAVRGVVEGKRVVMIDDSIVRGTTSKRIVRMLREAGATEVHVRIASPPLKYPCFYGIDIQTRKELIAANHTVEEIREMIGADSLTFLSEDGLVDAIGRPYEGKYGGLCMAYFNGDYPTALYDYEQELLESMK

SEQ ID NO: 30369 - DNA, 1533 bp, Bartonella quintana str. Toulouse
  CDS (1)..(1533): transl_table=11
atgatcctaacccatttcttacatcatgaccgaaagaatacaatgacaaaaatggacattccctttcaagaattttcattggatggcgatactcttcatgaagaatgtggagtttttggtattctaggccatgaagatgccgcgactttaacagctcttgggctccatgcacttcagcatcgtgggcaagaagcagctggaattgtttcctatcataacaaaatgtttcatcaagaaaagcatctaggtcttgttggagatcactatacaaaccccgcaacacttgcgcgtttaccaggaaatcgcgctattgggcatacccgttattcaacaactggagaaacagtattacgcaatgtgcaacctctttttgctgagttaaaagctggaggtattgctattgcccataatggcaatcttaccaacggtcttacattacgccgggaactcattgcgtccggcgctatttgccaatcaacatcagattcagaagtttttcttcatctgattgctcgttcacgttatgaatcatcatctgatcgctttgttgatgctattcggcaagtccaaggtggatatgctatgttagcgctaacacgcaccaagctcattgccgcacgcgatccaacaggtattcgacctttggtaataggtgaacttgatggtaaaccaattttttgttccgaaacctgtgcacttgatattattggagcaaaatatgttcgtgatgtcaaaaatggagaaatcatcatatgtgagatacaaaaaaatggggaaatcactaaaaaaattataaaaccagagagtgagaaaccagaaaaactgtgcctttttgaatatgtctattttgcgcgccctgattcaatcgttggaggtcggaatgtttacatgacacgtaaaaatatggggacctatttggcacaagaagcaccctgtgagggtgatgttgtggttcccgttcctgatggaggaacacctgccgcaattggctatgcacaagaaattggaatcccctttgaacttggtatcattcgtaatcattacgttggacgcacttttatcgaaccaacacagcaaattcgtgcttttggagttaaattgaagcattctgcaaaccgtcctgtcatcgaaggaaaacgcgttattctggttgatgactccattgtacgtggaacaacatccgtcaaaattgtgcgaatgctccgggatgcaggagcaaaagaagttcacatgcgcatttctagccctatgattttctatccagatttttatggcattgatacacctaacgttgaaagccttttggctaatcaatatccagacttaaaatccatgtgcaattttgttggagctgactcattagaatttctttcaacagatggtctataccttgctgtggccggagaaaaacgaaataacgctgatccacaatttactgaccattattttaccggacattatcctacacatctggttgatcaagaaagtatcccccaaattcatcaactctctgtcctaaaaacaagagattaa

SEQ ID NO: 30370 - protein, 510 aa, Bartonella quintana str. Toulouse
MILTHFLHHDRKNTMTKMDIPFQEFSLDGDTLHEECGVFGILGHEDAATLTALGLHALQHRGQEAAGIVSYHNKMFHQEKHLGLVGDHYTNPATLARLPGNRAIGHTRYSTTGETVLRNVQPLFAELKAGGIAIAHNGNLTNGLTLRRELIASGAICQSTSDSEVFLHLIARSRYESSSDRFVDAIRQVQGGYAMLALTRTKLIAARDPTGIRPLVIGELDGKPIFCSETCALDIIGAKYVRDVKNGEIIICEIQKNGEITKKIIKPESEKPEKLCLFEYVYFARPDSIVGGRNVYMTRKNMGTYLAQEAPCEGDVVVPVPDGGTPAAIGYAQEIGIPFELGIIRNHYVGRTFIEPTQQIRAFGVKLKHSANRPVIEGKRVILVDDSIVRGTTSVKIVRMLRDAGAKEVHMRISSPMIFYPDFYGIDTPNVESLLANQYPDLKSMCNFVGADSLEFLSTDGLYLAVAGEKRNNADPQFTDHYFTGHYPTHLVDQESIPQIHQLSVLKTRD

SEQ ID NO: 30371 - DNA, 1527 bp, Bartonella henselae str. Houston-1
  CDS (1)..(1527): transl_table=11
atgaaccgtttctcacatcataatcgaaagaatacgatgacaaaaatcgacattccatttcaggagttttcattgaatgacgatacccttcatgaagaatgcggagtctttggtattcttggccatgaggatgcagcgactttaacagctcttggacttcacgcgcttcaacatcgtggacaagaagcagctgggattgtttcttaccataataaaatgtttcatcaagaaaagcatctaggtcttgttggtgatcattatacaaaccccgcaacacttgcgcgtttaccgggaaatcgcgctatcgggcatacccgttattcaacaactggagaaatagcattacgcaatgtgcaacccctttttgctgagttaaaagctggaggtattgccattgcccataatggcaatcttactaacggtcttacattacgccgagaactcattgcttccggtgctatctgccaatcaacatcagattctgaagtttttcttcatcttattgctcgttcacgttatgaatcgtcgtcagatcgctttgttgatgctattcgaaaagtggaaggtggttatgccatgttagcgctcacacgcaccaaactgattgctgcgcgtgatccaataggtattcgacctctggtgatgggtgaacttcatggtaaaccaatattttgttccgaaacctgtgcccttgatattattggagcaaaatatattcgcgatgttaaaaatggagaagtcatcgtatgtgaaatacaaaaaaatggggaaatcaccacaaaaattataaaaccagaaaataagaaaccagaaaaactttgcctttttgaatatgtctattttgcgcgtcctgattcaatcgtcggaggacgaagtgtttatatgacacgtaaaaatatgggtatccgtttagctcaagaagccccctgtgaaggtgatattgtggttcctgttcctgacgggggaacacccgctgcaattggttatgcccaagaaattggaattccctttgagcttggtattattcgtaatcattacgtcggacgcacatttatcgaaccaacacaacaaattcgcgcttttggggttaaattaaagcattctgcaaatcgtcctgttattgaaggaaaacgtgtcattctggtcgatgactccattgtacgaggaacaacatccgttaaaattgtgcaaatgctccgcgatgcaggagcaaaagaagttcatatgcgcatctctagtcctatgattttctatcccgatttctatggtattgatacacctaaagttgaaagtttgttggctaatcaatatccagatttaaaagctatgtgcaattttgttggagctgactcattagaatttctttcaacaaatggtctatatcttgctgtgataggagaaaaacgaaataatgctgatccacaatttactgaccattattttactggagattatcctacacatctagtcgatcaagaaagtattcctaaaatttatcaatcatctgtcctaaaaacaagagattaa

SEQ ID NO: 30372 - protein, 508 aa, Bartonella henselae str. Houston-1
MNRFSHHNRKNTMTKIDIPFQEFSLNDDTLHEECGVFGILGHEDAATLTALGLHALQHRGQEAAGIVSYHNKMFHQEKHLGLVGDHYTNPATLARLPGNRAIGHTRYSTTGEIALRNVQPLFAELKAGGIAIAHNGNLTNGLTLRRELIASGAICQSTSDSEVFLHLIARSRYESSSDRFVDAIRKVEGGYAMLALTRTKLIAARDPIGIRPLVMGELHGKPIFCSETCALDIIGAKYIRDVKNGEVIVCEIQKNGEITTKIIKPENKKPEKLCLFEYVYFARPDSIVGGRSVYMTRKNMGIRLAQEAPCEGDIVVPVPDGGTPAAIGYAQEIGIPFELGIIRNHYVGRTFIEPTQQIRAFGVKLKHSANRPVIEGKRVILVDDSIVRGTTSVKIVQMLRDAGAKEVHMRISSPMIFYPDFYGIDTPKVESLLANQYPDLKAMCNFVGADSLEFLSTNGLYLAVIGEKRNNADPQFTDHYFTGDYPTHLVDQESIPKIYQSSVLKTRD

SEQ ID NO: 30373 - DNA, 1485 bp, Staphylococcus aureus subsp. aureus MRSA252
  CDS (1)..(1485): transl_table=11
atgtttaactactcaggattaaacgaagaatgtggcgtgtttggtatttggaatcatcctgaagcagcgcaactaacatatatgggacttcatagtttgcaacatcgtggtcaagaaggtgcaggtatagttgtttctgatcaaaatgaattaaaaggcgagcgaggattaggcttactaactgaagcgattaaagatgaccaaatggaacgattaaaaggatatcaacatgcaattggtcacgtccgttatgctacttcaggtaataaaggtattgaaaatattcaaccgcttctgtatcacttttatgatatgagtgtaggtatttgtcataatggtaacctcattaatgctaaatcattacgtcaaaatttagaaaaacaaggtgctatcttccattcgtcttcagatacagaagttattatgcatttgattcgacgcagtaaggcgccaacttttgaagaagcattaaaagaaagtcttcgaaaaattaaaggtggttttacatttgcaattttaacaaaggatgcgttatatggcgcagtagatccaaatgctatcagaccacttgttgtaggtaaaatgaaagatgggacatacatccttgcaagtgaaacatgtgcaattgatgtgttaggtgcagaattcgttcaagatattcatgcgggtgaatatgtcgtgattaatgataaaggtattacagttaaatcttatacacatcatacgacaactgcaatttctgcgatggaatatatttattttgcgagaccagattcaacgattgctggtaaaaatgttcatgcagtgcgtaaggcttcaggtaaaatgttagcacaagaaagtccggtaaaagctgatatggtcatcggtgtacctaattcatcattatctgcagcgagcggttatgctgaagaaatcggtttgccatatgaaatgggactagttaaaaatcaatatgttgcaagaacatttattcaaccaacgcaagagttacgtgaacaaggtgtaagagttaagctatctgcagtgaaagatattgtagacggtaaaaatattattcttgttgatgattccattgttcgaggtacgacaattcgacgtattgtgaaaatgttaaaagattctggtgcaaataaagtgcatgtgcgtatagcatcaccggaatttatgttcccaagtttttatggaatcgatgtttcaactacggcagaattaatttctgcaagcaaatcacctgaagaaattaaagattatattggcgctgattcgttagcatatctatctgtagatgggttaattgaatcaattggtttagattatgacgcgccatatagtggcttatgtgtagaaagtttcactggagattatcctgcagggttatatgattatgaagcaaattataaagcacatttaagtcatcgacaaaagcaatatatttctaaaaacaaacactattttgatagcgagggaaatttaaatgtctaa

SEQ ID NO: 30374 - protein, 494 aa, Staphylococcus aureus subsp. aureus MRSA252
MFNYSGLNEECGVFGIWNHPEAAQLTYMGLHSLQHRGQEGAGIVVSDQNELKGERGLGLLTEAIKDDQMERLKGYQHAIGHVRYATSGNKGIENIQPLLYHFYDMSVGICHNGNLINAKSLRQNLEKQGAIFHSSSDTEVIMHLIRRSKAPTFEEALKESLRKIKGGFTFAILTKDALYGAVDPNAIRPLVVGKMKDGTYILASETCAIDVLGAEFVQDIHAGEYVVINDKGITVKSYTHHTTTAISAMEYIYFARPDSTIAGKNVHAVRKASGKMLAQESPVKADMVIGVPNSSLSAASGYAEEIGLPYEMGLVKNQYVARTFIQPTQELREQGVRVKLSAVKDIVDGKNIILVDDSIVRGTTIRRIVKMLKDSGANKVHVRIASPEFMFPSFYGIDVSTTAELISASKSPEEIKDYIGADSLAYLSVDGLIESIGLDYDAPYSGLCVESFTGDYPAGLYDYEANYKAHLSHRQKQYISKNKHYFDSEGNLNV

SEQ ID NO: 30375 - DNA, 1539 bp, Acinetobacter sp. ADP1
  CDS (1)..(1539): transl_table=11
atgtgtggagtagttggtatagccggtaaagcgccagttaaccaaatgttgtttgatgcattaacgatgttgcagcatcgggggcaagatgcagctgggattgtaacctgccatgatggccgtttatttctcagaaaagacaatggaatggtgcgtgatgtattccatactcgtcatatgcgtgctttgatcggtaattacggtattggtcatgtgcgctatccaactgcgggttcctcaagtagtgctgaggcacaacctttttatgtgaattcaccctatggaattacgcttgcacacaatggtaatctgaccaacgctgaagaaattcacgatgatctgtttaaaacagatttgcgtcatatgaatacagattccgattccgaagttttgcttaacgtgtttgcgcacgaattgcaaaagagcggcaagttatcgcctacatcagaagatgtattccatgcggtttctcgtgtgcatgagcgctgcaagggtgcttatggcgtagttgcgatgatcactggacatggtcttgttggtttccgtgatccaaatgggattcgaccattaatttatggttcgcgtgaaactgaaaagggcgttgaatatattattgcctctgagtctgttgcaattacagcactcggattcaaaattgaacgcgatattcagccaggcgaagcaattttcatcaatgatcagggtgaattgtttacaaagcaatgtgctacaaatccacagcatcgcccatgtatctttgaatatgtttattttgcgcgtccagatgccattattgatggtatttctgtgtataaagcccgtttaaagatgggtgagaagctggcaaataaaatcttgcgcgagtggggtgaagatcacggaattgatgtcgtaattccaattccagatacaagtcgtacatcagcacttgaactggcgaatattctaggtgtgaaattccgtgaaggttttatgaaaaaccgttatatcggacgtacctttattatgccagggcagcaacaacgtaaaaaatcggtacgtcaaaagctgaacccagttgagcttgaatttaaaggtaaaaatgtattgcttgtagacgattcaatcgttcgcggtaccacctgtaatgaaattattcaaatggcgcgtgattctggtgctaaaaaggtatattttgcctctgctgcacctatggtgaagtatccaaatgtctatggtattgatatgcctgccaagacagaactgattgcttcgcaacgtagtgttgaagagattcgtgaaattatcggtgcagaccgtttggttttccaagacctggatgatctaaaaagtgctgtacgtaccaccaaagtacctgatctgacagagtttgatagttctgtttttgatggagtgtatgtggcaggtgggattgataaggcttatcttgaaaaccttgagaagaagcgcaacgatactgccaaaaatgcagcggatagttatattgatgtgaatatcgatgctgcttctgtggatttgactggaattcgagagctataa

SEQ ID NO: 30376 - protein, 512 aa, Acinetobacter sp. ADP1
MCGVVGIAGKAPVNQMLFDALTMLQHRGQDAAGIVTCHDGRLFLRKDNGMVRDVFHTRHMRALIGNYGIGHVRYPTAGSSSSAEAQPFYVNSPYGITLAHNGNLTNAEEIHDDLFKTDLRHMNTDSDSEVLLNVFAHELQKSGKLSPTSEDVFHAVSRVHERCKGAYGVVAMITGHGLVGFRDPNGIRPLIYGSRETEKGVEYIIASESVAITALGFKIERDIQPGEAIFINDQGELFTKQCATNPQHRPCIFEYVYFARPDAIIDGISVYKARLKMGEKLANKILREWGEDHGIDVVIPIPDTSRTSALELANILGVKFREGFMKNRYIGRTFIMPGQQQRKKSVRQKLNPVELEFKGKNVLLVDDSIVRGTTCNEIIQMARDSGAKKVYFASAAPMVKYPNVYGIDMPAKTELIASQRSVEEIREIIGADRLVFQDLDDLKSAVRTTKVPDLTEFDSSVFDGVYVAGGIDKAYLENLEKKRNDTAKNAADSYIDVNIDAASVDLTGIREL

SEQ ID NO: 30377 - DNA, 1518 bp, Erwinia carotovora subsp. atroseptica SCRI1043
  CDS (1)..(1518): transl_table=11
atgtgcggtattgtcggtatcgccggttttacaccggtcaaccagtcgatttatgacgcgttaacggtgttgcaacaccgtgggcaggatgccgcgggtattgtgaccatcgatgcctttaattgttttcgcctgcgtaaggccaatggcctggtgaaagatgtgtttgaagcgcggcacatgcagcgcttacagggaaacatggggcttggccatgtacgttatccgaccgcaggcagttccagcgcctcggaagcacagcctttttatgtaaactctccgttcggcatcacgatggctcacaacggtaacctgacgaacgcccacgaactgcgtaaaaagctgttcgagcaggagcgccgtcacgttaacaccacgtccgattctgaaatcctgttgaatatctttgccagagaactggaccgtttccaacattatccgttggaagccgataatatttttgcggccgttgccgcgacgcaccagcaaattcgtggtgcctatgcctgtgttggcatgattatcggtcatggcatggtggcgttccgcgatcctaacggtattcgtcctctggtgattggtaaacgtgacctggaagatggtcgcagcgaatatatggtagcgtctgaaagcgtcgcactggatacgctgggctttgagttcttacgtgatgttgcgccgggagaagcgatctacattacggaaaaagggcaactgtttactcgccagtgcgcagagaatccaaagagcaacccgtgcctgttcgaatatgtctacttcgctcgtcctgactctttcatcgataaaatttcggtctatagcgcacgcgttcgcatgggtcagaagctgggtgaaaagattgcacgtcagtgggaagatctcgatattgatgtcgtgatcccgattcctgaaacctcttgtgatatcgcgttggaaatcgcgcgcattatcaacaaaccgtatcgtcagggattcgtgaaaaaccgctatgttggtcgcacctttatcatgccgggacagcaggcgcgtaagaaatctgtgcgtcgcaagctgaacgcgaaccgtgccgagttccgtgataaaaatgtgctgctggtcgatgactctatcgtacgtggcacaacgtcggagcagattgtggagatggcgcgtgaagcaggagccaggcgtgtttatctggcctctgcggcaccggaaattcgcttccctaacgtgtacggcatcgacatgccgagcgttaatgaactgattgcccacggtcgcgaagtggacgagatctgtaagattatcggtgccgatgagctgatattccaggatctcgacgatctgatcgacgcagcgcgtgaagataacccggatattgttcagtttgaatgttcagtgttcaatgggatttacgtgacaaaagacgtcgatcaaggctatctggattatctggaagtactgcgtaacgatgatgctaaagcgttacgtagccagaatgaagtcgaagatctggaactgcacaacgaaggttaa

SEQ ID NO: 30378 - protein, 505 aa, Erwinia carotovora subsp. atroseptica SCRI1043
MCGIVGIAGFTPVNQSIYDALTVLQHRGQDAAGIVTIDAFNCFRLRKANGLVKDVFEARHMQRLQGNMGLGHVRYPTAGSSSASEAQPFYVNSPFGITMAHNGNLTNAHELRKKLFEQERRHVNTTSDSEILLNIFARELDRFQHYPLEADNIFAAVAATHQQIRGAYACVGMIIGHGMVAFRDPNGIRPLVIGKRDLEDGRSEYMVASESVALDTLGFEFLRDVAPGEAIYITEKGQLFTRQCAENPKSNPCLFEYVYFARPDSFIDKISVYSARVRMGQKLGEKIARQWEDLDIDVVIPIPETSCDIALEIARIINKPYRQGFVKNRYVGRTFIMPGQQARKKSVRRKLNANRAEFRDKNVLLVDDSIVRGTTSEQIVEMAREAGARRVYLASAAPEIRFPNVYGIDMPSVNELIAHGREVDEICKIIGADELIFQDLDDLIDAAREDNPDIVQFECSVFNGIYVTKDVDQGYLDYLEVLRNDDAKALRSQNEVEDLELHNEG

SEQ ID NO: 30379 - DNA, 1488 bp, Propionibacterium acnes KPA171202
  CDS (1)..(1488): transl_table=11
gtggcgcgcgcagacggaaggcttaccgcagacctcaacccccaggaccacgggccccaagacgcctgtggcgtcatcgggatctatgcccccggtgaggaggtttctaaactcacctacttcggcatgtatgccctgcaacaccgtggccaggaatcagctggcatggcggtgtcagacggtcgccacatgatggtctttaaagacatggggttggtgtcccaggtctttgacgaggccaccctcaattccctccagggacatatggccgtcgggcacacccggtattcgacgactggtgcgagtatctgggacaacgcccagccgacgttcaggtcgcgtcaaggtggtgacgggctagctctggcccataacggcaacctcaccaacaccggcgccctcgaagccctcatcgctgagcgtgccccggataccgaggttccccacaaagaccggatggactccagcaacgacacctcgctggtaacagccctcatgacgacctatgacggcactcttgaggaagtcgccgcccaggtcctgccccaccttcagggtgccttcagtctcgttttcatggacgaccacactttgtgcgctgctcgtgatccgcagggcatccgaccgttggtgctggggcgcctatctagtggttgggtggtcgcctccgaaactgcggctatcgacatcgtcggtggtactttcgttcgcgagatcgagcccggcgagatggtcgccattgacgcggctgggttgcgcaccagccgtttcgctgcggcccggcccaaggggtgcgtcttcgaatacgtttacctggctcgccctgacaccgttattgctggacgacgtatccacaacgttcgcgtcaaagtcggcaagatcctggcccaggaacaccctgccgacgccgacctcgtcatcccggtgccagagtctggcaccccggctgctatcggctatgccgacgagtccggcatcccctacggcatgggcctggtcaagaactcctacgtgggccggactttcatccagccctctcaaaccctgcgcaacttgggtattcggctcaagctcaacccgttgcgtgacgtcattgagggacgacgcatcgtcgtcgtcgatgactccatcgtgcgcggcaatacccagcgtcagctggtccgaatgttgcgtgaggctggtgcggccgaggtgcacgtgcgcatctcttctccgccggtgcagtggccgtgcttctacggcattgacttcgctactcgcgctcagctcatcgccccgggtcttgacgtcgaggacatctgccgatctatcggcgctgactcgcttggctacgtcagccttgacggcctcgtccgtgccacccacgttgacgccgataacctctgccgggcttgttttgacggcgtttatcccgtaccggtgcctgtctcggcgcgagccgtgctagccgacgccacccacaccaacccgaaccaggagcagcagtga

SEQ ID NO: 30380 - protein, 495 aa, Propionibacterium acnes KPA171202
MARADGRLTADLNPQDHGPQDACGVIGIYAPGEEVSKLTYFGMYALQHRGQESAGMAVSDGRHMMVFKDMGLVSQVFDEATLNSLQGHMAVGHTRYSTTGASIWDNAQPTFRSRQGGDGLALAHNGNLTNTGALEALIAERAPDTEVPHKDRMDSSNDTSLVTALMTTYDGTLEEVAAQVLPHLQGAFSLVFMDDHTLCAARDPQGIRPLVLGRLSSGWVVASETAAIDIVGGTFVREIEPGEMVAIDAAGLRTSRFAAARPKGCVFEYVYLARPDTVIAGRRIHNVRVKVGKILAQEHPADADLVIPVPESGTPAAIGYADESGIPYGMGLVKNSYVGRTFIQPSQTLRNLGIRLKLNPLRDVIEGRRIVVVDDSIVRGNTQRQLVRMLREAGAAEVHVRISSPPVQWPCFYGIDFATRAQLIAPGLDVEDICRSIGADSLGYVSLDGLVRATHVDADNLCRACFDGVYPVPVPVSARAVLADATHTNPNQEQQ

SEQ ID NO: 30381 - DNA, 1455 bp, Streptococcus pyogenes MGAS10394
  CDS (1)..(1455): transl_table=11
atgacatacgaagtaaaatctctaaatgaagaatgtggagtctttggtatctgggggcatcctcaggcagctcaagtcacttactttgggcttcatagccttcaacatcgcggtcaagaaggagctggtattgtttcaaatgacaatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgacgggcaatttgctttatgccataatggtaatttgacaaatgctatttccttaaggaaagaattagaaaagcaaggtgcaattttcaatgcctcctcagatactgaaattttgatgcacttgattcgtcgaagccataactcaagtttcatgggaaaggtaaaagaagctctaaatacagtaaagggtggctttgcctatctactgatgacagaaaataaactcattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggcgaagttattcttatagacgatcgtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggtcttgtaaaaaatcagtatacgcagcgaacctttattcaaccgacacaagaattaagggaacaaggtgttcgaatgaaactatcagcggtatctggtgttgtcaaaggaaagcgcgttgttatgattgatgactcaattgtaagaggaacgacttctagaaggattgtcggattattaagagaagcaggagctagtgaagtacatgttgctatagctagtccagaattaaagtatccttgtttttatggtattgatattcaaacaagacgagaattaatttcagcaaatcacgctgttgacgaagtgtgtgatattattggcgcagatagtctgacctatctctcattagatgggttgattgaatcaattggactcgaaacaaaagcaccaaatggtggtttatgcgtagcttactttgatgggcattatccaacaccgctttatgattatgaagaagaatacctcagaagtttagaagagaaaacaagtttttatattcaaaaagtgaaataa

SEQ ID NO: 30382 - protein, 484 aa, Streptococcus pyogenes MGAS10394
MTYEVKSLNEECGVFGIWGHPQAAQVTYFGLHSLQHRGQEGAGIVSNDNGKLYGYRNVGLLSEVFKNQSELDNLTGNAAIGHVRYATAGSADIRNIQPFLYKFHDGQFALCHNGNLTNAISLRKELEKQGAIFNASSDTEILMHLIRRSHNSSFMGKVKEALNTVKGGFAYLLMTENKLIAALDPNAFRPLSIGQMQNGAWVISSETCAFEVVGAKWVRDVEPGEVILIDDRGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGASEVHVAIASPELKYPCFYGIDIQTRRELISANHAVDEVCDIIGADSLTYLSLDGLIESIGLETKAPNGGLCVAYFDGHYPTPLYDYEEEYLRSLEEKTSFYIQKVK

SEQ ID NO: 30383 - DNA, 1560 bp, Leifsonia xyli subsp. xyli str. CTCB07
  CDS (1)..(1560): transl_table=11
gtggccggaggagacggtcgtctcagccatgatctgctgcccggcgagaaggggccgcaggatgcttgcggtgtcttcggtgtgtgggcccccggcgaggaggtcgctaagctcagctacttcggcctctatgccctgcagcaccgcggccaggagtcggcgggcatcgcgacgagcgacgacgagaagatcctcatctacaaggacatgggcctggtctcccaggtcttcaacgagaacgcgctcaactcgctgaccggccacatcgccgtcggccacacacgatattcgaccaccggcgcctccagctggcagaacgcgcagccgaccctcggctccacctccggcggcacggtcgcgctcgggcacaacggcaacctgacgaacaccgccgagctgatggagctggtgcaggagcgctacccagcgcacgacggcgagctctcccgcggcaacacgaccgacacggccgtcgtcaccgccctgctcaccggcgatctcgaccacacgctcgaagagaccgcgctggaagtcctgccgcgtctgcgcggagcgttctgtctcgtcttcatggacgagcacacgctctacgccgcccgcgatccgcagggcgtccgcccgctggtgctcggccgcctggagcgcggctgggtcgtcgcgtcggagaccgcggcgctcgacatcgtcggcgcgagcttcgtgcgcgaggtcgagccgggcgagttcatcgccatcgacgagaacggcctgcgcagcagccgcttcgccgccgagaagcgcgcgggatgcgtcttcgaatacgtctacctcgcccgccccgacaccaccatcgccggccgcggagtctacgaggcgcgggtcgagatgggccgccagctcgcgcgtgagcacgaggtggcggccgatctcgtcatcccgacgcccgagtccggcacgcccgccgcgatcggctatgcgcaggccgctggcgtcccgttcggtcagggtctcgtgaagaactcgtacgtcggccgcaccttcatccagccgtcgcagaccatccgccagcgcggcatcaagctgaagctgaaccccctgaaggacgtcatcaagggcaagcgtctcgtcgtggtggacgattcgatcgtccgcggcaacacgcagcgtgcgctggtctcgatgctgcgcgaggccggagcggcggaggtgcatgtgcgtatctccagcccgcccatcacctggccgtgcttctacggaatcgacttcgcctcccgcgcggagctcatcgccaccggcctcggcgtcgaggaagtgcgccagtctatcggcgccgactccctcggctatctctccgaggacgggatgatcgcctccaccgagcagccccgcgagtgcctctgcaccgcgtgctttaccggcgtctacccgatcgcgctgcccgccgcccagcacctcggcaagaacctgctggaacgcccggcggcggagggcgctgccgccaccggcgacggctgcgagcccggcccggattcggagcatgagcgcctgctggcgttcggggacccgggacggcaggagtaa

SEQ ID NO: 30384 - protein, 519 aa, Leifsonia xyli subsp. xyli str. CTCB07
MAGGDGRLSHDLLPGEKGPQDACGVFGVWAPGEEVAKLSYFGLYALQHRGQESAGIATSDDEKILIYKDMGLVSQVFNENALNSLTGHIAVGHTRYSTTGASSWQNAQPTLGSTSGGTVALGHNGNLTNTAELMELVQERYPAHDGELSRGNTTDTAVVTALLTGDLDHTLEETALEVLPRLRGAFCLVFMDEHTLYAARDPQGVRPLVLGRLERGWVVASETAALDIVGASFVREVEPGEFIAIDENGLRSSRFAAEKRAGCVFEYVYLARPDTTIAGRGVYEARVEMGRQLAREHEVAADLVIPTPESGTPAAIGYAQAAGVPFGQGLVKNSYVGRTFIQPSQTIRQRGIKLKLNPLKDVIKGKRLVVVDDSIVRGNTQRALVSMLREAGAAEVHVRISSPPITWPCFYGIDFASRAELIATGLGVEEVRQSIGADSLGYLSEDGMIASTEQPRECLCTACFTGVYPIALPAAQHLGKNLLERPAAEGAAATGDGCEPGPDSEHERLLAFGDPGRQE

SEQ ID NO: 30385 - DNA, 1440 bp, Desulfotalea psychrophila LSv54
  CDS (1)..(1440): transl_table=11
atgtcacaggtaaaaacattatccgcgtcccaggactaccccacccacgaatgtggtgtttgcggtattttcgaccatgaagatgctgcaaagctcacctacttcggcctctatgccctccagcaccgtggccaagaaagtgcgggaattgttacatcaaccggcaaagaggtctttcttcacaaagatatgggacttgtgcccgagatctttaccgaagatatcctgcaaggacttaaaggggacatgtccatcggccatgtacgctactccaccaccggtgcgtccaacttcaccaatacccaacccctgatggttcaccataagaaccagaccctctccgttgcccacaatggcaacctggtgaactccaccgagctcagaaacaggctcgaggagagtggttctatctttcaaaccaccatggactccgaggccgtcctccatctcatggtacgcaacagcggtcccgatctcgataaaacactgagcgagacattccgtgccctcaagggtgcctattccctgctctatatgaccgaggacaccctcgttgccgtccgtgatcccgatggatttcgccccctctgccttggtcgcctgaccactggcggctgggttatagcctctgaaacctgcgccctcgacctcatcgaggccgattatgtacgtgatatcgagccgggtgaagttcttatcatgaaaagaggtgaggagatgcgctccatcttcccatggccaaaacagaccccgcaccactgcatctttgagcaggtctactttgcccgtcccgattccgatgtctttggtatcaacgtctatcaatcacgtaagcagatgggtaagatcctggcccgcgaggcaaagattgatgccgatttcgttatgccctttcctgattccggtaactatgcggccattggctatgcacaggaatccggtattcccatggagatgggcgtgatcagaaatcactatgtgggcaggacattcattgaaccaagccagtccatgcgtgacttcaacgtcaaggtcaagctcaaccccgtacgatctctcttgaagggaaaacgggttatcatcgttgaggattctattatccgaggaacaacaggtaagagtcgggtacgagccctacgcgaggcgggggccaaagagatccacatggtggtcagctgtcctccgaccatgcatgcctgctactatggcatcgatttcccaacctcatcacagctcattgcctgcaataagaacgtcgaagaaatcgcagaatatctgggcctggactctctccactacctcagccttgagggcatggtagaggcaacgggtatccctaaagagcactactgtctggcctgtttcaatggcatttaccccatcgcccctgatcaaaaatatcacaaagacgctctggcaacaaaggttgtcaagggctag

SEQ ID NO: 30386 - protein, 479 aa, Desulfotalea psychrophila LSv54
MSQVKTLSASQDYPTHECGVCGIFDHEDAAKLTYFGLYALQHRGQESAGIVTSTGKEVFLHKDMGLVPEIFTEDILQGLKGDMSIGHVRYSTTGASNFTNTQPLMVHHKNQTLSVAHNGNLVNSTELRNRLEESGSIFQTTMDSEAVLHLMVRNSGPDLDKTLSETFRALKGAYSLLYMTEDTLVAVRDPDGFRPLCLGRLTTGGWVIASETCALDLIEADYVRDIEPGEVLIMKRGEEMRSIFPWPKQTPHHCIFEQVYFARPDSDVFGINVYQSRKQMGKILAREAKIDADFVMPFPDSGNYAAIGYAQESGIPMEMGVIRNHYVGRTFIEPSQSMRDFNVKVKLNPVRSLLKGKRVIIVEDSIIRGTTGKSRVRALREAGAKEIHMVVSCPPTMHACYYGIDFPTSSQLIACNKNVEEIAEYLGLDSLHYLSLEGMVEATGIPKEHYCLACFNGIYPIAPDQKYHKDALATKVVKG

SEQ ID NO: 30387 - DNA, 1518 bp, Yersinia pseudotuberculosis IP 32953
  CDS (1)..(1518): transl_table=11
atgtgcggtattgtcggtatcgccggttttacaccggtaaaccagtcgatttatgatgcgttgatggtgcttcagcatcggggtcaggatgcggcgggtattgttaccattgatgcccataatgggttccgtctgcggaaagcgaacggcttggtgaaggatgtatttgaaacccggcatatgctgcgtttacaggggaatatggggattggtcatgttcgttacccaacggcaggcagctccagcgcttctgaagctcaacctttctatgttaactcaccgtttggcattaccctggctcacaatggtaatctgactaacgctcaccaactgagaaagaaattattcgaagtttctcgtcgtcatgtaaataccacgtctgactcagaaattctgttgaatatttttgccagtgaattggatcgtttccagcattatccgttggagtctgacaacatttttgccgctgttgccgcgacgcaccagttgattcgtggtgcttatgcctgcgtcgcaatgattatcggccacggtatggtcgctttccgtgaccccaacggtattcgtccgctggtaattggtaaacgcacgctggctgatgggcgcaatgagtatatggttgcgtccgaaagtgtggctttggatacacttgattttgaattcttgcgtgatgttgcaccgggcgaagccgtgtatatcaccgagaaaggccaactgttcacgcgtcagtgtgctgagaatccaaaatacaacccatgcttgtttgaatatgtttattttgcccgcccagactcctttatggataaaatttctgtttacagtgcgcgcgtccgcatggggcagaagttggggaccaaaatagccaaacagtgggaagacatggatatcgatgttgtcattcctattccagaaacctcttgcgatatcgcactggaaattgcccgaattctggataaaccgtaccgtcaggggtttgtcaaaaaccgttatgtcgggcgtacatttatcatgccgggtcagcaagaacgccgtaaatcggtgcgtcgtaagctgaatgctaatcgtgctgagttccgtggtaaaaacgtgttattggtggatgattccattgttcgcgggaccacgtcagagcagattgtcgaaatggcacgggaagctggggcgaaaaaagtgtactttgcgtcggcagcacctgaaatccgtttcccgaatgtgtacggtatcgatatgccaagtgctaatgagttgattgctcatggccgtgaagttgatgaaattcgtcagttgattggcgccgatgcactgattttccaagatcttactgatcttattgatgcagtacgtgaagataatccagacattacccagttcgaatgttctgtctttaatggtatttacgtgacgaaagatgtggatcagagctatctggaatatcttgagtcattacgtaacgacgatgcgcaggcattgcgtagccacaatgaagcggaaaatttagagatgcataacgaaggttaa

SEQ ID NO: 30388 - protein, 505 aa, Yersinia pseudotuberculosis IP 32953
MCGIVGIAGFTPVNQSIYDALMVLQHRGQDAAGIVTIDAHNGFRLRKANGLVKDVFETRHMLRLQGNMGIGHVRYPTAGSSSASEAQPFYVNSPFGITLAHNGNLTNAHQLRKKLFEVSRRHVNTTSDSEILLNIFASELDRFQHYPLESDNIFAAVAATHQLIRGAYACVAMIIGHGMVAFRDPNGIRPLVIGKRTLADGRNEYMVASESVALDTLDFEFLRDVAPGEAVYITEKGQLFTRQCAENPKYNPCLFEYVYFARPDSFMDKISVYSARVRMGQKLGTKIAKQWEDMDIDVVIPIPETSCDIALEIARILDKPYRQGFVKNRYVGRTFIMPGQQERRKSVRRKLNANRAEFRGKNVLLVDDSIVRGTTSEQIVEMAREAGAKKVYFASAAPEIRFPNVYGIDMPSANELIAHGREVDEIRQLIGADALIFQDLTDLIDAVREDNPDITQFECSVFNGIYVTKDVDQSYLEYLESLRNDDAQALRSHNEAENLEMHNEG

SEQ ID NO: 30389 - DNA, 1488 bp, Symbiobacterium thermophilum IAM 14863
  CDS (1)..(1488): transl_table=11
gtgatccggcccggtgacccgaccctggccctggccctgcagccctacctgggcgggtggccgaccaacccggacaagggcccggcggacgagtgcggcgtcttcggcatctacggccaccctgaggcggcgcgggtggtgtaccacgccctgatcgccctgcagcaccgggggcaggagtccgcgggcatcgtggccgcggacggtgcgaacctgaacacccaccggggcatggggctggtcagcgacgtgttcgagaagcccgagaccatccagcggctggccggcgacatcgccatcggccacgtgcggtattcgaccaccggctcctcccggctgggcaacgcccagcccgtggtggtgaacacccggcgcggcggactggccctggcgcacaacggcaacctcgtggacgccccggccatccgggaccggctggaggagcagggggcgatcttcaccacgtccatcgacaccgaggtgctggcccacctgatcgtccgttcccgggcgaagagcctggaggacgcgatcgtcgacgccgtgagccaggtgcacggcggctatgccctgctcatcctggccgaggaccggctgatcggcatccgggatccccacggcatccgcccgctgcagctgggccggcttgacggcagctgggtgctggcctccgagacctgcgcctttgacaccatcggcgcggagttcgtgcgggaggtggcccccggcgagatggtgaccatcagcgaggggggcaagctccggtcccgggcggcggtcagggaggccgtcgccccccggccgtgcatcttcgagttcatctacttcgcccgtcccgactcgcagttcgtcggggtcaacgtgcacaccgtgcgcaaggcgatgggccgccagctcgcgaaggaggcgccggcggatgccgacatcgtcatcggggtgcccgactcctcgatctccgcggccaccggctacgcggaggagtccggcatcccctacgaggtcgggctggtcaagaaccgctacatcgcccggacgttcatcctgccgtcccaggccgggcgcgagtcggcgctgaagctgaagctgaacccgctgcgcaaggtgatcgagggcaggcgggtggtgctggtggacgactccatcgtgcgcggcaccacgtcccgccacctggtgagcctcctccgggaggccggggcgcgggaggtgcacctgcgcatcgcatcgccgccgtaccagaacgcctgccactacggcatcgatacctccaagtccaccgacctgatcgcccgcgggcgcacggtccgggagatcgccgacgccatcggcgccgactccctggcctacctctcggtggagggcatggtgaaggccaccggcctgtcgccggaagcgggcttctgcctggcctgcttcaccggcgactacccggtgcccgtgccggaagaggccgacaagtacgcgctggaggggggctgcggctgtgactga

SEQ ID NO: 30390 - protein, 495 aa, Symbiobacterium thermophilum IAM 14863
MIRPGDPTLALALQPYLGGWPTNPDKGPADECGVFGIYGHPEAARVVYHALIALQHRGQESAGIVAADGANLNTHRGMGLVSDVFEKPETIQRLAGDIAIGHVRYSTTGSSRLGNAQPVVVNTRRGGLALAHNGNLVDAPAIRDRLEEQGAIFTTSIDTEVLAHLIVRSRAKSLEDAIVDAVSQVHGGYALLILAEDRLIGIRDPHGIRPLQLGRLDGSWVLASETCAFDTIGAEFVREVAPGEMVTISEGGKLRSRAAVREAVAPRPCIFEFIYFARPDSQFVGVNVHTVRKAMGRQLAKEAPADADIVIGVPDSSISAATGYAEESGIPYEVGLVKNRYIARTFILPSQAGRESALKLKLNPLRKVIEGRRVVLVDDSIVRGTTSRHLVSLLREAGAREVHLRIASPPYQNACHYGIDTSKSTDLIARGRTVREIADAIGADSLAYLSVEGMVKATGLSPEAGFCLACFTGDYPVPVPEEADKYALEGGCGCD

SEQ ID NO: 30391 - DNA, 1431 bp, Bacillus licheniformis ATCC 14580
  CDS (1)..(1431): transl_table=11
atgcttgctgaaatcaaaggcttaaatgaagaatgcggcgtatttgggatttgggggcatgaagaagcaccgcaaattacgtactacggccttcacagccttcagcacagaggccaggagggcgccggcatcgtcgcgacagacggcgaaaaaatgtccgcccacaaaggccaggggctgattaccgaagtttttcaaaacggtgagctcaaaaaggtgaaaggaaagggagcgatcggccacgtccgctatgcaacggcgggcggcggcggcttcgaaaacgtccagccgttccttttccattcgcaaaacaacggcagccttgcgcttgcgcacaatggaaacttagtgaacgccactcagctaaaacagcagcttgaaaaccagggcagcatttttcaaacgtcttcagatacggaagtgctcgcccatttaattaaaagaagcggccacttcgagctgaaagatcaaatcaaaaacgctctttctatgctgaaaggcgcttatgctttcctgatcatgacggaaaaggaaatgatcgtggcgcatgatccgaacggactcagaccgctatctgtcgcaatgcttggcgacgcgtacgtcgtcgcttctgaaacgtgcgcatttgatgtggtcggcgcgacatatctgcgcgatgtagaaccgggcgagatgctgatcatcaatgatgaaggcatgaagtcagagcggttctccatcaacatcaaccgttcgatctgcagcatggagtacatttatttctcaagacctgacagcaatattaacggcattaacgtccacagcgcgagaaagaatctcggcaaaaagctcgccgaggaatcaggcattgaagcagatgtggtgacaggcgttcctgactcaagcatttcagcggcgatcggctatgccgaagcgacgggaattccttacgaactcggattgatcaaaaaccgctatgtcggcagaacgttcattcagccgtcacagtcgctcagggagcagggcgtgagaatgaagctgtcagccgtccgcggggtcgttgaaggaaagcgcgtcgtcatggtggacgattcaatcgtgaggggcacgacgagccgcaggattgtgacgatgctgcgcgaagccggagcgacggaagtgcacgtcagaatcagttccccgcctattgcccatccgtgcttttacggaattgacacatcgacgcacgaagaactgatcgcgtcctctcattcagtggaagaaatccgtcaggaaatcggcgccgatacattgtcattcttgagcattgaaggactcctttccgggatcggaagacagtatgaaggtgaaaactgcggccagtgcatggcctgttttacaggaaaatatccgaccgaaatttatcaggatactgttcttcctcacgtgaaagaaatcgttttgacaaaataa

SEQ ID NO: 30392 - protein, 476 aa, Bacillus licheniformis ATCC 14580
MLAEIKGLNEECGVFGIWGHEEAPQITYYGLHSLQHRGQEGAGIVATDGEKMSAHKGQGLITEVFQNGELKKVKGKGAIGHVRYATAGGGGFENVQPFLFHSQNNGSLALAHNGNLVNATQLKQQLENQGSIFQTSSDTEVLAHLIKRSGHFELKDQIKNALSMLKGAYAFLIMTEKEMIVAHDPNGLRPLSVAMLGDAYVVASETCAFDVVGATYLRDVEPGEMLIINDEGMKSERFSININRSICSMEYIYFSRPDSNINGINVHSARKNLGKKLAEESGIEADVVTGVPDSSISAAIGYAEATGIPYELGLIKNRYVGRTFIQPSQSLREQGVRMKLSAVRGVVEGKRVVMVDDSIVRGTTSRRIVTMLREAGATEVHVRISSPPIAHPCFYGIDTSTHEELIASSHSVEEIRQEIGADTLSFLSIEGLLSGIGRQYEGENCGQCMACFTGKYPTEIYQDTVLPHVKEIVLTK

SEQ ID NO: 30393 - DNA, 1512 bp, Mannheimia succiniciproducens MBEL55E
  CDS (1)..(1512): transl_table=11
atgtgtggtattgttggaattgtaagtcaaagcccggtcaatcaatcaatttatgatgccttgaccgtattgcagcatcgcggacaggatgctgccgggattgtgactattgatgatgaaaaccgctttcgcttgcgtaaagccaacggtttggtaagcgatgtgttccaacaggttcacatgacgcgtttacagggcaacgcggggattggacacgttcgttatccgacagccggtagctcaagcgtatcggaagcgcaacctttctatgtcaattcgccttacggcttatcattagtgcataacggcaaccttacaaattccgacgaattaaaatccaaacttttcaaattagcccgtcgtcacgtcaatactaattccgactccgaagcattgttaaatattctggcttattatcttgatcatatgcaaaccgagcatctttcaccggaagatattttttatgcgatcaaaaaaacccataaagatattcgcggcgcttatgcctgtatcgctatgattatcggtcacggtatggtggcgttcagagatcctcacggcattcgcccgttaattttgggtaaacgcgaagagagcggaaaaaccgaatatatgtttgcttcggaatctgttgcattagacaccgccggttttgacgtggtacgtgatattgaacccggcgaagcggtatatatcactttcgacggcaaactctacgcggagcaatgtgcggaaaatccggtgttaacgccttgtattttcgaatacgtttattttgcccgtccggattcgactattgacggcgtatcggtatatgcggcgcgcgtacatatgggtgaacgtttggggcaaaaaattgccaacgaatgggctgatgcggatattgatgtggtcattccggtgcctgaaacatccaatgatatcgcattaagaatcgcaaccatattgggcaaaccttaccgtcagggtttcgtaaaaaaccgttatgtgggacgcacatttattatgccggggcaaaaacagcgtattagtgcggttcgccgtaaattaaatacgatttcttccgaatttaaggataaaaacgtgttattagtggatgattccatcgtgcgcggtacaacttcggaacaaatcgttgatatggcgcgtgccgccggcgcgaagaaaatttattttgcttcggcagcgcctgaaattcgctatccgaatgtgtatggcattgatatgccgaccaagcacgaattaatcgcttatggccgcgagcctgaggaaattgccaaattaatcggcgtggataagctcatttttcaggatttatcggcattaacgcagtccgtacagcaagaaaatccaaatatcaaagaatttgatacttcggtatttaccggacattatgtgacgggcgatatttccaccgaatatctggataatattgcgcaacagcgtaatgacgcggcaaaaagaaaacgcgcaaaagatgcgacaaatctggaaatccataacgaaggataa

SEQ ID NO: 30394 - protein, 503 aa, Mannheimia succiniciproducens MBEL55E
MCGIVGIVSQSPVNQSIYDALTVLQHRGQDAAGIVTIDDENRFRLRKANGLVSDVFQQVHMTRLQGNAGIGHVRYPTAGSSSVSEAQPFYVNSPYGLSLVHNGNLTNSDELKSKLFKLARRHVNTNSDSEALLNILAYYLDHMQTEHLSPEDIFYAIKKTHKDIRGAYACIAMIIGHGMVAFRDPHGIRPLILGKREESGKTEYMFASESVALDTAGFDVVRDIEPGEAVYITFDGKLYAEQCAENPVLTPCIFEYVYFARPDSTIDGVSVYAARVHMGERLGQKIANEWADADIDVVIPVPETSNDIALRIATILGKPYRQGFVKNRYVGRTFIMPGQKQRISAVRRKLNTISSEFKDKNVLLVDDSIVRGTTSEQIVDMARAAGAKKIYFASAAPEIRYPNVYGIDMPTKHELIAYGREPEEIAKLIGVDKLIFQDLSALTQSVQQENPNIKEFDTSVFTGHYVTGDISTEYLDNIAQQRNDAAKRKRAKDATNLEIHNEG

SEQ ID NO: 30395 - DNA, 1485 bp, Bacillus licheniformis ATCC 14580
  CDS (1)..(1485): transl_table=11
atggattcatgcgcagacagaagagctcgaaagcgcatggaaaggagctatcccatgcttgctgaaatcaaaggcttaaatgaagaatgcggcgtatttgggatttgggggcatgaagaagcaccgcaaattacgtactacggccttcacagccttcagcacagaggccaggagggcgccggcatcgtcgcgacagacggcgaaaaaatgtccgcccacaaaggccaggggctgattaccgaagtttttcaaaacggtgagctcaaaaaggtgaaaggaaagggagcgatcggccacgtccgctatgcaacggcgggcggcggcggcttcgaaaacgtccagccgttccttttccattcgcaaaacaacggcagccttgcgcttgcgcacaatggaaacttagtgaacgccactcagctaaaacagcagcttgaaaaccagggcagcatttttcaaacgtcttcagatacggaagtgctcgcccatttaattaaaagaagcggccacttcgagctgaaagatcaaatcaaaaacgctctttctatgctgaaaggcgcttatgctttcctgatcatgacggaaaaggaaatgatcgtggcgcatgatccgaacggactcagaccgctatctgtcgcaatgcttggcgacgcgtacgtcgtcgcttctgaaacgtgcgcatttgatgtggtcggcgcgacatatctgcgcgatgtagaaccgggcgagatgctgatcatcaatgatgaaggcatgaagtcagagcggttctccatcaacatcaaccgttcgatctgcagcatggagtacatttatttctcaagacctgacagcaatattaacggcattaacgtccacagcgcgagaaagaatctcggcaaaaagctcgccgaggaatcaggcattgaagcagatgtggtgacaggcgttcctgactcaagcatttcagcggcgatcggctatgccgaagcgacgggaattccttacgaactcggattgatcaaaaaccgctatgtcggcagaacgttcattcagccgtcacagtcgctcagggagcagggcgtgagaatgaagctgtcagccgtccgcggggtcgttgaaggaaagcgcgtcgtcatggtggacgattcaatcgtgaggggcacgacgagccgcaggattgtgacgatgctgcgcgaagccggagcgacggaagtgcacgtcagaatcagttccccgcctattgcccatccgtgcttttacggaattgacacatcgacgcacgaagaactgatcgcgtcctctcattcagtggaagaaatccgtcaggaaatcggcgccgatacattgtcattcttgagcattgaaggactcctttccgggatcggaagacagtatgaaggtgaaaactgcggccagtgcatggcctgttttacaggaaaatatccgaccgaaatttatcaggatactgttcttcctcacgtgaaagaaatcgttttgacaaaataa

SEQ ID NO: 30396 - protein, 494 aa, Bacillus licheniformis ATCC 14580
MDSCADRRARKRMERSYPMLAEIKGLNEECGVFGIWGHEEAPQITYYGLHSLQHRGQEGAGIVATDGEKMSAHKGQGLITEVFQNGELKKVKGKGAIGHVRYATAGGGGFENVQPFLFHSQNNGSLALAHNGNLVNATQLKQQLENQGSIFQTSSDTEVLAHLIKRSGHFELKDQIKNALSMLKGAYAFLIMTEKEMIVAHDPNGLRPLSVAMLGDAYVVASETCAFDVVGATYLRDVEPGEMLIINDEGMKSERFSININRSICSMEYIYFSRPDSNINGINVHSARKNLGKKLAEESGIEADVVTGVPDSSISAAIGYAEATGIPYELGLIKNRYVGRTFIQPSQSLREQGVRMKLSAVRGVVEGKRVVMVDDSIVRGTTSRRIVTMLREAGATEVHVRISSPPIAHPCFYGIDTSTHEELIASSHSVEEIRQEIGADTLSFLSIEGLLSGIGRQYEGENCGQCMACFTGKYPTEIYQDTVLPHVKEIVLTK

SEQ ID NO: 30397 - DNA, 1500 bp, Legionella pneumophila subsp. pneumophila str. Philadelphia 1
  CDS (1)..(1500): transl_table=11
atgtgtggcattgtaggaatttacagtcatgaacccgttgctgctgagctttatgatagcttgattcatttacagcaccgggggcaagatgcctcaggtattttaaccggagctgatcgtttttacttcaaacatggacttggactggtcagagagtctattttctctgaagatattcttaaactgaaggggaatatcggcattgctcatgtgcgttatcccacggccggaggttatagtgaagcggatgttcagcctctttggatagggagccctcgcggtatagctttggctcataatggaaatttagtgaattatggagagttggttgatgatttatgcggaaaacagcataggcatttaaactctactcttgattctgaggcacttttattacttctggcagactatttagccaagggatcttattccgatcatgatgaagagcaattctttcaattactatgtatggcagttaatgaaatacatcaacgagttcagggttcctattctgttgtgagtttagtaattggcaaaggtttggttgcatttagggatccgcatggtatccgtcctttagtttggggtgagcgagtccatgaaaatggtagtaaagattatatttttgcttcagaaaccacccctttttatgctttaggttttgagcccaagggtgatttgcagcccggtgaagttgcttacgtgaatcagcaaggacaattgtacagaaaagtgctttcatcaaaaaaatttaccccttgtatatttgaatacgtttacttcgccagaccagatgccacattagacgatgtgagcgtttatcgagccagattacgtatggggcaaaatttagctaaaagctggaaaaagagatttccagatacactacctgatgtggtgattccagccccttcaacagcaaatactgccgcattagcttttgcaaatgagttgggaatacgttattccgaaggtttatataaaaatccttttattggacgtacttttattatgcctaatcaggagtcgcgatcaagacaggttcgttataaattaactcctcagaaaacggaaattaataaaaaaaaggtattaatcgttgatgacagtatcgtaaggggaactacctcacgcgaaatagtcagaatgatacgagaatatggtgcatcagaaatatattttgtatcaacctgtccaccaattaaaaacccttgtttctacgggattgatatcccatcgcgtaaaaaattgatagcagcccataaaacggaagaggaaatccgtcaatttctaggggtggataaattattataccaaactcaggaaaaccttatagaggctgtgtctcgcagggggcaatatgacatgagcaagccttgtatggcttgtatggatggtaaatacatttgtggacagattactgaagaaaaaattaaattgttggagaaaaaaagattaaccgagaatgaccaagaaacagagataggagagatgtcttga

SEQ ID NO: 30398 - protein, 499 aa, Legionella pneumophila subsp. pneumophila str. Philadelphia 1
MCGIVGIYSHEPVAAELYDSLIHLQHRGQDASGILTGADRFYFKHGLGLVRESIFSEDILKLKGNIGIAHVRYPTAGGYSEADVQPLWIGSPRGIALAHNGNLVNYGELVDDLCGKQHRHLNSTLDSEALLLLLADYLAKGSYSDHDEEQFFQLLCMAVNEIHQRVQGSYSVVSLVIGKGLVAFRDPHGIRPLVWGERVHENGSKDYIFASETTPFYALGFEPKGDLQPGEVAYVNQQGQLYRKVLSSKKFTPCIFEYVYFARPDATLDDVSVYRARLRMGQNLAKSWKKRFPDTLPDVVIPAPSTANTAALAFANELGIRYSEGLYKNPFIGRTFIMPNQESRSRQVRYKLTPQKTEINKKKVLIVDDSIVRGTTSREIVRMIREYGASEIYFVSTCPPIKNPCFYGIDIPSRKKLIAAHKTEEEIRQFLGVDKLLYQTQENLIEAVSRRGQYDMSKPCMACMDGKYICGQITEEKIKLLEKKRLTENDQETEIGEMS

SEQ ID NO: 30399 - DNA, 1407 bp, Bacteroides fragilis YCH46
  CDS (1)..(1407): transl_table=11
atgggaggttttttcggaacagtctcgaaaacgagctgtgtgaccgatttattctacggcacagactataactcacacctgggaacaaaacggggaggacttgcgacatatagtgaagaacagggatttatccgctcgattcataacctgcagagttcatatttccgtaccaaatttgaggaagaactggataaatttaaaggaaatgccggtatcggtattatcagtgatacagacgcccaacctattattattaactcacatctcggtagatttgccattgttacggttgctaaggtcacaaaccttaaagaactcgaagaggaactactttcacaaaacatgcatttcgccgaacttagttcgggtagtaccaatcaaacggaacttatcgctttattgattattcagggtaaaaattttgtagaaggaatagagaatgtatataaccatataaaaggttcgtgttctatgcttctgttgacagaagatggagtgattgccgcacgagataaatggggacgtactcctattgttatcgggaaaaaggagggcgcttatgcagccacgagtgaatctaacagttttccgaatcttgattttgaaatagaacgctatttaggacccggtgaaatagtccgtatgcatgctgaccgtcttgaacaacttcgcaagcctgatgacaaaatgcaaatctgttcatttttgtgggtgtattacggttttcccaattcatgttatgaaggccggaatgtagaagaggtacgctttacgagcgggttgaaaatgggtgaacaagatgactgcgatgctgattgtgtttgtggaattccggattcgggtatcgggcaggcattgggttatgcagaagggaaaggcattccttatcatcgtgctattaccaagtatactcctacctggccccgtagttttactccgagcaagcaggaattacgttctttggtggcaaagatgaagttgatccctaaccgtgctatgctccaagataagcgtattattttttgtgatgactccattgtgcgtggtacgcagttgcatgataatgtgaagattctttttgattatggtgcaaaagaggtacatatgcgtatcggatgcccaccgcttatttatggctgtccgtttattggttttacagcttcaaagtcggatatggaacttatcaccaggcagataataaaagaactggagggagatgaaaataagaatttggataaatatgctactacaggttcgccggaatatgagaagatggtaggcatcatcgccaagcgtttcggactttcgtctctcaaattcaacacgattgaaacactgattgaagccatcggattgccaaagtgtaaagtttgtacccattgttttgacggatccagttgtttctaa

SEQ ID NO: 30400 - protein, 468 aa, Bacteroides fragilis YCH46
MGGFFGTVSKTSCVTDLFYGTDYNSHLGTKRGGLATYSEEQGFIRSIHNLQSSYFRTKFEEELDKFKGNAGIGIISDTDAQPIIINSHLGRFAIVTVAKVTNLKELEEELLSQNMHFAELSSGSTNQTELIALLIIQGKNFVEGIENVYNHIKGSCSMLLLTEDGVIAARDKWGRTPIVIGKKEGAYAATSESNSFPNLDFEIERYLGPGEIVRMHADRLEQLRKPDDKMQICSFLWVYYGFPNSCYEGRNVEEVRFTSGLKMGEQDDCDADCVCGIPDSGIGQALGYAEGKGIPYHRAITKYTPTWPRSFTPSKQELRSLVAKMKLIPNRAMLQDKRIIFCDDSIVRGTQLHDNVKILFDYGAKEVHMRIGCPPLIYGCPFIGFTASKSDMELITRQIIKELEGDENKNLDKYATTGSPEYEKMVGIIAKRFGLSSLKFNTIETLIEAIGLPKCKVCTHCFDGSSCF

SEQ ID NO: 30401 - DNA, 1884 bp, Bacteroides fragilis YCH46
  CDS (1)..(1884): transl_table=11
atggaacaactgaaacatgaatgtggcgttgccatgatacgtttgcttaaaccgctggagtactatgaaaagaagtacggaacgtggatgtacgggctgaataagctctatctgctgatggaaaagcagcataaccgtggtcaggaaggtgccggtctggcgtgtgtgaaactggaagcaaatccgggtgaggagtatatgttccgtgagcgggcattgggttccggtgccatcaccgagatatttgagacagtacaaagcaacttcaaggatctgagcaaagaacagttgcacgatgccgcgtttgccaaacggacgctgccttttgccggagaagcttatatggggcatctgcgttactcgactaccggaaaatccgggatatcttatgttcatccgtttctcagaagaaataactggcgggcgaagaatcttgctctttgcggcaacttcaacatgactaatgtggatgaaatttttgcccgtatcacagccatcggccagcatccccgtaagtatgccgatacgtatattatgttggaacaagtggggcacaggctcgaccgtgaagtggaacgtctctttaacctggctgaggctgaaggcctgaccggcatgggcgtgacgcattacattgaggaccacatcgaccttgccaacgtgttgcgcacgtcgagtaaagaatgggacggggggtatgtgatgtgcggactgaccggtagcggagagagctttgcattgcgtgacccgtgggggattcgtccggtgttctggtatcaggatgacgagattgcggtgcttgcttccgaacgtccggtgattcagacggcactcaatgttccgataggagaaatcagggaattactgccgggacaggccctcctgatcagtaaagagggaaagttgcgtacggcacagatcaataaggcacgggagaagaaagcctgttcgttcgagcggatctacttctcgcgaggcagtgacgcggatatttacaaggagagaaaacaactgggtgagaaactggttccgaacatcctgaaagcgattgataatgacctcgaccataccgtcttctcgttcatcccgaatacggcagaggtggcattttacggtatgcttcaggggctggacaattatctgaatgaggagaaggtgcggcagattgcgagcctgggacatcatccggatcacgatgaactggaagtgattctgtcccgccgtatccgttcggagaaagtggctatcaaagatatcaaactgcgcactttcattgccgagggcaatagccggaatgacttggcagcacacgtatatgacatcacatacggcagtctccgttccggtatcgacaatctggtgattatcgacgacagcattgttcgcggtactactctgaaacagagtattatcggtatcctcgaccgtctgggaccgaagaagatagtcatcgtctcttcttctccgcaagttcgctatcccgactattacggtattgatatggcgaagatgtccgaattcatcgcctttaaagctgcaattgaattgctgaaggaccgggatatgaaagatgtgatcgcatcggcttaccggaagtcgaaagatcaggtgggactgccgaaagagcagatggtaaactatgtgaaggatatttatgctcctttcaccgatgaggagatttcggagaagatggtggaactgctgacgccgaaaggaacgaaagcgaaagtgcagattgtctaccagccgctcgaggggctgcacgaggcgtgtcccaatcatacgggagactggtacttcagtggcaactatcctacaccgggcggggtgaagctgctgaacgaagcatttattaactacatcgagcaggtgtaccaattttaa

SEQ ID NO: 30402 - protein, 627 aa, Bacteroides fragilis YCH46
MEQLKHECGVAMIRLLKPLEYYEKKYGTWMYGLNKLYLLMEKQHNRGQEGAGLACVKLEANPGEEYMFRERALGSGAITEIFETVQSNFKDLSKEQLHDAAFAKRTLPFAGEAYMGHLRYSTTGKSGISYVHPFLRRNNWRAKNLALCGNFNMTNVDEIFARITAIGQHPRKYADTYIMLEQVGHRLDREVERLFNLAEAEGLTGMGVTHYIEDHIDLANVLRTSSKEWDGGYVMCGLTGSGESFALRDPWGIRPVFWYQDDEIAVLASERPVIQTALNVPIGEIRELLPGQALLISKEGKLRTAQINKAREKKACSFERIYFSRGSDADIYKERKQLGEKLVPNILKAIDNDLDHTVFSFIPNTAEVAFYGMLQGLDNYLNEEKVRQIASLGHHPDHDELEVILSRRIRSEKVAIKDIKLRTFIAEGNSRNDLAAHVYDITYGSLRSGIDNLVIIDDSIVRGTTLKQSIIGILDRLGPKKIVIVSSSPQVRYPDYYGIDMAKMSEFIAFKAAIELLKDRDMKDVIASAYRKSKDQVGLPKEQMVNYVKDIYAPFTDEEISEKMVELLTPKGTKAKVQIVYQPLEGLHEACPNHTGDWYFSGNYPTPGGVKLLNEAFINYIEQVYQF

SEQ ID NO: 30403 - DNA, 1536 bp, Burkholderia mallei ATCC 23344
  CDS (1)..(1536): transl_table=11
atgtgcggcatcgtaggcgttatctcccagtccccggtcaaccagctcgtctatgacagcctgctgctgctgcagcatcgcggtcaggacgcggcgggcatcgcgacggcggacggcagcaatttccatatgtacaaggcgaacggcatggtgcgcgacgtgttccgcacgcgcaacatgcgcagcctgcccggcacggccgggatcggtcaggtccgctacccgacggcgggctccgcgtcgagcgaagccgaggcgcaaccgttctacgtgaacgcgccgttcggcatcatcctcgcgcacaacggcaacctgacgaactggcagcagttgaaggacgaaatgttccgcatcgaccgccgccacatcaacacgaactccgacagcgaagtgctgctgaacgtgctcgcgcacgaactgcagctctcgacgacgggcctcgagctcgatcccgattcgctgttcaaggcggtcgcgggcgtgcatcgccgcgcgcacggctcgtatgcgatcgtgtcgctgatcgccggctacggtctgctcgcgtttcgcgatccgttcggcattcgcccgctttgcatcggcaagctcgaaaccgagcagggcaccgagtggatggtggcgtcggaatcggtcgcggtggaaggcatcggcttcgaattcgtccgcgacgtgcagccgggcgaggtggtcttcatcgacgtgaacggcaagttccatagccgccagtgcgcggacaagccgagcctgaacccgtgcatgttcgagtacgtgtatctcgcgcgcccggattcgtgcctcgacggcgtgcccgtctacaacgtgcgcctgcgcatgggcgattacctcgccgagaagatcaggcgcgagctgccgaacgtgccgatcgatgtcgtgatgccgattcccgattcgtcgcggccggccgcgatgcaggtggcggcgaagctcggcgtcgagtatcgcgagggcttcttcaagaaccgctacgtcggccgcacgttcatcatgcccggccaggcggtgcgcaagaagtcggtgcgccagaagttcaacgcgatgagcatcgagttcaaggacaagcacgtgctgatcgtcgacgattcgatcgtgcgcggcaccacgtcgcacgagatcgtgcagatggcgcgcgacgcgggcgcgaaatcggtgatcttcgcgtcggcggcgccgcccgtgaagttcccgaacgtctacgggatcgacatgccgacgcgcggcgaactcgtcgcgcacggccgcaccgacgaggaagtcgcgaagatcatcggcgccgattatctgatctaccaggacgtcggcgatctgcgccgcgcggtgcgcgacatcaacccgtcgctcgaaggcttcgaggcgtcgtgcttcgacggcgactacatcaccggcgacgtcacgcccgagtatctggacgcgatcgagcgcgcccgcctcgcgcccgcgtcgcaggcggaccgcgatccgagcggcgaaggcgccgagcgctcgcagatgaacctgcagctgtcggtcgaatga

SEQ ID NO: 30404 - protein, 511 aa, Burkholderia mallei ATCC 23344
MCGIVGVISQSPVNQLVYDSLLLLQHRGQDAAGIATADGSNFHMYKANGMVRDVFRTRNMRSLPGTAGIGQVRYPTAGSASSEAEAQPFYVNAPFGIILAHNGNLTNWQQLKDEMFRIDRRHINTNSDSEVLLNVLAHELQLSTTGLELDPDSLFKAVAGVHRRAHGSYAIVSLIAGYGLLAFRDPFGIRPLCIGKLETEQGTEWMVASESVAVEGIGFEFVRDVQPGEVVFIDVNGKFHSRQCADKPSLNPCMFEYVYLARPDSCLDGVPVYNVRLRMGDYLAEKIRRELPNVPIDVVMPIPDSSRPAAMQVAAKLGVEYREGFFKNRYVGRTFIMPGQAVRKKSVRQKFNAMSIEFKDKHVLIVDDSIVRGTTSHEIVQMARDAGAKSVIFASAAPPVKFPNVYGIDMPTRGELVAHGRTDEEVAKIIGADYLIYQDVGDLRRAVRDINPSLEGFEASCFDGDYITGDVTPEYLDAIERARLAPASQADRDPSGEGAERSQMNLQLSVE

SEQ ID NO: 30405 - DNA, 1536 bp, Burkholderia pseudomallei K96243
  CDS (1)..(1536): transl_table=11
atgtgcggcatcgtaggcgttatctcccagtccccggtcaaccagctcgtctatgacagcctgctgctgctgcagcatcgcggtcaggacgcggcgggcatcgcgacggcggacggcagcaatttccatatgtacaaggcgaacggcatggtgcgcgacgtgttccgcacgcgcaacatgcgcagcctgcccggcacggccggaatcggtcaggtccgctacccgacggcgggctccgcgtcgagcgaagccgaggcgcaaccgttctacgtgaacgcgccgttcggcatcatcctcgcgcacaacggcaacctgacgaactggcagcagttgaaggacgaaatgttccgcatcgaccgccgccacatcaacacgaactccgacagcgaagtgctgctgaacgtgctcgcgcacgaactgcagctctcgacgacgggcctcgagctcgatcccgattcgctgttcaaggcggtcgcgggcgtgcatcgccgcgcgcacggctcgtatgcgatcgtgtcgctgatcgccggctacggtctgctcgcgtttcgcgatccgttcggcattcgcccgctttgcatcggcaagctcgaaaccgagcagggcaccgagtggatggtggcgtcggaatcggtcgcggtggaaggcatcggcttcgaattcgtccgcgacgtgcagccgggcgaggcggtcttcatcgacgtgaacggcaagttccatagccgccagtgcgcggacaagccgagcctgaacccgtgcatgttcgagtacgtgtatctcgcgcgcccggattcgtgcctcgacggcgtgcccgtctacaacgtacgcctgcgcatgggcgattacctcgccgagaagatcaggcgcgagctgccgaacgtgccgatcgatgtcgtgatgccgattcccgattcgtcgcggccggccgcgatgcaggtggcggcgaagctcggcgtcgagtatcgcgagggcttcttcaagaaccgctacgtcggccgcacgttcatcatgcccggccaggcggtgcgcaagaagtcggtgcgccagaagctcaacgcgatgagcatcgagttcaaggataagcacgtgctgatcgtcgacgattcgatcgtgcgcggcaccacgtcgcacgagatcgtgcagatggcgcgcgacgcgggcgcgaaatcggtgatcttcgcgtcggcggcgccgcccgtgaagttcccgaacgtctacgggatcgacatgccgacgcgcggcgaactcgtcgcgcacggccgcaccgacgaggaagtcgcgaagatcatcggcgccgattatctgatctaccaggacgtcggcgatctgcgccgcgcggtgcgcgacatcaacccgtcgctcgaaggcttcgaggcgtcgtgcttcgacggcgactacatcaccggcgacgtcacgcccgagtatctggacgcgatcgagcgcgcccgcctcgcgcccgcgtcgcaggcggatcgcgatccgagcggcgaaggcgccgagcgctcgcagatgaacctgcagctgtcggtcgaatga

SEQ ID NO: 30406 - protein, 511 aa, Burkholderia pseudomallei K96243
MCGIVGVISQSPVNQLVYDSLLLLQHRGQDAAGIATADGSNFHMYKANGMVRDVFRTRNMRSLPGTAGIGQVRYPTAGSASSEAEAQPFYVNAPFGIILAHNGNLTNWQQLKDEMFRIDRRHINTNSDSEVLLNVLAHELQLSTTGLELDPDSLFKAVAGVHRRAHGSYAIVSLIAGYGLLAFRDPFGIRPLCIGKLETEQGTEWMVASESVAVEGIGFEFVRDVQPGEAVFIDVNGKFHSRQCADKPSLNPCMFEYVYLARPDSCLDGVPVYNVRLRMGDYLAEKIRRELPNVPIDVVMPIPDSSRPAAMQVAAKLGVEYREGFFKNRYVGRTFIMPGQAVRKKSVRQKLNAMSIEFKDKHVLIVDDSIVRGTTSHEIVQMARDAGAKSVIFASAAPPVKFPNVYGIDMPTRGELVAHGRTDEEVAKIIGADYLIYQDVGDLRRAVRDINPSLEGFEASCFDGDYITGDVTPEYLDAIERARLAPASQADRDPSGEGAERSQMNLQLSVE

SEQ ID NO: 30407 - DNA, 1509 bp, Methylococcus capsulatus str. Bath
  CDS (1)..(1509): transl_table=11
atgtgcggaattgccggtatcgtttccaacgatgaggtcaatcaggaactgtacgaggcgctcaccgtgcttcagcatcgcggccaggatgccgccggtatcgtgacctgcgagagggagcggctgcatctgcgcaaggagagcggtctggtgcgggatgtgttccacacccgccacatggtggagctgaaaggcacgatgggcatcggccacgtgcgttatcccactgccggctgttccagcaccgctgaagcgcagccgttctatgtcaattccccgtacggcatctcgctcgcccacaatggcaatctgaccaatgcggcccggctcaaacgcgaactgttccgacaggatcagcgccatatcaacaccgattcggattcggaggttctactcaacgtcttcgcccatgaaatgcagggcatcggcaagctgcgggtatcgccggacgacgtgttccgggccgtttccgcggtgcataggcgctgccgcggtgcctatgccgtggtggcgatggtcaccggtttcggcgtcgtcggcttccgcgatccgcatggcatccgccctctggttttcggcgagcgggaggggcggttcggcaaggactacatgatcgcttccgagagcgtggctctggacgtgctcggcttcgagctggttcgggatgtggcgcccggcgaggcggtcctgatcgagaaggacggtaccctgcatatccgccagtgcgccgaacacgtcgtccattccccatgcatcttcgagttcgtctatttcgcccggccggattccatcatcgacgacatctccgtctacaaggcccggctgcgcatgggggacaagctggccgacaagattctgcgggagcgccccgagcacgacatcgacgtggtcatccccatcccggacaccagccgtacttcggcgctgcagctcgccaaccggctgggcgtgaaatacagcgaaggcttcatcaagaaccgttacatcggccgtaccttcatcatgccggggcagaccctgcgcaagaagtccgtgcggcagaagctcaacgccatcgacctggagttcaagggcaagaacgtgctgctggtggacgactccatcgtgcgtggcaccacctcgacccagatcatccagatggcgcgcgacgccggcgcccgcaaggtctatttcgcctcggcctcgccgccggtgcgctaccctaatgtttacggcatcgacatgccggcggtcgaggagctgatcgcccacggccggaccgacgaacaggtacgggaagcgctgggcgcggactggctggtctatcaggatctggccgatctggtcgagtcggtacagaagggcaacccgtcgatcccccgtttcgacacctcctgcttcgacaaggattacgtcaccggtgacatcgatcaggcctatctcgatcgcctgagcgagcaccgctcggatcatgccaaggccaaacgggatgcggccgcgaccgccatcgatctttacaacaccgtctaa

SEQ ID NO: 30408 - protein, 502 aa, Methylococcus capsulatus str. Bath
MCGIAGIVSNDEVNQELYEALTVLQHRGQDAAGIVTCERERLHLRKESGLVRDVFHTRHMVELKGTMGIGHVRYPTAGCSSTAEAQPFYVNSPYGISLAHNGNLTNAARLKRELFRQDQRHINTDSDSEVLLNVFAHEMQGIGKLRVSPDDVFRAVSAVHRRCRGAYAVVAMVTGFGVVGFRDPHGIRPLVFGEREGRFGKDYMIASESVALDVLGFELVRDVAPGEAVLIEKDGTLHIRQCAEHVVHSPCIFEFVYFARPDSIIDDISVYKARLRMGDKLADKILRERPEHDIDVVIPIPDTSRTSALQLANRLGVKYSEGFIKNRYIGRTFIMPGQTLRKKSVRQKLNAIDLEFKGKNVLLVDDSIVRGTTSTQIIQMARDAGARKVYFASASPPVRYPNVYGIDMPAVEELIAHGRTDEQVREALGADWLVYQDLADLVESVQKGNPSIPRFDTSCFDKDYVTGDIDQAYLDRLSEHRSDHAKAKRDAAATAIDLYNTV

SEQ ID NO: 30409 - DNA, 1500 bp, Nocardia farcinica IFM 10152
  CDS (1)..(1500): transl_table=11
gtgttcggtgtctgggcgccgagcgaggacgtggccaagctcacgtactacggcctctacgcgctgcagcatcgcggccaggaggcggcgggcatcgcggtctccgacggtcagcagatcctggtgttcaaggatctgggcttggtcagccaggtgttcgacgagcagacgctggccgccatgcccggccacatcgccgtcggccactgtcgctactccaccacgggcggcgtgacctgggagaacgcccagccgatcttccgcaccaccgcggtcggctccggcctggcgctgggccacaacggcaatctcgtcaacaccgccgaactggccgggcgcgcacgcgaactcgggctcatcggcacccccgtgtccggcggccggccgcagccggtgggcgcgacctccgactccgatgtgatgaccgccctgctggcgcacgccgcggccgactcgagcatcgagcaggccgcgatggaactgctgccgcagctgcgcggcgcgttctgcctcaccttcatggacgagcacaccctctacgccgcccgcgacccgcacggggtgcggccgctgtgcctgggcaggctcgaccgcggctgggtggtggccagcgagaccgccgcgctcgacatcgtcggcgccgccttcgtccgtgagatcgaacccggcgaactgctggcgatcgacgccgaaggcgtgcggtcgatgcgcttcgccaaccccgaacccaagggttgcgtcttcgaatacgtctatctggcccgtcccgactccaccatcgccgggcgctcggtgcacgccacccgcgtcgagatcggcaggcggctggccaaggagcatccggtcgaggccgatctggtcatcccggtccccgaatccggcaccccggccgcggtcggctacgcccagggctcgggtgtgccctacggccagggcctgatgaagaacgcctacgtggggcgcaccttcatccagccgagccagacgatccgccagctcggcatccggctcaagctcaacccgctgcgcgaggtgatccgcggcaagcggttgatcgtggtcgacgactccatcgtgcgcggcaacacccagcgcgcgctggtgcggatgctgcgggaggcgggcgcggtggagatccacgtccgcatcgcctcgccgccggtcaagtggccctgcttctacggcatcgatttcgcctcccgggcggagctgatcgccaacggtggcggcgccgacgacagctacgacgacatggtcgaagccgtgcggcgctcgatcggcgccgacaccctcggctacatctccaccgagggcatgatcgccgcgaccgaacagccgcggacccggctgtgcagcgcgtgcttcgacggccagtacccgatcccgctgcccaccgaggcttcgatcgggaagaacctgctcgaggggatgctcaccgggcagccggaatcggtgctgctcggcgacaacgccaacgccagcgcgttgagccgcccctga

SEQ ID NO: 30410 - protein, 499 aa, Nocardia farcinica IFM 10152
MFGVWAPSEDVAKLTYYGLYALQHRGQEAAGIAVSDGQQILVFKDLGLVSQVFDEQTLAAMPGHIAVGHCRYSTTGGVTWENAQPIFRTTAVGSGLALGHNGNLVNTAELAGRARELGLIGTPVSGGRPQPVGATSDSDVMTALLAHAAADSSIEQAAMELLPQLRGAFCLTFMDEHTLYAARDPHGVRPLCLGRLDRGWVVASETAALDIVGAAFVREIEPGELLAIDAEGVRSMRFANPEPKGCVFEYVYLARPDSTIAGRSVHATRVEIGRRLAKEHPVEADLVIPVPESGTPAAVGYAQGSGVPYGQGLMKNAYVGRTFIQPSQTIRQLGIRLKLNPLREVIRGKRLIVVDDSIVRGNTQRALVRMLREAGAVEIHVRIASPPVKWPCFYGIDFASRAELIANGGGADDSYDDMVEAVRRSIGADTLGYISTEGMIAATEQPRTRLCSACFDGQYPIPLPTEASIGKNLLEGMLTGQPESVLLGDNANASALSRP

SEQ ID NO: 30411 - DNA, 1500 bp, Legionella pneumophila str. Paris
  CDS (1)..(1500): transl_table=11
atgtgcggcattgtaggaatttacagtcatgaacccgttgctgctgagctttatgatagcttgattcatttacagcaccgggggcaagatgcctcaggtattttaaccggagctgatcgtttttacttcaaacatggacttggactggtcagagagtctattttctctgaagatattcttaaactgaaggggaatatcggcattgctcatgtgcgttatcccacggccggaggttatagtgaggcggatgttcagcctctttggatagggagccctcgcgggatagctctggctcataatggaaatttagtgaattatggagagttggttgatgatttatgcggaaaacagcataggcatttaaactctactcttgattcagaggcacttttattacttctggcagactatttagccaagggatcttattccgatcatgatgaagagcaattctttcaattattatgtatggcagttaatgaaatacatcaacgagttcaaggttcctattctgttgtgagtttagtaattggcaaaggtttggttgcatttagggatccgcatggtattcgtcctttagtttggggtgagcgagtccatgaagatggtagtaaagattatatttttgcttcagaaaccacgcctttttatgctttaggttttgagcccaagggtgatttgctgccaggtgaagttgcttacgtgaatcagcaaggacaattgtacagaaaagtgctttcatcaaaaaaatttacaccttgtatatttgaatacgtttacttcgccagaccagatgccacattagacgatgtgagcgtttatcgagccagattacgtatggggcaaaatttagctaaaagctggaaaaagagatttccagatacactacctgatgtggtgattccagccccttcaacagcaaatactgccgcattagcttttgcaaatgagttgggaatacgttattccgaaggtttatataaaaatccttttattggacgtacttttatcatgcctaatcaggagtcgcgatcaagacaggttcgctataaattaactcctcagaaaacggaaattaataaaaaaaaggtattaatcgttgatgatagtatcgtaaggggaactacctcacgcgaaatagtcagaatgatacgagaatatggagcatcagaaatatattttgtatcaacctgtccaccaattaaaaacccttgtttctacgggattgatatcccatcgcgtaaaaaattgatagcagcccataaaacggaagaggaaatccgtcaatttctaggggtggataaattattataccaaactcaggaaaaccttatagaggctgtgtctcgcagggggcaatatgacatgagcaagccttgtatggcttgtatggatggcaaatacatttgtggacagattactgaagaaaaaattaaattgttggagaaaaaaagattaaccgagaatgaccaagaaacagagataggagagatgtcttga

SEQ ID NO: 30412 - protein, 499 aa, Legionella pneumophila str. Paris
MCGIVGIYSHEPVAAELYDSLIHLQHRGQDASGILTGADRFYFKHGLGLVRESIFSEDILKLKGNIGIAHVRYPTAGGYSEADVQPLWIGSPRGIALAHNGNLVNYGELVDDLCGKQHRHLNSTLDSEALLLLLADYLAKGSYSDHDEEQFFQLLCMAVNEIHQRVQGSYSVVSLVIGKGLVAFRDPHGIRPLVWGERVHEDGSKDYIFASETTPFYALGFEPKGDLLPGEVAYVNQQGQLYRKVLSSKKFTPCIFEYVYFARPDATLDDVSVYRARLRMGQNLAKSWKKRFPDTLPDVVIPAPSTANTAALAFANELGIRYSEGLYKNPFIGRTFIMPNQESRSRQVRYKLTPQKTEINKKKVLIVDDSIVRGTTSREIVRMIREYGASEIYFVSTCPPIKNPCFYGIDIPSRKKLIAAHKTEEEIRQFLGVDKLLYQTQENLIEAVSRRGQYDMSKPCMACMDGKYICGQITEEKIKLLEKKRLTENDQETEIGEMS

SEQ ID NO: 30413 - DNA, 1500 bp, Legionella pneumophila str. Lens
  CDS (1)..(1500): transl_table=11
atgtgtggcattgtaggaatttacagtcatgaacccgttgctgctgagctttatgatagcttgattcatttacagcaccgggggcaagatgcctcaggtattttaaccggagctgatcgtttttacttcaaacatggacttggactggtcagagagtctattttctctgaagatattcttaaactgaaggggaatatcggcattgctcatgtgcgttatcccacagccggaggttatagtgaagcggatgttcagcctctctggatagggagccctcgcgggatagctctggctcataatggaaatttagtgaattatggagagttggttgatgatttatgcggaaaacagcataggcatttaaactctactcttgattcagaggcacttttattacttctggccgactatttagccaagggctcttattccgatcatgatgaagagcaattctttcaattattatgtatggcagttaatgaaatacatcaacgagttcaaggctcctattctgttgtgagtttagttattggcaaaggtttggttgcatttagggatccacatggtattcgtcctttagtttggggtgagcgagtccatgaaaatggtagtaaagattatatttttgcttcagaaaccacgcctttttatgctttaggttttgaacccaagggtgatttgctgccaggtgaagttgcttacgtaaatcagcaaggacaattgtacagaaaagtgctttcatcaaaaaaatttaccccttgtatatttgaatacgtttacttcgccagaccagatgccacattagacgatgtgagcgtttatcgagccagattacgtatggggcaaaatttagctataagctggaaaaagagatttccggatacactacctgatgtggtgattccagccccttcaacagcaaatactgccgcattagcttttgcaaatgagttgggaatacgttattccgaaggtttatataaaaatccttttattggacgtacttttatcatgcctaatcaggagtcgcgatcaagacaggttcgctataaattaactcctcagaaaacggaaattaataaaaaaaaggtattaatcgttgatgatagtatcgtaaggggaactacctcacgcgaaatagtcagaatgatacgagaatatggagcatcagaaatatattttgtatcaacctgtccaccaattaaaaacccttgtttctacgggattgatatcccatcgcgtaaaaaattgattgcagcccataaaacggaagaggaaatccgtcaatttctaggggtggataaattattataccaaactcaggaaaatcttatagaggctgtgtctcgcagggggcaatatgacatgagcaagccttgtatggcttgtatggatggcaaatacatttgtggacagattactgaagaaaaaattaaattgttggagaaaaaaagattaaccgagaatgaccaagaaacagagataggagagatgtcttga

SEQ ID NO: 30414 - protein, 499 aa, Legionella pneumophila str. Lens
MCGIVGIYSHEPVAAELYDSLIHLQHRGQDASGILTGADRFYFKHGLGLVRESIFSEDILKLKGNIGIAHVRYPTAGGYSEADVQPLWIGSPRGIALAHNGNLVNYGELVDDLCGKQHRHLNSTLDSEALLLLLADYLAKGSYSDHDEEQFFQLLCMAVNEIHQRVQGSYSVVSLVIGKGLVAFRDPHGIRPLVWGERVHENGSKDYIFASETTPFYALGFEPKGDLLPGEVAYVNQQGQLYRKVLSSKKFTPCIFEYVYFARPDATLDDVSVYRARLRMGQNLAISWKKRFPDTLPDVVIPAPSTANTAALAFANELGIRYSEGLYKNPFIGRTFIMPNQESRSRQVRYKLTPQKTEINKKKVLIVDDSIVRGTTSREIVRMIREYGASEIYFVSTCPPIKNPCFYGIDIPSRKKLIAAHKTEEEIRQFLGVDKLLYQTQENLIEAVSRRGQYDMSKPCMACMDGKYICGQITEEKIKLLEKKRLTENDQETEIGEMS

SEQ ID NO: 30415 - DNA, 1518 bp, Photobacterium profundum SS9
  CDS (1)..(1518): transl_table=11
atgtgtggtattgtcggaatcgtggggtctaccccagtaaaccagtctatctatgatgcactgaccgtgttgcaacaccgtggtcaagatgcagccggtattgttactctggaaagcaatcgtttccgtctgcgtaaagcgaatggacttgttcgtgatgtgtttgaagctagacacatgcagcgtcttcaagggaatgtgggtattggtcatgtacgttacccaacagcaggaagttctagtgcttcagaagctcaaccattttatgtgaattcaccttacggtatttctttggcacataatggtaatttaacaaatgctgctgaagttaaagaatctttatttacccatgctcgtcgtcatgttaatacaacatcagactctgaaattctgttgaatgtattggcaaatcaactagaactgtctaactcttaccctttgaaacctgaagatgttttcactgcagtacgtgaagttcatcgcaatgtaaaaggtgcatatgccgttgttgctatggtgattagccatggtttaatcgcatttcgcgacccacatggtattcgccctttatgtattggtaagcgtgaaattgacggttcaacggaatatatggttgcttctgaatctgttgcacttgatgcggtaggttttgatttcatgcgtgatgttgcgcctggcgaagccatatatgttacttttgatggccaattatatactgaacaatgtgctgataaccctgtattgaatccgtgtatttttgaattcgtctatttcgctcgcccagattcattcatggataaagtgtcagtttacagtgcacgtgtgtgcatggggcagagattgggtgagaaaatcaagcgcgagtgggatgatctggatattgatgttgttattcctattccagaaacatcatgcgacagtgcattagaaatcgcacgtacaatcgataaaccttatcgtcagggttttgtgaagaaccgttatgttggtcgcacatttatcatgcctggtcagcaaatgcgccgtaaatcagtacgtcgtaaattgaatgcgatccgttctgaatttaaaggcaagaatgtactgctagtcgatgactctattgttcgtggtacaacatctgaacagatcattgaaatggcacgtgatgccggtgctaacaaagtgtacctagcatcagcggcaccagaagtacgtttccctaatgtttatggtattgatatgccatcggcaaatgagttaatcgcccatggtcgcgaagttgacgaaatcagtgaaatgattggtgctgatgctcttattttccaagatctggaagacttagtggcagcggtcgctgaaggtaaccctgatattaaattattcgaaacgtcggtatttaatggcagttatgtaacgggtgatattgatcaacagtaccttgaatttttagattcgttacgtaatgaagactctaaaacccaacgtgaaattcagcaagatcttgcgaatttagagcttcataacgaaggcgtttaa

SEQ ID NO: 30416 - protein, 505 aa, Photobacterium profundum SS9
MCGIVGIVGSTPVNQSIYDALTVLQHRGQDAAGIVTLESNRFRLRKANGLVRDVFEARHMQRLQGNVGIGHVRYPTAGSSSASEAQPFYVNSPYGISLAHNGNLTNAAEVKESLFTHARRHVNTTSDSEILLNVLANQLELSNSYPLKPEDVFTAVREVHRNVKGAYAVVAMVISHGLIAFRDPHGIRPLCIGKREIDGSTEYMVASESVALDAVGFDFMRDVAPGEAIYVTFDGQLYTEQCADNPVLNPCIFEFVYFARPDSFMDKVSVYSARVCMGQRLGEKIKREWDDLDIDVVIPIPETSCDSALEIARTIDKPYRQGFVKNRYVGRTFIMPGQQMRRKSVRRKLNAIRSEFKGKNVLLVDDSIVRGTTSEQIIEMARDAGANKVYLASAAPEVRFPNVYGIDMPSANELIAHGREVDEISEMIGADALIFQDLEDLVAAVAEGNPDIKLFETSVFNGSYVTGDIDQQYLEFLDSLRNEDSKTQREIQQDLANLELHNEGV

SEQ ID NO: 30417 - DNA, 1443 bp, Haloarcula marismortui ATCC 43049
  CDS (1)..(1443): transl_table=11
atgcacgagaagtgcggcgttgttggcatctctttggaggaccgtgacgccgcccgaccgctttactactccttgtacgcgctccagcaccgcggccaggaatcggccggcatcgtcacccacgacgggttccagcagtacagccacgtcgaaatgggactcgtcggtgacgcattcgaccccggcgatctggaggcgctcaacggctcgaacggtatcggccacgtccgatacccgactgccgggagcgtcaacgcctgctgtgcccagccgttctccgtctcgttcaagtcggggtcgctgggactgtcccacaacgggaacctcgtcaacgctgacgagatcggcgacgaactggctgacctcggccacgcctttacctccgatggcgacaccgaggtcatcgcccacgacctcgcgcgtaatctcctcgaggaggatctggttcgggctgtcaagcggacgatgaaccgcatccacgggtcgtactctttgaccatcatgcacgacgagacggtcctcggcgtgcgcgacccgcaggggaaccggccgctgtgtatcggcgaactcaaggacggctacgtcctcgcctccgaatcagccgccatcgatacgctcgacggcgaactgatccgggacgtcaagcccggcgaactcgtcgtcctgcacgccgacggcaccggctacgacacctatcagctcgtcgaaccggagaacacggccaattgcttcttcgaacacgtctacttcgcgcgaccggactcgaccatcgacgagaacctcgtctacgaggtccggcgcgaactcggtcggaaactctgggaggagtccggcgtcgagtcggacgtggtgttgccggtgcccgactccgggcgtgcgttcgcctccggatacgctgaggccgcacaggacgacggctcggacatcgagttcgccgaagggctgatgaaaaaccggtacgtcggccgtacgttcatcatgccgacgcaagacgaacgcgagcgggctgtccgactgaagctcaaccccatcaagtccacaatcgagggcaaaagcgtcaccatcatcgacgactctatcgtccgcgggaccacctcgacgcaactgatcaagttgctgaaggatgccggtgccgaagaggtcaacgtgcgcatcggcgcgccgcccatcgtcgctccgtgttacatgggtatcgacatggcctcccgcgacgaactcatcgccgggaatcagtccgtcgaggaaatccgcgacgaaatcgaggcggactcgctgtcgtatctctctatcgacgccatcgcggaaacgctggacaagagccggactgacctctgtctcggctgtgtcaccggcgaatacccctacgacatcgagggcgaggcgacggaccgcgacgttgtccgcccggatatcgggacccaatcgagcccggctgacgactag

SEQ ID NO: 30418 - protein, 480 aa, Haloarcula marismortui ATCC 43049
MHEKCGVVGISLEDRDAARPLYYSLYALQHRGQESAGIVTHDGFQQYSHVEMGLVGDAFDPGDLEALNGSNGIGHVRYPTAGSVNACCAQPFSVSFKSGSLGLSHNGNLVNADEIGDELADLGHAFTSDGDTEVIAHDLARNLLEEDLVRAVKRTMNRIHGSYSLTIMHDETVLGVRDPQGNRPLCIGELKDGYVLASESAAIDTLDGELIRDVKPGELVVLHADGTGYDTYQLVEPENTANCFFEHVYFARPDSTIDENLVYEVRRELGRKLWEESGVESDVVLPVPDSGRAFASGYAEAAQDDGSDIEFAEGLMKNRYVGRTFIMPTQDERERAVRLKLNPIKSTIEGKSVTIIDDSIVRGTTSTQLIKLLKDAGAEEVNVRIGAPPIVAPCYMGIDMASRDELIAGNQSVEEIRDEIEADSLSYLSIDAIAETLDKSRTDLCLGCVTGEYPYDIEGEATDRDVVRPDIGTQSSPADD

SEQ ID NO: 30419 - DNA, 1440 bp, Streptococcus thermophilus LMG 18311
  CDS (1)..(1440): transl_table=11
atgacatacgaagttaaatctcttaatgaagaatgtggtgtttttggaatttggggtcacccagatgctgccaaattaacttatttcggactttatagtcttcaacaccgtggccaagagggggcaggaattctctcaaatgatgcgggtcaattgaagcgtcatcgtgatatggggcttctctcagaagttttccgtgatccagccaacttagacaagctgactggtaaggctgctatcggtcatgttcgttatgcgactgccggtgaggcttctgtagacaatattcaaccattcatgtttaagtttcacgatggacagcttggtcttgctcataatgggaatttgactaatgcagtgtcactaagacgtgagttggagaagaatggggccatttttagctcaacttctgattcagaaatcttagctcacttgattcgtcgtagccataacccatcatttatgggaaaagtaaaagaagctctgaacactatcaaaggtggatttgcttaccttcttatgattgaggacaagctaattgcagccttggatccaaatggttttcgtcccctttctattggtaagatggccaatggagctatcgtggtttcatctgaaacctgtgcctttgaagtagttggagcagagtggattcgcgatgtaaatccaggtgaagttgttatcatcgatgataacggcatcacttacgataactatacaacggacactcaattggctgtttgctcaatggagtatatctactttgcccgtcctgattcaaatatccgaggggtcaatgtccatacagctcgtaaacgtatgggtgctcaattagcacgtgagttcaaacatgaagcagatattgtcgttggtgtgcctaattcatcacttagtgcagccatgggatttgcggaagaatcaggcttgccaaatgaaatgggcttgataaaaaaccaatacacccaacgtacctttatccaaccaacacaagaattgcgtgagcaaggagttcgtatgaaactctctgccgtatcaggtgttgttaaaggaaaacgtgtggtcatgattgacgattccattgttcgtggaacaacgtcccgtcgtatcgttcaactcttgaaagaagcaggggcgactgaggttcacgtggctatcggaagtccagcccttgcttacccatgtttctacggtatcgatattcaaacacgtaaggaattgattgctgccaatcacacagtagaagaaatccgtgaaatcattggtgcggatagcttgacttacttgtctatcgatggcttgattgattccattggaattgacacagatgaaccaaatggtggcctttgtgtggactacttcactggcaaatattcaacaccattgtatgactacgaaaaaagctatttggaaagtttggaagaacacacttctttctattaa

SEQ ID NO: 30420 - protein, 479 aa, Streptococcus thermophilus LMG 18311
MTYEVKSLNEECGVFGIWGHPDAAKLTYFGLYSLQHRGQEGAGILSNDAGQLKRHRDMGLLSEVFRDPANLDKLTGKAAIGHVRYATAGEASVDNIQPFMFKFHDGQLGLAHNGNLTNAVSLRRELEKNGAIFSSTSDSEILAHLIRRSHNPSFMGKVKEALNTIKGGFAYLLMIEDKLIAALDPNGFRPLSIGKMANGAIVVSSETCAFEVVGAEWIRDVNPGEVVIIDDNGITYDNYTTDTQLAVCSMEYIYFARPDSNIRGVNVHTARKRMGAQLAREFKHEADIVVGVPNSSLSAAMGFAEESGLPNEMGLIKNQYTQRTFIQPTQELREQGVRMKLSAVSGVVKGKRVVMIDDSIVRGTTSRRIVQLLKEAGATEVHVAIGSPALAYPCFYGIDIQTRKELIAANHTVEEIREIIGADSLTYLSIDGLIDSIGIDTDEPNGGLCVDYFTGKYSTPLYDYEKSYLESLEEHTSFY

SEQ ID NO: 30421 - DNA, 1413 bp, Geobacillus kaustophilus HTA426
  CDS (1)..(1413): transl_table=11
atgcttgctgaaatcaaaggattgaacgaggagtgcggcattttcggcatttgggggcatgaagacgccgcccggctcacatactacgggcttcacagcctgcagcaccgtgggcaggaaggggccggcatcgttgtcgcgcataacgggagcttatccagtcataaagggctggggctggtgaccgatgtgtttcaaagcggtacgctcgatgcgctcaaaggggcggcggccatcggtcatgtccgctattcgacggcgggcgggggcggctatgaaaacgttcagccgctcttgttccgctcgcaaaccggcgcgatggcgctcgcccataacggcaacttgacaaacgccatcgagttgaagctcgcgcttgaagggcaaggaagcatttttcagacgacatcggatacggaagtgttcgcccatctcatccgccgcagccaagcgccgacgtttgtcgagcaaatgaaagaggcgctcagtcagatcgaaggggcgtttgcgtttttgctgctgacggaaaaggcgctctatgcggcgcttgatccgcacgggtttcggccgctgtcgctcggccggctcggctcggcgtatgtcgtggcgtcggaaacgtgcgcgtttgacgtcatcggcgccacatacgagcgggaagtggcgcctggggaattgctcatcatcagccgcgaaggggtgcgttcagaacggttcgctcctaggcagccgcggtcgatttgcagcatggagtacatttatttcgctcgtccggacagccatgtcgacggcatcaatgtccataaggcccgaaaaaacttaggaaagcggctggccttggaagcgccggcagaggccgacatcgtcaccggcgtgccggactcaagcatctctgttgccatcggctacgctgaggcgagcggcattccatacgaattggggttgattaaaaaccgatatgtcgggcggacgttcatccagccgtcgcaggcgttgcgcgagcaaggagtgaaaatgaagctgtcgccggtgcgcggggttgtggccggcaaacgggttgtgatggtggatgattcgatcgtgcgcgggacgacgagccggcgcatcgtcgcgatgctccgtgaagccggggcggttgaagtgcacgtgcgcatcagcgcgccgccgatcacccatccttgcttttacggcattgatacgtcgtcaaaggaagaattgatcgcggcgaatcgcactgttgaagagattcggcgcttgattggcgctgattccctcgcctttatcagccaggaagggatgcttgaggccatcgggcgtccggacgtctcgccgcagcgcgggcaatgtttggcgtgtttcactggccaatatccgacccgcctcggtcaagcggcgcggccatgtctgacgatgaaatga

SEQ ID NO: 30422 - protein, 470 aa, Geobacillus kaustophilus HTA426
MLAEIKGLNEECGIFGIWGHEDAARLTYYGLHSLQHRGQEGAGIVVAHNGSLSSHKGLGLVTDVFQSGTLDALKGAAAIGHVRYSTAGGGGYENVQPLLFRSQTGAMALAHNGNLTNAIELKLALEGQGSIFQTTSDTEVFAHLIRRSQAPTFVEQMKEALSQIEGAFAFLLLTEKALYAALDPHGFRPLSLGRLGSAYVVASETCAFDVIGATYEREVAPGELLIISREGVRSERFAPRQPRSICSMEYIYFARPDSHVDGINVHKARKNLGKRLALEAPAEADIVTGVPDSSISVAIGYAEASGIPYELGLIKNRYVGRTFIQPSQALREQGVKMKLSPVRGVVAGKRVVMVDDSIVRGTTSRRIVAMLREAGAVEVHVRISAPPITHPCFYGIDTSSKEELIAANRTVEEIRRLIGADSLAFISQEGMLEAIGRPDVSPQRGQCLACFTGQYPTRLGQAARPCLTMK

SEQ ID NO: 30423 - DNA, 1410 bp, Anaplasma marginale str. St. Maries
  CDS (1)..(1410): transl_table=11
ttggtgcagaatcgtatgccactggcaagcgtacacgaagaatgcgggatttttgcaatccagaaccacagcgacgcggctaagaagtgcctcatgggccttcatgcgctgcagcaccgcggtcaggagtcatttggcattgttacatcgtccaacaacggggagttcgctgtgtatcacagcagtgaacacgtgagtagcatattcgaaaagccggaggcacactcgttacggggcaatctgtcagtcgggcatgtaagatattccaccagcggcagtaaaccgggagcgcagccaatagtggtagactgcaagttcggcaaattggctatagcacacaacgggaacctaactaacgccgatagcctgcgtaggcagttagtcgacaaggggtgcgtgtttttgtcagacatcgatacggaggtcattgcccacttaatagcaaccagcccgtctgattcttttatcgattgcgtcatctccgccgtgaaagaggttaagggcgcgtattctctggtcatgatgacaaacaacaccctggtcggggtgagagacgctgccggtatacggccgttggtgcttggcattgtggatggggcatatgtcatggcatcagaaacttgcgcactcgatatagtaaaggcagagtttgtcagagatatacaacccggagaactggtggtaatcagccagtcaaatgagttgaccagcatgtatccgtttccgccgttgaagcgcagtttctgcatttttgagtatatatattttgccaggccggatagtgtcgtggacaacataccagtttatgaggcacgtaaaaatatcggggcagagcttgcagtagaaagccctcctcccgacaatgtagatatggtggtgcccgtaccagattctggtatcccagcagctatggggtacgcggcaaagtctggcgtgccttttgagtttgggatagtaaggaatcactatgtggggcgcactttcatccagccaaccgatggcgggcggcgcatgggggttgagctgaagcacaacgcgaactcctcagttttgcgcgggaaaaacatagttctggttgacgacagcatagtgcgtggcaccaccctgcgagaagtaatagagctgcttagaagggctggaacaaaagccatacacctccggatttctagcccgccaacactgcactcatgcttttatggtatcgatacgccggagcggtccaagttggtggcaaacaggctctctctacaagaactgaacacgatgctgcagtgcgatagcatagcatttatcagcatagatggtctgtacaaagcagtgtgcggggccccccgcaacaactcctctccacagtattgtgatgcatgcttcaccggcatgtacccggtaggcgaaatggaacagcactga

SEQ ID NO: 30424 - protein, 469 aa, Anaplasma marginale str. St. Maries
MVQNRMPLASVHEECGIFAIQNHSDAAKKCLMGLHALQHRGQESFGIVTSSNNGEFAVYHSSEHVSSIFEKPEAHSLRGNLSVGHVRYSTSGSKPGAQPIVVDCKFGKLAIAHNGNLTNADSLRRQLVDKGCVFLSDIDTEVIAHLIATSPSDSFIDCVISAVKEVKGAYSLVMMTNNTLVGVRDAAGIRPLVLGIVDGAYVMASETCALDIVKAEFVRDIQPGELVVISQSNELTSMYPFPPLKRSFCIFEYIYFARPDSVVDNIPVYEARKNIGAELAVESPPPDNVDMVVPVPDSGIPAAMGYAAKSGVPFEFGIVRNHYVGRTFIQPTDGGRRMGVELKHNANSSVLRGKNIVLVDDSIVRGTTLREVIELLRRAGTKAIHLRISSPPTLHSCFYGIDTPERSKLVANRLSLQELNTMLQCDSIAFISIDGLYKAVCGAPRNNSSPQYCDACFTGMYPVGEMEQH

SEQ ID NO: 30425 - DNA, 1518 bp, Idiomarina loihiensis L2TR
  CDS (1)..(1518): transl_table=11
atgtgtggtattgttggtattgttggtaagcagcctgttaaccaagcgctttacgatgggttaaccatgcttcaacatcgtggccaggacgccgctggtattatgacagttgatgagcactgtactttgcgtttaagaaaagccaacggattggtgcgggatgtgttccatacacgtcacatgcaccgcttgtcgggtaatgtcggtattggtcatgtgcgttatcctacagtcggaagttcgagctcagcagaagcgcaaccgttctatgttaactcaccttttggtattgccatggcgcataatggtaacttaaccaatgctgctgacgttcaggaacatttgtttcaaacggcgcgtcgtcatattaataccacctccgactcggaaattttgctgaacatttttgccaatgagctggataaaaacgagagtttaacgctgagcgaagaagacgtttttcgcaccatgaccgcggttcaccgtcaggttcgtggttcttatgccgtggtagcaatgatcctcggtcatggcatggttgcattccgtgacccatggggcattcgtcctttagccctgggtaaacgtgataccgaagacggcgaagagtacattgttgcctctgaaagcgttgccattgacggcaccggttttaaatatatgcgcgatgtcgagcctggcgaagctatttatattacaaacgatggcaagctgtattctcgtcagtgcgctgataagccaatacattgtccgtgtatttttgagtacgtgtactttgcgcgtcccgactcgtttattgatggcatttcggtctatgcctctcgggttaatatgggccgtaagctgggcgagaagataaagcgtgattacggcgaactcgatattgatgtggttattccaattcctgaaaccagctgtgatatcgctttagagatagccagcgtgctggacttaccttatcgccagggctttgtgaaaaaccgttatattggtcgtacctttattatgccgggacagactcagcgacgtaaatcagtacgccgaaagttaaatgccattagcgcggaattccgtggtaagaacgttctgctggttgatgattcaattgtacgtggaacaacgtcagagcaaataattgaaatggctcgtgaagccggtgcgaagaaagtatattttgcttcagctgctccggaaattcgcttcccgaacgtttacggcattgatatgccaagcgctaacgagctgattggtcacggacgtgaagcaacggaaattcgtgacataattaaagctgatggtctcatttatcaggatcttgacgacttaattgaagcagtaggagcagagaaccgatcaattaaacgttttgatacgtcggtattcagtggtgaatacgtaacgggtgatgtgagccaggagtacttagatcgtttgcatgcggcacgtaatgacgttgcaaggtccgatcgtgacggctcagaagacgccaacctcgaacttcacaacgacaacgattaa

SEQ ID NO: 30426 - protein, 505 aa, Idiomarina loihiensis L2TR
MCGIVGIVGKQPVNQALYDGLTMLQHRGQDAAGIMTVDEHCTLRLRKANGLVRDVFHTRHMHRLSGNVGIGHVRYPTVGSSSSAEAQPFYVNSPFGIAMAHNGNLTNAADVQEHLFQTARRHINTTSDSEILLNIFANELDKNESLTLSEEDVFRTMTAVHRQVRGSYAVVAMILGHGMVAFRDPWGIRPLALGKRDTEDGEEYIVASESVAIDGTGFKYMRDVEPGEAIYITNDGKLYSRQCADKPIHCPCIFEYVYFARPDSFIDGISVYASRVNMGRKLGEKIKRDYGELDIDVVIPIPETSCDIALEIASVLDLPYRQGFVKNRYIGRTFIMPGQTQRRKSVRRKLNAISAEFRGKNVLLVDDSIVRGTTSEQIIEMAREAGAKKVYFASAAPEIRFPNVYGIDMPSANELIGHGREATEIRDIIKADGLIYQDLDDLIEAVGAENRSIKRFDTSVFSGEYVTGDVSQEYLDRLHAARNDVARSDRDGSEDANLELHNDND

SEQ ID NO: 30427 - DNA, 1527 bp, Azoarcus sp. EbN1
  CDS (1)..(1527): transl_table=11
atgtgcggaattttaggggtcgtcgcgacttccccggtcaaccagttgctctacgatggcctccaggtcctgcagcatcgcggtcaggatgctgccgggatcgcgacttccgagggcggacgcttcttgatgcacaaggggtcgggcctcgtgcgcgacgtgtttcgtacgcgaaacatgcgcaatctcgtcggcaactggggcatcggccatgtccgctatcccacggcggggtccgcgtacaatcccgccgaagcgcagccgttctacgtcaattctccgttcgggctgctgcttgcgcacaatggcaatctgacgaactcggaggaactcaagcgggaaatgttcctttccgatctgcggcacatcaacacgaattcggattcggaagtgctgctgaacgtgcttgcccatgaattgcaggcagcggcgaagggtttcaagctcgatgaggacgcggttttccgcgccgtctccggtgtccatcggcgctgccgcggcgcgtacgcggtggtcgtgatgattgccggctacggcctgctcgcgttccgcgacccgtacgggatacggccgctcgtggtcgggcgcaatgaggtcgaggccggacaggagtggctcgtcgcttcggagtccgtcgcgatggatgtcctcggcttcaggatgctgcgcgatgtcgcccccggcgaggcgatcctcatcgatacgcaggggaatttccggagccggcagtgcgcggacaagactgtcgaagcgccctgcatgttcgagttcgtctatctcgcgcggccggattcgatcatcgacggggtgtcggtgtacgagtcgcgcgtcaagatgggcgagttcctcgccgacaagctcaagcgcgtgatgccgcatgccgagatcgacgtcgtgatcccgattcccgactcgagccgaccctccgcaatggaaatggcccaccggctgaaccttccctatcgcgaaggcttcgtgaagaaccgttatatcggacgcaccttcatcatgccgggacaggcgatccggcgtaagtcggtgcgccagaagctgaacacgattccgcaggaattcaggggcaagaaagtgctcctcgtcgacgattcgatcgtgcggggaacgaccagccgtgaaatcgtgatgatggcgcgcgaggccggtgccgagaaagtctatatggcgtcggcggcgcctcccgtccggtatgcgaacgtgtacgggatcgacatgccgacgcgcgccgaactgatcgccgcaagccgcgacgaggctcagatctgccaggagatcggtgcggacggactgatctaccaggacctcgccgacctgaaggcggcggtgagagccgtgaatccggcgatcagcttcttcgagacttcgtgcttcgacggatgctatgtgacgggggacatcacgccggagtatctcaacgggatcgagaaccggcacgacgccggcaacctctcatcggacgagagcgagggcggacaactcgacctcaacctcgtaggtagccacgacaactga

SEQ ID NO: 30428 - protein, 508 aa, Azoarcus sp. EbN1
MCGILGVVATSPVNQLLYDGLQVLQHRGQDAAGIATSEGGRFLMHKGSGLVRDVFRTRNMRNLVGNWGIGHVRYPTAGSAYNPAEAQPFYVNSPFGLLLAHNGNLTNSEELKREMFLSDLRHINTNSDSEVLLNVLAHELQAAAKGFKLDEDAVFRAVSGVHRRCRGAYAVVVMIAGYGLLAFRDPYGIRPLVVGRNEVEAGQEWLVASESVAMDVLGFRMLRDVAPGEAILIDTQGNFRSRQCADKTVEAPCMFEFVYLARPDSIIDGVSVYESRVKMGEFLADKLKRVMPHAEIDVVIPIPDSSRPSAMEMAHRLNLPYREGFVKNRYIGRTFIMPGQAIRRKSVRQKLNTIPQEFRGKKVLLVDDSIVRGTTSREIVMMAREAGAEKVYMASAAPPVRYANVYGIDMPTRAELIAASRDEAQICQEIGADGLIYQDLADLKAAVRAVNPAISFFETSCFDGCYVTGDITPEYLNGIENRHDAGNLSSDESEGGQLDLNLVGSHDN

SEQ ID NO: 30429 - DNA, 1527 bp, Zymomonas mobilis subsp. mobilis ZM4
  CDS (1)..(1527): transl_table=11
atgtcgcctagcctttcgagcgaactcttttccgactctatctctaccctgacgacgacaactgaatctttagataatggggcgtctgatgatacccttcatgaagaatgtggtgttttcggtatttggggcgcagatacagccgctgccgtcgtagctctcggactacatgctttacagcatcgcggacaggaagccgccggtatcaccagctgggatgggaaaaatttccactcccgtcgtgctgttggtcacgttgcgggtaactttgaccgtgacgatgctatccgcagcttgcccggatcatgtgctattggccatgtccgctatgcaaccaccggtgccagcaccttgtgcaatgttcagccgctttatgccgaactggtttcgggcggatttgcgattgctcataacggcaatatttccaatgccgaaactttgcgccatcagttggtgcgtcatggatctatctttcaatccacgtcggatactgaaacgattatccatctggttgcgacctcaagctatcgcagcctgttagaccgattcattgatgctttaaaacaggttgagggcgcttattctctcgtctgcctgacgccggaaggcatgattgcctgtcgtgatccgctgggtattcgcccgctggttctcggtaaagtcggggaaacttttgttgtcgcttccgaaacggttgctctcgatattattggcggaacctatatccgtcaggtcgaaccgggtgagctgattattatttcggaaaaagggctgcaatctattcatccctttaaaaagcagaagcctcgcccctgcattttcgagcatgtctatttttcgagaccggattctttgatcggtagcacctcggtttattctgttcggaaatctatcgggatcgaattggcgcgcgaaaatccggttgatgccgatatggttattcctgtgccagattcagggacacctgccgctatcggttatgcccagcaatcttctttgccgtttgaattgggtattatccgttcccattatgttggacgcacctttattcagccgggcgaccaagtccgtcatttgggcgtgaagctgaagcataatgccaaccgtgccttgattaaaggcaagaagttggttctagttgatgactctattgtcagaggcacgaccagcgtcaaaatcatcagaatgcttcgggatgcgggtgccaaggaaatccatttgcggattgccagcccaccgacccgtcatagctgtttttatggtgtagatacgccggagcgggcaaaattgttggcggctaaaatgaccgtcgaacagatggcagaatatatcggcgctgatagtttagcttttatttcgatggatggcctttatcgtgcggtcggtgaagaggctcgcaatgatgctcagccgcaatattgtgatgcttgctttacaggtgcctatcccacgcccctaaccgatcttggcgaattgggtgctagcgaacaactggttcgtttatccgaacaggtggctatcgcctaa

SEQ ID NO: 30430 - protein, 508 aa, Zymomonas mobilis subsp. mobilis ZM4
MSPSLSSELFSDSISTLTTTTESLDNGASDDTLHEECGVFGIWGADTAAAVVALGLHALQHRGQEAAGITSWDGKNFHSRRAVGHVAGNFDRDDAIRSLPGSCAIGHVRYATTGASTLCNVQPLYAELVSGGFAIAHNGNISNAETLRHQLVRHGSIFQSTSDTETIIHLVATSSYRSLLDRFIDALKQVEGAYSLVCLTPEGMIACRDPLGIRPLVLGKVGETFVVASETVALDIIGGTYIRQVEPGELIIISEKGLQSIHPFKKQKPRPCIFEHVYFSRPDSLIGSTSVYSVRKSIGIELARENPVDADMVIPVPDSGTPAAIGYAQQSSLPFELGIIRSHYVGRTFIQPGDQVRHLGVKLKHNANRALIKGKKLVLVDDSIVRGTTSVKIIRMLRDAGAKEIHLRIASPPTRHSCFYGVDTPERAKLLAAKMTVEQMAEYIGADSLAFISMDGLYRAVGEEARNDAQPQYCDACFTGAYPTPLTDLGELGASEQLVRLSEQVAIA

SEQ ID NO: 30431 - DNA, 1473 bp, Silicibacter pomeroyi DSS-3
  CDS (1)..(1473): transl_table=11
atgcccgcccctcgttttcccatcgcccatccctttgatgacgacaagctgcgcgaggaatgcgggatattcggggtgatcggagttcaggacgccgccagtttcgtggctcttggcctgcatgccctgcaacaccggggacaagaggcgggcggtatcgtcacccatgaccccgaacaggggttcaactcggcccgccgctttggctatgtccgcgacaacttcacctcgcaatcggtgatggaaaccctgcccggcccgctgggcatcggccatgtgcgctattccaccgccgggtccaagggtcagacccagatccgcgatgtgcagccctttttcggcgagtttgccatgggcggcgcggcgattgcccataacggcaacatcaccaatgccaatgccctgcgccgcgaactgatcgagcgcggctcgatctttcaaagctcttcggacagcgaatgcatcatccacctgatggcgcgctccttgcagcgcaccatccctgagcggatggaggatgcgctgcgtcgggtcgagggcgcgttttcggtggtggcgatgacccggaccaagctcatcggcgtgcgcgacccgctgggcgtgcgcccgctggttctgggcaaggtcggtgatggctggattctgtcctcggaaacctgcgcgctggatatcatcggcgccgagttcatccgcgagatcgaaccgggcgagatggtggtgatcactgccgaggacggggtgcagagccatttccccttccgcccgcaaccgtccaagttctgcatcttcgaacatgtctatttctcgcgccccgattcgatcctgggcgggcgcagcgtgtatgagacgcgcgaggcgatcggccgcgaactggccaaggaaagcccggtcgaggccgatctggtctgtccggtgcccgacagcggcaccccggcggcgatcggtttctcgctggaaagcggcattccctatgcgatggggatcatccgcaatcagtatatgggccgcaccttcatcgagcccaccgagcagatccgcaacatgggcgtgcgtctgaagctgaacgtgaaccgggcgctgatccggggcaagcgggtgatcctggtcgacgactcggtggtgcgcggcaccaccagccgcaagatcaaggacatgatcctggatgccggcgccaaggaggtgcatttccgcatcgccagcccgcccaccgcctggccgtgtttctatggcgtcgacacgcccgagcgcgagaagctgctggcagccaccatgagcgaggacgagatgcgcacgcatctgggggtggacagcctgaagttcatctctctcaatggactctaccgtgcagtgggcgagacaaatggccgtgacaacgcctgcccgcaatattgcgacgcctgcttctcgggcgaatacccggtgcggccctcggacatgatcgaaaagggcttctctctgaaagccgccgaatag

SEQ ID NO: 30432 - protein, 490 aa, Silicibacter pomeroyi DSS-3
MPAPRFPIAHPFDDDKLREECGIFGVIGVQDAASFVALGLHALQHRGQEAGGIVTHDPEQGFNSARRFGYVRDNFTSQSVMETLPGPLGIGHVRYSTAGSKGQTQIRDVQPFFGEFAMGGAAIAHNGNITNANALRRELIERGSIFQSSSDSECIIHLMARSLQRTIPERMEDALRRVEGAFSVVAMTRTKLIGVRDPLGVRPLVLGKVGDGWILSSETCALDIIGAEFIREIEPGEMVVITAEDGVQSHFPFRPQPSKFCIFEHVYFSRPDSILGGRSVYETREAIGRELAKESPVEADLVCPVPDSGTPAAIGFSLESGIPYAMGIIRNQYMGRTFIEPTEQIRNMGVRLKLNVNRALIRGKRVILVDDSVVRGTTSRKIKDMILDAGAKEVHFRIASPPTAWPCFYGVDTPEREKLLAATMSEDEMRTHLGVDSLKFISLNGLYRAVGETNGRDNACPQYCDACFSGEYPVRPSDMIEKGFSLKAAE

SEQ ID NO: 30433 - DNA, 1491 bp, Francisella tularensis subsp. tularensis SCHU S4
  CDS (1)..(1491): transl_table=11
atgtgtggagtaattggagtcgctggaccagatcaggttagttatgcattattttatggtttaagtcttttgcagcataggggtcaagatgctgcagggattgcaactatggatcatgggcacttttttatccgtaaaaatacaggtctagtaagtgatgtatttacagatgaaaaactagagaagtcaaaaggtaatatgggtatcggtcatgttagatatcctactgcaggtagcttgggtgcagctgatagccaacctttttatgtaaataatccccatggtatagttttcgttcataatggcaatctgactaatgtgccagagcttgcacaaatgctccatgatattgaaagacgccatcttaatacaagttcagattccgaattattgcttaatttctttgcttgtgggatgaataaatcaaaaggatctgcgacttctgaggctgtttataaagcatgtaaatttgtttttgagcatgtcaaaggtggttatgcatgtactgcgatgatagcaaattttggtttaattgcttttagagatccttatggtattcgtccacttgtgcttggttttaaagagtacgatgatggtgaaaaagcttacatggtcgctagtgaaagtgttgctttagatatttccggatttaaagtattacgtgatgttgagcctggtgaggtgataataattacagaggatagaaaagttcactctaaaatctgtgcaaagaatccagttttggcaccatgcctatttgagtatgtatactttgcacgtcctgatagtattatgaatggtgtgagtgtttatcaagcgcgagtagatgcgggtaaaatcctaagtaagagaatcaaagaagcgtggaaggataaggatatcgatatcgttatccctgtacctgagacaggtagagcctctgctcaagagattgcaacagcattaggtgttgagtaccgtgaaggttttgttaagaatcgctatgttggtagaacttttatcatgccagagaatgttgatagaaagaattttgtcagaagaaaactaaaccctattccagcagaatttagggataaaaatgttctacttgttgatgattctattgtccgaggtacaacatcaaagcgtattattgagatgattagagatttaggtgctaaatctgtttatcttgcttcagtatctccagccgttcgttatccaaatgtttatggtattgatatgccggttaagtcggatttaattgctcatggaaagactatagaagagattcgccagtggattggagtagatggactaatatatttaccattagaggatctaaaagagattattcaaaagcaaaaccctaaaattagagagtttgaggatagtgttttctctggtaattacattacaggtgatgtcgatgatgcttatctagatgcgctagagaaacatcgtaaagagttaaaagaattagaaaaaaaatacaaagggtttgataactaa

SEQ ID NO: 30434 - protein, 496 aa, Francisella tularensis subsp. tularensis SCHU S4
MCGVIGVAGPDQVSYALFYGLSLLQHRGQDAAGIATMDHGHFFIRKNTGLVSDVFTDEKLEKSKGNMGIGHVRYPTAGSLGAADSQPFYVNNPHGIVFVHNGNLTNVPELAQMLHDIERRHLNTSSDSELLLNFFACGMNKSKGSATSEAVYKACKFVFEHVKGGYACTAMIANFGLIAFRDPYGIRPLVLGFKEYDDGEKAYMVASESVALDISGFKVLRDVEPGEVIIITEDRKVHSKICAKNPVLAPCLFEYVYFARPDSIMNGVSVYQARVDAGKILSKRIKEAWKDKDIDIVIPVPETGRASAQEIATALGVEYREGFVKNRYVGRTFIMPENVDRKNFVRRKLNPIPAEFRDKNVLLVDDSIVRGTTSKRIIEMIRDLGAKSVYLASVSPAVRYPNVYGIDMPVKSDLIAHGKTIEEIRQWIGVDGLIYLPLEDLKEIIQKQNPKIREFEDSVFSGNYITGDVDDAYLDALEKHRKELKELEKKYKGFDN

SEQ ID NO: 30435 - DNA, 1413 bp, Bacillus clausii KSM-K16
  CDS (1)..(1413): transl_table=11
atgtttactgaaatcaaaggcttgaacgaagaatgtggcgtatttgccgtttggggccataaagaagctgcgcaaattacgtattatgggttgcacagcctccagcaccgcggccaggaaggcgcaggcattgtcgtgtccgacggaaacaagctctctgcccataaagggctcggcctagtcaatgatgtgtttaatcaagatgtcttgcgtaatcttcaagggaagggcgcgattggccacgtccgttatgcgacggccggtggaggcggctatgccaatgtccagccgttgtatttcaattcgcaaaaaggcggtcttgcgattgcgcacaatggcaatcttgtcaacgccaatcacttaaaacaccagcttgaagcacaagggtcgatcttccagtccacatcggatacggaagtgctcgcccatctcattaaacgcagcggctactatacgttagaagaacaattgaaaaatgggctgtcttccttaaaaggcgcctatgcatttgccgtcatgaatgagcgccaactgatggtcgcccttgatccaaatgggttgcgtcctctttccatcggacgtttaggcgatgcgtatgtcgttgcttcagagacatgtgcgttcgacatcattggcgccacctatgagcgtgaagtaatgccaggtgaactgctcattattgacgatacaggcttgcgcagcgaacgctttgtttctccagggaaccgggcgatttgcagcatggaatacgtttattttgcgcggccagattcaaacgtggataccatcaatattcatacagcgagaaaaaatttaggaaaacagcttgcgattgaagcgccagtggaagcggatgtggtgacaggcgtgcctgattccagcatttccgcagcaattggctatgctgagcagtctggcattccttatgagttgggcatgattaaaaatcgctatgtcgggcgcacctttattcaaccttcacaagaattacgggaacaaggggtaaagatgaagctttcccctgtgcgtggcgtagttgaaggcaaacgagttgttatgattgacgattcgattgtacggggaacgactagccgccgcattgtccatatgcttcgtgatgcaggggcagctgaagtccatgtccgcatttcatcgccaccgattaaacatccgtgcttttacggaattgatacgtcaacgacggaagaattaattgcttccaaccactcaatcgaagaaatgcgggaaatcatgggggctgattcacttgcttttttgtcgactgaaggcttgaaagcagggattggccgttctgaggcgatgcataattgcgggcaatgccttgcctgctttacaggcgaatacccaacggagatttatgccgacaccgtgcatccgcacgcgaaagtatag

SEQ ID NO: 30436 - protein, 470 aa, Bacillus clausii KSM-K16
MFTEIKGLNEECGVFAVWGHKEAAQITYYGLHSLQHRGQEGAGIVVSDGNKLSAHKGLGLVNDVFNQDVLRNLQGKGAIGHVRYATAGGGGYANVQPLYFNSQKGGLAIAHNGNLVNANHLKHQLEAQGSIFQSTSDTEVLAHLIKRSGYYTLEEQLKNGLSSLKGAYAFAVMNERQLMVALDPNGLRPLSIGRLGDAYVVASETCAFDIIGATYEREVMPGELLIIDDTGLRSERFVSPGNRAICSMEYVYFARPDSNVDTINIHTARKNLGKQLAIEAPVEADVVTGVPDSSISAAIGYAEQSGIPYELGMIKNRYVGRTFIQPSQELREQGVKMKLSPVRGVVEGKRVVMIDDSIVRGTTSRRIVHMLRDAGAAEVHVRISSPPIKHPCFYGIDTSTTEELIASNHSIEEMREIMGADSLAFLSTEGLKAGIGRSEAMHNCGQCLACFTGEYPTEIYADTVHPHAKV

SEQ ID NO: 30437 - DNA, 1338 bp, Campylobacter jejuni RM1221
  CDS (1)..(1338): transl_table=11
atgtgtgcagttgtaggagttatcaattcaaaaaatgctagcacttatgcgtattatgcgctttttgctatgcaacaccgtgggcaagaagcaagtggcattagtgtgagtaatggtaaaaatattaagactattaaagctaaaggtgaagtgagtcaaatttttaatcctgataatctaaaaactttagaaggtgaaatcgctatagggcataatcgctattctacagcaggaaattcaagtttaaatgacgctcagcccatagcagctacttcggttttaggtgatattgctttagcgcataatggaaatttagtcaataaagaagaggtaagatcaagacttattcaagatggggctatttttcaaaccaatatggatacagaaaatgttgtccatcttatcgcaagaagtaagcaagaaagtctaaaagatagatttattgagagtttaaaagaatgtataggagcttattgttttgttttagcaagcaaagataaactttatgttgtaagagatcctcatggggtgcgtcctttgtctttagggcgtttaaaagatggaggctatatagttgctagtgaaacttgtgcttttgatcttatagaggctgaatttattcgtgatgttaaaccaggggaaatgcttatttttactcagggaaatgataaatttgaaagcatagaacttttttctcaaactcctagaatttgcgcttttgaatacatttattttgctagacctgatagtatagtagaaggcaaaagcgtgtatgaagtgcgtaaaaaaatgggcgaagctttagctaaaaaatttgcttataaagcagactttgtcgtgcctgtgccagatagtggagtaagtgcagctataggttttgcgcaatatttacaaatccctcttgaaatggcaatagtaagaaatcattatgtaggaagaacttttatagagccaactcaagagcttagaaatttaaaagtaaaattaaaacttaatcctatgcgtaaagttttagaaggcaaagaaatcgtagtcattgatgatagcttggtgcgtggcactacttctaaaaaaataatttccttacttcgtgctgcaggagcgagtaaaatccatcttgccatagcttgtcctgagatcaaatttcctgatacttatggtatagatactccaacttttgaagaacttatcagcgcaaataaaaatgctgaagaagtgcgtgaatatgtagaagctgatacgctaagttttttaagcataaaagagctaactcaaagcataggcgatgaaagaaaatattctttaatcagttttgatggagattattttattaaataa

SEQ ID NO: 30438 - protein, 445 aa, Campylobacter jejuni RM1221
MCAVVGVINSKNASTYAYYALFAMQHRGQEASGISVSNGKNIKTIKAKGEVSQIFNPDNLKTLEGEIAIGHNRYSTAGNSSLNDAQPIAATSVLGDIALAHNGNLVNKEEVRSRLIQDGAIFQTNMDTENVVHLIARSKQESLKDRFIESLKECIGAYCFVLASKDKLYVVRDPHGVRPLSLGRLKDGGYIVASETCAFDLIEAEFIRDVKPGEMLIFTQGNDKFESIELFSQTPRICAFEYIYFARPDSIVEGKSVYEVRKKMGEALAKKFAYKADFVVPVPDSGVSAAIGFAQYLQIPLEMAIVRNHYVGRTFIEPTQELRNLKVKLKLNPMRKVLEGKEIVVIDDSLVRGTTSKKIISLLRAAGASKIHLAIACPEIKFPDTYGIDTPTFEELISANKNAEEVREYVEADTLSFLSIKELTQSIGDERKYSLISFDGDYFIK

SEQ ID NO: 30439 - DNA, 1401 bp, Ehrlichia ruminantium str. Welgevonden
  CDS (1)..(1401): transl_table=11
atgcaatttaatgaaatatatgaggaatgtggagtatttgccatatataataacaattatgcagctatcaattgtattttaggattacacgctattcaacatagaggacaagaatcatttggtatagtaacatctgataatactaatttttactcctattactctaatgaacaagtgaatactatcttcactcaacaatcaaaaatagaccacctattaggaaatattgctattggacacgtacgttactctacaagcggaagcaaaactggtatgcaacctataattttagattgccaatttggaaaattagcaatagcacataatggtaaccttattaatgcattacaaattagagaatcactcattaaaaaaggacgtatattttcatcagacattgatacagaagtaatagcacatcttattgctatgaatacacaagatactatattggacaatataatatacgccctacaaaatattaagggtgcttattctttagtaattttgataaacaatactttagtatgttgtcgagatccatatggtattagaccattagtactaggcatgttagacaatgtatatgtaatagcttcagaaacatgtgctttagatatagttggagcacaatttgtcagagatattttaccaggagaattaataacaattaatcaaagtaataccttaacaagttatttcccatttgaaaaacaaaaatcaagtttttgtatttttgaatacgtatattttgcacgaccagacagtataatggaaaataagtctgtatatgaaatacgtaaaaacataggaagagaactagcaatagagaatcctgtaccaaaagatacaaatatggtaatacctatacctgattctggagtaccagctgcattagggtttgcagaatatactaatataccttttgagttcggcattattaggaatcattatataggaagaacttttatacaacctcacgaccatattcgtaatataggagtaaagcttaagcataatcccaattcttcaatattaaaaggtaaaaatatagttttaatagatgatagtattgtacgaggaacaactttaaaaaatataatagcattactccataaagcaggtgtcaaacagatacacttaagaatctcaagtcctcctactatacattcttgcttctacggaatagacacaccagaagaatcaaaattgatagccaacaatttatcaaaagcagacattataaaattattaggatgtgatagcttacatttcttaagcataaatgggctttacaaggcaatatgcaatacaaaacgcaataatgtcccacaatattgtgatgcatgcttcactggagattacccaattggtaaaatagatacaaataatgtttactaa

SEQ ID NO: 30440 - protein, 466 aa, Ehrlichia ruminantium str. Welgevonden
MQFNEIYEECGVFAIYNNNYAAINCILGLHAIQHRGQESFGIVTSDNTNFYSYYSNEQVNTIFTQQSKIDHLLGNIAIGHVRYSTSGSKTGMQPIILDCQFGKLAIAHNGNLINALQIRESLIKKGRIFSSDIDTEVIAHLIAMNTQDTILDNIIYALQNIKGAYSLVILINNTLVCCRDPYGIRPLVLGMLDNVYVIASETCALDIVGAQFVRDILPGELITINQSNTLTSYFPFEKQKSSFCIFEYVYFARPDSIMENKSVYEIRKNIGRELAIENPVPKDTNMVIPIPDSGVPAALGFAEYTNIPFEFGIIRNHYIGRTFIQPHDHIRNIGVKLKHNPNSSILKGKNIVLIDDSIVRGTTLKNIIALLHKAGVKQIHLRISSPPTIHSCFYGIDTPEESKLIANNLSKADIIKLLGCDSLHFLSINGLYKAICNTKRNNVPQYCDACFTGDYPIGKIDTNNVY

SEQ ID NO: 30441 - DNA, 1419 bp, Dehalococcoides ethenogenes 195
  CDS (1)..(1419): transl_table=11
ttgcatgaatcttgcggcattttcggtgtatttgcccccggtcaggatgtagcccggctcacatttttcgccctgtttgccttgcagcacaggggacaggaaagctcaggtatttctacatctgacgggcgggaacttaagctttattcccagatgggtctggtctcccatatctttactgaagatatactccgcaaactgggcggacatattgccatagggcataaccgttattccaccaccggttcaagccagcagataaacgcccagccatttctgatgggccaaggcgacaacgttatggccatagcccataacggcaatatagttaattcagaagccctgaatgccgaactaagctctcagggatatgtttttaaaagctctacagataccgaaataatcggccagcttatcctgtcagcagttgaaactgactgggtcaaacggatacgctatgccatgaaccgccttaaaggggctttttcctgcactattatgaccaaagacaccctctacgccatgcgtgacccgctgggtgtccgccccctgtgcctgggcaaaattcaagggggttacgtagttgcttccgaaagctgtgcccttgaccatatcggggctgatttcatacgcgaaatagagccgggtgaaattctggctataaatgaaaacggggtaaccagtttcaaacagccgatttcccgccgggctttgtgcatatttgaatttatttattttgcccgccctgacagccagatagacgggcagcttttatattccgcccgccaggctatgggggcagagctggccagagagtacccggtagaagcggatttggtgataggcgtacctgactccgctacagcagccggtataggttatgctataaattcaggcatacccccggccgaaggccttattaaaaaccgctacatggggcggacatttattcagcctgaccagcaccttcgcgacctgggagtaaagctcaagttcaaccccctgaggagtgttctggaagacaagcgggtagtactggtagatgacagcatagtccgcgggactaccaccccccaggttatccgcctgctgcgcaaagccggtgccaaagaagtacatatgagggtatgcgccccgcccataaccaacccctgtttcttcggggtagacatggccacccgttcggagcttattgccgctaaaatgagcgtgcctgagatacagaaatacataggggcagattcacttggttacctcagcctgcccggccttataaaggcagtggggctgcccaaagataacttctgcctggcctgtttcaccggcgaatacgccctgccggttcagctggagatggataaatttgcactcggcaaccagcgcggcaactgctgccagatgccatcacccggcagctaa

SEQ ID NO: 30442 - protein, 472 aa, Dehalococcoides ethenogenes 195
MHESCGIFGVFAPGQDVARLTFFALFALQHRGQESSGISTSDGRELKLYSQMGLVSHIFTEDILRKLGGHIAIGHNRYSTTGSSQQINAQPFLMGQGDNVMAIAHNGNIVNSEALNAELSSQGYVFKSSTDTEIIGQLILSAVETDWVKRIRYAMNRLKGAFSCTIMTKDTLYAMRDPLGVRPLCLGKIQGGYVVASESCALDHIGADFIREIEPGEILAINENGVTSFKQPISRRALCIFEFIYFARPDSQIDGQLLYSARQAMGAELAREYPVEADLVIGVPDSATAAGIGYAINSGIPPAEGLIKNRYMGRTFIQPDQHLRDLGVKLKFNPLRSVLEDKRVVLVDDSIVRGTTTPQVIRLLRKAGAKEVHMRVCAPPITNPCFFGVDMATRSELIAAKMSVPEIQKYIGADSLGYLSLPGLIKAVGLPKDNFCLACFTGEYALPVQLEMDKFALGNQRGNCCQMPSPGS

SEQ ID NO: 30443 - DNA, 1350 bp, Thermococcus kodakarensis KOD1
  CDS (1)..(1350): transl_table=11
atgcgcgaaaagtgcggggtctttgcagcactctcagagaacgcgccgaagaaagcatactacgccctgatagccctccagcaccgcggccaggagagcgccggaataagtgtatggaagcacaggataagaaccgtcgctggcagggggcttatccaggacgttttcaatgggaaaaccctctcatcccttcgctccaacctcgcgatcggtcacgtccgctactccacatccggctctctcagcgagactcagcctcttgaaacggagtgctgtggaaagaggatagcagttgcccacaacggcaccctcacgaactttctccctctgagaaagagttatgagaataggggggttaggtttcaccactccgttgattctgaacttcttgggatttcgtttctctggcacctgaatgagaccggcgacgagtttgaggccatgagagaagtctttaacgaggttaagggcgcttattcggttgctctgctcttcgacggcaaaatcctcgtagcgagagattccgtagggttcaggcccctgagctatgggattggagacggccactactttgcgagcgaggattcggctttgaggcttttcgttgacgagactgagggcggggaaataagggacgttcggccgggtgaggtctttctactctcggaagggagtgtggagagtagagttctggcgagggagaagcaccaccactgcgtcttcgagtacatctacttcgcccggccagacagcacaatagacggcgtgaacgtctatcatgcgagggtgaagatgggaagggaacttgctagggagagtcccgccgatgcagatgttgtgatagcggttcccgactctgggagggcagcagcgttgggcttttcgatggaaagcgggataccctactcggaggggctgataaagaaccgctacatcgggaggactttcataacccccggccagttctacagggagcttaaggtaaagctcaagctctcgcccgtgagggaggtcatcaacggaaagagagtcgttctcgttgatgattccatagtcagggggacgaccatgaggagactagtctcccttctgaggaaagcgggagcgaaggaagtgcacgtgagaatagcgtcgccgcctataaggcacccctgctacatgggtatagacatcccgacgaggcacgaacttatagctgccttcgggagcgttgagaaggtgaggggagcgataggtgctgacagcctggcatatttaagcgttgagggccttatcagggctgttggcaagaaagacctatgcctggcgtgcctcacaggggagtaccctgagtgggccttcaggttttaa

SEQ ID NO: 30444 - protein, 449 aa, Thermococcus kodakarensis KOD1
MREKCGVFAALSENAPKKAYYALIALQHRGQESAGISVWKHRIRTVAGRGLIQDVFNGKTLSSLRSNLAIGHVRYSTSGSLSETQPLETECCGKRIAVAHNGTLTNFLPLRKSYENRGVRFHHSVDSELLGISFLWHLNETGDEFEAMREVFNEVKGAYSVALLFDGKILVARDSVGFRPLSYGIGDGHYFASEDSALRLFVDETEGGEIRDVRPGEVFLLSEGSVESRVLAREKHHHCVFEYIYFARPDSTIDGVNVYHARVKMGRELARESPADADVVIAVPDSGRAAALGFSMESGIPYSEGLIKNRYIGRTFITPGQFYRELKVKLKLSPVREVINGKRVVLVDDSIVRGTTMRRLVSLLRKAGAKEVHVRIASPPIRHPCYMGIDIPTRHELIAAFGSVEKVRGAIGADSLAYLSVEGLIRAVGKKDLCLACLTGEYPEWAFRF

SEQ ID NO: 30445 - DNA, 1482 bp, Gluconobacter oxydans 621H
  CDS (1)..(1482): transl_table=11
atgaggcgtccttgtgaaaccagtccggaaaggccgcgccgcatgacccagtccgacagtctcaaccgcccctacgaagagtgtggggtttttggcgtctggggtgtgcctgatgcgtccgccctgacggctctggggctgcacgccctgcagcatcgcggccaggaagccgccggcatcgtcagtttcgatggcgaacggttccaccagcacaaaggtctgggactggtcggcgatgtgttcggtgacagccgcgtcatggcgacgctgcccggcacggtggccatcggtcacaaccgctatgccacgacgggcgggacgcatgtccgcaatgtgcagccactttatgccgattatgaattcggcggtctggccgtggcgcataacggcaacctgaccaattccgcgaccctcaagcaggcgctggtcaagcgcggatgcatcttccattcctcgacggatacggaagtcttcatccacctgatcgccatatcgctctatacgaccgtgctcgatcgcttcatcgatgccgtcaagcaggtgaagggtgcgtactcgctcattacgctgacgccggatgacggcctgatcggcatgcgcgatccgctcggtgtgcgtccgctcgtccttggccggatgccgggctatgagcagggcaatggcggctgggtgctcgcgagcgagacctgtgctctggatatcattggtgcggactatgtccgggatatcgaacccggcgagatcgtcgtcatcaataatgacggactgcgctccctgcggcctttcggcgatcagggcggccggttctgcgtttttgaatacatttacttcgcgcggcctgattccgtgctcgaaggccagccggtctatgaggcgcggcgtcagatcggctgcgaactggcacgggagagcgcggttgaggcggatgtcgtggtgccggtgccggattccggtgtgccgtctgcgatcggctatgcggcggagagtggcattccgttcgagcttggcattatccgtaaccattatgtgggccggaccttcatcgagccgacggaccagatccgtaatctcggcgtgaagatgaagcactccgccaaccgtccggttctggcgggcaagcgcgtcatcctggtggatgattcgatcgtccggggcacgacgtcgcgcaagatcgtggacatggtgcgtgcggccggtgcgacggaagtgcacatgcgcatcacgtctccgccgacgaagcatgcgtgtttctacgggatcgacacgcctgaagagagcaagctgatggcggcgacgcatacgcttgaggaaatggcacaggcgatcggtgcggacagtctggcctttgtcagcttcgacgggctttaccgggcgctgggtcatgctaaccgggccgagggcgcgcgccgttactgcgatgcctgcttcaccggggattacccgatcgaactggtggacaaggaaggcaatctggtcgcgtaa

SEQ ID NO: 30446 - protein, 493 aa, Gluconobacter oxydans 621H
MRRPCETSPERPRRMTQSDSLNRPYEECGVFGVWGVPDASALTALGLHALQHRGQEAAGIVSFDGERFHQHKGLGLVGDVFGDSRVMATLPGTVAIGHNRYATTGGTHVRNVQPLYADYEFGGLAVAHNGNLTNSATLKQALVKRGCIFHSSTDTEVFIHLIAISLYTTVLDRFIDAVKQVKGAYSLITLTPDDGLIGMRDPLGVRPLVLGRMPGYEQGNGGWVLASETCALDIIGADYVRDIEPGEIVVINNDGLRSLRPFGDQGGRFCVFEYIYFARPDSVLEGQPVYEARRQIGCELARESAVEADVVVPVPDSGVPSAIGYAAESGIPFELGIIRNHYVGRTFIEPTDQIRNLGVKMKHSANRPVLAGKRVILVDDSIVRGTTSRKIVDMVRAAGATEVHMRITSPPTKHACFYGIDTPEESKLMAATHTLEEMAQAIGADSLAFVSFDGLYRALGHANRAEGARRYCDACFTGDYPIELVDKEGNLVA

SEQ ID NO: 30447 - DNA, 1467 bp, Lactobacillus acidophilus NCFM
  CDS (1)..(1467): transl_table=11
ttggaaggagtgcatcccttgtttaatgaaatcaaaagcctaaatgaggaatgtggcatcttcggagtttttggagctcctaatgctagtcaattaacctatttaggcttgcataacttacagcaccgcggccaagaaggggccggcattgtttcaagtgatggcgagcatttataccaacaccgcgatcgtgggcttctatccgatgcctttgccgatcctaacgatttaaaaaagctagtcggtgacagtgctataggccatgttcgctacagtacgacggggcgcaattcgattcaaaatgtgcagccatttctttttcactttctcgatggggatgtggctttagctcacaacggtaatttagttaacgccgtgtctttacgagacaagctggaaaaacaaggtgcaatttttcaatcttcatctgataccgaaattttaatccacttgattcgtaatcatattaaagatggttttatttcggcattaaagcaaggtttaaacgaagttcatggcggttttgccttcttgcttttacaaaaagatcgcatgattgcagccctggatcctaacggaatcagacctttatgcattggccagcttgataatggcgcatacgttgtttctagtgagacttgcgcgctagacataattggtgccaaatttgttcgcgacgttcaaccgggtgaattaatcatcattgatcgagatgggatgaaaattgatcattttactgaggatactcatttagcaatctgttcaatggaatacatctattttgctcgacctgattcgattattcacggcgtgactgtccacaatgctagaaagagaatgggacgactgctggctcgtgaagccccagccgatgttgatatggtaattggcgtgccgaattcatctttgtcagctgcttctggttacgctgaagagttacatttgccatacgaaatgggactagttaagaatcaatatgttgctagaaccttcatccaacctacgcaagccttgcgtgaaaagagcgtgaagttgaagctttcggctgtacgaggcgttgttgctggtaaaaagatcgctgtcattgacgattcaattgtaagagggacaacttctaagcaaattgtcagaatgcttaaagaagtaggtgccaaagaagttcacttgagaattgctagtccaccatttaaatttccttgtttttacggcattgacatttcaactcgggctgaattaatagctgctcattattcagtagaagaaatgcgtaaaatcatcggtgctgatagccttggctttttgagcgttgatagcttgattaaagcaatcaatgtgcctgatcgtggagacttatcggggctgacagttgcttactttaatggtaaatatccaactaaattggatgactacgaagctggatacttagcttctcttaatgctcaagaacggcgaaaaagaaaggaataa

SEQ ID NO: 30448 - protein, 488 aa, Lactobacillus acidophilus NCFM
MEGVHPLFNEIKSLNEECGIFGVFGAPNASQLTYLGLHNLQHRGQEGAGIVSSDGEHLYQHRDRGLLSDAFADPNDLKKLVGDSAIGHVRYSTTGRNSIQNVQPFLFHFLDGDVALAHNGNLVNAVSLRDKLEKQGAIFQSSSDTEILIHLIRNHIKDGFISALKQGLNEVHGGFAFLLLQKDRMIAALDPNGIRPLCIGQLDNGAYVVSSETCALDIIGAKFVRDVQPGELIIIDRDGMKIDHFTEDTHLAICSMEYIYFARPDSIIHGVTVHNARKRMGRLLAREAPADVDMVIGVPNSSLSAASGYAEELHLPYEMGLVKNQYVARTFIQPTQALREKSVKLKLSAVRGVVAGKKIAVIDDSIVRGTTSKQIVRMLKEVGAKEVHLRIASPPFKFPCFYGIDISTRAELIAAHYSVEEMRKIIGADSLGFLSVDSLIKAINVPDRGDLSGLTVAYFNGKYPTKLDDYEAGYLASLNAQERRKRKE

SEQ ID NO: 30449 - DNA, 1401 bp, Ehrlichia ruminantium str. Gardel
  CDS (1)..(1401): transl_table=11
atgcaatttaatgaaatatatgaagaatgtggagtatttgccatatataataacaattatgcagctatcaattgtattttaggattacacgctattcaacatagaggacaagaatcatttggtatagtaacatctgataatactaattttcactcctattactctaatgaacaagtgaatactatcttcactcaacaatcaaaaatagaccacctactaggaaatattgctattggacacgtgcgttactctacaagcggaagtaaaactggtatgcaacctataattttagattgtcaatttggaaaattagcaatagcacataatggtaaccttattaatgcattacaaattagagaatcactcattaaaaaaggacgtatattttcatcagacattgatacagaagtaatagcacatcttattgctatgaatacacaagatactatattggacaatataatatacgctctacaaaatattaagggtgcttattctctagtaattttgataaacaatactttaatatgttgtcgagatccatatggtattagaccattagtactaggcatgttagacaatgtatatgtaatagcttcagaaacatgtgctttagatatagttggggcacaatttgttagagatattttaccaggagaattaataacaattaatcaaagtaataccttaacaagttatttcccatttgaaaaacaaaaatcaagtttttgtatttttgaatacgtatattttgcacgaccagacagcataatggaaaataagtctgtatatgaaatacgtaaaaacataggaagagaactagcaatagagaatactgtaccaaaagatacaaatatggtaatacctatacctgattctggagtaccagctgcattagggtttgcagaatatactaatataccttttgagttcggcattattaggaatcattatataggaagaacttttatacaacctcacgaccatattcgtaatataggagtaaagcttaagcataatcccaattcttcaatattaaaaggtaaaaatatagttttaatagatgatagtattgtacgaggaacaactttaaaaaatataatagcattactccataaagcaggtgtcaaacagatacacttaagaatctcaagtcctcctactatacattcttgcttctacggaatagacacaccagaagaatcaaaattgatagccaacaatttatcaaaagcagacattataaaattattaggatgtgatagcttacatttcttaagcataaatgggctttacaaggcaatatgcaatacaaaacgcaataatgtcccacaatattgtgatgcatgcttcactggagattaccccattggtaaaatagatacaaataatgtttactaa

SEQ ID NO: 30450 - protein, 466 aa, Ehrlichia ruminantium str. Gardel
MQFNEIYEECGVFAIYNNNYAAINCILGLHAIQHRGQESFGIVTSDNTNFHSYYSNEQVNTIFTQQSKIDHLLGNIAIGHVRYSTSGSKTGMQPIILDCQFGKLAIAHNGNLINALQIRESLIKKGRIFSSDIDTEVIAHLIAMNTQDTILDNIIYALQNIKGAYSLVILINNTLICCRDPYGIRPLVLGMLDNVYVIASETCALDIVGAQFVRDILPGELITINQSNTLTSYFPFEKQKSSFCIFEYVYFARPDSIMENKSVYEIRKNIGRELAIENTVPKDTNMVIPIPDSGVPAALGFAEYTNIPFEFGIIRNHYIGRTFIQPHDHIRNIGVKLKHNPNSSILKGKNIVLIDDSIVRGTTLKNIIALLHKAGVKQIHLRISSPPTIHSCFYGIDTPEESKLIANNLSKADIIKLLGCDSLHFLSINGLYKAICNTKRNNVPQYCDACFTGDYPIGKIDTNNVY

SEQ ID NO: 30451 - DNA, 1386 bp, Wolbachia endosymbiont strain TRS of Brugia malayi
  CDS (1)..(1386): transl_table=11
atgctcgataaaatgtacgaagagtgcggagtatttggtataagctgcaataaagattctgcctttgactctatactaggtcttcatgctttgcagcacaggggtcaagaatcttttggcgtagtaacaagtaacaacgataagctgcattcttatcattttcaaggtcaggtgagtagtgtacttgacaatatagatgaaataaaaaaatccttgcctggaaattatgcaataggtcacgttcgatactcaacaagtggcaataaatctggagtgcagcctatccttggcaaaagtaacaagtttggagattttgccatagcacataatggtaacttaattaatatttctccaatacgcgagcagttgattaaacagggacgcgtttttcaatcagatattgatacagaggtggtagctcgtttggtagaagccaatacgaaaaatagctttctagggagtttcatatatgcattaaagcaaatacaaggcgcttattcttttgtagcaatcaaccgagaagtagttgttggagtacgtgattcagcaggaatcagacctcttgttttaggaaaattgaacagttcttacgtgctcgcatctgagacttgcgcccttgatatagtaaatgcagagtttattagagaaatagaaccaggtgaactagttactatcgatcaaaatggtaatctagcttcagcatttcctctttctcagcaaaagtcaagtttctgtatctttgaatacatttatttttcaaggccagacagcataatagaagataggtccatatatgatataagaaaagagataggaagaacacttgcagaagagagtccaccgaaaaacaatgtggatatggttgtaccaatacctgattctggaatacctgcagccatcggatacacaaaatattcaggattacctatagaactcggaataatccgtaatcattacattggaagaacttttatacaaccaaccgctgaagtacgtaaagttagaataaaattaaaatttaatgctaataaagacattttaaagggtaagaacataattttaatagacgatagtatagtacgtggtagtacactaaaaagcataatagttatgctaaaagatgcaggagtaaaagaaattcacctaaaaatctcaagtccaccaattaagtattcttgtttttacggaattgacacaccagagtgcaaggatctaattgccgcaagtaagtctgtaagggaaatagaagcaattataggggtaaatagtttaaccttcttaagcatcgatggattatatcaggctgttaacggagagaaacgtaataacacagcaccgcaatactgcgatgcctgtttcactggtgattatccgattggtaagtaa

SEQ ID NO: 30452 - protein, 461 aa, Wolbachia endosymbiont strain TRS of Brugia malayi
MLDKMYEECGVFGISCNKDSAFDSILGLHALQHRGQESFGVVTSNNDKLHSYHFQGQVSSVLDNIDEIKKSLPGNYAIGHVRYSTSGNKSGVQPILGKSNKFGDFAIAHNGNLINISPIREQLIKQGRVFQSDIDTEVVARLVEANTKNSFLGSFIYALKQIQGAYSFVAINREVVVGVRDSAGIRPLVLGKLNSSYVLASETCALDIVNAEFIREIEPGELVTIDQNGNLASAFPLSQQKSSFCIFEYIYFSRPDSIIEDRSIYDIRKEIGRTLAEESPPKNNVDMVVPIPDSGIPAAIGYTKYSGLPIELGIIRNHYIGRTFIQPTAEVRKVRIKLKFNANKDILKGKNIILIDDSIVRGSTLKSIIVMLKDAGVKEIHLKISSPPIKYSCFYGIDTPECKDLIAASKSVREIEAIIGVNSLTFLSIDGLYQAVNGEKRNNTAPQYCDACFTGDYPIGK

SEQ ID NO: 30453 - DNA, 1467 bp, Xanthomonas oryzae pv. oryzae KACC10331
  CDS (1)..(1467): transl_table=11
atgtgtggcatcgtcggtattgtcggcaaccagaacgtcgccgggcagctgtatgacggcctgaccgtcctgcagcatcgtgggcaggacgccgcaggcatcgccaccgcagatggcacgcgcctgcgggtgcagaaggccaatggcctggtccgcgacgtcttcgacgaaaagaaaatggcggtgctggaaggccgcgtcggtatcgcgcattgccgttacccgaccgcaggttcggaaggcatggacgaggcgcagccgttctatgtcaactcgccttatggcatcgcgctggcgcacaacggcaacctgatcaacaccgaggccttgcgccagcaagtgttcgaagccgaccgccgcaacatcaataccgattcggacagcgaagtgctgttgaacgtgttcgcctacgagctggacgcgcagcgcatgcttacccccgaagcggccatccgcgcggtggccggcgtgcaccgccgctgcaagggcggctacgcggtggtcagcgtggtgttgggcctgggcctggtcgcgttccgcgacccgcacggcatccgcccgctggtgctgggcaagcgcgagcatgccgaaggcgccgaatacatcgtgtcttccgaatcggcagcgctcgacatcctggggtatcagcgcgtgcgcgacgtgcgcccgggcgaagcgttggtgattacggcgcgcggcgagctgttttcggaaatctgcgcttcgccgaccaacaacgcgccgtgcattttcgagtacgtgtatttcgcccgtcccgattcgatgatcgacaacatctcggtgcacaaggcgcgcatgcgcatgggcctgaagctgggcgaaaagatcctgcgcctgcgcccgaatcatgatatcgacaccatcattccgatcccggacacctcgcgcgatgtggcgctggagatgtccaacgtgctcggcgtgaagtaccgcgagggcttcgtcaagaaccgttacgtgggccgcaccttcatcatgccggggcagggcgaacggcagaaatcggtacgccgcaagctcaacccgatccacctggaattccgcaaccgtgtggtgttgctggtcgacgattcgatcgtgcgcggcaccaccagccggcagatcgtgcagatggcgcgcgacgccggcgcgcgcaaggtgtacctggcctcggctgcgccgccggtgcgttaccccaacatctacggcatcgacatgccggcggccgaagagctcatcgcgcatggccgcagcgagctggaaatccaggagtttctgggctgcgactggctgatctaccaggatctggaagacctggaagtggcggtgcgcgaagggaatccggacatcaagcagttcgactcttcgtgcttcaacggcgagtacatcaccggcatcgagccgggatatttcgaacgcatccagcagctgcgctcggacgatgccaagaagcgtcgtcgcgcctga

SEQ ID NO: 30454 - protein, 488 aa, Xanthomonas oryzae pv. oryzae KACC10331
MCGIVGIVGNQNVAGQLYDGLTVLQHRGQDAAGIATADGTRLRVQKANGLVRDVFDEKKMAVLEGRVGIAHCRYPTAGSEGMDEAQPFYVNSPYGIALAHNGNLINTEALRQQVFEADRRNINTDSDSEVLLNVFAYELDAQRMLTPEAAIRAVAGVHRRCKGGYAVVSVVLGLGLVAFRDPHGIRPLVLGKREHAEGAEYIVSSESAALDILGYQRVRDVRPGEALVITARGELFSEICASPTNNAPCIFEYVYFARPDSMIDNISVHKARMRMGLKLGEKILRLRPNHDIDTIIPIPDTSRDVALEMSNVLGVKYREGFVKNRYVGRTFIMPGQGERQKSVRRKLNPIHLEFRNRVVLLVDDSIVRGTTSRQIVQMARDAGARKVYLASAAPPVRYPNIYGIDMPAAEELIAHGRSELEIQEFLGCDWLIYQDLEDLEVAVREGNPDIKQFDSSCFNGEYITGIEPGYFERIQQLRSDDAKKRRRA

SEQ ID NO: 30455 - DNA, 1515 bp, Vibrio fischeri ES114
  CDS (1)..(1515): transl_table=11
atgtgcggtattgttggaatcgtgggcgcaacaccagtaaaccagtcaatctatgacgctttaacagtgctacaacatcgtggccaagatgctgctggtattattaccatagaaagcaatcgtttccgtctgagaaaggcgaacggtttggtgaaggatgtgtttgaaacaaaacacatgcaacgcctacaaggtaacgttggtattggacatgttcgataccctacagcaggtagttctagtgcctcagaagcacaacctttctatgtaaactctccatttggtatcactcttgcgcataatggtaacttaaccaatgcaaatgaaattcgtgaaacgttatttgaacaagagcgtcgtcatgtaaatacaacctctgattctgaagttttattaaatatctttgcacaccatcttgatgaatcaaaaaattacccgctaacaaacgatgatatctttaaaactgtagcgaaagttcatgaacaaattcgtggtgcttatgcagtaacggcaatgatcattggccatggcatggtggcatttcgagatccaaacggcattcgcccattatgtttaggtaagcgtgaaattgaaggtcgcacagaatatatggtggcttcagagtcagtcgctttggatgcagtaggctttgatttcgttcgtgatgttgcaccgggtgaagcgatttatgctccatttgaagggggtttatatactcaacaatgtgcgcatggaccaaagttaaatccatgtatttttgaatttgtttattttgctcgtccagattcgtttattgataaaatttcggtatacagtgcacgagttgaaatgggtaagcgtttaggtgagaaaattaagcgtgagtgggatgatttagatattgatgttgtactgcctattcctgaaacatcatgtgatatcgcattagaaatcgctcagattatcaataagccttaccgccaaggctttgttaagaaccgttatgtcggccgtacttttatcatgccaggtcaacaagagcgtaagaaatcagttcgtcgtaaattgaatgctattcgttcagaatttaaagataaaaacgttttattagttgatgactccattgtgcgtggaacaacctcagagcagattattgaaatggctcgtgattctggtgctaaaaacgtttatatggtgtcagctgctcctgagattcgtttccctaacgtatatggtatcgatatgccaagtgcaaatgagctgattgcacatggtcgtgaagttgatgagatttgcaacgagattggtgcggatgctcttattttccaagacctttcagacttagttgatgcggttggttgcggtaacagagaaattgagaaatttgaaacctctgttttcaatgcacattatgttactggtgatgttgaccagaattacctagagtacttagaaagcctacgtaatgatgatgcaaaacaagacaacgaagcacaaaacgtagcaagtctagatatttataacgaagagatttaa

SEQ ID NO: 30456 - protein, 504 aa, Vibrio fischeri ES114
MCGIVGIVGATPVNQSIYDALTVLQHRGQDAAGIITIESNRFRLRKANGLVKDVFETKHMQRLQGNVGIGHVRYPTAGSSSASEAQPFYVNSPFGITLAHNGNLTNANEIRETLFEQERRHVNTTSDSEVLLNIFAHHLDESKNYPLTNDDIFKTVAKVHEQIRGAYAVTAMIIGHGMVAFRDPNGIRPLCLGKREIEGRTEYMVASESVALDAVGFDFVRDVAPGEAIYAPFEGGLYTQQCAHGPKLNPCIFEFVYFARPDSFIDKISVYSARVEMGKRLGEKIKREWDDLDIDVVLPIPETSCDIALEIAQIINKPYRQGFVKNRYVGRTFIMPGQQERKKSVRRKLNAIRSEFKDKNVLLVDDSIVRGTTSEQIIEMARDSGAKNVYMVSAAPEIRFPNVYGIDMPSANELIAHGREVDEICNEIGADALIFQDLSDLVDAVGCGNREIEKFETSVFNAHYVTGDVDQNYLEYLESLRNDDAKQDNEAQNVASLDIYNEEI

SEQ ID NO: 30457 - DNA, 1545 bp, Neisseria gonorrhoeae FA 1090
  CDS (1)..(1545): transl_table=11
atgtgcggcgtattaggtttggtcagtcatgaacccgtgaaccagcttctgtacgacggtttgcagatgttgcagcacagggggcaggatgcggcgggcattgcaacggcggaaggcggtaccttccatatgcacaaaggcaaagggatggtgagcgaagtgttccgcacgcgcaatatgcgcgatttgaccggcaacgccggcatcgcccacgtccgttatcccacggcgggcaacgccggcagcagcgcggaggcgcagcctttctacgtcagctcgcctttcggcatcgttttggcgcacaacggcaacctcaccaacactgccgaactgtatgaaaacgtgtgtaacaaacacctgcgccacatcaacaccggctccgattccgaagttttgctcaacgtattcgcgcacgaattgcgccgcgaagtctctaaaaacgccgacccgcaccggctcaatgccgacaatattttcaacgccgttgccgaagtccaccgcctagtgcgcggtgcatacggcgtggttgccatgattgcgggctacggtatgctcgccttccgcgacccttacggcatccgcccgctggcattgggttcgcaaaccgacagcgaaggcaggaaatcctatgccgtcgcctccgaatccgtcgccttcaatgcgcttgcctacgatttggaacgcgatatccggccgggcgaagcggtatttgtcggctttaacggcacaatcatcgcccgacaatgcagcgaccgtgccaaactcagcccctgcctttttgaatatgtttattttgcccgccccgactctgtgattgacggtgtatcggtttaccaatcgcgcttggatatgggcgtgtccttggcggaaaaaatcaaacgcgagctgcccgtggacggcatcgacgtcgtgatgcccattcccgataccagccgccccagtgcaatggagcttgccgtccacctcaacaaaccctaccgcgagggtttgattaaaaaccgctatatcggccgcacctttattatgcccggtcagtcgacgcgcaaaaaatccgtgcgccaaaaactcagcccgatggaaaccgaatttgcaggcaaaagcgtgttgctggtggacgactccatcgtgcgcgggacgaccagccgcgaaatcgtcgaaatggtacgcgcggcgggcgcgcgcaaagtctatatcgcctccgccgcgcccgaagtgcgctatcccaatgtgtacggcatcgatatgcccacgcgcgaagagttgattgccaacgggcgcagcgcggcggaaatcgccgccgaaatcggcgcggacggcatcgtgtttcaagacttgggcgatttggaagccgtcgtcaaagcactcaacccgaaaatcgaatccttcgattcgtcctgtttcaacggcatttatcggaccggcgacatcgatgatgcctacctcgaccgcctgtctgccgagaaatccggctgcgccggtctgaaaatccacccgagcaggatggaacacagcatcagcatcagcgatgcgggcgacgaagaataa

SEQ ID NO: 30458 - protein, 514 aa, Neisseria gonorrhoeae FA 1090
MCGVLGLVSHEPVNQLLYDGLQMLQHRGQDAAGIATAEGGTFHMHKGKGMVSEVFRTRNMRDLTGNAGIAHVRYPTAGNAGSSAEAQPFYVSSPFGIVLAHNGNLTNTAELYENVCNKHLRHINTGSDSEVLLNVFAHELRREVSKNADPHRLNADNIFNAVAEVHRLVRGAYGVVAMIAGYGMLAFRDPYGIRPLALGSQTDSEGRKSYAVASESVAFNALAYDLERDIRPGEAVFVGFNGTIIARQCSDRAKLSPCLFEYVYFARPDSVIDGVSVYQSRLDMGVSLAEKIKRELPVDGIDVVMPIPDTSRPSAMELAVHLNKPYREGLIKNRYIGRTFIMPGQSTRKKSVRQKLSPMETEFAGKSVLLVDDSIVRGTTSREIVEMVRAAGARKVYIASAAPEVRYPNVYGIDMPTREELIANGRSAAEIAAEIGADGIVFQDLGDLEAVVKALNPKIESFDSSCFNGIYRTGDIDDAYLDRLSAEKSGCAGLKIHPSRMEHSISISDAGDEE

SEQ ID NO: 30459 - DNA, 1458 bp, Brucella abortus biovar 1 str. 9-941
  CDS (1)..(1458): transl_table=11
atgctggatgatgacaccctgcatgaagaatgtggtgtattcggcattctgggccatgaggatgcggctgcgctgaccgcgctcggcctgcatgcgctccagcatcgcggtcaggaagccgccggcattgtttcctatcataatcgccgtttccattccgaacgccatatgggcctcgtcggcgaccatttcaccgatgcggcaacactgaaccgcctgccgggcaaccgcgccatcggccatgtgcgttattccacaaccggcgagacgatcctgcgcaatgtacagccgctgtttgcggaactggaagtcggcggcatcgccattgcccataacggcaatttcaccaatggcattacgctgcgcaaacagttgattgcttccggcgcgatcttccaggcaacgtcggatacggaagtcgtgctgcacatgattgcccgttcgcggcactcctcctcaaccgaccgtttcgtggaagcgatccgccaggttgaaggcggctatgccatgctggcgcttacccgcaccaagctgatcgccgcgcgcgatcccatcggcattcgcccgctcgtcatgggcgagctggacggcaagccgatcttctgctcggaaacctgcgctctcgatattatcggcgcgaaatatattcgcgacgtcgagaatggcgaagtggtagtctgcgaaatccagaaggatggctccatcaccacccgatccatcaagccggaaaatccgcagccggagcggctgtgcctttttgaatatgtttatttcgcacggccggattcggtagtgggtggccgcagcgtctatgtggcgcgcaagaacatgggcatgaaccttgccgccgaggcgggcgtggatgccgatgtggtcgtgcccgtaccggatggcggtacgccggcagcgctgggctttgcgcaggcaagcggtattccgtttgaatatggcatcatccgcaaccattatgtgggccgcaccttcattgagcctacacagcagatccgcgcgcttggcgtgaagctgaaacattcagccaatcgcgctatgattgaaggcaagcgggtcgttctggtggatgattccatcgtgcgcggcaccacctcggtcaagatcgttcagatgatccgcgacgcaggcgcaaccgaagtccatatgcgcgtggcaagcccgatgatcttccacccggatttttacggtatcgacaccccccatgccgataagctgctggccaaccagcacgaaagcctcgaatccatgtgccgctacatcggcgccgattcgctggccttcctttccatcgacgggctctacaaggccgttggcggaaagccgcgtgatccaaaggcgccgaccttcaccgatcactatttcacgggcgagtatccgacccgccttctggatcaggaaggcgaaagcaacgtccacaccttgtcgctgctcgccagcaacggctga

SEQ ID NO: 30460 - protein, 485 aa, Brucella abortus biovar 1 str. 9-941
MLDDDTLHEECGVFGILGHEDAAALTALGLHALQHRGQEAAGIVSYHNRRFHSERHMGLVGDHFTDAATLNRLPGNRAIGHVRYSTTGETILRNVQPLFAELEVGGIAIAHNGNFTNGITLRKQLIASGAIFQATSDTEVVLHMIARSRHSSSTDRFVEAIRQVEGGYAMLALTRTKLIAARDPIGIRPLVMGELDGKPIFCSETCALDIIGAKYIRDVENGEVVVCEIQKDGSITTRSIKPENPQPERLCLFEYVYFARPDSVVGGRSVYVARKNMGMNLAAEAGVDADVVVPVPDGGTPAALGFAQASGIPFEYGIIRNHYVGRTFIEPTQQIRALGVKLKHSANRAMIEGKRVVLVDDSIVRGTTSVKIVQMIRDAGATEVHMRVASPMIFHPDFYGIDTPHADKLLANQHESLESMCRYIGADSLAFLSIDGLYKAVGGKPRDPKAPTFTDHYFTGEYPTRLLDQEGESNVHTLSLLASNG

SEQ ID NO: 30461 - DNA, 1485 bp, Corynebacterium glutamicum ATCC 13032
  CDS (1)..(1485): transl_table=11
atgacccaggtaaaccacccgtacgatgatctcaacgaacaggcaccgcaggaagaatgcggcgttttcggcgtttgggcgccaggtgaggaagtctcgaaacttacctactttggcctcttcgcacttcagcaccgtggtcaagaagccgcgggcatcgcagtaggcgatggcgaacagatcctggttttcaaagatttgggcctagtctcccaagttttcgacgaaccaattctggaatccctccgcggaaacatcgccatcggacacacccgatacaccaccgccggcggaaacacctgggaaaatgcccagcctatgttccgcatggcaccagatggcaccgatatcgcccttggacacaacggcaacctgattaattacatcgagttgttggacaaagccaccgaacttggcctcgtcgatcccgccaagaagccatcagataccgatgtgctcactggactgctcgcaagcggcgtccatgacggaaataatctctttgattccgccaaggaactcctccccagcgtcaagggagcctactgcctcaccttcaccgacggacacaccctgtacgcagcgcgtgatccattcggcatccgcccactgtccatcggccgcctcgagcgcggctgggtagtcgcatctgaaaccgcagcgctcgacatcgtaggtgcctcgcatgtgcgcgaggtcgaaccaggcgaactgattgctatcgacgaatccggcctcaagtccgcacgattcgccgagacaacccgcaaaggttgcgtcttcgaatacgtttacctggctcgtccagactccgtgatcaagggaagaaacgtcaacgaagcccgacttgaaatcggccgcaagctcgctgcagaagcaccagcagtcggcgatctagtcatcccaaccccagaatcaggcaccccagcagcagttggattcgcccaagcatctggcatcccattcggccaaggcatggtcaaaaacgcctacgttggccgaaccttcatccagccttccgacactctccgccaactgggaatccgcctcaagctgaacccattgcgcgaggttatcgccggaaagcgccttgtggttgtggatgattccatcgtccgcggtaacacccaacgcgccgtgatccgcatgttgcgcgaagccggtgcagctgaggttcacgtacgcatcgcctcaccacccgtgaaatggccatgcttctacggcatcgattttgccaccccaggcgaactcattgccaacgctgtcaccagtgacaacgaagcagaaatggtagaagcagtccgctccgcaatcggcgcagacaccctcggctacgtctccatcgactccatggttgcagcaaccgagcaaccagccaacgaactctgcatcgcctgcttcgacggcaaataccccatgggtctgccacagggaaacagcaacgcagacctagtccgcaagatgcaagcaaccgcctcaagttaa

SEQ ID NO: 30462 - protein, 494 aa, Corynebacterium glutamicum ATCC 13032
MTQVNHPYDDLNEQAPQEECGVFGVWAPGEEVSKLTYFGLFALQHRGQEAAGIAVGDGEQILVFKDLGLVSQVFDEPILESLRGNIAIGHTRYTTAGGNTWENAQPMFRMAPDGTDIALGHNGNLINYIELLDKATELGLVDPAKKPSDTDVLTGLLASGVHDGNNLFDSAKELLPSVKGAYCLTFTDGHTLYAARDPFGIRPLSIGRLERGWVVASETAALDIVGASHVREVEPGELIAIDESGLKSARFAETTRKGCVFEYVYLARPDSVIKGRNVNEARLEIGRKLAAEAPAVGDLVIPTPESGTPAAVGFAQASGIPFGQGMVKNAYVGRTFIQPSDTLRQLGIRLKLNPLREVIAGKRLVVVDDSIVRGNTQRAVIRMLREAGAAEVHVRIASPPVKWPCFYGIDFATPGELIANAVTSDNEAEMVEAVRSAIGADTLGYVSIDSMVAATEQPANELCIACFDGKYPMGLPQGNSNADLVRKMQATASS

SEQ ID NO: 30463 - DNA, 1509 bp, Pseudomonas syringae pv. syringae B728a
  CDS (1)..(1509): transl_table=11
atgtgtggcatcgtcggtatcgtcggcaagtcgaacgtcaatcaggcgctgtatgacgcgcttaccgtcctccagcaccgcggccaggacgctgccggtatcgtaaccagccatgatggccggttattcctgcgcaaggacaacggattggtgcgcgatgtgtttcatcaacgtcatatgcagcgtctggtcgggcatatgggcatcggtcacgtgcgttaccccaccgcgggcagttcgacgtcggccgaggctcagccgttttacgtcaactcgccttacggcatcacgctggcgcacaacggcaacctcaccaacgtcgagcagctggccaaggaaatttacgagtccgacctgcgccatgtgaacaccaattccgattcggaagtgctgctcaacgtgttcgcccatgaactggccgtgcgtggcaagttgcagccaaccgaagaggatatcttcgcggccgtgaccgacgtgcacaatcgctgccgcggtggttatgcggtcgtagccatgatcaccggctacggtatcgtcggcttccgtgacccggacgccattcgtcctatcgtgttcggccagcgtcacaccgacgaaggcgtcgagtacatgatcgcctcggaaagcgtatcgctggacgtgctgggctttaccctgattcgcgaccttgcaccgggcgaagcggtctacatcaccgaagacggcaagctgcacacccgtcagtgcgcggccaaccccaaatacgctccgtgtatcttcgagcacgtctatctggcgcgcccggattcgatcatcgacggtatctcggtctacaaggcgcgcctgcgcatgggcgagaagctggccgacaagatcctgcgcgagcgtccggatcacgatatcgacgtggtcatcccgattccggacaccagccgtactgcggcgctggagctggccaaccatctgggcgtcaagttccgcgaaggcttcgtcaagaaccgttacatcggccggaccttcatcatgccgggccaggctgcgcgcaagaaatccgtacgccagaagctcaacgccatcgagctggagttccgcggcaagaacgtgatgctggtggatgactccatcgtacgcggcacgacctgcaagcagatcatccagatggcccgcgaagccggtgccaagaatgtctacttctgttctgcagccccggctgtgcgctaccccaacgtctacggcatcgacatgccgagtgctcacgagctgattgcccacaaccgcaccacgcaggacgtggccgacctcatcggtgccgactggctggtctatcaggacctgaatgacctgatcgaagcggtcagcggcagcaagaaaatcaagatcgacaacttcgattgctcggttttcgacggcaagtacgtgaccggcgacatcgacgagcattatttgaaccggatcgagagcgcgcgtaatgacgcctccaagatcaagactcaggcagtgagcgcgatcatcgatctgtacaacaactaa

SEQ ID NO: 30464 - protein, 502 aa, Pseudomonas syringae pv. syringae B728a
MCGIVGIVGKSNVNQALYDALTVLQHRGQDAAGIVTSHDGRLFLRKDNGLVRDVFHQRHMQRLVGHMGIGHVRYPTAGSSTSAEAQPFYVNSPYGITLAHNGNLTNVEQLAKEIYESDLRHVNTNSDSEVLLNVFAHELAVRGKLQPTEEDIFAAVTDVHNRCRGGYAVVAMITGYGIVGFRDPDAIRPIVFGQRHTDEGVEYMIASESVSLDVLGFTLIRDLAPGEAVYITEDGKLHTRQCAANPKYAPCIFEHVYLARPDSIIDGISVYKARLRMGEKLADKILRERPDHDIDVVIPIPDTSRTAALELANHLGVKFREGFVKNRYIGRTFIMPGQAARKKSVRQKLNAIELEFRGKNVMLVDDSIVRGTTCKQIIQMAREAGAKNVYFCSAAPAVRYPNVYGIDMPSAHELIAHNRTTQDVADLIGADWLVYQDLNDLIEAVSGSKKIKIDNFDCSVFDGKYVTGDIDEHYLNRIESARNDASKIKTQAVSAIIDLYNN

SEQ ID NO: 30465 - DNA, 1518 bp, Haemophilus influenzae 86-028NP
  CDS (1)..(1518): transl_table=11
atgtgtggtattgtcggtattgttagccaaagtccggttaatgaatctatttatgcagcattaactcttttgcaacatcgtggacaagatgcggcgggtattgtaacggttgatgatgaaaaccgtttccgcttacgtaaagctaatggcttagtcagcgatgtgttccgtcaagagcatatgctacgcttgcaaggaaatgctggattagggcatattcgctatcctacggcaggaagttctagcgtctcagaggcacaacctttttatgtaaattctccctatggtgtcactttggtgcataacggcaatttaaccaactcagtggagttaaaagaaaaagtctttaaaactgcccgccgtcacgtaaacactaattcagattctgaacttcttcttaatattctcgctaatcatcttgatcacattcctcaaaaccatcttgatccacaagatattttctatgctgttcgtaaaactcacaatgatattcgtggtgcttatgcctgcgtagcgatgattattggacacggaatggttgcatttagagatccttttggtattcgtcctttggtgttgggtaaacgtgaagaaaatggcaaaactgattatatgttcgcctctgaaacagtagctttagatattgtgggtttcgagtttgtgcgtgatattgctgcgggcgaagccgtttatgtgacatttgatggcgagctttattcacaacaatgtaccgaaagtgcggtgttaaatccttgtatttttgagtatgtttattttgcacgcccagattcaacgattgatggtgtctctgtttatgcggcacgtgttcatatgggggaaaaactcgggaaaaaaattgcaaaagaatgggcggatgaaattgataatattgatgtggtcattcctattcctgaaacctccacagatattgcgttacaaatagctcgtgttctagggaagccttatcgacaaggatttgtgaaaaatcgctatgttggtcgtacctttattatgccaggtcaagcacagcgtattagttctgttcgtcgcaaattgaataccattaaagctgaatttaaagataaaaatgtgttattggtggacgattctatcgttcgtggcacaacctctgagcaaattgttgaaatggctcgctcagctggtgcgaagaaaatttactttgcctctgcagctcctgaaattcgttatccgaatgtatatggtattgatatgccgagttgtgatgaactgatcgcttacggtcgaaatgttgaggaaattgcacatttgatcggcgtagataaattaattttccaagatctgaccgcacttactgaatctgttcaattggaaaatccagccattcaaggttttgattgttcagtattcacaggcgaatatattacaggcgatattagtcctgaatatcttgataaaatcgcacttcaacgcaacgatagtgcaaagaaaaaacgtgaaaaacaagcatccaatcttgaaatttataatgaacaataa

SEQ ID NO: 30466 - protein, 505 aa, Haemophilus influenzae 86-028NP
MCGIVGIVSQSPVNESIYAALTLLQHRGQDAAGIVTVDDENRFRLRKANGLVSDVFRQEHMLRLQGNAGLGHIRYPTAGSSSVSEAQPFYVNSPYGVTLVHNGNLTNSVELKEKVFKTARRHVNTNSDSELLLNILANHLDHIPQNHLDPQDIFYAVRKTHNDIRGAYACVAMIIGHGMVAFRDPFGIRPLVLGKREENGKTDYMFASETVALDIVGFEFVRDIAAGEAVYVTFDGELYSQQCTESAVLNPCIFEYVYFARPDSTIDGVSVYAARVHMGEKLGKKIAKEWADEIDNIDVVIPIPETSTDIALQIARVLGKPYRQGFVKNRYVGRTFIMPGQAQRISSVRRKLNTIKAEFKDKNVLLVDDSIVRGTTSEQIVEMARSAGAKKIYFASAAPEIRYPNVYGIDMPSCDELIAYGRNVEEIAHLIGVDKLIFQDLTALTESVQLENPAIQGFDCSVFTGEYITGDISPEYLDKIALQRNDSAKKKREKQASNLEIYNEQ

SEQ ID NO: 30467 - DNA, 1488 bp, Corynebacterium jeikeium K411
  CDS (1)..(1488): transl_table=11
ttgctgagtccattcgacgaccggggcgaaactgagccccgggaagaatgtggcgtattcggagtatgggcaccgggggaggacgtttctaagctgacctactacggcctctacgccttgcagcatcgtggccaggaggccgcaggtattgcggtgggcgatggcgaccagatcgttgtattcaaggatctggggcttgtcagccaggtcttcgacgaacagtcgctggaggccctgaaggggcacatcggcttgggacataaccgctacaccaccgccggtggaaatagctgggaaaatgcgcagcccatgttccgaatggcccccgatggcacggacgtagcgctggggcacaatggcaacctggtggatcaccgggagctgacccaggaggccgcccgtctgggactggtggatccaaaggaaaacccctccgattccctggtgatgtgtgccctgctggctgccgacacacgcgaaggtcacggggtagaagaagcagcgatggagctgttccccaaggtcaagggtgcattctgtgtgctgttcaccgacggtgacgcgctgtatgcggcgcgcgacccgcagggcgtgcggccgctgtccatcggccagctggcaggtggcggctgggttgtggcttctgaaaccgcggcgctggacatcgtgggtgcgcgtttcgtccgcgatgtggagccgggcgagctggtgatcgtcgacggcgatggcgtgcgctcccgccgcttcgccgagaccgcccacaagggctgcgtgtttgagtacgtatacctggcgcgccccgattccgtgatccgcggccgctcggtcaatggcgcgcgtctgcagatcggccggaaactggcggaggaagccccggcggacggcgacctggtcatccccgttccggaatccggcaccccggcggcggtgggatatgcccaggcttcgcgcatccccttcggccaggggctgatgaagaacgcctatgtggggcgcacctttatccagccttcgcagacgatccgtcagctgggcattcgcttgaagctcaacccgctgcgcgaggttatcgagggcaagcgcctggtcgttgtcgacgattcgatcgtgcgtggcaacacccagcgcgctctcatcaagatgctgcgtgaagcgggagcgaaggaagttcacgtccgcatcgcttcgccgccggtgaagtggccgtgcttctacggcatcgactttgcctcgcccaccgagctcattgcgaataacgttgacgccgcagacccggtggaagggatccgcaaggaaatcgatgcggattccctagccttcgtctcgaccgaggcgatgatagaggcgtcacaacaaagcagcgacgagctgtgcgcggcgtgcttcgatggcgtgttccccctaggcatgccgagcgacaacccgaattcagcgctggtcgaaacaatgctgaagcaacaggctaagaaagcgagtactaagccatga

SEQ ID NO: 30468 - protein, 495 aa, Corynebacterium jeikeium K411
MLSPFDDRGETEPREECGVFGVWAPGEDVSKLTYYGLYALQHRGQEAAGIAVGDGDQIVVFKDLGLVSQVFDEQSLEALKGHIGLGHNRYTTAGGNSWENAQPMFRMAPDGTDVALGHNGNLVDHRELTQEAARLGLVDPKENPSDSLVMCALLAADTREGHGVEEAAMELFPKVKGAFCVLFTDGDALYAARDPQGVRPLSIGQLAGGGWVVASETAALDIVGARFVRDVEPGELVIVDGDGVRSRRFAETAHKGCVFEYVYLARPDSVIRGRSVNGARLQIGRKLAEEAPADGDLVIPVPESGTPAAVGYAQASRIPFGQGLMKNAYVGRTFIQPSQTIRQLGIRLKLNPLREVIEGKRLVVVDDSIVRGNTQRALIKMLREAGAKEVHVRIASPPVKWPCFYGIDFASPTELIANNVDAADPVEGIRKEIDADSLAFVSTEAMIEASQQSSDELCAACFDGVFPLGMPSDNPNSALVETMLKQQAKKASTKP

SEQ ID NO: 30469 - DNA, 1485 bp, Staphylococcus haemolyticus JCSC1435
  CDS (1)..(1485): transl_table=11
gtgtttaactacagtggattaaacgaagaatgtggtgtgttcggcatttggaatcattcagaagccgctcaattaacctatatgggacttcacagtttacaacatcgtggtcaagaaggtgcaggtattgttgtatcagatggagaaattttaaaaggtgaacgaggtcttggattgttaacagaagcaattaaaggtgatcaaatggatcaacttaaagatggacacaacgccattggccatgttcgctatgccacatcaggtaataaagggattgaaaatatacaaccatttttatatcacttttacgatatgagcgttgcgatttgccacaatggtaatttaattaatgcccagacgttacgtcaatatttggaaaaacatggtgcaatcttccattcttcatctgacactgaagtgattatgcatttaatacgcagaagtaaagcaccaacttttgaagaagcgttaaaagagagcttgcgacaaattaaaggcggattcacatttgcaatacttactaaagatgcattatatggagcagtagatcctaacgctatccgtccactggtagtaggtaaaatgcaagatgacacgtacatcttagctagtgaaacatgtgccattgatgtattaggtgctgaatatgtgcaagatatccatgctggagaatatgttgttattaataatgaaggtattgaagtgaaatcatatacgagtcatacaaatacggctatttcagctatggaatatatttatttcgctcgtcctgattctactattgctggcaaaaatgttcatgctgttcgtaaagcatctggaaaaaaattagcacaagaaagccctgcaaatgcagatatggttattggtgtacccaactcatcattatcagctgcaagtgggtatgctgaagaaagtcacctaccttatgaaatggggttggtgaagaaccaatatgtagctcgcacatttatccaaccgactcaagagttaagagaacaaggtgtccgcgttaaattgtcggcagtcaaggatatcgtagaaggtaaacgaattgtattagttgatgattcaattgtgcgtggaacaacgagtaaacgtattgtcagaatgttaaaggactccggagctaaagaggttcatgtaagaatcgcttctccagaatttatgttcccaagcttttacggtatagatgtttcaacgactgctgaactcatttctgcaagtaagtcacctaaagaaatttgtgattatattggtgcagactcattatcatatttaagcgtagacggtctaattgaatcgattggattagattatgacgcaccgtatagtggtttatgtgtagagagctttacaggtgattatccagcaggactatttgattatgaagataaatattataagaacttaagtcaacgtcaacaggattatattaataatcataaacactactttgatagagagggtaatattcatgtctaa

SEQ ID NO: 30470 - protein, 494 aa, Staphylococcus haemolyticus JCSC1435
MFNYSGLNEECGVFGIWNHSEAAQLTYMGLHSLQHRGQEGAGIVVSDGEILKGERGLGLLTEAIKGDQMDQLKDGHNAIGHVRYATSGNKGIENIQPFLYHFYDMSVAICHNGNLINAQTLRQYLEKHGAIFHSSSDTEVIMHLIRRSKAPTFEEALKESLRQIKGGFTFAILTKDALYGAVDPNAIRPLVVGKMQDDTYILASETCAIDVLGAEYVQDIHAGEYVVINNEGIEVKSYTSHTNTAISAMEYIYFARPDSTIAGKNVHAVRKASGKKLAQESPANADMVIGVPNSSLSAASGYAEESHLPYEMGLVKNQYVARTFIQPTQELREQGVRVKLSAVKDIVEGKRIVLVDDSIVRGTTSKRIVRMLKDSGAKEVHVRIASPEFMFPSFYGIDVSTTAELISASKSPKEICDYIGADSLSYLSVDGLIESIGLDYDAPYSGLCVESFTGDYPAGLFDYEDKYYKNLSQRQQDYINNHKHYFDREGNIHV

SEQ ID NO: 30471 - DNA, 1335 bp, Sulfolobus acidocaldarius DSM 639
  CDS (1)..(1335): transl_table=11
gtgattagcaagataaaggaacattgcggaatagtcggaattcacaatgttcccgatgcaccaagaattgtatatgagactttgaagtttctccaacatagaggtcaggaatcggctggaataacattcctcgataaggatcgacttagtactgttaagggactaggacttgtggaagacgcattagacccaataattcttaaatcgtcaaacttctctattggtcacgtaagatactcgactacaggacggggagtaatagatgaagctcagcccctaagcgacggtaaaatcgctctagcgtttaatggaactattccaaattacattaattataacgtgaggattgatactgaattcatttatgaagtactgaaaaaccaagaagatataaggcaagggataagaaaattggtggacgtagcagatggtggttattccttagttgtcttaaccaataagggtgaactaatcggtctaagagatcccaaaggctttagacctttggttttaggtaaattaggctcaggctatattatagcgtctgaagattctgcaataaggcagttgggaggaatagtgattagggatgttaaacccggtgagatgatatacatcaagaatggctcaattgaaagcgagatcgtagctagggacgaagttcatttttgttccttcgagtatatttacttctctagggctgactcaataatagacggagtttcagtctatagggctagagtgaggttaggcgagatattagctgagaaccatccagcgaaagcagatattgtggttcctgtaccggagtcctctgtgccaattgccctagggttttcaaggaaatctggaattcctctggaatatggattggtcagaacgtctgtatctaagagatcttttataatgccttcccaggataagagggaaagtattgttgaggagaaattcggagttgttggtgaggtggtaagaaacaagaaaattatattaatagatgattctatagttagaggcacaacaatgaaaaaattagtgaaactaattagagaaaatggtgcaagtgagattcatgtgagaataggttcacctatgatcaggtatccctgctatatgggtatagactttccgaacaagaaggaattaatcgcaaatgataaaaacgagatggagattgcaaagtcaattggagcagattctgttgaatacctctctatagatgagatgattaaggcaattggtagacaagatttatgtcacgcatgtttttcaggtatgtatcctcttaaacattcgtatgatttttctaaactcagtgtaagtatgaaagggtga

SEQ ID NO: 30472 - protein, 444 aa, Sulfolobus acidocaldarius DSM 639
MISKIKEHCGIVGIHNVPDAPRIVYETLKFLQHRGQESAGITFLDKDRLSTVKGLGLVEDALDPIILKSSNFSIGHVRYSTTGRGVIDEAQPLSDGKIALAFNGTIPNYINYNVRIDTEFIYEVLKNQEDIRQGIRKLVDVADGGYSLVVLTNKGELIGLRDPKGFRPLVLGKLGSGYIIASEDSAIRQLGGIVIRDVKPGEMIYIKNGSIESEIVARDEVHFCSFEYIYFSRADSIIDGVSVYRARVRLGEILAENHPAKADIVVPVPESSVPIALGFSRKSGIPLEYGLVRTSVSKRSFIMPSQDKRESIVEEKFGVVGEVVRNKKIILIDDSIVRGTTMKKLVKLIRENGASEIHVRIGSPMIRYPCYMGIDFPNKKELIANDKNEMEIAKSIGADSVEYLSIDEMIKAIGRQDLCHACFSGMYPLKHSYDFSKLSVSMKG

SEQ ID NO: 30473 - DNA, 1215 bp, Sulfolobus acidocaldarius DSM 639
  CDS (1)..(1215): transl_table=11
atggcaggtatactaggtgtatatgcatttgataaaatctggaacataagtaagtttttgtactacggtataataggcttgcaacatagaggctattcaagaagtggtatctcgacattaagcgataaaggattttttaccatctcaggagactcagcacctgaagacttagagcttccagagattcagggatgggctggtgtcgcatatacaggattagaaaagaagtatccttataccacagattatggggttttatccatagatggagtagtgaagactgatctcaatgaactcagtaaaaagctatacaaggatcctgagactgccctaatggaagctgatggagtcttctctttagtcttcctatcaaaagacggaagaatgatcggttatagggatgaacttggagtaaagccactggaaataggaggtttcggatttgatctagccatactgtcttctgaaacaccaggtatttcagtgattggtggtgagttgaaaagggaaataaagccaggagaactagtttatatagattcatattctgtgtcgtacaagagacttaaggaatcatcgtcctctagatattgctctattgatatagtttatcagtcaaggatagacagttacgtttttgatggtaatatctacgatataagggtcaggataggtgaacagttagctgaagagaggaaaattgaaggagatgtggtaataggagttccagacactgcaataccatacgcaataggctattcccgtaaatccggaataccattctctttaggcttcaccaggacaggcagtcctataaggactatgttagcctcggatgatttcctcaaggttattggtgttcagttaaagcttaatcccataaagtctgccgttaagggaaaaagagtaatattaattgatgattctatggtaactggaagaacattaaagaacaccatctttaacttaagagtattaggagccaaggaagtacatgtgctaattggcagtcctaagctaattgccaaatgcccctatggtatgcaagttcctgaagaaaaggagctcatagcagccaatcttccggataacgaaataactaaagttatgggtgcagactcaatatattggctaagtcttgagggactttacaaagtagttggtcatagaaatttatgcgttggttgcatgactaacctctttcctaaatggtga

SEQ ID NO: 30474 - protein, 404 aa, Sulfolobus acidocaldarius DSM 639
MAGILGVYAFDKIWNISKFLYYGIIGLQHRGYSRSGISTLSDKGFFTISGDSAPEDLELPEIQGWAGVAYTGLEKKYPYTTDYGVLSIDGVVKTDLNELSKKLYKDPETALMEADGVFSLVFLSKDGRMIGYRDELGVKPLEIGGFGFDLAILSSETPGISVIGGELKREIKPGELVYIDSYSVSYKRLKESSSSRYCSIDIVYQSRIDSYVFDGNIYDIRVRIGEQLAEERKIEGDVVIGVPDTAIPYAIGYSRKSGIPFSLGFTRTGSPIRTMLASDDFLKVIGVQLKLNPIKSAVKGKRVILIDDSMVTGRTLKNTIFNLRVLGAKEVHVLIGSPKLIAKCPYGMQVPEEKELIAANLPDNEITKVMGADSIYWLSLEGLYKVVGHRNLCVGCMTNLFPKW

SEQ ID NO: 30475 - DNA, 1506 bp, Pseudomonas fluorescens Pf-5
  CDS (1)..(1506): transl_table=11
atgtgtggcatcgtcggtatcgtcggtaagtcgaacgtcaatcaggcgctgtatgacgcgctaaccgtcctccagcaccgcggccaggacgctgccggtatcgtgaccagccatgatggccggttattcctgcgcaaggacaacggcctggtgcgtgatgtgttccagcagcggcacatgcagcgcctggtaggccatatgggcatcggccatgtccgctatccaaccgcgggcagctcgacctcggccgaggctcagccgttctacgtcaactcgccttacggcatcaccctggcgcacaacggcaacctgaccaatgtggagcagttggccaaggagatctacgagtccgacctgcgccacgtcaacaccaactccgactctgaagtgctgctcaacgtgtttgcccacgagctggcccagcgcggcaagttgcagcctaccgaggaagacgtgtttgccgccgtcaccgacgtgcacaaccgttgcgtgggtggctacgcggtggtggccatgatcaccggctacggcattgtcggtttccgtgacccccacggtatccgtccgatcgtcttcggccagcgtcataccgacgaaggcgtggaatacatgatcgcctcggaaagcgtttccctggatgtgctgggtttcaccctgattcgcgacctggctccgggcgaagcggtctacatcactgaagagggcaagctctacacccgccagtgcgccaccaacccgcaactcacgccgtgcatcttcgaacacgtatatctggcccgtccggattcgatcattgatggcgtctcggtgtacaaggcgcgcctgcgcatgggtgagaaactggcagagaagatcctgcgcgagcgtcctgagcacgatatcgacgtggtgatcccgattccggataccagccgcactgcggcgctggagctggcgaaccatctgggggtcaagttccgcgaaggtttcgtcaagaaccgctacataggccgtaccttcatcatgccgggccaggcggcgcggaagaaatccgtacgccagaagctcaatgcgatcgaactggaatttcgcggcaagaacgtgatgctggtggacgactccatcgtccgtggcaccacctgcaagcagattatccagatggcccgtgaagcgggcgcgaagaacgtctacttctgctcggctgcacctgccgtgcgttacccgaacgtgtatggcatcgacatgccgagcgcccacgagttgatcgcccacaatcgttcgacccaggacgtggcagacctgatcggcgccgactggctgatctaccaggacttgccggacctgatcgaggcggtcggtggtggcaagatcaagatcgagaacttcgactgcgcggtgttcgacggcaagtacgttaccggcgatgtcgacgaggcctacctgaacaagatcgagaacgctcgtaacgatgcgtccaaggccaagacccaggcggtcagcgccatcatcgatctgtacaacaactga

SEQ ID NO: 30476 - protein, 501 aa, Pseudomonas fluorescens Pf-5
MCGIVGIVGKSNVNQALYDALTVLQHRGQDAAGIVTSHDGRLFLRKDNGLVRDVFQQRHMQRLVGHMGIGHVRYPTAGSSTSAEAQPFYVNSPYGITLAHNGNLTNVEQLAKEIYESDLRHVNTNSDSEVLLNVFAHELAQRGKLQPTEEDVFAAVTDVHNRCVGGYAVVAMITGYGIVGFRDPHGIRPIVFGQRHTDEGVEYMIASESVSLDVLGFTLIRDLAPGEAVYITEEGKLYTRQCATNPQLTPCIFEHVYLARPDSIIDGVSVYKARLRMGEKLAEKILRERPEHDIDVVIPIPDTSRTAALELANHLGVKFREGFVKNRYIGRTFIMPGQAARKKSVRQKLNAIELEFRGKNVMLVDDSIVRGTTCKQIIQMAREAGAKNVYFCSAAPAVRYPNVYGIDMPSAHELIAHNRSTQDVADLIGADWLIYQDLPDLIEAVGGGKIKIENFDCAVFDGKYVTGDVDEAYLNKIENARNDASKAKTQAVSAIIDLYNN

SEQ ID NO: 30477 - DNA, 1536 bp, Psychrobacter arcticum 273-4
  CDS (1)..(1536): transl_table=11
atgtgtggagtcgttggggtcgcagctcatgagccggtcaaccaaattttgtatgatgccttaaccatgttgcagcaccgtgggcaagatgcggcaggtattgtgactttacaggatggacgtttatatttacgtaaagaaaacggcatggtacgtgacgtctttatgagtcgccatatgttaaagctggtcggtaaatttggtatcggacatgtgcgttatccaactgctggaacgtctagcagtgctgaagcacagcctttttatgtcaactcgccttacggtattacccttgcacataatggtaatttgaccaatgctgagagcttggcaaaatcgctttatcaagaagatcgccgccatttaaataccgactcagattctgaggtattgctcaatgtgcttgcacatgagatgcaaaatctaggaaaaactcatccaacgcctactgatatctttgaagcagtcacagcggtttatagtcgtgttgaaggcgcttacggtgtggtcgctctgattaccggtcatggtttgctagcattccgtgatccaaatggtattcgaccgcttatctttggtaagcgcatggctgctaatggcggcacagaatacatggtggcatcagaatcggttgccttaacaggttcaggttttagtattgtgcgtgatgttaagcctggcgaagctatctttattgatctagatcataaactgcatacgcatcagtgcgtcgagcaaaaagaatatacgccatgtatctttgaatacgtttattttgcccgtccagattcaattatggataatatttctgtctacaaatcgcgcttacgtatgggcgaaaaactggctgataaaatccttgctgaatggggtgaagatcatgatatcgatgtcgtcattcctattccagatacctcgcgcacctcagcgatggagctggcgctaaagatgaatgtgaagtatcgtgaagggtttatgaaaaaccgctatatcggtcgtacctttattatgccaggtcagcagcaacgcaaaaagtcagtacgtcaaaagctcagtgcggtaccattagagtttaaaggtaaaaacgtactcttggttgatgattctatcgttcgcggtaccacttgccatgagattatccaaatggcacgcgatgcaggcgctcgtaaagtattctttgccagtgcatcgccaccggttaaatatccaaacgtctatggtattgatatgccagtgcgtagcgagctgatcgcatcagggcatagcgttgaagaggtacgagaaattattggcgctgaccgtttaattttccaagatttggatgatttgattgaggcggtaaaagatactaagcatagcaaagttgaaggctttgattgtgcggtattcaatggctgttatatcaccggtcaaatcaacgaagcgtatcttgagcatctgcaagagcagcgtaacgacactgctaaaaagggtaaagaaggggtacaagtagtggctgatacaccagtagatatgatgggggtagaagagctttag

SEQ ID NO: 30478 - protein, 511 aa, Psychrobacter arcticum 273-4
MCGVVGVAAHEPVNQILYDALTMLQHRGQDAAGIVTLQDGRLYLRKENGMVRDVFMSRHMLKLVGKFGIGHVRYPTAGTSSSAEAQPFYVNSPYGITLAHNGNLTNAESLAKSLYQEDRRHLNTDSDSEVLLNVLAHEMQNLGKTHPTPTDIFEAVTAVYSRVEGAYGVVALITGHGLLAFRDPNGIRPLIFGKRMAANGGTEYMVASESVALTGSGFSIVRDVKPGEAIFIDLDHKLHTHQCVEQKEYTPCIFEYVYFARPDSIMDNISVYKSRLRMGEKLADKILAEWGEDHDIDVVIPIPDTSRTSAMELALKMNVKYREGFMKNRYIGRTFIMPGQQQRKKSVRQKLSAVPLEFKGKNVLLVDDSIVRGTTCHEIIQMARDAGARKVFFASASPPVKYPNVYGIDMPVRSELIASGHSVEEVREIIGADRLIFQDLDDLIEAVKDTKHSKVEGFDCAVFNGCYITGQINEAYLEHLQEQRNDTAKKGKEGVQVVADTPVDMMGVEEL

SEQ ID NO: 30479 - DNA, 1482 bp, Candidatus Pelagibacter ubique HTCC1062
  CDS (1)..(1482): transl_table=11
atgaaaaaaactatcaagattccaaagaaaaaattcaagatttataatcccaaattaaaagaagaatgtggtgtctttggcgtaagtaacaataaagattcagccgcactaaccgctttaggattacatgctctgcaacatagaggtcaagaaggctgtggaatagtaacatttgatggaaaaaaatattactctgaaaaaagatttggcttagttggagataattttaataaagagaaagtgttaaatagtttacctggtgattatgctattggtcataacagatatagtacaactggtgaaaacactttaagaaatatacagcctttttttgcagatacaaatgctggaggtatcggtgtagctcataatggaaatttaactaattcaataactcttcgaaatagattggttcaagatggtgcaatatttcatactacatctgacacagaaacaattgttcaattaattgctaaatcaaaaagaaacaaaacaattgataaagttatagatgccatattccaaatacaaggtggttacgcgcttgtcatgctaacacaaaatactttaattggtgtaagagatcctcatggtatcagaccattagtaattgggaaaatcaaagatagctatgtctttgcttctgaaacatgtgcactagatataattggtgcaaaatatattcgagatgtagaaaacggtgaggttgtttatatagagaataatgaactaaaaagcatcaaacccttccctgctagaaaagttcgtccgtgcgtttttgagtatatttattttgcaagaccagacagtttactaaatggtaaatctgcttatgaacatagaaaacaatttgggattgaacttgcaaaagaaaacaaaatcaaagcagatattgtagttcctgtaccagactctggtaatgcagcagcccttggttttgctcaacacttaggaattaactttgaattaggtttgattagaaatcattatgttggtcgaacctttattgaacctagtcaaaaaattagaagtcttggtgtaaaattaaaattaaatgcaaatcaatcaactattaaggataagataattattttaatagatgactcgcttgtaagagggacaacttctcataaaattgtgaaaatgttatatgatgcaggagccaaagaagttcatgtaaaaattgcctgtccagaaattaggtttcctgatttttatggtgtggatactcctactaaaaaagagttacttgctgcaaataaaactaatgacgaaatttgtgaatatattggtgctaaatcattagattttttatccttagaaggtgtttatagagcaatgggttttaacaaaagagataataattatcctcaattaacagatcattattttacaggtgaatatcctgttaaacctatagatgaattaggggatgataagatcactcaattatcattactaagcaccgcttcaaataactaa

SEQ ID NO: 30480 - protein, 493 aa, Candidatus Pelagibacter ubique HTCC1062
MKKTIKIPKKKFKIYNPKLKEECGVFGVSNNKDSAALTALGLHALQHRGQEGCGIVTFDGKKYYSEKRFGLVGDNFNKEKVLNSLPGDYAIGHNRYSTTGENTLRNIQPFFADTNAGGIGVAHNGNLTNSITLRNRLVQDGAIFHTTSDTETIVQLIAKSKRNKTIDKVIDAIFQIQGGYALVMLTQNTLIGVRDPHGIRPLVIGKIKDSYVFASETCALDIIGAKYIRDVENGEVVYIENNELKSIKPFPARKVRPCVFEYIYFARPDSLLNGKSAYEHRKQFGIELAKENKIKADIVVPVPDSGNAAALGFAQHLGINFELGLIRNHYVGRTFIEPSQKIRSLGVKLKLNANQSTIKDKIIILIDDSLVRGTTSHKIVKMLYDAGAKEVHVKIACPEIRFPDFYGVDTPTKKELLAANKTNDEICEYIGAKSLDFLSLEGVYRAMGFNKRDNNYPQLTDHYFTGEYPVKPIDELGDDKITQLSLLSTASNN

SEQ ID NO: 30481 - DNA, 1518 bp, Colwellia psychrerythraea 34H
  CDS (1)..(1518): transl_table=11
atgtgtggtattgttggtattgtcggtaaaactcctgttagtcagcatatatatgatggactaactgtacttcagcatcgtggtcaagatgctgctggtattgtaacaattcataataatactttcaggctaagaaaaggtaatgggttagtgaaagatgtttttcatacccgccatatgcttcgcctacaaggtaatattggtattggtcacattcgctatccaacagcgggcacttctagctcttcagaagcacaacctttttatgccaactcaccttttggtttgtcattggcacataatggtaacttaaccaacgctgaagaattaagaacatggttatttgatgaagctcgtcgccatgtgaacacaacttcagattctgaggttctgttaaatatcctagcgcatgaattacagcaaagtgaaaacattgcgctaacaccggaagatattttcactgcagttgctaaagtccataaacgtgttcgtggcgcatatgctactgtagcgcttattgttggtcacggtatgattgcttttcgtgaccctaacggaattcgtcctttagtttttggtaaaagagaaactgaattgggcgttgagtatatggttgcgtctgaatcagttgcgctagatgcatgttcttttgaatttgtacgtgatgttgctccaggtgaaactatatttttctctgaagatggcctaattcacagtctgcaatgtgctgaaaatcctgtttatagcccatgtatatttgaatttgtatactttgctcgccctgattcaaccatggataaaatgtctgtttatgcctctcgtgtagaaatgggaactaagttaggcgagaaaattgccgaggaatggcaagatattgatattgatgttgttattcctatccctgaaacatcttgcgatattgccttacaaatagcaaagcagcttaacttaccttaccgacaaggttttgttaaaaaccgatacatcggtcgtacttttattatgccgggtcaagagcaacgtaaaaaatcagttcgtcaaaagcttaacgctattgcaacggaatttaagggtaaaaatgttttactagttgacgattctgttgttcgaggcactacctcggagcagataattgatatggcgcgtgcctcaggtgcaaaaaatgtctattttgcttcagcagcacctgaagtaagattccctaatgtctatggtatagatatgccaagtgctaatgaactcattgcacatggtcgtgaattggatgatatttgtagtttaattggtgcagataaattaatatttcaatctcttgaggacttaatctctgcagttagcgttggcaatccagacatcaaaacttttgatacttctgtatttgatggtaactatgtcaccaatgatatcgaccaagcatatttagaaagattagatgcattgcgtaataatacgagtaaagaagaatcagacaaaaatgctgattctattattgatatgcataatgaaggtgcagagtag

SEQ ID NO: 30482 - protein, 505 aa, Colwellia psychrerythraea 34H
MCGIVGIVGKTPVSQHIYDGLTVLQHRGQDAAGIVTIHNNTFRLRKGNGLVKDVFHTRHMLRLQGNIGIGHIRYPTAGTSSSSEAQPFYANSPFGLSLAHNGNLTNAEELRTWLFDEARRHVNTTSDSEVLLNILAHELQQSENIALTPEDIFTAVAKVHKRVRGAYATVALIVGHGMIAFRDPNGIRPLVFGKRETELGVEYMVASESVALDACSFEFVRDVAPGETIFFSEDGLIHSLQCAENPVYSPCIFEFVYFARPDSTMDKMSVYASRVEMGTKLGEKIAEEWQDIDIDVVIPIPETSCDIALQIAKQLNLPYRQGFVKNRYIGRTFIMPGQEQRKKSVRQKLNAIATEFKGKNVLLVDDSVVRGTTSEQIIDMARASGAKNVYFASAAPEVRFPNVYGIDMPSANELIAHGRELDDICSLIGADKLIFQSLEDLISAVSVGNPDIKTFDTSVFDGNYVTNDIDQAYLERLDALRNNTSKEESDKNADSIIDMHNEGAE

SEQ ID NO: 30483 - DNA, 1509 bp, Pseudomonas syringae pv. phaseolicola 1448A
  CDS (1)..(1509): transl_table=11
atgtgtggcatcgtcggtatcgtcggcaagtcgaacgtcaatcaggcgctgtatgacgcgcttaccgtcctccagcaccgcggccaggacgctgccggtatcgtaaccagccacgatggccggttattcctgcgcaaggacaacggattggtgcgtgatgtgtttcatcaacgccatatgcagcgcttggtcgggcatatgggcatcggtcatgtgcgctatccaacggcgggcagctcgacgtctgcagaggcccagccgttctacgtcaactcgccttatggcatcacgttggcgcacaacggcaacctcaccaacgtcgaacaactggccaaggagatttacgaatccgacctgcgccatgtgaacaccaattccgattcggaagtgctgctcaacgttttcgcccatgagctggccgtgcgtggcaagttgcagccgaccgaagaggatatcttcgccgcagtgaccgacgtgcataatcgctgccgtggcggctatgcggtcgtggcaatgatcaccggctacggcattgtcggtttccgtgacccggacgccattcgtcctatcgtgtttggccagcgtcataccgacgaaggcgtcgaatacatgatcgcatcggaaagcgtgtcgctggacgtgctcggctttaccctgattcgcgacctggcaccgggcgaagcggtctacatcactgaagacggcaagctgcatacccgtcagtgtgcggccaaccccaaatatgcaccgtgcatcttcgaacacgtttatctggcacgtcctgactcgatcatcgacggcatttcggtctacaaggcgcgtttgcgcatgggcgagaagctggccgacaagatcctgcgcgagcgtccggatcacgatatcgatgtggtcatcccgattccggacaccagccgtaccgctgcgctggagctggccaatcatctgggcgtcaagttccgcgaaggtttcgtcaagaaccgctacatcggccggaccttcatcatgccgggccaggcagcacgcaagaaatccgtgcgtcagaagctcaacgcaatcgagctggagttccgcggcaagaacgtgatgctggtggatgactccatcgtgcgcggcacgacctgcaaacagatcatccagatggcccgtgaagccggtgccaagaatgtctacttctgttcggcggccccggccgtgcgctaccccaacgtctacggcatcgacatgccgagtgctcacgagctgatcgcccacaaccgttccactcaggacgttgccgaccttatcggtgccgactggctggtttatcaggatctgaatgacctgatcgaagcggtcagcggcagcaagaaaatcaagatcgacaacttcgattgctcggttttcgacggcaagtacgtgaccggtgacatcgacgagcattatctgaacaggatcgagagcgcgcgtaacgacgcctccaagatcaagactcaggccgtgagcgcgatcatcgatctgtacaacaactaa

SEQ ID NO: 30484 - protein, 502 aa, Pseudomonas syringae pv. phaseolicola 1448A
MCGIVGIVGKSNVNQALYDALTVLQHRGQDAAGIVTSHDGRLFLRKDNGLVRDVFHQRHMQRLVGHMGIGHVRYPTAGSSTSAEAQPFYVNSPYGITLAHNGNLTNVEQLAKEIYESDLRHVNTNSDSEVLLNVFAHELAVRGKLQPTEEDIFAAVTDVHNRCRGGYAVVAMITGYGIVGFRDPDAIRPIVFGQRHTDEGVEYMIASESVSLDVLGFTLIRDLAPGEAVYITEDGKLHTRQCAANPKYAPCIFEHVYLARPDSIIDGISVYKARLRMGEKLADKILRERPDHDIDVVIPIPDTSRTAALELANHLGVKFREGFVKNRYIGRTFIMPGQAARKKSVRQKLNAIELEFRGKNVMLVDDSIVRGTTCKQIIQMAREAGAKNVYFCSAAPAVRYPNVYGIDMPSAHELIAHNRSTQDVADLIGADWLVYQDLNDLIEAVSGSKKIKIDNFDCSVFDGKYVTGDIDEHYLNRIESARNDASKIKTQAVSAIIDLYNN

SEQ ID NO: 30485 - DNA, 1512 bp, Streptococcus pyogenes MGAS6180
  CDS (1)..(1512): transl_table=11
ttgtgcgaaaaactttctattttcgctttacttgacagcctttgtatcgaggtaaaaatgacatacgaagtaaaatctctaaatgaagaatgtggagtctttggtatctggggacatcctcaggcagctcaagtcacttactttgggcttcatagccttcaacatcgcggtcaagaaggagctggtattgtttcaaatgacaatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgacgggcaatttgctttatgccataatggtaatttgacaaatgctatttccttaaggaaagaattagaaaagcaaggtgcaattttcaatgcctcctcagatactgaaattttgatgcacttgattcgtcgaagccataactcaagtttcatgggaaaggtaaaagaagctctaaatacagtaaagggtggctttgcctatctactgatgacagaaaataaactcattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggcgaagttattcttatagacgatcgtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggtcttgtaaaaaatcagtatacgcagcgaacctttattcaaccgacacaagaattaagggaacaaggtgttcgaatgaaactatcagcggtatctggtgttgtcaaaggaaagcgcgttgttatgattgatgactcaattgtaagaggaacgacttctagaaggattgtcggattattaagagaagcaggagctagtgaagtacatgttgctatagctagtccagaattaaagtatccttgtttttatggtattgatattcaaacaagacgagaattaatttcagcaaatcacgctgctgacgaagtgtgtgatattattggcgcagatagtctgacctatctctcactagatgggttgattgaatcaattggactcgaaacaaaagcaccaaatggtggtttatgcgtagcttactttgatggacattatccaacaccgctttatgattatgaagaagaatacctcagaagtttagaagaaaaaacaagtttttatattcaaaaagtgaaataa

SEQ ID NO: 30486 - protein, 503 aa, Streptococcus pyogenes MGAS6180
MCEKLSIFALLDSLCIEVKMTYEVKSLNEECGVFGIWGHPQAAQVTYFGLHSLQHRGQEGAGIVSNDNGKLYGYRNVGLLSEVFKNQSELDNLTGNAAIGHVRYATAGSADIRNIQPFLYKFHDGQFALCHNGNLTNAISLRKELEKQGAIFNASSDTEILMHLIRRSHNSSFMGKVKEALNTVKGGFAYLLMTENKLIAALDPNAFRPLSIGQMQNGAWVISSETCAFEVVGAKWVRDVEPGEVILIDDRGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGASEVHVAIASPELKYPCFYGIDIQTRRELISANHAADEVCDIIGADSLTYLSLDGLIESIGLETKAPNGGLCVAYFDGHYPTPLYDYEEEYLRSLEEKTSFYIQKVK

SEQ ID NO: 30487 - DNA, 1455 bp, Streptococcus pyogenes MGAS5005
  CDS (1)..(1455): transl_table=11
atgacatacgaagtaaaatctctaaatgaagaatgtggagtctttggtatctggggacatcctcaggcagctcaagtcacttactttgggcttcatagccttcaacatcgcggtcaagaaggagctggtattgtttcaaatgacaatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgacgggcaatttgctttatgccataatggtaatttgacaaatgctatttccttaaggaaagaattagaaaagcaaggtgcaattttcaatgcctcctcagatactgaaattttgatgcacttgattcgtcgaagccataactcaagtttcatgggaaaggtaaaagaagctctaaatacagtaaagggtggctttgcctatctactgatgacagaaaataaactcattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggcgaagttattcttatagacgatcgtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggtcttgtaaaaaatcagtatacgcagcgaacctttattcaaccgacacaagaattaagggaacaaggtgttcgaatgaaactatcagcggtatccggtgttgtcaaaggaaagcgcgttgttatgattgatgactcaattgtaagaggaacgacttctagaaggattgtcggattattaagagaagcaggagctagtgaagtacatgttgctatagctagtccagaattaaagtatccttgtttttatggtattgatattcagactcgtcgtgagttgatttcagccaatcactctgttgatgaagtgtgtgatattattggcgcagatagtctgacctatctctcactggatgggttgattgaatcaattggactcgaaacaaaagcaccaaatggtggtttatgcgtagcttactttgatgggcattatccaacaccgctttatgattatgaagaagaatacctcagaagtttagaagagaaaacaagtttttatattcaaaaagtgaaataa

SEQ ID NO: 30488 - protein, 484 aa, Streptococcus pyogenes MGAS5005
MTYEVKSLNEECGVFGIWGHPQAAQVTYFGLHSLQHRGQEGAGIVSNDNGKLYGYRNVGLLSEVFKNQSELDNLTGNAAIGHVRYATAGSADIRNIQPFLYKFHDGQFALCHNGNLTNAISLRKELEKQGAIFNASSDTEILMHLIRRSHNSSFMGKVKEALNTVKGGFAYLLMTENKLIAALDPNAFRPLSIGQMQNGAWVISSETCAFEVVGAKWVRDVEPGEVILIDDRGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGASEVHVAIASPELKYPCFYGIDIQTRRELISANHSVDEVCDIIGADSLTYLSLDGLIESIGLETKAPNGGLCVAYFDGHYPTPLYDYEEEYLRSLEEKTSFYIQKVK

SEQ ID NO: 30489 - DNA, 1518 bp, Dechloromonas aromatica RCB
  CDS (1)..(1518): transl_table=11
atggcgacaacgccggtcaatcagctgctttacgatggtctgatggtgcttcagcatcgtggccaggatgcggccggcatcgcgacggcggaaggtaacaccttccacctgcacaaggggcctggtctggtgcgtgacgttttccgcactcgcaacatgcgtgccctgccgggcaactgcggcatcggtcatgttcgttatccgaccgctggctcggcctacaatttcgccgagtcacaacccttctacgttaattcaccgtttggcctggtgcttggccataacggcaacctgaccaatgccgagcaactcaagggcgagatgttccgcctcgatcgccggcacatcaataccaattccgactccgaagtgctgctcaatgtgctggcccatgagctgcagtcatcggcgcatggttatgagcttgatgttgatgccatcttccaggctgtgggcggcgtgcatcgccgctgccgtggcgcttacgccgtcgtggtgctgattgccggttatggcctgcttgctttccgtgacccgcacggcattcgcccgctgatctacggtcagaacgaaacaccggaaggcatggaatacctcgtctcttccgagtccgtggcgctcgatacactcggtttcaagatggtgcgcgacatcgagccgggcgaagccattttcatcgacttcaatcatcagttgcatagccgtcagtgcgcgcagcagccgatgtacgccccgtgtatcttcgagtacgtctatctggctcggccggataccgtgatcgacggcgtttcggtctatgaagcccgcctggcgatgggcgaactgttggccgagaaggtcaagaagcatatcccgatcgaggaaatcgacgtcgtcattccgattcccgactccagtcgcccgtcggccatgcaactggcgcaggtgctcaacattccgttccgcgagggcttcgtcaagaatcgctatgtcggtcgtaccttcatcatgccggggcaggccatgcgcaagaagtcggtgcgccagaaactgaacaccgtcggccaggagttcaagggcaagcgggtgctgctggtcgatgactccatcgtccgcggcacgaccagccacgaaattgtcgaaatggcccgtgcggcaggtgccgtcaaggtctatttcgcttcggcggcgccaccggtgcgcttcccgaacgtttatggcatcgatatgccgacccgctccgaactgattgccaccgggcggaccgatgcccagatcgctgccgaaattggcgccgatgccctggtttatcaggatcttgaagcgctgaagcagtccatcaccaacctgcgggccgacctgaccgtattcgatgcttcctgcttcgacggctgctacatcaccggcgacattgatgactactacctcgatgcagtcgagggcaagcgtggcggcaagccggtcaagaacgatgatgacggcgacggtcgctcttcgcagcagatggtgctgggcctggcgaatggtgggcaggagtaa

SEQ ID NO: 30490 - protein, 505 aa, Dechloromonas aromatica RCB
MATTPVNQLLYDGLMVLQHRGQDAAGIATAEGNTFHLHKGPGLVRDVFRTRNMRALPGNCGIGHVRYPTAGSAYNFAESQPFYVNSPFGLVLGHNGNLTNAEQLKGEMFRLDRRHINTNSDSEVLLNVLAHELQSSAHGYELDVDAIFQAVGGVHRRCRGAYAVVVLIAGYGLLAFRDPHGIRPLIYGQNETPEGMEYLVSSESVALDTLGFKMVRDIEPGEAIFIDFNHQLHSRQCAQQPMYAPCIFEYVYLARPDTVIDGVSVYEARLAMGELLAEKVKKHIPIEEIDVVIPIPDSSRPSAMQLAQVLNIPFREGFVKNRYVGRTFIMPGQAMRKKSVRQKLNTVGQEFKGKRVLLVDDSIVRGTTSHEIVEMARAAGAVKVYFASAAPPVRFPNVYGIDMPTRSELIATGRTDAQIAAEIGADALVYQDLEALKQSITNLRADLTVFDASCFDGCYITGDIDDYYLDAVEGKRGGKPVKNDDDGDGRSSQQMVLGLANGGQE

SEQ ID NO: 30491 - DNA, 1455 bp, Thermobifida fusca YX
  CDS (1)..(1455): transl_table=11
gtgtcgcaacccgacggccgcctcagcctggacatcgatcctttagaacgcggaccgcaggacgcctgcggagtgttcggggtctgggctcccggcgaagaagtaagcaaactgacctacttcggtctctacgcgctccagcaccgcggccaagagtccgcgggcatcgccctcagcaacggtgagcggatcgtcgtctacaaagacatggggctcgtgtcccaggtcttcaacgaagtcaccctggactccctcaaagggcacctggcgatcggccactgccgctactccactaccggctcatccgtctgggagaacgcgcaacccacgttcttcagcgcgcgggagggcggtctcgcgctcggccacaacggcaacctgatcaacaccccggagctcgcggcgctgctgccgtcggatcgcctgagcgcgaccacggacaccgaggtgctcacccgtctgctcgccgccgccccgcaccgcaccaccgaggaagccgccctcgacgtgctgcccaaagtcaagggcgcattctccctggtcttcatggacgagcacaccctgtacgcggctcgcgacccccagggaatccgcccgctggtcctgggccgcctcgacaccgggtgggtcgtggccagcgagaccgcggcgctcgacatcgttggtgcttccgtggtgcgcgaggtcgaaccgggagagctgctggtcatcaacgcggacggcgtcgcttcccggcgtttcgccccggccgagcccaaaggctgcctgttcgaatacgtctacctggcccgtcccgacaccacgatcgcgggacgcaacgtcaacagcgcccgcgtcgaagtggggcggcggctggcccggcagcacccggccgatgcagacgtggtcatccccgtccccgaatcgggcacgcccgcggccgtgggctacgccgaaagcagcggcatcccgttcgcccaagggctggtgaagaactcctatgtgggccgcacgttcatccagccgagccagacgctgcgccagcgcggcatccggctcaagctgaacccgctgcgcgaagtcatcgaaggcaagcggctggtcgtcgtcgacgactcgatcgtgcggggcaacacccagcgggccctggtgcggatgctgcgcgaggcgggcgctgccgaggtccacgtccggatctccagcccgcccgtgatgtggccctgctactacggcatcgacttcgccaccaaagccgaactgatcgcgggtagcctctccgtcgaagagatctgccaatccatcggcgcagactcgctcggcttcatcgatctcgatgaactggtcgcagccaccagagtcgagaagaaccggctgtgccgggcctgcttcgacggcgtctacccggtcgaggtcgacgaggactcccgcggcaagtacctgttggagaagtcctgcggcgcccctaagcgcccctag

SEQ ID NO: 30492 - protein, 484 aa, Thermobifida fusca YX
MSQPDGRLSLDIDPLERGPQDACGVFGVWAPGEEVSKLTYFGLYALQHRGQESAGIALSNGERIVVYKDMGLVSQVFNEVTLDSLKGHLAIGHCRYSTTGSSVWENAQPTFFSAREGGLALGHNGNLINTPELAALLPSDRLSATTDTEVLTRLLAAAPHRTTEEAALDVLPKVKGAFSLVFMDEHTLYAARDPQGIRPLVLGRLDTGWVVASETAALDIVGASVVREVEPGELLVINADGVASRRFAPAEPKGCLFEYVYLARPDTTIAGRNVNSARVEVGRRLARQHPADADVVIPVPESGTPAAVGYAESSGIPFAQGLVKNSYVGRTFIQPSQTLRQRGIRLKLNPLREVIEGKRLVVVDDSIVRGNTQRALVRMLREAGAAEVHVRISSPPVMWPCYYGIDFATKAELIAGSLSVEEICQSIGADSLGFIDLDELVAATRVEKNRLCRACFDGVYPVEVDEDSRGKYLLEKSCGAPKRP

SEQ ID NO: 30493 - DNA, 1527 bp, Ralstonia eutropha JMP134
  CDS (1)..(1527): transl_table=11
atgtgcggtatcgtcggcgcggtctctacctcgcccgtcaaccaattgatttacgacagcctgctgttgttgcaacaccgcggacaggatgctgccggcatcgccaccgccaacggcagtactttccacatgcacaaggccaacggcctcgtgcgcgacgtgttccggacccgcaatatgcgcggcctgccgggcaccgccggcatcggtcaggtgcgttacccgaccgcgggctccgcctccagcgaagaagaggcacagccgttctacgtcaatgcgccgtacggcatcatcctggcccacaacggcaacctgaccaactggcagcaactgcgcgaggaaatgttccgccgcgaccgccgccacatcaatacgcactcggataccgaggtgctgctcaatgtgctcgctgacgaactgcagcgcgcgagccagggcatggcgctggatccggaaacgatcttcaaggccgtttccggcatgcaccgccgcgtgaagggctcgtacgccattgccgcgcagatcgccggttacggcatgcttgccgtgcgcgatccgttcggcatccgcccgctgagtcttggcagcgtggacacgcccaccggcaaggaatggatggtggcgtcggagtcggtggcgctggaaggcatcggctatcgcatggagcgcgacgtggcgcccggcgaggccatcttcatcgacctcgacggcaagctgtacagcaagcagtgcgcggacaaccccgtgctgacgccgtgcatcttcgagtacgtctacctggcccgtccggattcgtgcatcgatggcgtgcccgtctatgacgcccgcctgcgcatgggcgactacctggccgaaaagatccgccaggaagtgtcggccggcgacatcgacgtggtcatgccgattcccgattccagccgcccggccgccatgcaggtagccaaccggctgggcgtgggctatcgcgaaggtttcttcaagaaccgctacgtgggccgcaccttcatcatgccgggccaggcggtgcgcaagaagtcggtgcgccagaagctcaacgcgatggccgtcgagttcaagggcaagaacgtgctgatcgtcgatgactcgatcgtgcgcggcaccacgtcgttcgagatcgtgcagatggcgcgcgacgccggcgccaacaaggtcatcttcgcctcggccgcgccgccggtgaagtacccgaacgtgtacggcattgacatgccgacgcgcagcgagttggtggcccatggccgcacgcacgaagagatcgccaagatcatcggcgccgacaagctggtgtaccaggacgtggaagcgatgaagcaggctgtacgcgacatcaaccccgcgttgaacgacttcgacgcgtcgtgcttcgatggccgctacgttaccggcgacatcgacgaggcctacctggatcgcctggaaacggcgcgcagcttggctgatcgcgaaggcaccggagacatggagcgctcgcaactgcacctgcagcgttcgggcggcaacgagtaa

SEQ ID NO: 30494 - protein, 508 aa, Ralstonia eutropha JMP134
MCGIVGAVSTSPVNQLIYDSLLLLQHRGQDAAGIATANGSTFHMHKANGLVRDVFRTRNMRGLPGTAGIGQVRYPTAGSASSEEEAQPFYVNAPYGIILAHNGNLTNWQQLREEMFRRDRRHINTHSDTEVLLNVLADELQRASQGMALDPETIFKAVSGMHRRVKGSYAIAAQIAGYGMLAVRDPFGIRPLSLGSVDTPTGKEWMVASESVALEGIGYRMERDVAPGEAIFIDLDGKLYSKQCADNPVLTPCIFEYVYLARPDSCIDGVPVYDARLRMGDYLAEKIRQEVSAGDIDVVMPIPDSSRPAAMQVANRLGVGYREGFFKNRYVGRTFIMPGQAVRKKSVRQKLNAMAVEFKGKNVLIVDDSIVRGTTSFEIVQMARDAGANKVIFASAAPPVKYPNVYGIDMPTRSELVAHGRTHEEIAKIIGADKLVYQDVEAMKQAVRDINPALNDFDASCFDGRYVTGDIDEAYLDRLETARSLADREGTGDMERSQLHLQRSGGNE

SEQ ID NO: 30495 - DNA, 1488 bp, Staphylococcus saprophyticus subsp. saprophyticus ATCC 15305
  CDS (1)..(1488): transl_table=11
atgtatgacagcaacggattaaatgaagaatgtggcgtgtttggcatatggaatcatccggaatctgctcaattaacctatatgggactacacagtttgcaacatcgtggtcaagaaggtgctggaatcgtttgttcaaatggtgaagtgcttaaaggtgaacgtggtttaggtttattgacagatgcgatatcagatacacaaatggaatcatttaaaacatatcaacatgcaattgggcatgtgagatacgcaacatccgggaataaaggtatagagaatattcaaccgtttttatatcatttttatgatatgagtgttgcagtttgtcataatggtaatcttatcaatgcgcaaagtctaaaaaaatctttagaacatcaaggctctatttttcactcttcttcagatactgaagttatcatgcacttgatacgcagaagtaaagcacctacatttgaagatgcttttcaagaaagtttaagaaaaataaaaggcggatttacttttgcggtactaactaaagacgctttatatggtgcagttgaccctaatgcgattcgaccattagctgttggtaaaatgaaaaatggttcatatattattgccagtgaaacatgtgcaatcgatgtcctaggtgctgaatttgtaagagatattcatgctggagaatatgtagtcatcaatgatgatgggatcagagtcgaatcttatacgcgtcatacaacgacggctatttcagctatggagtatatttactttgctagacctgattcaaccattgccggtaaaaatgttcatgctgttagaaaacagtctggtaagcaattagcgaaagaaagtccagcatcaaatgcggacatggttattggtgtacctaattcttcactttcagcagcatctggttatgccgaagagagtagactgccgtatgaaatgggtcttgttaaaaatcaatatgttgcaagaacatttattcaaccgacacaagaattacgtgaacaaggcgtccgcgtaaaattatctgctgtaaaagatattgtctatgataaaaatattgtcttagtagatgattcgattgtcagaggtactacgagtaaacgtatagtacaaatgttgaaagacgcaggcgctaaggaagttcatgtacgcattgcttctcctgagtttatgtttccaagtttttatggcatagatgtttcaacaacggcagagcttatttcatcaaataaatcgcccgaggagattagtgattatattggagcagattcactggcttatttaacagtcgaaggtctaattgattctattggacttgattgcgatgcgccttatagtggactttgtgttgaaagtttcacaggtgattatcctgcaggtttatatgattatgagcaagattatgtagcgcatttaagtgaacgtcaaaaagcgtacttagcaaatcatcaacaatactttgatagagagggtaatttaaatgtctaa

SEQ ID NO: 30496 - protein, 495 aa, Staphylococcus saprophyticus subsp. saprophyticus ATCC 15305
MYDSNGLNEECGVFGIWNHPESAQLTYMGLHSLQHRGQEGAGIVCSNGEVLKGERGLGLLTDAISDTQMESFKTYQHAIGHVRYATSGNKGIENIQPFLYHFYDMSVAVCHNGNLINAQSLKKSLEHQGSIFHSSSDTEVIMHLIRRSKAPTFEDAFQESLRKIKGGFTFAVLTKDALYGAVDPNAIRPLAVGKMKNGSYIIASETCAIDVLGAEFVRDIHAGEYVVINDDGIRVESYTRHTTTAISAMEYIYFARPDSTIAGKNVHAVRKQSGKQLAKESPASNADMVIGVPNSSLSAASGYAEESRLPYEMGLVKNQYVARTFIQPTQELREQGVRVKLSAVKDIVYDKNIVLVDDSIVRGTTSKRIVQMLKDAGAKEVHVRIASPEFMFPSFYGIDVSTTAELISSNKSPEEISDYIGADSLAYLTVEGLIDSIGLDCDAPYSGLCVESFTGDYPAGLYDYEQDYVAHLSERQKAYLANHQQYFDREGNLNV

SEQ ID NO: 30497 - DNA, 1389 bp, Ehrlichia canis str. Jake
  CDS (1)..(1389): transl_table=11
atgcagtttaaagaagtatatgaagaatgtggtatattcgccatacaaaacaacagacgtgctgcagtgaactgtatcttaggactacatgcacttcaacacagaggtcaagaatcatttggcatagtaacgtcagaagataacaagctttattgtcactattccaatgaacaagttaatagcatgtttaatcagcaacccaaaataaatttactactagggaaatctgcgattggacatgtacgttattctacaagtggtagtaaaattggtgtgcaaccaataactttagattgtaaattcgggaaattggcaatagcacataatggtaatcttaccaacgcaacacaaataagaaactcattaactgaaaaaggatgcatattttcatccgacatagatacagaagtaatcgcacatttaatcgctattaatacacaggctactctgttaaataacatcacaaatgcactaaaaactatcaatggtgcatactcactagtaattcttgtaaatggtaccataatatgctgccgtgacccagctggtattagacctctagtattaggcatattagataattcatacattgtagcttcagaaacttgttctctagacatagttggagcacaatttgtaagagagatatcaccaggagaactgattataattgatcaaaataatactctaacaagttcttttccatttaaaaaacaaaaatcaagtttttgcattttcgaatatgtatattttgcacgaccagacagtataataaacaataaatctgtatatgaaatacgtaaaaacataggaaaagaactcgcaatagaaaatcctgtaccaaaagatacacatatggtagtaccagtaccagactctggagtaccagctgcattaggattctcagaatatacaaaaataccttttgaatttggaattattagaaatcattacgtaggaagaacttttatccagcctagcaactacgttcgtaatatgggagtaaaacttaaacataacgctaatgcttctattttgaaagacaaaataataatcctaatagatgacagtcttgttagaggtacaacattaaaaaacatcataacattactacacaaagcgcaagttaaagaaatacatctcaggatttctagcccaccaactataaactcttgcttttacggaatagatacaccagaagagtcaaagttaatagcaaataagttatcaactacagaaatcaaaaatgaacttggctgtgatagtatatattttctaagtataaatggcctttacaaagcaatcaataacacaactaggaataatagttctcctcaatactgtgatgcttgtttcactggagattatcctataggaaaaattgagtaa

SEQ ID NO: 30498 - protein, 462 aa, Ehrlichia canis str. Jake
MQFKEVYEECGIFAIQNNRRAAVNCILGLHALQHRGQESFGIVTSEDNKLYCHYSNEQVNSMFNQQPKINLLLGKSAIGHVRYSTSGSKIGVQPITLDCKFGKLAIAHNGNLTNATQIRNSLTEKGCIFSSDIDTEVIAHLIAINTQATLLNNITNALKTINGAYSLVILVNGTIICCRDPAGIRPLVLGILDNSYIVASETCSLDIVGAQFVREISPGELIIIDQNNTLTSSFPFKKQKSSFCIFEYVYFARPDSIINNKSVYEIRKNIGKELAIENPVPKDTHMVVPVPDSGVPAALGFSEYTKIPFEFGIIRNHYVGRTFIQPSNYVRNMGVKLKHNANASILKDKIIILIDDSLVRGTTLKNIITLLHKAQVKEIHLRISSPPTINSCFYGIDTPEESKLIANKLSTTEIKNELGCDSIYFLSINGLYKAINNTTRNNSSPQYCDACFTGDYPIGKIE

SEQ ID NO: 30499 - DNA, 1434 bp, Methanosarcina barkeri str. fusaro
  CDS (1)..(1434): transl_table=11
ttgaaagaagaatgtggcgttgcaggcataattctaccaggcgataggccgcaatccaatactgtcgcattcaagctgtattacgccttgtatgccctccagcatagaggacaggaatccactggcataatggtatatgatggtacatcctctcattccattaaaggcatgggtctcgtccctgatgtgtataacaaagattctcttgggcacctggttggaaatgtaggagtagggcatgtccgctactcaaccaccggaggatcaaaaatcgaaaattgccagccctttgttctgaaattcaaaggaggagcagttgcaattgcccataacgggaacctggttaatgccagaacgctcaaggatgaactggagtgtgaaggccgtatctttatcagtgagtccgatacagaagttattggccaccttcttgtaaaagaactgataagacacgaccctatagaatcaatccggaatgtcatgcgtaagcttgtcggttcctattccctggttatccatatcggcggtgttctgtatgctgtgcgtgaccctctcggtcttaagccgctctgctttggggaagtcgatggtggatatgcagtattctcggaaagcgtagcccttgatacccttaacggcacccttatcagggatgtacggccaggtgaggtaatagtttttacaggcgacagctttgagagctaccagataggaaacgagcctcatcccgcacattgtgtgtttgagttcatttattttgcaagacccgattctattattgacggaaaactggtctacaaagttcgggaaaatatcgggagagagcttgccagagaacatccggtagaggctgatgttgtttcacctgtcccggactctgggattacttccgcaatcggctacgccagggagtcaggcaccaaataccttgaaggcttgatgaagaaccgttatatagggcgtacatttatcctgcctggccaagagctgcgtgaaaccgcagttcggcttaaaatgaatgctatccaggataatgttaaagacaaacgtgttgttctggttgacgacagtattgtccgtggtacaacctccaggcggattatagatatggtccgcagggcaggtgcttcagaaatccatgcaaggataggaagtccagcaattattgctccctgttatctgggtatagatatggccaccaggcaagaacttatcgcctcttataagaccgtaaaagaggttgaaggccttattaatgcggattcactcggatatctaagtattgacggacttatgagggctcttgggcgcgataagtgcgacatgtgccttggctgccttacaggtgagtatcctgtcgaaattcctggagaaaactgcataaggaagcagacacgtctggatgattttaacaataaccaggaaagttcctga

SEQ ID NO: 30500 - protein, 477 aa, Methanosarcina barkeri str. fusaro
MKEECGVAGIILPGDRPQSNTVAFKLYYALYALQHRGQESTGIMVYDGTSSHSIKGMGLVPDVYNKDSLGHLVGNVGVGHVRYSTTGGSKIENCQPFVLKFKGGAVAIAHNGNLVNARTLKDELECEGRIFISESDTEVIGHLLVKELIRHDPIESIRNVMRKLVGSYSLVIHIGGVLYAVRDPLGLKPLCFGEVDGGYAVFSESVALDTLNGTLIRDVRPGEVIVFTGDSFESYQIGNEPHPAHCVFEFIYFARPDSIIDGKLVYKVRENIGRELAREHPVEADVVSPVPDSGITSAIGYARESGTKYLEGLMKNRYIGRTFILPGQELRETAVRLKMNAIQDNVKDKRVVLVDDSIVRGTTSRRIIDMVRRAGASEIHARIGSPAIIAPCYLGIDMATRQELIASYKTVKEVEGLINADSLGYLSIDGLMRALGRDKCDMCLGCLTGEYPVEIPGENCIRKQTRLDDFNNNQESS

SEQ ID NO: 30501 - DNA, 1419 bp, Dehalococcoides sp. CBDB1
  CDS (1)..(1419): transl_table=11
ttgcatgaatcttgcggcgttttcggtgtatttgcccccggtcaggatgtagcccgactcacatttttcgctctgtttgccttgcagcacagagggcaggaaagttcaggcatatctacatctgatggacaggagcttaagcttcattcccagatgggtctggtttcccatattttcactgaagatatacttaaaaaactggacggccatattgccataggccacaaccgctattccaccaccggttcaagccagcagattaacgcccagccctttgtaatggggcagggagataatgttatagccatagcccataatggcaacatcgtaaattccgaagctttgaatacagaacttacctctcagggatacacctttaagacatccactgataccgaaataatcagccagcttatcctttcatctattgaaactgactgggtcaaacggatacgttatgccatgaaccgcctgaaaggggctttttcctgcacccttatgaccaaagacaccctatttgccatgcgtgactcactgggtgtccgtcccctgtgcttgggtaaaattcagggcggttatgtagtcacttctgaaagctgtgctcttgaccatatcggagctgatttcgtgcgtgaaatagagccgggcgagattgtagctataaacggaaacggcataaccagttttaaacagcaaagctccagacgggctttgtgtatatttgagttcatttattttgcccgccccgatagcctgatagacgggcgtcttttgtattccgcccgccaagccatgggggtagaactggccaaagaatacccggtagatgcagacctggttataggcgtacctgactctgccacggctgccggtatcggctatgccgtaggttcaggcattcctccagccgaaggccttattaaaaaccgctacatggggcgaacctttattcagcctgaccagcgtctgcgtgatttgggcgtgaaactaaagttcaatccccttaagagcgttctggaagataagcgggtagtactggtagatgacagcatagtccggggaactaccaccccacaggttatccgcctgttacgtaaagccggcgccaaagaagtccatatgcgggtatgcgcaccccccataaccaacccatgtttcttcggggtagatatggccacccgttcagaacttattgccgccagaatgagcatacctgagatacaaaaatacataggtgcagattcacttggctatcttagcctgcccgggttgataaatgccgtggggctgcctgagaagaatttctgtctggcctgtttcaccggcgaatatgccctgccagttcaactggaaatggataaatttgcacttggcaatcaacgacacaactgttgccagatgccttcacccgaaagctag

SEQ ID NO: 30502 - protein, 472 aa, Dehalococcoides sp. CBDB1
MHESCGVFGVFAPGQDVARLTFFALFALQHRGQESSGISTSDGQELKLHSQMGLVSHIFTEDILKKLDGHIAIGHNRYSTTGSSQQINAQPFVMGQGDNVIAIAHNGNIVNSEALNTELTSQGYTFKTSTDTEIISQLILSSIETDWVKRIRYAMNRLKGAFSCTLMTKDTLFAMRDSLGVRPLCLGKIQGGYVVTSESCALDHIGADFVREIEPGEIVAINGNGITSFKQQSSRRALCIFEFIYFARPDSLIDGRLLYSARQAMGVELAKEYPVDADLVIGVPDSATAAGIGYAVGSGIPPAEGLIKNRYMGRTFIQPDQRLRDLGVKLKFNPLKSVLEDKRVVLVDDSIVRGTTTPQVIRLLRKAGAKEVHMRVCAPPITNPCFFGVDMATRSELIAARMSIPEIQKYIGADSLGYLSLPGLINAVGLPEKNFCLACFTGEYALPVQLEMDKFALGNQRHNCCQMPSPES

SEQ ID NO: 30503 - DNA, 1521 bp, Thiobacillus denitrificans ATCC 25259
  CDS (1)..(1521): transl_table=11
atgtgcggggtaatcggagtcgtcgccaacacggcggtcaatcagcttttgtacgacgggctgatggtgttgcagcatcgcggacaggatgctgcgggcatcgtgaccgccgaggaaaaccgttttcacatgcacaaggcgcccgggctcgcgcgcgacgtcttccgcacacgcgacatgcgcaacctgctcggcgacatgggcgtcgcacacgtgcgctatcccaccgcgggcagtgcgtcgtcgtcggccgaatcgcagccgttctacgtgaactcgccctacggcatcgtgctcgggcacaacggcaacctgacgaacacgcatgaactgaaggaatcgttgttccgcagcgatctgcgccacgtcaacaccaactccgactccgaggtcctgctcaatgtactggcgcacgagctccacgtccgcgcgtccgggcagcagctgagcctcgatacgatcttcggcgcggtcgccggcgtccacgcgcgctgcaagggcgcctacgccgtgaccgcgttcatcgccggctacggcctgctggccttccgcgatccgcacggcatccgcccgctggtgatcggcatcaacgaccaggtcacgccgcacgagtacatcgtcgcgtccgagagcgtcgcgatcgatacgctcggcttccgcctgctgcgcgacgtcgcgcccggcgaggccgtgttcatcgactacgagcgtcggctgcacagccgccagtgcagcgacaaccccgtgctcaacccctgcattttcgaatacgtctatctggcccgcccggattcggtcatggacggaatctcggtctacagcacgcgcctcgcgatgggcgtgtcgctcgcggaaaaaatccgccgcgaattcggccacctgcagatcgacgtcgtgatcccgatccccgacaccagccgcccgtcggcgcttcaattggcgaaccatctcgcggtgccgtaccgtgagggcttcatcaagaaccgctacatcggccgcactttcatcatgccggggcaggcgctgcgcaagaagtcggtgcggcagaagctcaacgcgatcgccgaggagttcaagggcaagaacgtcctgctcgtcgacgattcgatcgtccgcggcacgacgagccgggagattgtccagatggcgcgcgacgcgggtgcggagaaggtctatttcgcgtccgcctcgccgcctgtgcgcttctgtaacgtctacggcatcgacatgccgtcgcgccgcgaactcattgccaacggccgcaatgacgaggaaatcgcgcgtgagatcggctgcgacgcgctgatctatcaggatctcgacgcgatggtcgaggtggtgcgcgccgccaacccggcgatccgcgagttcgacacctcgtgcttcaacggctgctacatcaccggcgacatcacgcccgagtacctcgactacgtcgaggccgcgcgcgacggcgaaagcccgccgccgtcggcgctgtcgacccagcagctcgacctcaacctcgcgacgggcagttga

SEQ ID NO: 30504 - protein, 506 aa, Thiobacillus denitrificans ATCC 25259
MCGVIGVVANTAVNQLLYDGLMVLQHRGQDAAGIVTAEENRFHMHKAPGLARDVFRTRDMRNLLGDMGVAHVRYPTAGSASSSAESQPFYVNSPYGIVLGHNGNLTNTHELKESLFRSDLRHVNTNSDSEVLLNVLAHELHVRASGQQLSLDTIFGAVAGVHARCKGAYAVTAFIAGYGLLAFRDPHGIRPLVIGINDQVTPHEYIVASESVAIDTLGFRLLRDVAPGEAVFIDYERRLHSRQCSDNPVLNPCIFEYVYLARPDSVMDGISVYSTRLAMGVSLAEKIRREFGHLQIDVVIPIPDTSRPSALQLANHLAVPYREGFIKNRYIGRTFIMPGQALRKKSVRQKLNAIAEEFKGKNVLLVDDSIVRGTTSREIVQMARDAGAEKVYFASASPPVRFCNVYGIDMPSRRELIANGRNDEEIAREIGCDALIYQDLDAMVEVVRAANPAIREFDTSCFNGCYITGDITPEYLDYVEAARDGESPPPSALSTQQLDLNLATGS

SEQ ID NO: 30505 - DNA, 1518 bp, Haemophilus influenzae R2866
  CDS (1)..(1518)
atgtgtggtattgtcggtattgttagccaaagtccggttaatgaatctatttatgcagcattaacccttttgcaacatcgtggacaagatgcggcaggtattgtaacggttgatgatgaaaaccgttttcgcttacgtaaagctaatggtttagtcagtgatgtgttccgtcaagaacatatgctacgattgcaaggaaatgctggattggggcatgttcgctatcctacagcggggagttctagcgtctcagaggcacagcctttttatgtgaattctccctatggtgtcactttagtgcataacggcaacttaaccaactcagtggagttaaaagaaaaggtctttaaaactgctcgccgccatgtaaacactaattcagattccgaacttcttcttaatattctcgccaatcacctcgatcacattcctcaagatcacctcgatccacaagatattttctatgctgttcgtaaaactcacaaggatgttcgcggtgcttatgcttgtttagcgatgattattgggcatggcatggttgcgtttcgtgatccttttggcattcgtcctttggtgttgggtaaacgcgaagaaaatggcaaaaccgattatatgtttgcctctgaaacagtggccttagatattgttggtttcgagtttgtgcgtgatattgctgcaggcgaagccgtttatgtgacgtttgatggcgagctttattcacaacaatgtgctgaaagtgcggtgttaaatccttgtatttttgagtatgtttattttgcacgcccagattcaacgattgatggcgtctctgtttatgctgcgcgtgttcacatgggcgaaaaactcggacaaaaaattgcaaaagaatgggctgatgaaattgataatattgatgtggtcattcccgttcctgaaacctccacagatattgcgttacaaatagctcgtgtactagggaagccttatcgccaaggatttgtgaaaaatcgctatgttggtcgtacctttattatgccaggtcaagcacagcgtattagttctgttcgtcgcaaattgaataccattaaagctgaatttaaagataaaaacgtgttattggtggacgattctatcgttcgtggcacaacctctgagcaaattgttgaaatggctcgctcagctggtgcgaagaaaatttactttgcctctgctgctcctgaaattcgttatccgaatgtatatggtattgatatgccgagttgtgatgaactgatcgcttatgggcgaaatgttgatgaaattgcacatttgatcggcgtagataaattaattttccaagatctgaccgcacttactgaatctgttcaattggaaaatccagccattcaaggttttgattgttcagtattcacaggcgaatatattacaggcgatattagtcctgaatatcttgataaaatcgcacttcaacgcaacgatagtgcaaagaaaaaacgtgaaaaacaagcatccaatcttgaaatttataatgaacaataa

SEQ ID NO: 30506 - protein, 505 aa, Haemophilus influenzae R2866
MCGIVGIVSQSPVNESIYAALTLLQHRGQDAAGIVTVDDENRFRLRKANGLVSDVFRQEHMLRLQGNAGLGHVRYPTAGSSSVSEAQPFYVNSPYGVTLVHNGNLTNSVELKEKVFKTARRHVNTNSDSELLLNILANHLDHIPQDHLDPQDIFYAVRKTHKDVRGAYACLAMIIGHGMVAFRDPFGIRPLVLGKREENGKTDYMFASETVALDIVGFEFVRDIAAGEAVYVTFDGELYSQQCAESAVLNPCIFEYVYFARPDSTIDGVSVYAARVHMGEKLGQKIAKEWADEIDNIDVVIPVPETSTDIALQIARVLGKPYRQGFVKNRYVGRTFIMPGQAQRISSVRRKLNTIKAEFKDKNVLLVDDSIVRGTTSEQIVEMARSAGAKKIYFASAAPEIRYPNVYGIDMPSCDELIAYGRNVDEIAHLIGVDKLIFQDLTALTESVQLENPAIQGFDCSVFTGEYITGDISPEYLDKIALQRNDSAKKKREKQASNLEIYNEQ

SEQ ID NO: 30507 - DNA, 1515 bp, Microbulbifer degradans 2-40
  CDS (1)..(1515)
atgtgcggaatagtgggtatagttggtaagagcgatgtgaacgtagcgctgtacgacgcgttaacgatgctacaacatcgtggccaggatgccgcaggaattatgacttgccataacggcaaattggctcaacaaaaggctgttggcttagtaaaagacgtgtttcgtacgcgtcatatgcagcgcctagtgggcaacatgggtattgggcatgtgcgctatccaacggcaggcagctctggcccagctttggcgcagccgttttacgttaactcaccatacggaattgccttggcgcataacggtaaccttactaataccgagaaagttagcgaagacttgtttaaagaagatctacgtcatgtaaacacagagtccgattctgaagttttacttaacgtttttgctcacgaattgcagcttcaaggtaaattgcgacctgcaccagaagatatctttaatgccgttgccagagtgcataagcgcattcgcggtggctatgcggttgtatctatgattgcaagctacggcgtcgtagctttccgcgacccccacggtattcgtccgctggtattcggtgagcgtattaccgataaaggcaccgagtatatgatcgcctcagagagtgtttcgctggatgtgctgggctttcgcttaatccgcgatgttgcaccgggcgaggccatttttgtaacggttgatggcgaactgcatacacgtcaatgcgccgaaaaccccagtttgcgcccgtgtatattcgaacacgtgtactttgctcgtccagattccattatggatggcgtatctgtatataagtctcgcttgcgtcagggtgagaaactagcagagaaaattttgcgtgaaacgcctaatcacgacatagatgtggttattcctatcccagatagcagccgtgttgctgggcaagcattagctcaaaatttaggcgttaagttccgtgaaggcttggttaaaaaccgctatattggtcgtacttttattatgccgggccagcagcagcgtaagaaatcagtgcgtcaaaagttgaacgtaattgatttggagttccgcggtaaaaatgtactgttagtagatgactccatagtacgtggcaccacttgccagcaaataatccaaatggcgcgtgatgcaggtgcggccaaagtgtattttgcttctgcggcaccagctgtgaagtaccctaatgtttatggtattgatatgccaaccgccgcagagcttattgctcacggtcgtacagaagaagaagtgtgcaaggagattggcgccgactggctaatttaccaagatttagaagacttaatcgccgcttctagcgagggtagcccagacgttacccagtttgaatgtgctgtatttaatggcaactacgtaactggggatgtaacccccgagtatcttaaaaagttggaagatcgccgcaacgactcatcaaaaatgcgggatcaaagccagtctaacaatgccatggtgggtattcacaacgacggttaa

SEQ ID NO: 30508 - protein, 504 aa, Microbulbifer degradans 2-40
MCGIVGIVGKSDVNVALYDALTMLQHRGQDAAGIMTCHNGKLAQQKAVGLVKDVFRTRHMQRLVGNMGIGHVRYPTAGSSGPALAQPFYVNSPYGIALAHNGNLTNTEKVSEDLFKEDLRHVNTESDSEVLLNVFAHELQLQGKLRPAPEDIFNAVARVHKRIRGGYAVVSMIASYGVVAFRDPHGIRPLVFGERITDKGTEYMIASESVSLDVLGFRLIRDVAPGEAIFVTVDGELHTRQCAENPSLRPCIFEHVYFARPDSIMDGVSVYKSRLRQGEKLAEKILRETPNHDIDVVIPIPDSSRVAGQALAQNLGVKFREGLVKNRYIGRTFIMPGQQQRKKSVRQKLNVIDLEFRGKNVLLVDDSIVRGTTCQQIIQMARDAGAAKVYFASAAPAVKYPNVYGIDMPTAAELIAHGRTEEEVCKEIGADWLIYQDLEDLIAASSEGSPDVTQFECAVFNGNYVTGDVTPEYLKKLEDRRNDSSKMRDQSQSNNAMVGIHNDG

SEQ ID NO: 30509 - DNA, 1341 bp, Campylobacter upsaliensis RM3195
  CDS (1)..(1341): transl_table=11
atgtgtgcagttgtgggagtgattaattcatcaaatgctagcacttatgcatactatgcactttttgctatgcaacacagaggacaagaggcaagcggaataagtgtgagtgatggagagaaaataagaaccattaaggctaagggggaagtgagtcaaatttttaatggggagaatttgaaaaatctaaacggaagcctagccataggacacaatcgctattctaccgctggaaattcaagccttaatgacgcccagcccatagccgccacttgtatcctaggcgacatagccctagcacataatggaaatttggttaataaagaagagattagaaatgagcttattaaagacggagccattttccgcactaatatggacacagaaaatgtcgtgcatttaatcgctaaaagcaaaaaagaaagcttgaaggaaagatttgtagaaagtttgcaaaaatgcgttggggcgtattgcttcgttttgactgatagaaataggctttatgtgatgcgagatcgctttggtgtgcgtccgctttccttagggcgtttaaaggatggaggctatatcgtggctagtgaaacttgtgcttttgatttgatagaggctgagtttatccgcgatgtaaaacccggcgaaatgctcatttttacgcaaggagaggaggaatttgaaagcttgcagcttttcaaagaagagcctagaatttgtgcttttgaatatatttattttgctcgtcctgatagcatagtcgaggggaaaagcgtgtatgaagtgcgtaagaaaatgggcgagaatttagcgaaaaaattcactcacaaagccgattttgtcgtgcctgtgccagatagtggagtgagtgccgctataggctttgcacaatttttaaaacttccacttgaaatggcaatcgttagaaatcactatgtaggacgcaccttcatcgaacccacccaagaattgcgtaatcttaaggttaaattaaaactcaaccctatgcgccctgttttagagggcaaagagatagttgttattgatgatagtatagtgcgtggaacgacctcaaagaaaatcatttctcttttacgcgcagctggagcgaaaacaattcaccttgccatagcttgccctgagattaaattcccagacctttacggcatagacacgccgacttttgaagaattaattagtgctaataaaagcagcgaagaggtgagggagtattgcggtgcagatactttgagctttttaagcatagaagagcttgttaaaagcatagggaccgaaagggcttactctctcattagctttgatggggattattttattaaggagtga

SEQ ID NO: 30510 - protein, 446 aa, Campylobacter upsaliensis RM3195
MCAVVGVINSSNASTYAYYALFAMQHRGQEASGISVSDGEKIRTIKAKGEVSQIFNGENLKNLNGSLAIGHNRYSTAGNSSLNDAQPIAATCILGDIALAHNGNLVNKEEIRNELIKDGAIFRTNMDTENVVHLIAKSKKESLKERFVESLQKCVGAYCFVLTDRNRLYVMRDRFGVRPLSLGRLKDGGYIVASETCAFDLIEAEFIRDVKPGEMLIFTQGEEEFESLQLFKEEPRICAFEYIYFARPDSIVEGKSVYEVRKKMGENLAKKFTHKADFVVPVPDSGVSAAIGFAQFLKLPLEMAIVRNHYVGRTFIEPTQELRNLKVKLKLNPMRPVLEGKEIVVIDDSIVRGTTSKKIISLLRAAGAKTIHLAIACPEIKFPDLYGIDTPTFEELISANKSSEEVREYCGADTLSFLSIEELVKSIGTERAYSLISFDGDYFIKE

SEQ ID NO: 30511 - DNA, 1521 bp, Lactococcus lactis subsp. cremoris SK11
  CDS (1)..(1521)
atgtctgatgaaatgacaagcgcaacatttactgaacaagagtggtcgcattttgagaaaaaaagtttgaatcaaactgaagccgatgagctccgcgactggtcgcggtttgaagcgaagacattaaatgaagaatgtggacttttcggcgtttggggacatcctgatgccgctcgtctaacctattttggtcttcacgctttgcaacatcgcgggcaagaaggcgcaggaattctggtcaataacaacggcaagctcaatcgtcatcgtggtttaggtttggtcaccgaagtttttcgtgacgaaaaagatttggaagaactgacaggttcatctgccattggtcatgtccgctatgcgacggctggctcggcaaatattaataatgttcagccattccagtttgaatttcatgacggatcacttggacttgcccacaatggaaatttaactaacgctcaatccttgcgctgtgaacttgaaaaatctggagcaatattttctagtaattcagacacagaaatcctcatgcacttgattcgccgtagtcatcatccagaatttatgggcagagtcaaagaagcacttaatacggtcaaaggtggctttgcctatcttattatgactgaaaattcaattgtcgcagctcttgaccctaatggatttcggccactttcaatcggtaaaatgagcaacggtgcgcttgtcgtggcctcagaaacttgtgctttcgatgttgttggcgccacttggattcaagatgttcaacccggtgaaatcattgaaattaatgacgacggcattcatgtggaccaattttctgacagcaccaacatgactatttgttcaatggaatacatctatttcgctcgtcctgacagcaatatcgctggagttaatgttcatactgccagaaaacgttcaggaaaaattttagcccaagaagccaaaattgacgctgatattgtcattggtgtccctaattcatcactcagtgccgcttcaggctacgctgaagaatcgggcttgccttacgaaatggggctgattaaaaatcaatatgtggcaagaactttcattcaaccgactcaagaacttcgtgaacaaggcgttcgcatgaaattgagtgctgttcgaggtgttgtagaaggaaaacgtgtcatcatggttgatgacagcattgtgcgtggaacgaccagccgtcgcattgtcaaactcctcaaagatgcaggcgcagccgaggttcatgtggcaatcgccagtcccgctctcaaatatccttgcttttacggcattgacatccaagatcgtgacgaactcatcgcagccacacacacgactgatgaaatcagagaagctatcggagcggatagtctgacctatctcagccagtcagggcttgtcgaggcgatcggtcacgataaactttgcttgtcatattttgacggcgaatatccaacaccgctttatgattatgaagcagactatttggaatctttggcaaaaaatggtctgaaataa

SEQ ID NO: 30512 - protein, 506 aa, Lactococcus lactis subsp. cremoris SK11
MSDEMTSATFTEQEWSHFEKKSLNQTEADELRDWSRFEAKTLNEECGLFGVWGHPDAARLTYFGLHALQHRGQEGAGILVNNNGKLNRHRGLGLVTEVFRDEKDLEELTGSSAIGHVRYATAGSANINNVQPFQFEFHDGSLGLAHNGNLTNAQSLRCELEKSGAIFSSNSDTEILMHLIRRSHHPEFMGRVKEALNTVKGGFAYLIMTENSIVAALDPNGFRPLSIGKMSNGALVVASETCAFDVVGATWIQDVQPGEIIEINDDGIHVDQFSDSTNMTICSMEYIYFARPDSNIAGVNVHTARKRSGKILAQEAKIDADIVIGVPNSSLSAASGYAEESGLPYEMGLIKNQYVARTFIQPTQELREQGVRMKLSAVRGVVEGKRVIMVDDSIVRGTTSRRIVKLLKDAGAAEVHVAIASPALKYPCFYGIDIQDRDELIAATHTTDEIREAIGADSLTYLSQSGLVEAIGHDKLCLSYFDGEYPTPLYDYEADYLESLAKNGLK

SEQ ID NO: 30513 - DNA, 1023 bp, Chromohalobacter salexigens DSM 3043
  CDS (1)..(1023): transl_table=11
atgtgcggtatcgtgggcctcatggccaatcaggcggtcaatcagtcgctgtatgacgcgctgacagtgctccaacaccgtggccaggatgccgccgggatgatgacatggcatgagggacgcttcctgttgcgcaagagcaacgggctggtgcgggatgtcttccacacgcgtcacatgacgcgcctgcgcggcaacatgggcatcgggcatatccgctatcccaccgcgggctcgtcgagcgaagcggagtcgcagccgttctacgtcaattcgccctacgggatctccctggcgcacaacggcaacctgaccaactccgaacagctcaagcgcgagctgttcttttccgacctgcgccacatcaacaccagctccgactcggaagtgctgctcaacgtcttcgcgcacgagctcggcaagcagggacatcacctgacacccgacgatatcttcgatgcggtgcgtcgggtgcaccgccgttgccaagggggctacgccgcggtggccttcatcaacggtttcggcatggtggcgtttcgcgacccccatggcatccgcccggtggtctacggcacgcgcgacaccgaggaaggccaggaggtgatgatcgcctccgaatcggtggcgctggacgtggggggcttcgagctgtgccgcgacctggcgccgggcgaggcgatcttcatcgaaaccgatggcaaccgcgtgcacacccagcagtgtgccgatcgcccccgcctgacaccctgcatcttcgagcacgtctacctggcgcgtcccgattcgatcctcgacggcgcctatgtctacggcacgcgcatggaaatggggcgcaagctgggcgatcgcatcctgcgcgactggccggaacatgacatcgacgtggtgatcccgatccccgacacctcgcgtacctcggcgctggaactggcgcagcacctgggcgtcacctatcgcgaaggcttcatgaagaaccgctacatcgggcggaccttcatcatgcccggccagacccagtag

SEQ ID NO: 30514 - protein, 340 aa, Chromohalobacter salexigens DSM 3043
MCGIVGLMANQAVNQSLYDALTVLQHRGQDAAGMMTWHEGRFLLRKSNGLVRDVFHTRHMTRLRGNMGIGHIRYPTAGSSSEAESQPFYVNSPYGISLAHNGNLTNSEQLKRELFFSDLRHINTSSDSEVLLNVFAHELGKQGHHLTPDDIFDAVRRVHRRCQGGYAAVAFINGFGMVAFRDPHGIRPVVYGTRDTEEGQEVMIASESVALDVGGFELCRDLAPGEAIFIETDGNRVHTQQCADRPRLTPCIFEHVYLARPDSILDGAYVYGTRMEMGRKLGDRILRDWPEHDIDVVIPIPDTSRTSALELAQHLGVTYREGFMKNRYIGRTFIMPGQTQ

SEQ ID NO: 30515 - DNA, 1515 bp, Shewanella amazonensis SB2B
  CDS (1)..(1515): transl_table=11
atgtgtggtatcgtcggaatagttggccattcctcggttaatcagaccatctatgacgcactgacagtgcttcaacaccgtggtcaggatgcagccgggatagtcacggtagacaatgacgcgttcaggctccgtaaggcgaacggactggtgcgtgatgtgtttgaacccaaacacatgcagcgcctgcagggtaacgccggtatcggccatgtgcgttatcccaccgccgggagctccagctcctcagaagcccagcctttttacgttaactcgccttttggtatttctctggcgcacaacggcaacctgaccaacactcaagacctgtcggctcgtcttaagcagcagcgtcgacacgtgaataccacgtcggattctgaagtgctgctgaacctgctcgccgatgagctgcagcaggtacagagcgcccatctgagcgccgatcaggtgtttgatgccgtggcaaaagtgcacgcccaaacccgtggtgcttacgcggtagtggccatgattgttggcgaaggtcttgtggccttccgtgaccccaatggcattcgcccgctggtgcttggcaaaaatgaaaccgccaccggcacagagtacatggtggcctcagagagtgtggccctggatgccgtgggttttgaagtcattcgtgatgttgcgccgggcgaagccgtatacgtcaccctcgacggtcagctgtttacccgtcagtgcgccgaagcgccgctctattcgccctgtattttcgaatttgtttactttgcccgtccagactccaccatcgacaaggtgtctgtgtacgccagccgggtaaatatgggcgccaaactgggcgagaaaatcaagaaagaatggtacgacaacgacatcgatgtggttatccccattcctgaaacctcctgtgatatcgcactggaaattgcccgtgttatggacttgccttaccgtcagggctttgtaaagaaccgctacattggccgtaccttcatcatgcctggtcagcaggagcgtaagaagtcagtgcgccgtaaactcaatgccatcaacaccgagtttaagggcaagaatgtgcttttggtggacgactccatcgtgcgtggtaccacgtcagagcaaatcatcgagatggcccgcgaagccggtgccaagaaggtgtatttcgcctctgctgcccctgaaattcgtttccccaacgtgtacggcatcgatatgcccacttccaatgagctgattgcccacggacgtgatgcggatgaaattgccaaactgattggtgccgatggtatcatcttccaggatttgactgatctggttgaagctgtgcgtatggaaaaccccgaaatcaagcgttttgaaacatcggtgtttgacggtgattacatcactggtgatgtgactcaggcgtatcttgaccacctcactcagctgagaaacgatgatgccaaggcaaatcgcaacagcgatgtgggcacgaatctcgagctgcacaacgtctgtcacccgtaa

SEQ ID NO: 30516 - protein, 504 aa, Shewanella amazonensis SB2B
MCGIVGIVGHSSVNQTIYDALTVLQHRGQDAAGIVTVDNDAFRLRKANGLVRDVFEPKHMQRLQGNAGIGHVRYPTAGSSSSSEAQPFYVNSPFGISLAHNGNLTNTQDLSARLKQQRRHVNTTSDSEVLLNLLADELQQVQSAHLSADQVFDAVAKVHAQTRGAYAVVAMIVGEGLVAFRDPNGIRPLVLGKNETATGTEYMVASESVALDAVGFEVIRDVAPGEAVYVTLDGQLFTRQCAEAPLYSPCIFEFVYFARPDSTIDKVSVYASRVNMGAKLGEKIKKEWYDNDIDVVIPIPETSCDIALEIARVMDLPYRQGFVKNRYIGRTFIMPGQQERKKSVRRKLNAINTEFKGKNVLLVDDSIVRGTTSEQIIEMAREAGAKKVYFASAAPEIRFPNVYGIDMPTSNELIAHGRDADEIAKLIGADGIIFQDLTDLVEAVRMENPEIKRFETSVFDGDYITGDVTQAYLDHLTQLRNDDAKANRNSDVGTNLELHNVCHP

SEQ ID NO: 30517 - DNA, 1497 bp, Prosthecochloris aestuarii DSM 271
  CDS (1)..(1497): transl_table=11
atgtgcggagtgttcggtgtctacaattctaaaactcccgctgaagataccttttacgggttatattcattgcaacacagaggtcaggaagccgcaggaattgttgtagcagattacggtgaagacaaaaagaaaacaatctaccggcagcataaagcaatgggtctggttgcggaagtcttcaaggatgaaaagctcttcgacaaacttcacggtcatgcagctataggccataatcgttactcgacgacaggggcctcaaaatcgaccaacaacatccagcctttctcgctcatctaccgctcaggaaatctcgctatagctcacaatggaaatctgaccaatgcccgggcacttcgaaaagagctgacagaaaaaggggtcatcttccaggcctcgtcagacacggaagtcattccgcatctggcagccttaagccccgaaaatgaacccatccatcagatctaccacgcgctaagacaggtacagggcgccttctccatcgtcattctcgcaaacgaccaactcattgccgcacgcgacccatacggcgtcaggccacttgcccttggaaagaaagtcgatcccgataccggagaagcatcattttacatcgccagtgaaacctgcgcgttcgacattctatcagttgaatatctcagagatgtcgaacctggcgaaattctgctcatcgacagagtatcgacccgaacacataaaccaaaatcgctctatctgccgccgtcaaaacgcaaagctcgctgtattttcgaatatgtctactttgctcgtccagacagtacgatctttcagaactccgtcgataaaatccgtcgaaacctcggcaaaaaccttgcccgggaatcaaccgtccagcaatccaacgaagacaaacatctgattgtcgccagcgttccggactcgtcaaataccgctgctctcggttttgtgcgtgaaagcaataaaatcaaccgtccagcccgtttcgaacacggtctcatccgcaaccactatgtaggaagaaccttcattcagcctggaaaggcaagcagagagattaaagttcgctccaaatacaacatcatccggggggttctgcagaatcgtcagattatcctgatcgacgactcgatcgttcgcggaacaacagcacgaatgcttataaaactcattcgggaagcaaaccccaaagaaatccacctccacatcagctcgccaccgatcaccaacccctgcttctacggcatggacttccctaccaagggccagctcctgaccaatctgttcatcggcgccgcaagcgaacaggaggaagttgaaagcatcagacaatatatcggtgtagactcgctcaaatacctctctctgcagggtctgctcaacagcgtcccgcaattcgatcatgaaacctgcagttactgcacggcctgtttcacaggagactaccccatcaagatcgaagacgcaacgaccgataaagaagaaaacgacgtataa

SEQ ID NO: 30518 - protein, 498 aa, Prosthecochloris aestuarii DSM 271
MCGVFGVYNSKTPAEDTFYGLYSLQHRGQEAAGIVVADYGEDKKKTIYRQHKAMGLVAEVFKDEKLFDKLHGHAAIGHNRYSTTGASKSTNNIQPFSLIYRSGNLAIAHNGNLTNARALRKELTEKGVIFQASSDTEVIPHLAALSPENEPIHQIYHALRQVQGAFSIVILANDQLIAARDPYGVRPLALGKKVDPDTGEASFYIASETCAFDILSVEYLRDVEPGEILLIDRVSTRTHKPKSLYLPPSKRKARCIFEYVYFARPDSTIFQNSVDKIRRNLGKNLARESTVQQSNEDKHLIVASVPDSSNTAALGFVRESNKINRPARFEHGLIRNHYVGRTFIQPGKASREIKVRSKYNIIRGVLQNRQIILIDDSIVRGTTARMLIKLIREANPKEIHLHISSPPITNPCFYGMDFPTKGQLLTNLFIGAASEQEEVESIRQYIGVDSLKYLSLQGLLNSVPQFDHETCSYCTACFTGDYPIKIEDATTDKEENDV

SEQ ID NO: 30519 - DNA, 1515 bp, Shewanella frigidimarina NCIMB 400
  CDS (1)..(1515): transl_table=11
atgtgtggtatcgtcggaatagtaggaaaatcaacagttaatcagaccatttatgatgcgctgactgtgctccaacatcgtggtcaagacgcagcaggtattgtgacggttgacatgaatgcgtttcgtttacgcaaagcaaacggcttagtcaaagatgtgtttgaacctaaacatatgcagcgtttacaaggcaatgccggtattggacatgttcgttatcctaccgctggcagctcgagtgcatcagaggcacaaccgttttatgttaactcgccatttggtatttcgttagcgcataacggtaacttgactaatacgattgaactggctgctagcctagtcacaaagcgtcgtcatgttaacactacctcagattctgaaatcttgttaaatctgttagccgatgaattacaagaaacgcgcagtttaactttaagtgccgacgaagtgtttgacgcagttgctaaagtacatgcgcaaacgcgtggtgcttatgcggtagttgcgatgattattggccaaggtttagtggcatttcgtgacccatttggtattcgtcctttggtattgggtaaacacgaaaccgcaacgggtaccgagtatatggttgcttcagaaagtgttgctttagacgctgttggttttgaagtgatgcgtgacgtagcacctggtgaagctgtttatatttctcttgatggccagttatttacccgtcaatgtgcagcagacccaagctatgccccatgtattttcgaattcgtgtattttgcacgtcccgattcgagcattgataaagtgtctgtttatgcaagccgtgtaaacatgggcgctaaattaggcgaaaaaattaagaaagaatgggaagatcacgacattgatgttgttattcctattcctgagacttcgtgcgatatcgcattagaaattgcacgttgcatggatttaccgtaccgccaaggttttgtgaaaaatcgttatattggtcgtacgtttattatgcctgggcagttagagcgtaaaaaatcagtacgtcgtaaactgaatgcgattaataccgaatttaaaggtaaaaacgtattattggttgatgactcgattgtacgtggtactacgtctgaacagatcattgaaatggcgcgtgaagctggagcaaagaaagtatactttgcatcagcagcaccggaaatccgtttcccgaatgtgtatggtattgatatgccaacgtctaatgagcttattgctcatggccgtgatgcagacgaaattgccaaaatcattggtgccgatggcattattttccaagacttaagcgacttaattgaagcggtaagaatggaaaatccagagattaagcgtttcgaaacatcagtgttcgacggtcattatattaccaacgacgttgaccaagcttacttggatcatttaacgcagttacgtaacgatgatgccaaagccaatcgctcaaaagacattggcactaacttagaaatgcacaacgagtgtcatccataa

SEQ ID NO: 30520 - protein, 504 aa, Shewanella frigidimarina NCIMB 400
MCGIVGIVGKSTVNQTIYDALTVLQHRGQDAAGIVTVDMNAFRLRKANGLVKDVFEPKHMQRLQGNAGIGHVRYPTAGSSSASEAQPFYVNSPFGISLAHNGNLTNTIELAASLVTKRRHVNTTSDSEILLNLLADELQETRSLTLSADEVFDAVAKVHAQTRGAYAVVAMIIGQGLVAFRDPFGIRPLVLGKHETATGTEYMVASESVALDAVGFEVMRDVAPGEAVYISLDGQLFTRQCAADPSYAPCIFEFVYFARPDSSIDKVSVYASRVNMGAKLGEKIKKEWEDHDIDVVIPIPETSCDIALEIARCMDLPYRQGFVKNRYIGRTFIMPGQLERKKSVRRKLNAINTEFKGKNVLLVDDSIVRGTTSEQIIEMAREAGAKKVYFASAAPEIRFPNVYGIDMPTSNELIAHGRDADEIAKIIGADGIIFQDLSDLIEAVRMENPEIKRFETSVFDGHYITNDVDQAYLDHLTQLRNDDAKANRSKDIGTNLEMHNECHP

SEQ ID NO: 30521 - DNA, 1704 bp, Vigna unguiculata
  CDS (1)..(1704)
atggccgcgtctaatctctccaccctctgctcctcttcacactccaaaccctctttccctttcttcaacacacaaagcttcagcgtcaacactaacactctttttctcaacaccaccaccaactcctttcaaacccttctctctcattccacccgctacactctgcctctcccatgcaccaaaaccacaaacactttcgcctccttcaatgatgacgaaaagcctcgcgaagagtgcggcgttgtgggcatctacggcgacccagaagcctcccgtctctgctccctcgccctccacgccctccagcaccgcggccaggaaggcgccggcatcgtcgccgtcgacaacaacgtcctccacacagtcaacggcgttggcctcgtttctgacgtcttcgacgagactaagctctctcagctacccggctcctgcgccattggccacgtccgctactccaccgcgggacactccaggctctgcaacgtccaacccttcgtcgccggctaccgcttcggctccgtcgccgtctcgcacaatggaaacttcgtgaactaccggtccctgcgcgccaaactggaagacaacgggtccatcttcaacacgacctccgacaccgacgtggtgctccacctgatcgccacctccaagcacagacctttcctactgagaatcgtggatgcctgcgagaatctgaagggcgcgtactccctggtgttcctcacggaggacaagctggtggccgtgaaggaccccttcgggttccgaccgttggtgatgggaaggagaagcaacggcgctgtggttttcgcctcggagacatgcgcgctggatttgatcgaagcgacgtacgagcgagaggtgaacccgggtgaggttgtggtggtggaccacaccggaatccaatccctctgcctcgtgactcatccggagccaaagcaatgcatcttcgagcacatatacttcgcgcttcccaactctgttgtcttcgggaggtccgtgtacgagtccaggagaaaattcggggaaatactggccaccgagagccccgtcgagtgcgacgtagtgatcgcggttcctgattccggggtggtggctgcgcttggctacgctgcaaaagctggggttccctttcagcaggggttgataaggtcgcactatgtggggaggaccttcatcgagccctcgcagaaaataagagattttggggtgaagctgaagctgtttccggtgcgtggcgtgcttgaagggaagagggttgtggtggtggatgaatccattgtgaggggcaccacattgtccaagattgtgaggctgataaaggaagcgggtgccaaagaggtccacatgaggattgcgtgtccacccattgttgggtcctgttactacggcgtcgacacccccagtaaggaggagttgatttccaacaggatgagtgtggaggagataagagagtttattgggtctgattccctcgcttttcttcccttggacacgttgaagaggttgttggaggatgatgctcctaactactgctatgcttgcttctccggaaaataccctgttcagccggaggaacttaaaaccagcaacctcaatgagtttgattgggacgatgctttgaatgggagtttgaaatctattgagaacgagggttgggttagaaaccaggagggagtgtctgagaataagattgttagtgtctga

SEQ ID NO: 30522 - protein, 567 aa, Vigna unguiculata
MAASNLSTLCSSSHSKPSFPFFNTQSFSVNTNTLFLNTTTNSFQTLLSHSTRYTLPLPCTKTTNTFASFNDDEKPREECGVVGIYGDPEASRLCSLALHALQHRGQEGAGIVAVDNNVLHTVNGVGLVSDVFDETKLSQLPGSCAIGHVRYSTAGHSRLCNVQPFVAGYRFGSVAVSHNGNFVNYRSLRAKLEDNGSIFNTTSDTDVVLHLIATSKHRPFLLRIVDACENLKGAYSLVFLTEDKLVAVKDPFGFRPLVMGRRSNGAVVFASETCALDLIEATYEREVNPGEVVVVDHTGIQSLCLVTHPEPKQCIFEHIYFALPNSVVFGRSVYESRRKFGEILATESPVECDVVIAVPDSGVVAALGYAAKAGVPFQQGLIRSHYVGRTFIEPSQKIRDFGVKLKLFPVRGVLEGKRVVVVDESIVRGTTLSKIVRLIKEAGAKEVHMRIACPPIVGSCYYGVDTPSKEELISNRMSVEEIREFIGSDSLAFLPLDTLKRLLEDDAPNYCYACFSGKYPVQPEELKTSNLNEFDWDDALNGSLKSIENEGWVRNQEGVSENKIVSV

SEQ ID NO: 30523 - DNA, 1473 bp, Corynebacterium ammoniagenes
  CDS (1)..(1473): transl_table=11
gtgaatttagatgaccaaggcgagcaagaaccccgcgaagagtgcggtgtctttggcgtctgggctcctggtgaagatgttgcgacactgacctactttggtctgttcgcattgcagcatcgtgggcaggaagctgcaggtatcggcgtcggtgatggagaccgcctcgttgtcttcaaaaacatgggcttggtctcgaatattttcgatgagtccattttaaattccctccatggctccgtgggcgtggggcatacgcgctactcgactgccggtggcaaagagtggtcgaatgtccagccgatgtttaataccacctcaaatggggtagacatcgctttgtgccacaacggcaacttggtgaactaccaagaactgcgcgatgaagcagtagctctgggactttaccgagagaatgaaaaatccctgtcggattccatgatcatgacagctttgctggcgcacggagtcggggaaggcaactctgtctttgacgccgctaagcaactgctgccaagcatcaaaggcgctttttgcttgacctttaccgatggcaagaccttgtacgccgcgcgtgacccgcacggtgtacgccccttggtcattggccgcttggcgcaaggctgggttgttgcttccgaaacctgtgcgctggatatcgtgagcgcacagtttatccgtgaggtagagcccggtgaacttatctctgtcaatgaggcaggaatccacagcgaaaaattcgctgagccgaagcgccagggctgcgtctttgaatacgtctacttggcacgtccagacaccgtgatcaaaggccgcaacgttcacgcgacgcgcgtggatattggtcgcgcacttgcgaaatctcaccctgcgccagaagctgacatggtcatccccgtgccagaatccggaaacccggcagctgttggctacgcccgggaatcgggcctgacatttgcgcacggcttggtcaaaaacgcctacgtgggtcgaaccttcattcagcccacccagaccttgcgccagctgggtattcgcctcaagctcaaccccctgcgcgaggtcatcgagggcaagtcactcgttgttgtagatgactctattgtccgcggcaacacccaacgcgcgctggtgcgcatgctgcgtgaagcaggcgctgctgaagtgcacgtgcgcattgcttcaccgccagtcaaatggccttgtttctacggcattgacttcgcctcgcctggtgaattgattgctaatatcaagccttctgatgatcctcaggtagtaaccgatgcagtgtgcgaagctatcggagcagactctttagggtttgtatctgtagatgagatggttgaggcaacgcaccaacctatcaattccttgtgtaccgcttgctttgatggcaactacgaactcggacttccgaccgctaaccccaatgctgacgctgtgcgaactttgctcagccaaaagaactga

SEQ ID NO: 30524 - protein, 490 aa, Corynebacterium ammoniagenes
MNLDDQGEQEPREECGVFGVWAPGEDVATLTYFGLFALQHRGQEAAGIGVGDGDRLVVFKNMGLVSNIFDESILNSLHGSVGVGHTRYSTAGGKEWSNVQPMFNTTSNGVDIALCHNGNLVNYQELRDEAVALGLYRENEKSLSDSMIMTALLAHGVGEGNSVFDAAKQLLPSIKGAFCLTFTDGKTLYAARDPHGVRPLVIGRLAQGWVVASETCALDIVSAQFIREVEPGELISVNEAGIHSEKFAEPKRQGCVFEYVYLARPDTVIKGRNVHATRVDIGRALAKSHPAPEADMVIPVPESGNPAAVGYARESGLTFAHGLVKNAYVGRTFIQPTQTLRQLGIRLKLNPLREVIEGKSLVVVDDSIVRGNTQRALVRMLREAGAAEVHVRIASPPVKWPCFYGIDFASPGELIANIKPSDDPQVVTDAVCEAIGADSLGFVSVDEMVEATHQPINSLCTACFDGNYELGLPTANPNADAVRTLLSQKN

SEQ ID NO: 30525 - DNA, 1536 bp, Arabidopsis thaliana
  CDS (1)..(1536)
atggagtctcctcctacttctcctctccttcaccatccgaagaacaattctcatgccccttttgattaccacaacgacgaagacgacgaaaagcctcgagaagagtgcggtgtcgtcggaatctatggagatccagaagcttcacgactcttttacttagctctccacgcacttcagcatcgtggtcaagaaggtgcaggtattgtaacagtaagtcccgagaaagttcttcaaaccattacaggtgttggtttagtctctgaggttttcaacgaatcaaaacttgatcaattacctggtgaatttgctattgcccatgttcgttactcaacagctggagcttctatgctcaaaaatgttcagcctttcgtcgccggttatcgattcggttccatcggtgttgcccacaatggtaatttagtaaattacaaaactttgagagctatgcttgaagagaacggttctatcttcaatactagctctgatactgaggttgtgcttcatttgattgctatttctaaagctagacctttttttatgaggattattgatgcttgtgagaaacttcaaggtgcttattcaatggtgtttgttactgaggataagcttgttgctgttcgtgatccttatgggtttagacccttagttatgggtaggagaagtaatggagctgttgttttcgcttcggagacttgtgctcttgatttgattgaagctacttatgagagagaggtttatcctggtgaggttttggttgtggataaggatggtgtcaagtctcagtgtttgatgcccaagtttgagcctaagcaatgtattttcgaacatatctacttctcgttgcctaactcgattgtgtttggtcggtccgtgtatgaatctaggcatgtgtttggtgagattttggcaactgagtcgcctgttgagtgcgatgttgtcatcgctgtgcctgactctggtgttgtggctgctctcgggtacgctgcgaaatccggtgtgccgtttcaacaggggttgattaggtctcattatgtagggaggacgttcattgagccgtcacagaagattagagactttggtgtgaagcttaagttgtctcctgttcgtggtgttttagaagggaagagagttgttgtggtggatgattcgattgttagaggcacaacttcgtctaagattgtgcgtttattgagagaagctggtgcgaaagaggttcatatgaggattgctagtcctcctatagtagcttcttgttactatggtgttgatacgcctagctcagaggagttgatatccaacagattgagtgttgaggagattaacgagttcatcgggagtgactctcttgcgtttctgtcgtttgataccttaaagaaacacttggggaaagactctaagagcttctgctatgcgtgcttcacgggtgactatcccgtgaagccaacagaagttaaggtgaaacgaggaggaggggatttcattgatgacggtctcgttggtagcttcgaaaacatcgaagcaggttgggttcgataa

SEQ ID NO: 30526 - protein, 511 aa, Arabidopsis thaliana
MESPPTSPLLHHPKNNSHAPFDYHNDEDDEKPREECGVVGIYGDPEASRLFYLALHALQHRGQEGAGIVTVSPEKVLQTITGVGLVSEVFNESKLDQLPGEFAIAHVRYSTAGASMLKNVQPFVAGYRFGSIGVAHNGNLVNYKTLRAMLEENGSIFNTSSDTEVVLHLIAISKARPFFMRIIDACEKLQGAYSMVFVTEDKLVAVRDPYGFRPLVMGRRSNGAVVFASETCALDLIEATYEREVYPGEVLVVDKDGVKSQCLMPKFEPKQCIFEHIYFSLPNSIVFGRSVYESRHVFGEILATESPVECDVVIAVPDSGVVAALGYAAKSGVPFQQGLIRSHYVGRTFIEPSQKIRDFGVKLKLSPVRGVLEGKRVVVVDDSIVRGTTSSKIVRLLREAGAKEVHMRIASPPIVASCYYGVDTPSSEELISNRLSVEEINEFIGSDSLAFLSFDTLKKHLGKDSKSFCYACFTGDYPVKPTEVKVKRGGGDFIDDGLVGSFENIEAGWVR

SEQ ID NO: 30527 - DNA, 1835 bp, Mus musculus
  CDS (120)..(1673)
ggggaaggaggcagtcagtagcgcgagcctcttgaggcgttcgatagcggagcggacagctggttggtgcttggaccacgccgcggcagcaggtccctccacgtgctttccgaggcgccatggagctggaggagttggggatccgcgaggaatgtggtgtgtttgggtgcatcgcttctggagactggcccacgcagctagatgtgccgcatgtgatcactctgggactcgtggggctacagcaccgaggtcaggagagcgctggtattgtgaccagtgatgggagtgcagtgcctaaattcagggtgcataagggaatgggtcttgtaaaccatgtttttaccgaagacaatttgaagaaattgtatgactcaaaccttggaatcggacatacgaggtacgccaccacgggaaagtgtgagctggaaaactgccagccattcgtagttgagacgcttcacggaaaaatagctgtggcccataacggggaactggtgaacgccgctcggttgcggaagaagcttctgcggcagggtattgggctttccacgtcctctgatagtgaaatgattacccagttactcgcatacacccctcctcaagaaaaagatgatgctccagactgggtagcaagaattaagaacttaatgaaagaagcgcccgcagcatactccctggttataatgcacagggacttcatttacgcggtgcgagatccatatggaaatcgtcctctctgcatcgggcgtcttatgccagtctctgatgtaaatgacaaagagaaaaaatcctcagaaactgaaggatgggtggtgtcctcagagtcttgcagctttttatccatcggtgccagatattgccatgaagtcaaacccggagaaattgtagaaatatccagacatggtatcagaactcttgatataattccaaggtctaacggagacccagtggctttttgtatttttgaatatgtttattttgcaagaccagatagtatgtttgaagaccaaatggtttatacagtaaggtaccggtgtggtcagcagctggcaattgaagcacccgtggaggcggacttggttagcacagttccagagtctgctacgcctgcagcgctgggatatgcaacaaagtgtgggctgccttatgtggaagtgctgtgtaagaaccggtatgtaggaagaaccttcattcaaccaaacatgaggttaagacaactcggtgttgcaaagaagtttggcgtgttgtctgacaactttaaaggcaaaagaatcgttctcatagatgattcgattatgaggggcaatactatctcacccatcataaaactcctcaaagaatccggtgcaaaagaggtgcacattcgagtcgcttcaccaccaataaaatatccgtgcttcatgggaataaacattcctacaaaagaagagctcatagccaataagccagaatttgattgtcttgcagagtacctcggagcaaacagcgttgtgtatctgtcagtggaaggactggtttcatctgtgcaacaagaaataaaatttaagaagcagaaagtgaaaaaacatgatattgcaattcaagaaaatggaaatggtttggaatattttgaaaagacgggacactgtacagcttgcctcactgggcagtaccctgtggagctggaatggtagctgcctggacagatgtgttgcttccagactgtagggtcatcaagaagtggtctacatactgttgttactcaggtggtaccaagtggataccacatgcttatgtatgtatactttaagctttgagattttctgaggttattattaaattgctatattgaaccc

SEQ ID NO: 30528 - protein, 517 aa, Mus musculus
MELEELGIREECGVFGCIASGDWPTQLDVPHVITLGLVGLQHRGQESAGIVTSDGSAVPKFRVHKGMGLVNHVFTEDNLKKLYDSNLGIGHTRYATTGKCELENCQPFVVETLHGKIAVAHNGELVNAARLRKKLLRQGIGLSTSSDSEMITQLLAYTPPQEKDDAPDWVARIKNLMKEAPAAYSLVIMHRDFIYAVRDPYGNRPLCIGRLMPVSDVNDKEKKSSETEGWVVSSESCSFLSIGARYCHEVKPGEIVEISRHGIRTLDIIPRSNGDPVAFCIFEYVYFARPDSMFEDQMVYTVRYRCGQQLAIEAPVEADLVSTVPESATPAALGYATKCGLPYVEVLCKNRYVGRTFIQPNMRLRQLGVAKKFGVLSDNFKGKRIVLIDDSIMRGNTISPIIKLLKESGAKEVHIRVASPPIKYPCFMGINIPTKEELIANKPEFDCLAEYLGANSVVYLSVEGLVSSVQQEIKFKKQKVKKHDIAIQENGNGLEYFEKTGHCTACLTGQYPVELEW

SEQ ID NO: 30529 - DNA, 1677 bp, Mus musculus
  CDS (1)..(1677)
atggagctggaggagttggggatccgcgaggaatgtggtgtgtttgggtgcatcgcttctggagactggcccacgcagctagatgtgccgcatgtgatcactctgggactcgtggggctacagcaccgaggtcaggagagcgctggtattgtgaccagtgatgggagtgcagtgcctaaattcagggtgcataagggaatgggtcttgtaaaccatgtttttaccgaagacaatttgaagaaattgtatgactcaaaccttggaatcggacatacgaggtacgccaccacgggaaagtgtgagctggaaaactgccagccattcgtagttgagacgcttcacggaaaaatagctgtggcccataacggggaactggtgaacgccgctcggttgcggaagaagcttctgcggcagggtattgggctttccacgtcctctgatagtgaaatgattacccagttactcgcatacacccctcctcaagaaaaagatgatgctccagactgggtagcaagaattaagaacttaatgaaagaagcgcccgcagcatactccctggttataatgcacagggacttcatttacgcggtgcgagatccatatggaaatcgtcctctctgcatcgggcgtcttatgccagtctctgatgtaaatgacaaagagaaaaaatcctcagaaactgaaggatgggtggtgtcctcagagtcttgcagctttttatccatcggtgccagatattgccatgaagtcaaacccggagaaattgtagaaatatccagacatggtatcagaactcttgatataattccaaggtctaacggagacccagtggctttttgtatttttgaatatgtttattttgcaagaccagatagtatgtttgaagaccaaatggtttatacagtaaggtaccggtgtggtcagcagctggcaattgaagcacccgtggaggcggacttggttagcacagttccagagtctgctacgcctgcagcgctgggatatgcaacaaagtgtgggctgccttatgtggaagtgctgtgtaagaaccggtatgtaggaagaaccttcattcaaccaaacatgaggttaagacaactcggtgttgcaaagaagtttggcgtgttgtctgacaactttaaaggcaaaagaatcgttctcatagatgattcgattgtgaggggcaatactatctcacccatcataaaactcctcaaagaatccggtgcaaaagaggtgcacattcgagtcgcttcaccaccaataaaatatccgtgcttcatgggaataaacattcctacaaaagaagagctcatagccaataagccagaatttgattgtcttgcagagtacctcggagcaaacagcgttgtgtatctgtcagtggaaggactggtttcatctgtgcaacaagaaataaaatttaagaagcagaaagtgaaaaaacatgatattgcaattcaagaaaatggaaatggtttggaatattttgaaaagacgggacactgtacagcttgcctcactgggcagtaccctgtggagctggaatggtggctgcctggacagatgtgttgcttccagactgtagggtcatcaagaagtggtctacatactgttgttactcaggtggtaccaagtggataccacatgcttatgtatgtatactttaagctttga

SEQ ID NO: 30530 - protein, 558 aa, Mus musculus
MELEELGIREECGVFGCIASGDWPTQLDVPHVITLGLVGLQHRGQESAGIVTSDGSAVPKFRVHKGMGLVNHVFTEDNLKKLYDSNLGIGHTRYATTGKCELENCQPFVVETLHGKIAVAHNGELVNAARLRKKLLRQGIGLSTSSDSEMITQLLAYTPPQEKDDAPDWVARIKNLMKEAPAAYSLVIMHRDFIYAVRDPYGNRPLCIGRLMPVSDVNDKEKKSSETEGWVVSSESCSFLSIGARYCHEVKPGEIVEISRHGIRTLDIIPRSNGDPVAFCIFEYVYFARPDSMFEDQMVYTVRYRCGQQLAIEAPVEADLVSTVPESATPAALGYATKCGLPYVEVLCKNRYVGRTFIQPNMRLRQLGVAKKFGVLSDNFKGKRIVLIDDSIVRGNTISPIIKLLKESGAKEVHIRVASPPIKYPCFMGINIPTKEELIANKPEFDCLAEYLGANSVVYLSVEGLVSSVQQEIKFKKQKVKKHDIAIQENGNGLEYFEKTGHCTACLTGQYPVELEWWLPGQMCCFQTVGSSRSGLHTVVTQVVPSGYHMLMYVYFKL

SEQ ID NO: 30531 - DNA, 1554 bp, Mus musculus
  CDS (1)..(1554)
atggaactggaggagttggggatccgcgaggaatgtggtgtgtttgggtgcatcgcttctggagactggcccacgcagctagatgtgccgcatgtgatcactctgggactcgtggggctacagcaccgaggtcaggagagcgctggtattgtgaccagtgatgggagtgcagtgcctaaattcagggtgcataagggaatgggtcttgtaaaccatgtttttaccgaagacaatttgaagaaattgtatgactcaaaccttggaatcggacatacgaggtacgccaccacgggaaagtgtgagctggaaaactgccagccattcgtagttgagacgcttcacggaaaaatagctgtggcccataacggggaactggtgaacgccgctcggttgcggaagaagcttctgcggcagggtattgggctttccacgtcctctgatagtgaaatgattacccagttactcgcatacacccctcctcaagaaaaagatgatgctccagactgggtagcaagaattaagaacttaatgaaagaagcgcccgcagcatactccctggttataatgcacagggacttcatttacgcggtgcgagatccatatggaaatcgtcctctctgcatcgggcgtcttatgccagtctctgatgtaaatgacaaagagaaaaaatcctcagaaactgaaggatgggtggtgtcctcagagtcttgcagctttttatccatcggtgccagatattgccatgaagtcaaacccggagaaattgtagaaatatccagacatggtatcagaactcttgatataattccaaggtctaacggagacccagtggctttttgtatttttgaatatgtttattttgcaagaccagatagtatgtttgaagaccaaatggtttatacagtaaggtaccggtgtggtcagcagctggcaattgaagcacccgtggaggcggacttggttagcacagttccagagtctgctacgcctgcagcgctgggatatgcaacaaagtgtgggctgccttatgtggaagtgctgtgtaagaaccggtatgtaggaagaaccttcattcacccaacactgaggttaagacaactcggtgtcgcaaagaagtttggcgtgtcgtctgacaactttaaaggcaaaagaatcgttctcatagatgattcgattgtgaggggcaatactatctcacccatcataaaactcctcaaagaatccggtgcaaaagaggtgcacattcgagtcgcttcaccaccaataaaatatccgtgcttcatgggaataaacattcctacaaaagaagagctcatagccaataagccagaatttgattgtcttgcagagtacctcggagcaaacagcgttgtgtatctgtcagtggaaggactggtttcatctgtgcaacaagaaataaaatttaagaagcagaaagtgaaaaaacatgatattgcaattcaagaaaatggaaatggtttggaatattttgaaaagacgggacactgtacagcttgcctcactgggcagtaccctgtggagctggaatggtag

SEQ ID NO: 30532 - protein, 517 aa, Mus musculus
MELEELGIREECGVFGCIASGDWPTQLDVPHVITLGLVGLQHRGQESAGIVTSDGSAVPKFRVHKGMGLVNHVFTEDNLKKLYDSNLGIGHTRYATTGKCELENCQPFVVETLHGKIAVAHNGELVNAARLRKKLLRQGIGLSTSSDSEMITQLLAYTPPQEKDDAPDWVARIKNLMKEAPAAYSLVIMHRDFIYAVRDPYGNRPLCIGRLMPVSDVNDKEKKSSETEGWVVSSESCSFLSIGARYCHEVKPGEIVEISRHGIRTLDIIPRSNGDPVAFCIFEYVYFARPDSMFEDQMVYTVRYRCGQQLAIEAPVEADLVSTVPESATPAALGYATKCGLPYVEVLCKNRYVGRTFIHPTLRLRQLGVAKKFGVSSDNFKGKRIVLIDDSIVRGNTISPIIKLLKESGAKEVHIRVASPPIKYPCFMGINIPTKEELIANKPEFDCLAEYLGANSVVYLSVEGLVSSVQQEIKFKKQKVKKHDIAIQENGNGLEYFEKTGHCTACLTGQYPVELEW

SEQ ID NO: 30533 - DNA, 1554 bp, Homo sapiens
  CDS (1)..(1554)
atggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttccgtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctgttggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtacacattcgagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtag

SEQ ID NO: 30534 - protein, 517 aa, Homo sapiens
MELEELGIREECGVFGCIASGEWPTQLDVPHVITLGLVGLQHRGQESAGIVTSDGSSVPTFKSHKGMGLVNHVFTEDNLKKLYVSNLGIGHTRYATTGKCELENCQPFVVETLHGKIAVAHNGELVNAARLRKKLLRHGIGLSTSSDSEMITQLLAYTPPQEQDDTPDWVARIKNLMKEAPTAYSLLIMHRDVIYAVRDPYGNRPLCIGRLIPVSDINDKEKKTSETEGWVVSSESCSFLSVGARYYREVLPGEIVEISRHNVQTLDIISRSEGNPVAFCIFEYVYFARPDSMFEDQMVYTVRYRCGQQLAIEAPVDADLVSTVPESATPAALAYAGKCGLPYVEVLCKNRYVGRTFIQPNMRLRQLGVAKKFGVLSDNFKGKRIVLVDDSIVRGNTISPIIKLLKESGAKEVHIRVASPPIKYPCFMGINIPTKEELIANKPEFDHLAEYLGANSVVYLSVEGLVSSVQEGIKFKKQKEKKHDIMIQENGNGLECFEKSGHCTACLTGKYPVELEW

SEQ ID NO: 30535 - DNA, 1686 bp, Arabidopsis thaliana
  CDS (1)..(1686)
atggcggccacctgcagcatctcttcttctctatctctcaatgctaaacccaacaagctctctaacaacaacaacaacaataagcctcaccgtttcctccgtaatcccttccttaacccctcctcctcctctttctctcctcttccggcttctatctcctcttcttcttcttctccttcgtttccgctcagagtttcaaaccctcttacccttttggcggcagacaacgatgattatgacgagaagcctcgggaagagtgtggagttgtcggaatctacggtgactcagaagcttcacgactctgttacttagctctccatgcgcttcagcatcgaggtcaagaaggtgcaggtattgttaccgttagtaaagataaggttcttcagaccattacaggtgttggtttggtctctgaggttttcagtgaatccaaactcgatcaattaccaggagacatagccattggtcatgtcaggtactcgactgctggttcttctatgctcaagaacgttcagccgtttgttgctggttatcgatttggctctgttggtgttgctcacaatggcaatttagtgaattacacgaaattgagagctgatttagaggaaaatggttcgattttcaatactagctctgatactgaggttgtgcttcatttgattgccatttctaaagctagaccctttttcatgagaattgttgatgcttgtgagaagcttcaaggtgcttattcgatggtgtttgtgactgaggataagcttgttgctgttcgtgacccacatgggtttaggcctttagttatgggtaggagaagtaatggagctgttgtgtttgcttctgagacttgtgctcttgatttgattgaagctacttatgagagagaggtttatcctggtgaggttttagttgtggataaagatggtgtcaaatgtcagtgtttgatgcctcatcctgagccaaagcaatgcattttcgaacatatttacttctcgttgcctaattcgattgtctttggtcggtctgtgtatgagtctaggcatgtctttggtgagattttagctactgagtcacctgttgattgtgatgtggtgatcgctgtgcctgactcgggtgttgtggctgctcttggttacgcggctaaagctggtgtagcgtttcagcaaggtttgattaggtctcattatgttggaaggactttcattgagccgtctcagaaaatcagagattttggagtgaagctgaagctatcgccagtccgaggagttttagaagggaaaagagttgttgttgttgatgattcgattgttagaggaacaacttcgtccaagattgtgcgtttattgagagaagcgggtgcgaaagaggttcacatgaggatcgcgagtcctcctattattgcatcttgttactacggagtggacacgcctagctcaaatgagttgatatcgaataggatgagtgttgatgaaatcagggattacatcggatgtgattcccttgcgtttttgtcgtttgagacgttaaagaaacatttgggggaagattctagaagcttctgctatgcatgcttcacgggggactatccggtgaagcctacagaggataaggtgaagcgaggaggagattttatcgatgatggtctcgttggaggaatccacaacattgaaggaggttgggtacggtag

SEQ ID NO: 30536 - protein, 561 aa, Arabidopsis thaliana
MAATCSISSSLSLNAKPNKLSNNNNNNKPHRFLRNPFLNPSSSSFSPLPASISSSSSSPSFPLRVSNPLTLLAADNDDYDEKPREECGVVGIYGDSEASRLCYLALHALQHRGQEGAGIVTVSKDKVLQTITGVGLVSEVFSESKLDQLPGDIAIGHVRYSTAGSSMLKNVQPFVAGYRFGSVGVAHNGNLVNYTKLRADLEENGSIFNTSSDTEVVLHLIAISKARPFFMRIVDACEKLQGAYSMVFVTEDKLVAVRDPHGFRPLVMGRRSNGAVVFASETCALDLIEATYEREVYPGEVLVVDKDGVKCQCLMPHPEPKQCIFEHIYFSLPNSIVFGRSVYESRHVFGEILATESPVDCDVVIAVPDSGVVAALGYAAKAGVAFQQGLIRSHYVGRTFIEPSQKIRDFGVKLKLSPVRGVLEGKRVVVVDDSIVRGTTSSKIVRLLREAGAKEVHMRIASPPIIASCYYGVDTPSSNELISNRMSVDEIRDYIGCDSLAFLSFETLKKHLGEDSRSFCYACFTGDYPVKPTEDKVKRGGDFIDDGLVGGIHNIEGGWVR

SEQ ID NO: 30537 - DNA, 1527 bp, Brachydanio rerio
  CDS (1)..(1527)
atggagtttgaggagtcgggcatcggagaggagtgcggggtgttcggatgtgtggcggcgggcgaatggccaacacaactggaggtcgcgcagattctgacacttggacttgttgctttacagcacaggggtcaggaaagtgctggaattgtcacaagtactggaacaaaccccccaacattctccaccctgaagggaatgggtttagtgaatacagcttttaaaccagaggatttgctgaaactgcgctatggtaaccttggcattggacacacacggtactccaccacgggcatctcagagctgcataactgccagccttttgttgtagacaccctgcatggcaagattgcagtggcacacaatggagaactggtcaatgcctccgcactgcgcaagaaggttatgcgccatggtgttggtctgtccacctgttcagacagtgaactcatcacccagctccttgctttgactccacccatggaggaactcgacaatcctgattgggtcgctcgtattaaaaacctcatgacagagacgcctacatcatactcgctgcttgtgatgtataaagatgtgatctatgctgtgagagacccctatggaaacagacctctctgtatcggacgtttagtgccaatctccaaactgcacagctcaggtgctggagaagcagacacagaaggctgggtggtttcatctgagtcctgtagctttcaatctattggagcaaagtattatcgtgaagtaaagcctggagagattgtccagatatcaaaaaatggtgtagagagtctaagtgttgtgccacgaccagaaggagatcttcctgcattttgtatatttgaatatgtttacttcgccaggccagactccatgtttgaaggtcagatggtgtacacagtgaggcagcgctgtgggcgtcagttggccattgaggctcccactgatgctgatgtggtcagcactgttccagaatcagccacgcctgcagcattaggatacgcacaacaatctggccttccgtatgtagaggtgctttgtaaaaaccgatatgtgggtagaaccttcattcaaccaaacactcgcctgcgtcagcttggagtggccaagaagttcggggcattgactgacaactttgctggcaaacgagtggtgctcattgatgattccattgtgaggggaaacactatttcacctattataaaactgctgaaggaagcaggggcaacagaggtccatattcgagttgcatctcctcccatccggttcccatgttacatgggaatcaacattcctaccaaagaagagctaattgcaaacaaaccagagtttaaggatatagctggttatattggtgctacaagtgtgcgctatctgtccgttgaaggcctgttatctgctgttcaaggtgggattgagtcgcatggaaaagacgagaggatcagctccaccactaagaccactagaattggccactgtacagcctgcctcacaggaaaatacccagtggagctggagtggtga

SEQ ID NO: 30538 - protein, 508 aa, Brachydanio rerio
MEFEESGIGEECGVFGCVAAGEWPTQLEVAQILTLGLVALQHRGQESAGIVTSTGTNPPTFSTLKGMGLVNTAFKPEDLLKLRYGNLGIGHTRYSTTGISELHNCQPFVVDTLHGKIAVAHNGELVNASALRKKVMRHGVGLSTCSDSELITQLLALTPPMEELDNPDWVARIKNLMTETPTSYSLLVMYKDVIYAVRDPYGNRPLCIGRLVPISKLHSSGAGEADTEGWVVSSESCSFQSIGAKYYREVKPGEIVQISKNGVESLSVVPRPEGDLPAFCIFEYVYFARPDSMFEGQMVYTVRQRCGRQLAIEAPTDADVVSTVPESATPAALGYAQQSGLPYVEVLCKNRYVGRTFIQPNTRLRQLGVAKKFGALTDNFAGKRVVLIDDSIVRGNTISPIIKLLKEAGATEVHIRVASPPIRFPCYMGINIPTKEELIANKPEFKDIAGYIGATSVRYLSVEGLLSAVQGGIESHGKDERISSTTKTTRIGHCTACLTGKYPVELEW

SEQ ID NO: 30539 - DNA, 1722 bp, Nicotiana tabacum
  CDS (1)..(1722)
atggccgccaccgtctccaccgcctctgccgccgccaccaacaaatctcctctttcacagccccttgacaaacccttttgctccctatctcaaaagctcttatctttatcccctaaaacccatcctaaaccctacagaactctcatcaccgcctcttccaaaaaccccttaaacgacgtcatttcgtttaagaaatcagctgacaataccttggactcctattttgacgatgacgataaaccccgtgaagagtgcggcgttgtgggcatctatggcgactcagaagcttcacgcctttgctatttagcacttcacgcgcttcaacaccgtggccaagaaggcgccggcattgtcgccgttaacgacgacgttcttaagtcaattacaggtgttgggttagtatccgacgtgttcaatgagtcaaagcttgaccaactccctggtgacatggcaattggccacgtaaggtactctactgctggctcttctatgttaaaaaatgttcagccttttgttgctagttataaatttgggtcagttggtgttgcccataatggtaatttagtgaattataagttactgcgtagtgaactagaggaaaatgggtcaatttttaatacaagttctgatactgaggttgtacttcaccttattgctatatctaaagctaggccatttttattgaggattgttgaggcttgtgaaaaaattgaaggtgcttattctatggtgtttgttactgaggataagttggttgccgtaagggatcctcatgggtttaggccattggttatgggtaggagaagtaatggtgctgttgttttcgcgtctgagacgtgtgctttggatttgattgaggctacttatgagagggaggtgaatcctggtgaggttgttgttgtggataaagatggggttcagtctatttgtttgatgcctcatcccgagcgtaaatcttgtatctttgagcatatttactttgctctgcctaattcggtcgtgtttgggaggtctgtgtacgagtctaggcgtgctttcggggagattcttgctactgaagctcccgtggaatgtgatgttgtgatagcagttcctgactcgggtgtcgtggctgcgctcggttatgctgctaaagcaggggtaccgtttcaacaaggtttgattaggtcgcattatgttggtaggacgttcatcgagccatcgcagaagataagggatttcggggtgaagcttaagctgtcgccggttagggcggtgttggagggaaaaagagttgtggtcgtggatgattcgatcgttagaggaacgacctcgtccaagattgtgaggctgttaaaggaggcgggtgcgaaagaggttcatatgaggattgcaagcccaccaattatagcttcttgttattatggagtggatactcctagttcagatgagttgatatcaaataggatgagtgtggaggagattaaggagttcattggatcggattcgcttgcttttctgccaatggatagcttgaataagctcttaggcaatgattctaaaagcttttgctatgcttgcttttcgggcaattacccagtcgagccgacgggtaaggttaaaaggataggggatttcatggatgatggattaagtggagatatggattccattgatggtggatggctaccaggaagtagtagggttcaaaagactatcttgaatgaagttagaaccagctaa

SEQ ID NO: 30540 - protein, 573 aa, Nicotiana tabacum
MAATVSTASAAATNKSPLSQPLDKPFCSLSQKLLSLSPKTHPKPYRTLITASSKNPLNDVISFKKSADNTLDSYFDDDDKPREECGVVGIYGDSEASRLCYLALHALQHRGQEGAGIVAVNDDVLKSITGVGLVSDVFNESKLDQLPGDMAIGHVRYSTAGSSMLKNVQPFVASYKFGSVGVAHNGNLVNYKLLRSELEENGSIFNTSSDTEVVLHLIAISKARPFLLRIVEACEKIEGAYSMVFVTEDKLVAVRDPHGFRPLVMGRRSNGAVVFASETCALDLIEATYEREVNPGEVVVVDKDGVQSICLMPHPERKSCIFEHIYFALPNSVVFGRSVYESRRAFGEILATEAPVECDVVIAVPDSGVVAALGYAAKAGVPFQQGLIRSHYVGRTFIEPSQKIRDFGVKLKLSPVRAVLEGKRVVVVDDSIVRGTTSSKIVRLLKEAGAKEVHMRIASPPIIASCYYGVDTPSSDELISNRMSVEEIKEFIGSDSLAFLPMDSLNKLLGNDSKSFCYACFSGNYPVEPTGKVKRIGDFMDDGLSGDMDSIDGGWLPGSSRVQKTILNEVRTS

SEQ ID NO: 30541 - DNA, 1641 bp, Neurospora crassa
  CDS (1)..(1641)
atgtgtggtattctcgcccttatcctcgcggataccgatgcgtcggacgcctctgccgatttgcacgagagcttgtactatcttcaacaccgtggtcaagatgcctgtggtatcgcgacctgtggttctggaggtagaatctttcagtgcaagggcaatggcatggcctccaaggtctttgacgacggcaagcgcacggtagaccttcccggctacatgggcattgcccatcttcgttacccgactgccggaactagctctagcgccgagagtcagcctttttacgtcaactcgccctacggcatctgcttcgcgcacaacggtaacctcatcaacgctcccgccctgcgcagctatctcgaccaagaggcccatcgtcatgtgaacaccgactcggacagcgagctgatgctcaacgtctttgccaacgccctgaacgagaccggcaaggcccgtgtcaacaccgacgacatcttcagtgccctcaagaagacgtacgagaggtgccaaggtggctgggccgtcactgctatgattgctggcttcggtatcttcgccttccgtgatcaatacggcatccgccccctcattatgggatcgcgtccctccagcaccctcgaaggcggtatcgactacatgttcgcttccgagagcattgctcttcgtcagctgggcttcagcaacttccaggatatcctcccgggacaagccgtgttcatccaaaagaacgggcagcctcaattccaccaggttgttgagcaaaaggcttactcccccgatatcttcgagtacgtttacttcgcccgcccggataccatcatggatggaatctccgtgcaccgcagcaggcagaacatgggcgtgaagcttgccaacaaggtcaaggagatcctcggagaggagggtgtcaaggagattgatgtgatcattcccgtcccggagaccagtaatactgccgctgccgtggtatcagagcagcttcggaaacccttctctaacggtttcgtcaagaaccgttacgtctaccgcaccttcatcttgcccggtcagaaggccaggcaaaagagcgtccggagaaagctcagcgccatggagtccgagttcaaggaccgtgtcgtcctgctcgtggacgactccattgtccgtggcaccaccagtagggagattgtgagcatggctcgtgaggctggtgcccgcaaggttatctttgctagctgtgctcctcccatcatctacccccacatttacggtatcgatctcgcttctccacaggagctcatcgcccacgagaagacaagaagcgacatcgccaagcacatcaatgccgatgatgtcatttaccaggaccttgccgaccttaaggcggcctgtactgaggcctctcctgatcaccagaagatcaccgactttgaagtgggtgtgttctgcggcaaataccagaccgacatccctgaaggttacttcgaccacctgaacgagagccgtggcacgaagcggaaggccgccgttgtgaacggcaccaacaaggtcttggtcgccaatagcggcccggtcaatgtttctacacccgaaccccctgcgctcatggagaaccccgagaacaggcaggatatcagcatccacaacattgccaactcctaa

SEQ ID NO: 30542 - protein, 546 aa, Neurospora crassa
MCGILALILADTDASDASADLHESLYYLQHRGQDACGIATCGSGGRIFQCKGNGMASKVFDDGKRTVDLPGYMGIAHLRYPTAGTSSSAESQPFYVNSPYGICFAHNGNLINAPALRSYLDQEAHRHVNTDSDSELMLNVFANALNETGKARVNTDDIFSALKKTYERCQGGWAVTAMIAGFGIFAFRDQYGIRPLIMGSRPSSTLEGGIDYMFASESIALRQLGFSNFQDILPGQAVFIQKNGQPQFHQVVEQKAYSPDIFEYVYFARPDTIMDGISVHRSRQNMGVKLANKVKEILGEEGVKEIDVIIPVPETSNTAAAVVSEQLRKPFSNGFVKNRYVYRTFILPGQKARQKSVRRKLSAMESEFKDRVVLLVDDSIVRGTTSREIVSMAREAGARKVIFASCAPPIIYPHIYGIDLASPQELIAHEKTRSDIAKHINADDVIYQDLADLKAACTEASPDHQKITDFEVGVFCGKYQTDIPEGYFDHLNESRGTKRKAAVVNGTNKVLVANSGPVNVSTPEPPALMENPENRQDISIHNIANS

SEQ ID NO: 30543 - DNA, 1620 bp, Drosophila virilis
  CDS (1)..(1620)
atggcgcaaagtgaatgtggaaatttctgtggtaagccaaatgccaatcgggcaacggaaacagttgctgccaggaaagtatttcccgataagatctacaaatcggtgcagccaaagggagaccatgtgacgggcatgacctgcgaatgcggtgtatttggcgccattgcctgtggcgattatcctacacagctggacatcgcacaaatgatctgcctgggcctggtggcgctgcagcatcgcggccaggagtcggcgggcattgtgaccagcctgggcaagagctccaagaacttcggcgtgcacaagggcatgggcatgatcaacaacatcttcaacgacaaggccatacgcaagctcaagggcaacctgggcattggccacacacgctactcaacggcagctgcctccgaggtggtcaattgccagccctttgtggtgcacacggcgcacggtgcgctggcgattgcccacaacggcgagctggtcaactgtgagtcgctgcgtcgcgaggtgctcgaacggggcgtcggcctgtccacgcacagcgacagcgaactgattgcccagtcgctgtgctgtgcgccggaggatgtctcggagcacgacggacccaattggccggcacgcatacgccattttatgacgctggcgccgctctcctactcactggtggtcatgcacaaggacaagatctatgctgtgcgcgattcctatggcaatcggccgctctgcctgggcaagattgtgcccttcgatgcgggccatgccaatatcgaggatcagctagccgagggctgggtggtgagcagcgagagctgcggatttctctccataggcgcgcgctacgtgcgcgaagtggagccgggcgagattatcgaactgtcgcgcaacggctaccggaccgtggacattgtggagcggccggactacaagcgcatggccttctgcatcttcgagtatgtttactttgcgcgcagcgactccatgtttgaaggccagatggtctactcggcgcggctgcagtgcggccggcagctggcacgggaatcgccgctggacgcggatctggtcagctctgtgccggagtcaggcactgcggcggcccatggctatgcacgtgagtcgggtctgaactttggcgaggtcctgtgcaagaatcgttatgtgggacgcaccttcatccagccctcgacgcgtttgcgccaactgggcgtggccaagaagtttggcgctctggcccaaaatgtggagggcaagcgcattgtgctcgtcgacgactcgattgtgcgtggcaatacaattggccccattattaagctgctgcgcgatgccggcgccatcgaggtgcacatccgcattgccagcccgccgctgcagtatccctgctacatgggcatcaatatacccacgcgcgaggagctcattgccaacaagctgaacgcaacgcagctggccaaccatgtcggtgccgacagtctggcctacctcagcgtggagggcctgatcaaggcggtgcagatgaacaaaacgcacgtgaatcccatcaagtccggctactgcaccgcctgcctcaccggcgagtatccgggcggtctgcccgaggagctcagctggtag

SEQ ID NO: 30544 - protein, 539 aa, Drosophila virilis
MAQSECGNFCGKPNANRATETVAARKVFPDKIYKSVQPKGDHVTGMTCECGVFGAIACGDYPTQLDIAQMICLGLVALQHRGQESAGIVTSLGKSSKNFGVHKGMGMINNIFNDKAIRKLKGNLGIGHTRYSTAAASEVVNCQPFVVHTAHGALAIAHNGELVNCESLRREVLERGVGLSTHSDSELIAQSLCCAPEDVSEHDGPNWPARIRHFMTLAPLSYSLVVMHKDKIYAVRDSYGNRPLCLGKIVPFDAGHANIEDQLAEGWVVSSESCGFLSIGARYVREVEPGEIIELSRNGYRTVDIVERPDYKRMAFCIFEYVYFARSDSMFEGQMVYSARLQCGRQLARESPLDADLVSSVPESGTAAAHGYARESGLNFGEVLCKNRYVGRTFIQPSTRLRQLGVAKKFGALAQNVEGKRIVLVDDSIVRGNTIGPIIKLLRDAGAIEVHIRIASPPLQYPCYMGINIPTREELIANKLNATQLANHVGADSLAYLSVEGLIKAVQMNKTHVNPIKSGYCTACLTGEYPGGLPEELSW

SEQ ID NO: 30545 - DNA, 1635 bp, Drosophila virilis
  CDS (1)..(1635)
atgtcaagcagcagcagcagcagcaacaattcgcagcagcagccgcagcagcagcagcagcaacatgtgcgcattgagagccgcgatcaacaggtggaggccgagttgcccacgccgttgaccattgctgaaagtaaggagctaaccggtttgacgcatgagtgcggcgtttttggtgcgattgcctgcggcgactggccaacccagattgatattgctcacgtgatctgcttgggtctggtggcattgcagcaccgtgggcaggagtcggcgggcattgcgaccagcgagggcaagtgttccaagaacttcaatgtgcacaagggcatgggcatgatcagcaccctgttcaacgacgattcgatgaagaagctgcgtggcaatctgggcattgggcatacacgctactccacggccggcgcctcggaggtggtcaattgccagccgtttgtggtgcacacggcgcatggcgccatggcgctggcccacaacggcgagctggtcaacaatgaatctctgcgtcgcgaggtgctgggccgcggcgtcggcctgtccacgcacagcgacagcgagctgatagctcagtcgctttgctgtgcaccggagggcgtctccgagcacgatggacccaactggccggcgcgcattcggcatttcatgatgctggcgccattgtcctattcgctggtcatcatgctcacggataagatctacgctgtgcgcgatacgtacggcaaccgaccgctgtgcattggcaaaatcgtgcccatcaacacgggccatgcgggccacagcacggagacacctgctgatggctgggtggtgtccagcgagagctgcggcttcttgtccattggtgcgcgctatgtgcgcgaagtggagccgggcgagattgtcgagctgacacgcaatggctatcgcaccgttgacattgtggagcgtccggacttcaagcgcatggccttctgcatctttgagtatgtgtactttgcccgcggcgacagcatcttcgaggatcagatggtgtactcagtgcgcttggagtgcggtcgccagctgtggcgcgaggcacccgttgaagcagacattgtcagctcagtgccagagtcgggcacggccgcagcgcatggctatgcgcgcgagtcgaacctcgagttcgccgaggttctgtgccggaatcgttatgtgggacgcacctttatacagccctcgacacggctgcgccaactgggcgtggccaagaagttcggcgcactgtccgagaacgtggccggcaagcggctggtgctcatcgacgattcgattgtgcgcggcaacacaatcggaccaataatcaagctgctgcgcgacgctggggcccgcgaggtgcacatacgcatcgccagccccccgctgcagtatccctgctacatgggcatcaatatacccacgcgcgaggagctgatcgccaacaagctgaacgccaagcaactggcccgtcatgtgggcgccgacagtctggcatatctgagtgtcgccggcctggtacagacggtgcagcgcaagcatgtggcatctggcaaggcgacgggtcattgcaccgcctgtctgacgggcgaatatcctggcggactgccggacgagctaagctggtag

SEQ ID NO: 30546 - protein, 544 aa, Drosophila virilis
MSSSSSSSNNSQQQPQQQQQQHVRIESRDQQVEAELPTPLTIAESKELTGLTHECGVFGAIACGDWPTQIDIAHVICLGLVALQHRGQESAGIATSEGKCSKNFNVHKGMGMISTLFNDDSMKKLRGNLGIGHTRYSTAGASEVVNCQPFVVHTAHGAMALAHNGELVNNESLRREVLGRGVGLSTHSDSELIAQSLCCAPEGVSEHDGPNWPARIRHFMMLAPLSYSLVIMLTDKIYAVRDTYGNRPLCIGKIVPINTGHAGHSTETPADGWVVSSESCGFLSIGARYVREVEPGEIVELTRNGYRTVDIVERPDFKRMAFCIFEYVYFARGDSIFEDQMVYSVRLECGRQLWREAPVEADIVSSVPESGTAAAHGYARESNLEFAEVLCRNRYVGRTFIQPSTRLRQLGVAKKFGALSENVAGKRLVLIDDSIVRGNTIGPIIKLLRDAGAREVHIRIASPPLQYPCYMGINIPTREELIANKLNAKQLARHVGADSLAYLSVAGLVQTVQRKHVASGKATGHCTACLTGEYPGGLPDELSW

SEQ ID NO: 30547 - DNA, 1470 bp, Thermoplasma volcanium
  CDS (1)..(1470): transl_table=11
gtggacaccacacctataacgtcaggactaagaggtgctcccactgtggattcccggccccaaggatcagatcctataaatgggcaaaagccaagtgaagattgcgcagttgtggggttcaaggggaagataaacgcctataaccccataataactgcacttcgaacattgcaacatagaggccaggaatcggctggtatggctgtttttgacggcaagaaggtaacgttgaaaaaaggaagtggcctagtaacagatgtttttaatcctgcaaccgacgatattaaaggttacgtgggagtaggccatacacgttattcaactgctggatcaaaaaatgtggttaatgctgggccatttgtaatgaactcttctttcggttacataaccatatcccacaacggtgagatagtaaacgctgatgaattgcgtgattccatgaaaaaagaagggatcacgttccagagcgattcagatacagaggttatgctggcagagctttcgagaaatatctcaaagtatggcctaaaaagaggattcgaacagtccatggagagcctaaggggagcttatgcatgcgcaataagcataaatgatcgcctctacgccgtaagggacccaaatgggataaggcctctggttatagggaagaataacgacggatacatagtagcttcagaaagctgcgcaatagatgctctcgaaggcacgttaataaaaaacatcgaaccaggggaagtagttgagatatctgacgaaggcataagaacaattgtaagcaaatctgcaaatcgaatagcccactgcatgtttgagtatgtatatttctcaaggccggatagcgttatagacggcataaacgtttatgccgccagggtaaacatgggcagaatacttgctaaggagagcccagttgaagctgacatagtcgtccctgttccagattcagggcgttctcaagcaataggttattccatggaatctggaatgccttacacagaggggctgattaagaataggtattcggagaggaccttcataatgcctactcagagcgataggaaggccgcgatacatttgaagctaaatcctatacgcgaagtgatagggggaaagaaggtagtgcttgtagatgatagcatagtccgtggaaacactatgaggttcatcgtcggcctaatgaggaaatatggcgcaaaggagatacatgtcagaattggatcgccgcatataatcgcaccatgctattttggtgtcgacatgaagacgaaggatcaattcatagcgcgcggtaaaaccgatgaggagataaacagagaaatcggggccgattcactcgcgtttctttcagttgacggcctcaaacaggcgatatctatgaaaaacaataacctgtgccttgggtgcctcacaggagaatatcctatagatatatcaaagaaactcgcagaaaatattacttcttactag

SEQ ID NO: 30548 - protein, 489 aa, Thermoplasma volcanium
MDTTPITSGLRGAPTVDSRPQGSDPINGQKPSEDCAVVGFKGKINAYNPIITALRTLQHRGQESAGMAVFDGKKVTLKKGSGLVTDVFNPATDDIKGYVGVGHTRYSTAGSKNVVNAGPFVMNSSFGYITISHNGEIVNADELRDSMKKEGITFQSDSDTEVMLAELSRNISKYGLKRGFEQSMESLRGAYACAISINDRLYAVRDPNGIRPLVIGKNNDGYIVASESCAIDALEGTLIKNIEPGEVVEISDEGIRTIVSKSANRIAHCMFEYVYFSRPDSVIDGINVYAARVNMGRILAKESPVEADIVVPVPDSGRSQAIGYSMESGMPYTEGLIKNRYSERTFIMPTQSDRKAAIHLKLNPIREVIGGKKVVLVDDSIVRGNTMRFIVGLMRKYGAKEIHVRIGSPHIIAPCYFGVDMKTKDQFIARGKTDEEINREIGADSLAFLSVDGLKQAISMKNNNLCLGCLTGEYPIDISKKLAENITSY

SEQ ID NO: 30549 - DNA, 1536 bp, Mycobacterium smegmatis
  CDS (1)..(1536): transl_table=11
gtgatcggccacgacgacaacgagtccgaaaatgaaccccgtgaggaatgtggcgtcttcggcgtctgggccccgggcgaagaagttgccaagctgacctactacggcctctacgccctgcagcaccgcgggcaggaagccgcgggtatcgcggtcgccgatggctcccaggtgctggtcttcaaggatctgggcctggtcagtcaggtgttcgacgagcagaccctggccgcgatgccgggtcacgtcgccgtcggccactgccggtactccaccaccgggtccacgacctgggagaacgcgcaacccgtgttccgcaacaccgcggcaggcaccggcgtcgccctcggacacaacggaaacctcgtcaacacggccgaactcgccgcccgtgcccgcgacaacggcctgatcgaactcaagggtggcccggcggccaccaccgactccgacatcctcggtgcgctgctcgcgcacggcgccgccgacgcgacgctcgagcaggccgcgctcgaactgctgccgaccgtccgcggcgcgttctgcctgacgttcatggacgagaacacgctgtacgccgcgcgcgacccgcacggtgtgcggccgctgtcgctgggccggctggaccgtggctgggtggtcgcgtcggagaccgcggcgctcgacatcgtcggcgcctcgttcgtccgcgacatcgaacccggcgaactgctcgcgatcgacgccgacggcgtgcgctccacgcggttcgcgaaccccgagcccaaggggtgcgtcttcgaatacgtctacctggcccgccccgacagcacattggtcggccgctcggtgcacgccacccgcgtcgacatcggccgccgcctggcccgcgaacatcccgtcgaggccgatctggtgatcggtgtcccggaatcgggcacgcccgccgcggtggggtacgcgcaggaatcgggcatcccgttcgggcagggcctgatgaagaacgcctacgtgggccgcaccttcatccagccgtcgcagacgatccgtcagctgggcatccggctcaagctcaacccgctgcgcgaggtgatccgcggcaagcggctgatcgtggtcgacgactcgatcgtgcgcggcaacacccagcgcgccctcgtgcggatgctgcgcgaggccggggccctcgaggtgcacgtgcgcatcgcgtccccgcccgtcaggtggccgtgtttctacggcatcgatttcgccaccccggccgaactgatcgccaacgcggcctcgcaggaacacgaaggcgagatgctcgaagcggtccgccacgcgatcggcgccgacagcctcggctacatctcccagcagggcatgatcgcggccaccgagcagcccgcgtcgcggttgtgctcggcgtgcttcgacggcaagtacccgatcgagctgcccggcgagaccgccctgggcaagaacgtcatcgagcacatgctcgcctcggcggcccgcagcggcatccccgtggcgcagaacgacaacgcctcggcgttgcgcaggccctga

SEQ ID NO: 30550 - protein, 511 aa, Mycobacterium smegmatis
MIGHDDNESENEPREECGVFGVWAPGEEVAKLTYYGLYALQHRGQEAAGIAVADGSQVLVFKDLGLVSQVFDEQTLAAMPGHVAVGHCRYSTTGSTTWENAQPVFRNTAAGTGVALGHNGNLVNTAELAARARDNGLIELKGGPAATTDSDILGALLAHGAADATLEQAALELLPTVRGAFCLTFMDENTLYAARDPHGVRPLSLGRLDRGWVVASETAALDIVGASFVRDIEPGELLAIDADGVRSTRFANPEPKGCVFEYVYLARPDSTLVGRSVHATRVDIGRRLAREHPVEADLVIGVPESGTPAAVGYAQESGIPFGQGLMKNAYVGRTFIQPSQTIRQLGIRLKLNPLREVIRGKRLIVVDDSIVRGNTQRALVRMLREAGALEVHVRIASPPVRWPCFYGIDFATPAELIANAASQEHEGEMLEAVRHAIGADSLGYISQQGMIAATEQPASRLCSACFDGKYPIELPGETALGKNVIEHMLASAARSGIPVAQNDNASALRRP

SEQ ID NO: 30551 - DNA, 1527 bp, Zymomonas mobilis
  CDS (1)..(1527): transl_table=11
atgtcgcctagcctttcgagcgaactcttttccgactctatctctaccctgacgacgacaactgaatctttagataatggggcgtctgatgatacccttcatgaagaatgtggtgttttcggtatttggggcgcagatacagccgctgccgtcgtagctctcggactacatgctttacagcatcgcggacaggaagccgccggtatcaccagctgggatgggaaaaatttccactcccgtcgtgctgttggtcacgttgcgggtaactttgaccgtgacgatgctatccgcagcttgcccggatcatgtgctattggccatgtccgctatgcaaccaccggtgccagcaccttgtgcaatgttcagccgctttatgccgaactggtttcgggcggatttgcgattgctcataacggcaatatttccaatgccgaaactttgcgccatcagttggtgcgtcatggatctatctttcaatccacgtcggatactgaaacgattatccatctggttgcgacctcaagctatcgcagcctgttagaccgattcattgatgctttaaaacaggttgagggcgcttattctctcgtctgcctgacgccggaaggcatgattgcctgtggtgatccgctgggtattcgcccgctggttctcggtaaagtcggggaaacttttgttgtcgcttccgaaacggttgctctcgatattattggcggaacctatatccgtcaggtcgaaccgggtgagctgattattatttcggaaaaagggctgcaatctattcatccctttaaaaagcagaagcctcgcccctgcattttcgagcatgtctatttttcgagaccggattctttgatcggtagcacctcggtttattctgttcggaaatctatcgggatcgaattggcgcgcgaaaatccggttgatgccgatatggttattcctgtgccagattcagggacacctgccgctatcggttatgcccagcaatcttctttgccgtttgaattgggtattatccgttcccattatgttggacgcacctttattcagccgggcgaccaagtccgtcatttgggcgtgaagctgaagcataatgccaaccgtgccttgattaaaggcaagaagttggttctagttgatgactctattgtcagaggcacgaccagcgtcaaaatcatcagaatgcttcgggatgcgggtgccaaggaaatccatttgcggattgccagcccaccgacccgtcatagctgtttttatggtgtagatacgccggagcgggcaaaattgttggcggctaaaatgaccgtcgaacagatggcagaatatatcggcgctgatagtttagcttttatttcgatggatggcctttatcgtgcggtcggtgaagaggctcgcaatgatgctcagccgcaatattgtgatgcttgctttacaggtgcctatgccacgcccctaaccgatcttggcgaattgggtgctagcgaacaactggttcgtttatccgaacaggtggctatcgcctaa

SEQ ID NO: 30552 - protein, 508 aa, Zymomonas mobilis
MSPSLSSELFSDSISTLTTTTESLDNGASDDTLHEECGVFGIWGADTAAAVVALGLHALQHRGQEAAGITSWDGKNFHSRRAVGHVAGNFDRDDAIRSLPGSCAIGHVRYATTGASTLCNVQPLYAELVSGGFAIAHNGNISNAETLRHQLVRHGSIFQSTSDTETIIHLVATSSYRSLLDRFIDALKQVEGAYSLVCLTPEGMIACGDPLGIRPLVLGKVGETFVVASETVALDIIGGTYIRQVEPGELIIISEKGLQSIHPFKKQKPRPCIFEHVYFSRPDSLIGSTSVYSVRKSIGIELARENPVDADMVIPVPDSGTPAAIGYAQQSSLPFELGIIRSHYVGRTFIQPGDQVRHLGVKLKHNANRALIKGKKLVLVDDSIVRGTTSVKIIRMLRDAGAKEIHLRIASPPTRHSCFYGVDTPERAKLLAAKMTVEQMAEYIGADSLAFISMDGLYRAVGEEARNDAQPQYCDACFTGAYATPLTDLGELGASEQLVRLSEQVAIA

SEQ ID NO: 30553 - DNA, 1473 bp, Corynebacterium ammoniagenes
  CDS (1)..(1473): transl_table=11
gtgaatttagatgaccaaggcgagcaagaaccccgcgaagagtgcggtgtctttggcgtctgggctcctggtgaagatgttgcgacactgacctactttggtctgttcgcattgcagcatcgtgggcaggaagctgcaggtatcggcgtcggtgatggagaccgcctcgttgtcttcaaagacatgggcttggtctcgaatattttcgatgagtccattttaaattccctccatggctccgtgggcgtggggcatacgcgctactcgactgccggtggcaaagagtggtcgaatgtccagccgatgtttaataccacctcaaatggggtagacatcgctttgtgccacaacggcaacttggtgaactaccaagaactgcgcgatgaagcagtagctctgggactttaccgagagaatgaaaaatccctgtcggattccatgatcatgacagctttgctggcgcacggagtcggggaaggcaactctgtctttgacgccgctaagcaactgctgccaagcatcaaaggcgctttttgcttgacctttaccgatggcaagaccttgtacgccgcgcgtgacccgcacggtgtacgccccttggtcattggccgcttggcgcaaggctgggttgttgcttccgaaacctgtgcgctggatatcgtgggcgcacagtttatccgtgaggtagagcccggtgaacttatctctgtcaatgaggcaggaatccacagcgaaaaattcgctgagccgaagcgccagggctgcgtctttgaatacgtctacttggcacgtccagacaccgtgatcaaaggccgcaacgttcacgcgacgcgcgtggatattggtcgcgcacttgcgaaatctcaccctgcgccagaagctgacatggtcatccccgtgccagaatccggaaacccggcagctgttggctacgcccgggaatcgggcctgacatttgcgcacggcttggtcaaaaacgcctacgtgggtcgaaccttcattcagcccacccagaccttgcgccagctgggtattcgcctcaagctcaaccccctgcgcgaggtcatcgagggcaagtcactcgttgttgtagatgactctattgtccgcggcaacacccaacgcgcgctggtgcgcatgctgcgtgaagcaggcgctgctgaagtgcacgtgcgcattgcttcaccgccagtcaaatggccttgtttctacggcattgacttcgcctcgcctggtgaattgattgctaatatcaagccttctgatgatcctcaggtagtaaccgatgcagtgtgcgaagctatcggagcagactctttagggtttgtatctgtagatgagatggttgaggcaacgcaccaacctatcaattccttgtgtaccgcttgctttgatggcaactacgaactcggacttccgaccgctaaccccaatgctgacgctgtgcgaactttgctcagccaaaagaactga

SEQ ID NO: 30554 - protein, 490 aa, Corynebacterium ammoniagenes
MNLDDQGEQEPREECGVFGVWAPGEDVATLTYFGLFALQHRGQEAAGIGVGDGDRLVVFKDMGLVSNIFDESILNSLHGSVGVGHTRYSTAGGKEWSNVQPMFNTTSNGVDIALCHNGNLVNYQELRDEAVALGLYRENEKSLSDSMIMTALLAHGVGEGNSVFDAAKQLLPSIKGAFCLTFTDGKTLYAARDPHGVRPLVIGRLAQGWVVASETCALDIVGAQFIREVEPGELISVNEAGIHSEKFAEPKRQGCVFEYVYLARPDTVIKGRNVHATRVDIGRALAKSHPAPEADMVIPVPESGNPAAVGYARESGLTFAHGLVKNAYVGRTFIQPTQTLRQLGIRLKLNPLREVIEGKSLVVVDDSIVRGNTQRALVRMLREAGAAEVHVRIASPPVKWPCFYGIDFASPGELIANIKPSDDPQVVTDAVCEAIGADSLGFVSVDEMVEATHQPINSLCTACFDGNYELGLPTANPNADAVRTLLSQKN

SEQ ID NO: 30555 - DNA, 1521 bp, Lactococcus lactis
  CDS (1)..(1521): transl_table=11
atgtctgatgaaatgacaagcgcaacatttactgaacaagagtggtcgcattttgagaaaaaaagtttgaatcaaactgaagccgatgagctccgcgactggtcgcggtttgaagcgaagacattaaatgaagaatgtggacttttcggcgtttggggacatcctgatgccgctcgtctaacctattttggtcttcacgctttgcaacatcgcgggcaagaaggcgcaggaattctggtcaataacaacggcaagctcaatcgtcatcgtggtttaggtttggtcaccgaagtttttcgtcacgaaaaagatttggaagaactgacaggttcatctgccattggtcatgtccgctatgcgacggctggctcggcaaatattaataatattcagccattccagtttgaatttcatgacggatcacttggacttgcccacaatggaaatttaactaacgctcaatccttgcgctgtgaacttgaaaaatctggagcaatattttctagtaattcagacacagaaatcctcatgcacttgattcgccgtagtcatcatccagaatttatgggcagagtcaaagaagcacttaatacggtcaaaggtggctttgcctatcttattatgactgaaaattcaattgtcgcagctcttgaccctaatggatttcggccactttcaatcggtaaaatgagcaacggtgcgcttgtcgtggcctcagaaacttgtgctttcgatgttgttggcgccacttggattcaagatgttcaacccggtgaaatcattgaaattaatgacgacggcattcatgtggaccaatttactgacagcaccaacatgactatttgttcaatggaatacatctatttcgctcgtcctgacagcaatatcgctggagttaatgttcatactgccagaaaacgttcaggaaaaattttagcccaagaagccaaaattgacgctgatattgtcattggtgtccctaattcatcactcagtgccgcttcaggctacgctgaagaatcgggcttgccttacgaaatggggctgattaaaaatcaatatgtggcaagaactttcattcaaccgactcaagaacttcgtgaacaaggcgttcgcatgaaattgagtgctgttcgaggtgttgtagaaggaaaacgtgtcatcatggttgatgacagcattgtgcgtggaacgaccagccgtcgcattgtcaaactcctcaaagatgcaggcgcagccgaggttcatgtggcaatcgccagtcccgctctcaaatatccttgcttttacggcattgacatccaagatcgtgacgaactcatcgcagccacacacacgactgatgaaatcagagaagctatcggagcggatagtctgacctatctcagccagtcagggcttgtcgaggcgatcggtcacgataaactttgcttgtcatattttgacggcgaatatccaacaccgctttatgattatgaagcagactatttggaatctttggcaaaaaatggtctgaaataa

SEQ ID NO: 30556 - protein, 506 aa, Lactococcus lactis
MSDEMTSATFTEQEWSHFEKKSLNQTEADELRDWSRFEAKTLNEECGLFGVWGHPDAARLTYFGLHALQHRGQEGAGILVNNNGKLNRHRGLGLVTEVFRHEKDLEELTGSSAIGHVRYATAGSANINNIQPFQFEFHDGSLGLAHNGNLTNAQSLRCELEKSGAIFSSNSDTEILMHLIRRSHHPEFMGRVKEALNTVKGGFAYLIMTENSIVAALDPNGFRPLSIGKMSNGALVVASETCAFDVVGATWIQDVQPGEIIEINDDGIHVDQFTDSTNMTICSMEYIYFARPDSNIAGVNVHTARKRSGKILAQEAKIDADIVIGVPNSSLSAASGYAEESGLPYEMGLIKNQYVARTFIQPTQELREQGVRMKLSAVRGVVEGKRVIMVDDSIVRGTTSRRIVKLLKDAGAAEVHVAIASPALKYPCFYGIDIQDRDELIAATHTTDEIREAIGADSLTYLSQSGLVEAIGHDKLCLSYFDGEYPTPLYDYEADYLESLAKNGLK

SEQ ID NO: 30557 - DNA, 1374 bp, Archaeoglobus fulgidus; identical to SEQ ID NO: 30165
  CDS (1)..(1374)

SEQ ID NO: 30558 - protein, 457 aa, Archaeoglobus fulgidus; identical to SEQ ID NO: 30166

SEQ ID NO: 30559 - DNA, 1431 bp, Bacillus subtilis
  CDS (1)..(1431): transl_table=11
atgcttgctgaaatcaaaggcttaaatgaagaatgcggcgtttttgggatttggggacatgaagaagccccgcaaatcacgtattacggtctccacagccttcagcaccgaggacaggagggtgctggcatcgtagcgactgacggtgaaaagctgacggctcacaaaggccaaggtctgatcactgaagtatttcaaaacggcgaactcagcaaagtaaagggaaaaggcgctatcgggcacgttcggtacgcaacggctggaggcggcggatacgaaaatgttcagccgctcctcttccgttcccaaaacaacggcagcctggcgcttgctcataacggaaatcttgtcaacgccactcagctgaagcagcagctcgaaaatcaagggagcatctttcaaacctcttcggatacagaggttttggctcacctgatcaaaagaagcggacacttcacgctgaaggatcaaattaaaaactcgctttctatgctgaaaggcgcctacgcgttcctgatcatgaccgaaacagaaatgattgtcgcacttgatccaaacgggctgagaccgctatccatcggcatgatgggcgacgcttatgtggtcgcatcagaaacatgcgcatttgacgtcgtcggcgcaacgtaccttcgcgaggtagagccgggagaaatgctgatcattaatgatgaaggcatgaaatcagagcgtttttccatgaatatcaatcgttccatttgcagcatggagtacatttatttctccagaccagacagcaatattgacggtattaatgtgcacagtgcccgtaaaaaccttgggaaaatgctggctcaggaatccgcagttgaagctgacgtcgtaaccggggttccggattccagtatttcagcggcgatcggctatgcagaggcaacaggcattccgtatgagcttggcttaatcaaaaaccgttatgttggcagaacgtttattcagccgtcccaggctctgcgtgagcaaggcgtcagaatgaagctgtctgcggtgcgcggggttgtagaaggcaaacgcgtcgtgatggtggatgactctatcgtgcgaggaacaactagccgccggattgtcacgatgctaagagaggcgggtgcgacagaggtgcatgtgaaaatcagttcaccgccgatcgctcatccgtgcttttacggcattgacacttccacacatgaagaactgatcgcgtcttcgcattctgtcggagaaatccgtcaggaaatcggagccgataccctctcatttttgagtgtggaagggctgctgaaaggcatcggcagaaaatacgatgactcgaattgcggacagtgtctcgcttgctttacaggaaaatatccgactgaaatttaccaggatacagtgcttcctcacgtaaaagaagcagtattaaccaaataa

SEQ ID NO: 30560 - protein, 476 aa, Bacillus subtilis
MLAEIKGLNEECGVFGIWGHEEAPQITYYGLHSLQHRGQEGAGIVATDGEKLTAHKGQGLITEVFQNGELSKVKGKGAIGHVRYATAGGGGYENVQPLLFRSQNNGSLALAHNGNLVNATQLKQQLENQGSIFQTSSDTEVLAHLIKRSGHFTLKDQIKNSLSMLKGAYAFLIMTETEMIVALDPNGLRPLSIGMMGDAYVVASETCAFDVVGATYLREVEPGEMLIINDEGMKSERFSMNINRSICSMEYIYFSRPDSNIDGINVHSARKNLGKMLAQESAVEADVVTGVPDSSISAAIGYAEATGIPYELGLIKNRYVGRTFIQPSQALREQGVRMKLSAVRGVVEGKRVVMVDDSIVRGTTSRRIVTMLREAGATEVHVKISSPPIAHPCFYGIDTSTHEELIASSHSVGEIRQEIGADTLSFLSVEGLLKGIGRKYDDSNCGQCLACFTGKYPTEIYQDTVLPHVKEAVLTK

SEQ ID NO: 30561 - DNA, 1533 bp, Gallus gallus
  CDS (1)..(1533)
atggagctggaggagctgggcatccgcgaagagtgcggcgtgttcggctgcatcgccgccggcgtgtggcccaccgagctggacgtgccccatgtgatcacgctggggctcgtggggctgcagcacaggggccaggagagtgctggaattgtgacaagtgatggagagtcatcccaggcattcaaagtgcacaagggaatgggtcttataaatcacgtgttcaatgcagacagcctgaagaagctgtatgtttcaaaccttggtatcgggcacaccaggtactctacctcggggatctctgagctgcagaactgccagcctttcgttgtagaaactcttcatggaaagatagctgtggcacacaatggggaactaacaaacgctgtacgactgaggaggaagcttatgcggcatggtgtaggattgtcaaccagttctgacagtgaattgatcacccagctgctggctttcacacctcctctagaaaatgacgacactgctgactgggtagcaagaattaaaaatttaatgaacgaaactccaacttcatactcattgctaattatgcacaaagacataatctatgcagtacgtgatccatatgggaatcgcccactctgcattggtcgccttattccagtaggggacataaatggaaaaggaaaagataacagtgagacagaaggatgggtggtctcttctgaatcctgtagctttttatctattggtgccgagtactatcgtgaggtacttcctggagagattgtgaaaatatccaggtatgatgtccaaacattggatgttgtaccaagaccagaaggagatccatcagcattctgcatcttcgaatatgtttattttgcaagaccagacagtatctttgaaggtcaaatggtgtattcagtcaggaggagatgtggccagcaacttgctattgaagcacctgtggaggcagacctggtcagcactgttccagagtctgcaaccccagcagctctgggttacgctcaaaagtgtggactgccatacgttgaagtactctgtaaaaatcgctatgtaggaagaacttttatccagccaaatatgaggttacggcaacttggtgttgcaaagaagtttggtgttctatctgacaattttaaaggcaaacgagttgttatcattgatgattcaattgtgaggggcaatactatttctcccataataaaactactaagggaatcaggagctaaagaggtgcatattcgtgtggcttcacctcccataagatttccatgttatatgggaataaacattccaacaaaagaagaacttattgccaacagacccgaatttcatgatcttgcgaactatataggggccgacagtgttgtttatctttctgtggaagggctcgtatcgtctgtgcaagaaagcatcaaagcaagaaaagagaacgagaacagccttaagacccagaaatcgcgtgttggaaagattggtcattgcacagcatgtctcactggagattatcctgtagagctagaatggtga

SEQ ID NO: 30562 - protein, 510 aa, Gallus gallus
MELEELGIREECGVFGCIAAGVWPTELDVPHVITLGLVGLQHRGQESAGIVTSDGESSQAFKVHKGMGLINHVFNADSLKKLYVSNLGIGHTRYSTSGISELQNCQPFVVETLHGKIAVAHNGELTNAVRLRRKLMRHGVGLSTSSDSELITQLLAFTPPLENDDTADWVARIKNLMNETPTSYSLLIMHKDIIYAVRDPYGNRPLCIGRLIPVGDINGKGKDNSETEGWVVSSESCSFLSIGAEYYREVLPGEIVKISRYDVQTLDVVPRPEGDPSAFCIFEYVYFARPDSIFEGQMVYSVRRRCGQQLAIEAPVEADLVSTVPESATPAALGYAQKCGLPYVEVLCKNRYVGRTFIQPNMRLRQLGVAKKFGVLSDNFKGKRVVIIDDSIVRGNTISPIIKLLRESGAKEVHIRVASPPIRFPCYMGINIPTKEELIANRPEFHDLANYIGADSVVYLSVEGLVSSVQESIKARKENENSLKTQKSRVGKIGHCTACLTGDYPVELEW

SEQ ID NO: 30563 - DNA, 1641 bp, Drosophila melanogaster
  CDS (1)..(1641)
atgtcagcgccacagcaacaacaacagtcgcagcagaagcaacaacaacatgtgcgcgtggtcgagcaacaacaggtggaaccagctgaggcggtgacctccagcatggaatcggaatccatctcggccagcaaggagctaaccggtttgacgcacgagtgcggcgttttcggggcaatcgcttgcggagattggcccacccaaatggacattgcacacgtgatctgtttggggctggtggcactgcagcatcgtgggcaggagtctgcgggcatagcgaccagcgagggaaagtgctccaagaacttcaacgtgcacaagggcatgggtatgatcagcaccctgttcaacgacgactccatgaagaagcttcgtggcaacctgggcatcggtcatacacgctactcgaccgctggcggatccggagtggttaactgtcagccctttgaggtacatacgacacatggagcattggccctggcccacaatggtgagcttgttaacaacgaatctctaagaagggaggttttggccagaggcgtgggcttatccacgcacagcgacagtgagttgatcgcccagtcgttgtgctgcgccccggaggatgtttccgaactggatggacccaactggccagctaggatcaggcatttcatgatgctggcgccactctcctactcgctggtcatcatgctaaaggacaaaatctacgccgtgagggacacctatggaaataggccgctatgcattggcaagatagtgcccatcaatgctgggcacggaaataacttagacacacctgccgatggttgggtggtgtccagtgagagctgtggcttcctgtcgatcggtgccagatacgtccgcgaagtggagcctggagagatagtggagctgtcgcgaagtggctaccgcacggtggacattgtggaaagacccgacttcaagcgcatggccttttgtatatttgagtacgtttacttcgcccgcggagacagcatcttcgagggtcagatggtgtacacagtgaggctgcagtgcggccggcagctgtggcgagaggctccagtggaggcggatattgtgagttccgttcccgagtctggcacagcggcggcgcatggctatgcccgtgagtctggcattgaatttgccgaggttctctgcaggaatcgctacgtgggacggacgtttattcaaccctctacccggctgcggcagttgggagtagccaagaagttcggagccctatccgagaacgtggctggcaagagattggtcctgatagacgattccattgtgcgcggcaacaccattggaccaataatcaagctgctacgggatgcaggcgcccgggaggtgcacatccgcattgccagcccaccgctgcagtacccatgctatatgggtataaatattccaactcgagaggaattgattgccaacaagctgaaccccgaccaactagctaggcatgtgggcgccgacagtctggcttatcttagtgtggagggactagtggaggctgtccaactaaagcaccgcgatgcaggcgatagtaaatccaagggaacgggccactgcaccgcctgtctcactggtgaatatcccggtgggctgcccgatgagttgagctggtga

SEQ ID NO: 30564 - protein, 546 aa, Drosophila melanogaster
MSAPQQQQQSQQKQQQHVRVVEQQQVEPAEAVTSSMESESISASKELTGLTHECGVFGAIACGDWPTQMDIAHVICLGLVALQHRGQESAGIATSEGKCSKNFNVHKGMGMISTLFNDDSMKKLRGNLGIGHTRYSTAGGSGVVNCQPFEVHTTHGALALAHNGELVNNESLRREVLARGVGLSTHSDSELIAQSLCCAPEDVSELDGPNWPARIRHFMMLAPLSYSLVIMLKDKIYAVRDTYGNRPLCIGKIVPINAGHGNNLDTPADGWVVSSESCGFLSIGARYVREVEPGEIVELSRSGYRTVDIVERPDFKRMAFCIFEYVYFARGDSIFEGQMVYTVRLQCGRQLWREAPVEADIVSSVPESGTAAAHGYARESGIEFAEVLCRNRYVGRTFIQPSTRLRQLGVAKKFGALSENVAGKRLVLIDDSIVRGNTIGPIIKLLRDAGAREVHIRIASPPLQYPCYMGINIPTREELIANKLNPDQLARHVGADSLAYLSVEGLVEAVQLKHRDAGDSKSKGTGHCTACLTGEYPGGLPDELSW

SEQ ID NO: 30565 - DNA, 1518 bp, Haemophilus influenzae; identical to SEQ ID NO: 30219
  CDS (1)..(1518)

SEQ ID NO: 30566 - protein, 505 aa, Haemophilus influenzae; identical to SEQ ID NO: 30220

SEQ ID NO: 30567 - DNA, 1554 bp, Homo sapiens
  CDS (1)..(1554)
atggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttccgtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctattggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtacacattcgagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtag

SEQ ID NO: 30568 - protein, 517 aa, Homo sapiens
MELEELGIREECGVFGCIASGEWPTQLDVPHVITLGLVGLQHRGQESAGIVTSDGSSVPTFKSHKGMGLVNHVFTEDNLKKLYVSNLGIGHTRYATTGKCELENCQPFVVETLHGKIAVAHNGELVNAARLRKKLLRHGIGLSTSSDSEMITQLLAYTPPQEQDDTPDWVARIKNLMKEAPTAYSLLIMHRDVIYAVRDPYGNRPLCIGRLIPVSDINDKEKKTSETEGWVVSSESCSFLSIGARYYREVLPGEIVEISRHNVQTLDIISRSEGNPVAFCIFEYVYFARPDSMFEDQMVYTVRYRCGQQLAIEAPVDADLVSTVPESATPAALAYAGKCGLPYVEVLCKNRYVGRTFIQPNMRLRQLGVAKKFGVLSDNFKGKRIVLVDDSIVRGNTISPIIKLLKESGAKEVHIRVASPPIKYPCFMGINIPTKEELIANKPEFDHLAEYLGANSVVYLSVEGLVSSVQEGIKFKKQKEKKHDIMIQENGNGLECFEKSGHCTACLTGKYPVELEW

SEQ ID NO: 30569 - DNA, 1416 bp, Methanococcus jannaschii; identical to SEQ ID NO: 30185
  CDS (1)..(1416)

SEQ ID NO: 30570 - protein, 471 aa, Methanococcus jannaschii; identical to SEQ ID NO: 30186

SEQ ID NO: 30571 - DNA, 1425 bp, Methanobacterium thermoautotrophicum
  CDS (1)..(1425): transl_table=11
ttgttgggagaatctgaagtgagagataaatgcggtattgtagggatttactcacaggataagaaaaccggtgtggcctcccagatatattatgcgctctacgcactgcagcacaggggacaggagtctgcagggatctcaacattcaatgggaacgatatactgacacacaggggaatggggctggtctgcgacgtcttcaatcctgagaagctagaggaacttaaggggaacgtcgggataggacacgtgcgctactcaaccacaggcgaatcaaggattgagaattctcagccattctggagcgaatttcagggaggtaaaattgcaatagcccacaatggagacatcataaactccatggaactccgggaggaactcgaggaggagggtcacaactttgtctcaacgacggactcagaggtcatctgccacctcctcagcagggaatacgatgagaaaccgaacatgatatactccataaagagggtttcagagcagctggtgggatcatattccctggtggtgcttctgaaccaggacctctatgtcgtcagggaccctgtgggtataaaaccactggcctttgcaaggaagggcagcacccagatcgtggcctcggagaccgtggcctttgatgtcataggtgccgagcatgtaagggacgtccagcccggtgagatactccacctgaaccggggcaaatcctactgggttgcaaacgcccccaacaccaggagggcccactgcatgtttgagtacgtctacttcgcaaggccggacagtgtaatcgacgggcgcaacgtatacagggtccgcctcaatattggggaggccctctacagggagcacccggccaacgcagacgtggttgtacccgtacctgactcatccatcccggcggccataggatactcaagggcctcagggataccctacggtgagggcctgataaagaacaggtacgtgggtcgtacatttataatgccgacccaggaggaacgtgaaacagcggttaaactcaagatgaaccccataaggtccgaacttgagggtaaacgcatagtactcatcgatgacagtatagtgagggggacaacctcaagggcactcattgacatcataagggatgccggggcagaggagatacatctgaggataggctgcccacccataaagtccccgtgctactatggcatagcaatggcaacgaagaaggagctcatagcatccaccaggaacgttgaggagataaggaggataataggtgttgattccctgggctacctcagcatcgagtccctggtggagtgcataggtataaagaagggattcctgtgcacgggatgccttgacggggactaccccacacccctaccatctgacataagtgaatatgaggccatgaggtcctgctccagatga

SEQ ID NO: 30572 - protein, 474 aa, Methanobacterium thermoautotrophicum
MLGESEVRDKCGIVGIYSQDKKTGVASQIYYALYALQHRGQESAGISTFNGNDILTHRGMGLVCDVFNPEKLEELKGNVGIGHVRYSTTGESRIENSQPFWSEFQGGKIAIAHNGDIINSMELREELEEEGHNFVSTTDSEVICHLLSREYDEKPNMIYSIKRVSEQLVGSYSLVVLLNQDLYVVRDPVGIKPLAFARKGSTQIVASETVAFDVIGAEHVRDVQPGEILHLNRGKSYWVANAPNTRRAHCMFEYVYFARPDSVIDGRNVYRVRLNIGEALYREHPANADVVVPVPDSSIPAAIGYSRASGIPYGEGLIKNRYVGRTFIMPTQEERETAVKLKMNPIRSELEGKRIVLIDDSIVRGTTSRALIDIIRDAGAEEIHLRIGCPPIKSPCYYGIAMATKKELIASTRNVEEIRRIIGVDSLGYLSIESLVECIGIKKGFLCTGCLDGDYPTPLPSDISEYEAMRSCSR

SEQ ID NO: 30573 - DNA, 1584 bp, Mycobacterium bovis
  CDS (1)..(1584): transl_table=11
gtggccgtagactcggattacgtcaccgaccgcgccgcagggagccgccaaaccgtgaccggccagcaacccgagcaagacctgaactcgccccgggaagagtgcggtgtcttcggggtctgggccccgggtgaagacgtcgccaaactcacctactacggcctgtacgcgttgcagcatcgcggccaggaagccgccgggatcgccgtcgccgacggctcccaggtgctggtcttcaaagacctcggcctggtcagccaggtgttcgacgagcagacgttggcggccatgcagggccatgtcgccatcgggcactgtcgttactccaccaccggggacacgacgtgggagaacgcccagcccgtgttccgcaacaccgccgctggcaccggtgttgcgttgggccacaacggaaatctggtcaatgccgctgcccttgccgcccgcgcccgcgacgcggggttgatcgccacccgctgcccagccccggcgacgacggactccgacattctgggggcgctgctggcccacggtgctgccgattccaccctcgaacaggcggcgctggacctgctgcccacagtgcggggagcgttctgtctgacgttcatggacgaaaacacgctttatgcgtgccgcgacccgtacggggtgcgcccgctatcgctcgggcgtttggaccgtggctgggtggtggcctccgaaacggccgcactcgacatcgtcggcgcctcgttcgtccgtgatatcgaaccgggcgaattgctggctatcgacgccgacggggtgcggtccacccgctttgccaaccccacgcccaagggctgcgtattcgaatacgtctacctggcgcggccggacagtacgatcgccggccggtcggtacacgccgcgcgggtggagatcggtcgccgactggctcgggaatgcccggtcgaggccgacttggtgattggtgtgccggaatccggcacacccgccgcggtcggctacgcgcaggagtccggcgttccatatgggcagggtctgatgaagaacgcctatgtcgggcgcaccttcatccagccgtcacagaccatccgtcagctcggcatccggctgaagctcaacccgctcaaagaggtgatccgcggcaagcggctcatcgtcgtcgacgactcgatcgtgcggggcaacacccagcgtgcgctggtacgcatgctgcgcgaggccggtgcggtcgaattgcatgtgcgcatcgcctcgccaccggtgaagtggccgtgcttctacggtatcgacttcccctcgccggccgagttgatcgccaacgccgtggaaaacgaggacgagatgctggaggcggtacggcatgccatcggggccgacacgctgggatacatctcgctgcggggcatggtggcggcgtccgagcagcccacgtcgcggctgtgcaccgcctgcttcgacggcaagtatccaatagagctgccccgcgagaccgcgctaggcaaaaatgtcatcgagcacatgctcgccaatgcggcccgcggagccgcgctgggcgaactcgccgccgacgacgaagtccccgttgggcgctga

SEQ ID NO: 30574 - protein, 527 aa, Mycobacterium bovis
MAVDSDYVTDRAAGSRQTVTGQQPEQDLNSPREECGVFGVWAPGEDVAKLTYYGLYALQHRGQEAAGIAVADGSQVLVFKDLGLVSQVFDEQTLAAMQGHVAIGHCRYSTTGDTTWENAQPVFRNTAAGTGVALGHNGNLVNAAALAARARDAGLIATRCPAPATTDSDILGALLAHGAADSTLEQAALDLLPTVRGAFCLTFMDENTLYACRDPYGVRPLSLGRLDRGWVVASETAALDIVGASFVRDIEPGELLAIDADGVRSTRFANPTPKGCVFEYVYLARPDSTIAGRSVHAARVEIGRRLARECPVEADLVIGVPESGTPAAVGYAQESGVPYGQGLMKNAYVGRTFIQPSQTIRQLGIRLKLNPLKEVIRGKRLIVVDDSIVRGNTQRALVRMLREAGAVELHVRIASPPVKWPCFYGIDFPSPAELIANAVENEDEMLEAVRHAIGADTLGYISLRGMVAASEQPTSRLCTACFDGKYPIELPRETALGKNVIEHMLANAARGAALGELAADDEVPVGR

SEQ ID NO: 30575 - DNA, 1671 bp, Mycobacterium leprae
  CDS (1)..(1671): transl_table=11
gtgtgtttggctgtcggggtaggtgtccgggcacctaaacacgtgccacagattcgtcgactgggccgtgctggccgtagactccgttgcgtcaccaactgcgccctagggagctgcccaatcgtgaccgtccagcaacccgggcgggatttcagctcgccccgcgaagagtgcggtgtgttcggggtctgggctccgggtgaactagtcgccaaactcacttatttcggtctatacgcgttgcagcatcgcggccaggaagctgcggggatcgctgtcgctgatggatcgcaggtgttggtcttcaaagaccttggcttagttagtcaagtgttcgacgagcagacattggcggcgatggagggtcacgttgccatcggtcattgccgctactccaccaccggcgacaccacctgggaaaatgcccagcctgttttccgcaacatcgctgccggatccggggttgcgttggggcacaacggaaacctggtcaacactgccgagcttgccgcacgtgcccgcgacgcggggttgatagcaaaacgctgcccggccccagcgacaacggactccgacatcctgggcgcgctgttagcccacggtgcggccgactcgaccctggaacaggctgcgctggaactgctgccgaccgtgcggggtgcgttctgcctgacattcatggacgaaaacaccctctatgcctgccgggacccgtatggagtacggccgctgtcgctcggacgactggatcgcggctgggtggtggcttctgaaacggcggggctcgacattgtcggcgcctcgtttgtccgcgacatcgagccgggcgaattgctggcgatcgacgccgacggagtacggtccactcgtttcgccaaccctacgcccaagggttgtgtttttgagtacgtttacctggcacggcccgacagcacgctggccggacggtcggtgcacggcactcgggtggagatcggtcgtcgacttgcccgcgaatgcccggtcgaggccgacttggtgatcggtgtgcccgaatcaggcactcccgccgcagtgggatacgcgcaggaatccggcatctcttacgggcagggtctgatgaagaatgcatatgttggacgcacattcatccaaccgtcgcaaaccatccgtcaactgggcatccggctgaagctcaatccgcttaaagaggtaatccgcggcaagcggctgattgttgtcgacgactcggttgtgcgggggaacacccaacgcgctctggtgcggatgctgcgcgaggccggtgccgtcgagctgcacgtgcgcatcgcttcaccaccggtgaagtggccctgtttttacggcatcgacttcccatcgccggccgaattgatcgctaacgtcgtcgcagacgaggaggagatgctcgaggcggtacggcagggcatcggtgccgacacactgggctacatctcgctgcggggcatgattgcggcttccgagcagcccgcttcgcggctgtgttacgcttgctttgacggtaggtatccgatcgagctgcccagtgaagccatgttaggcaaaaatgtcatcgagcacatgcttgccaatgcggcgcgtggagccgggctacgcgatcttgctgctgatcaggtcccagtcgatgcggacgaaaattgcgtttggcgttga

SEQ ID NO: 30576 - protein, 556 aa, Mycobacterium leprae
MCLAVGVGVRAPKHVPQIRRLGRAGRRLRCVTNCALGSCPIVTVQQPGRDFSSPREECGVFGVWAPGELVAKLTYFGLYALQHRGQEAAGIAVADGSQVLVFKDLGLVSQVFDEQTLAAMEGHVAIGHCRYSTTGDTTWENAQPVFRNIAAGSGVALGHNGNLVNTAELAARARDAGLIAKRCPAPATTDSDILGALLAHGAADSTLEQAALELLPTVRGAFCLTFMDENTLYACRDPYGVRPLSLGRLDRGWVVASETAGLDIVGASFVRDIEPGELLAIDADGVRSTRFANPTPKGCVFEYVYLARPDSTLAGRSVHGTRVEIGRRLARECPVEADLVIGVPESGTPAAVGYAQESGISYGQGLMKNAYVGRTFIQPSQTIRQLGIRLKLNPLKEVIRGKRLIVVDDSVVRGNTQRALVRMLREAGAVELHVRIASPPVKWPCFYGIDFPSPAELIANVVADEEEMLEAVRQGIGADTLGYISLRGMIAASEQPASRLCYACFDGRYPIELPSEAMLGKNVIEHMLANAARGAGLRDLAADQVPVDADENCVWR

SEQ ID NO: 30577 - DNA, 1344 bp, Pyrococcus abyssi
  CDS (1)..(1344): transl_table=11
atggcaaaggtgagagggatgagagagaagtgcgggatattcggtgtaagctctgaggatgccgttaggaagacgtattatggcttaatagccctacaacataggggtcaagaaggagctggaataagcgtttggaatggtagaataagaacgataaaaggacatggtctcgtctctgaagttttcgacgagaactccttgaaccttgcaagtaacattgcgataggccacgttaggtactcgacgtccggctctctaagtgaagttcaaccgttggaagttaggtgttgtgggtacgagcttgctatagcccacaatggaaccttgacgaatttcatacccctcaggagattatacgagggtatgggaattaagttccattcctcagtagataccgaggtgattgggatatccttccttaaccactatagtcaagtgaaagatgagtttgaggccatgaggagggtcttcgaggaggttaaaggggcttactcaatattaatcctcttcgacggaaagataatagcggcaagggatccagtcggctttaggcccttggtctttggggagggcgatggatactattttgcctcggaggattccgccctaaggatgtttgggctggaaacaagggatgttcttcctggggaggtcttcgtaatcgatggagaaagctatgagagtaaagttcttgccagggagaaacatgcctactgcgtttttgaatacatctacttcgcaagaccagatagcacgttgaacgggataaacgtttactgtgcccgctataggatgggggttgagctcgccagggaaagtccagctgaaggagacgttgtgattgcggttccagattctgggagaacggccgctttaggatttgcccacgaaagtggaatcccttatatggaaggcctaataaagaaccgctacatagggaggactttcataatgccaagcggcagagggttgaaagttaagctcaagctgtctccagttagggaagtagtgaatggtaaaagggtagttctggttgatgattccatagttaggggaactaccatgacgaggatagtcaagatgcttagggatgcaggggccagggaagtccacgttaggatagcctccccaccaataagatacccatgctacatggggatagacatacctacccggcacgagcttatagctgcctggaggagcattgaggatattaggaaggagattggggcagattcattggcttacctcagcatagagggtcttaagagggccgttggaacgaaaaacctatgcatggcatgcttaactggtgaatatcctgagtgggcattcaacttttaa

SEQ ID NO: 30578 - protein, 447 aa, Pyrococcus abyssi
MAKVRGMREKCGIFGVSSEDAVRKTYYGLIALQHRGQEGAGISVWNGRIRTIKGHGLVSEVFDENSLNLASNIAIGHVRYSTSGSLSEVQPLEVRCCGYELAIAHNGTLTNFIPLRRLYEGMGIKFHSSVDTEVIGISFLNHYSQVKDEFEAMRRVFEEVKGAYSILILFDGKIIAARDPVGFRPLVFGEGDGYYFASEDSALRMFGLETRDVLPGEVFVIDGESYESKVLAREKHAYCVFEYIYFARPDSTLNGINVYCARYRMGVELARESPAEGDVVIAVPDSGRTAALGFAHESGIPYMEGLIKNRYIGRTFIMPSGRGLKVKLKLSPVREVVNGKRVVLVDDSIVRGTTMTRIVKMLRDAGAREVHVRIASPPIRYPCYMGIDIPTRHELIAAWRSIEDIRKEIGADSLAYLSIEGLKRAVGTKNLCMACLTGEYPEWAFNF

SEQ ID NO: 30579 - DNA, 1350 bp, Pyrococcus horikoshii
  CDS (1)..(1350): transl_table=11
atgagaggtgaaatcatgaaagagaagtgtgggatctttggggcttattcccaggatgcaactaaaaagacttattatggcctaatggccctccaacacagggggcaagaaggggctggaattagtgtctgggatggggatataagaacggttaaaggtcatgggcttgtttccgaagtctttaaggggggcagtattcggaggttaaatggtaatcccgtgatagggcacgttaggtactcaacatcgggttccctttcagaagtccaaccgctggaggttgaatgttgtgggtataaggtatctatagctcataacggcacgcttacaaattttcttcccctaaggaggttttatgaaagtagaggatttaaatttcgctcttccatcgatacggaagttatagcggtctcttttttaaatcattactctgagctgaaggatgaatttgaagccatgagtagagtttttgaagaagttaaaggggcttattcagttttaatgttgttcaatggaaagcttatagccgttagggatcctgtgggttttaggcctctgagttttggagctggggatggatattacttctcttccgaggattctgctctcaggatgttctgtactaacataagggatgtatctcccggtgaggttattgtagttaaggatggggaagcagagagtaagatagttggaagatccgagcatgcatattgcgtcttcgagtatatatactttgcaagacctgatagcattataaacggaataagcgtttactgggctcgctatagaatgggagttgaattggctagggaaagtccagctgagggagatgtggtaatagctgttcccgattcagggagaactgcagctttgggttttgctcacgagagtgggatcccctacatggaggggcttataaagaatcgctatatcgggagaaccttcataatgccaagtgggcgagaaatcaaggttaggttaaagctctccccagttaaagaagtcattaagggaaggaggatagttcttgttgatgattcaatagtaaggggaacaacgatgaagaacattgtgaagatgcttagagatgcgggggctagggaagtgcacgtgagaatagcatctcccccgataaggtatccatgctatatggggatagacattccgacaagacatgagcttatagcagcttggaagagtattgaggagataaagaaagagattggagctgattctctagcctacctaagtgtagaggggcttaagagggctatagggactgataagctttgcatggcatgtttaactggaaactatccagagtgggcttttgactttaaggtttag

SEQ ID NO: 30580 - protein, 449 aa, Pyrococcus horikoshii
MRGEIMKEKCGIFGAYSQDATKKTYYGLMALQHRGQEGAGISVWDGDIRTVKGHGLVSEVFKGGSIRRLNGNPVIGHVRYSTSGSLSEVQPLEVECCGYKVSIAHNGTLTNFLPLRRFYESRGFKFRSSIDTEVIAVSFLNHYSELKDEFEAMSRVFEEVKGAYSVLMLFNGKLIAVRDPVGFRPLSFGAGDGYYFSSEDSALRMFCTNIRDVSPGEVIVVKDGEAESKIVGRSEHAYCVFEYIYFARPDSIINGISVYWARYRMGVELARESPAEGDVVIAVPDSGRTAALGFAHESGIPYMEGLIKNRYIGRTFIMPSGREIKVRLKLSPVKEVIKGRRIVLVDDSIVRGTTMKNIVKMLRDAGAREVHVRIASPPIRYPCYMGIDIPTRHELIAAWKSIEEIKKEIGADSLAYLSVEGLKRAIGTDKLCMACLTGNYPEWAFDFKV

SEQ ID NO: 30581 - DNA, 1554 bp, Rattus norvegicus
  CDS (1)..(1554)
atggaactggaggagtcggggatccgtgaggaatgtggtgtgttcgggtgcatcgcttctggagactggcccacgcagctagatgtgccacatgtgatcactctgggactcgtggggcttcagcaccgaggtcaggagagcgctggtattgtgaccagtgatgggagttcagtgcctaaattcagggtgcataagggaatgggccttgtaaatcatgtttttaccgaagacaatttgaagaaattgtatgtctcaaatcttggaatcggacatacgcggtacgccaccacagggaagtgtgagctggaaaattgccagccgtttgttgttgagactctgcatgggaaaatagctgtggcccataacggagagctggtgaacgcagctcggctgaggaagaagcttctgcggcatggtattgggctttccacatcctccgatagtgaaatgattacccagttactcgcatatacccctcctcaggaacaagatgatactccagactgggtagcaagaattaagaacttaatgaaggaagcgcccgcagcctactccctggtcataatgcacagggacgtcatttacgcagtgcgagatccatacggaaatcgtcctctatgcatcggccgtcttatgccagtttctgacataaatgacaaagagaaaaagtcttcagagactgaaggatgggtggtgtcctcagagtcttgcagctttttatctattggtgcgagatattgccatgaagtgaagcctggggaaattgtagaaatatccagacatggtgtcagaactcttgatataattccaaggtctaatggagacccagtggctttttgtatcttcgaatatgtttattttgcaagaccagatagtatgtttgaagaccagatggtttatacggtaaggtaccggtgtggccagcagctggcagttgaagcaccagtggaggcggacctggtcagcacagttccagaatctgccacgcctgcggccctggggtatgcgacaaagtgtgggctgccatatgtggaggtgctgtgtaagaaccggtatgtaggaagaaccttcattcagccaaacatgaggctaagacaacttggggttgcaaagaaattcggcgtgttgtctgacaactttaaaggcaaaagaattgttctcatagatgattccattgtgagaggcaatactatctcacccatcataaaactcctcaaagaatccggtgcaaaggaggtacacattcgagtcgcttcgccaccaataaaacatccgtgcttcatgggaataaacattcctacaaaagaagagcttatagccaataagcccgaatttgagtatcttgcagagtaccttggagcaaacagcgttgtgtatctgtcagtggaaggactagtttcgtctgtgcaacaagaaataaagttcaagaagcagaaagttaaaaagcgtgatatcacaattcaagaaaatggaaatggtctggagtattttgagaagacgggacactgtacggcttgcctcactggccagtaccctgtggatctggaatggtag

SEQ ID NO: 30582 - protein, 517 aa, Rattus norvegicus
MELEESGIREECGVFGCIASGDWPTQLDVPHVITLGLVGLQHRGQESAGIVTSDGSSVPKFRVHKGMGLVNHVFTEDNLKKLYVSNLGIGHTRYATTGKCELENCQPFVVETLHGKIAVAHNGELVNAARLRKKLLRHGIGLSTSSDSEMITQLLAYTPPQEQDDTPDWVARIKNLMKEAPAAYSLVIMHRDVIYAVRDPYGNRPLCIGRLMPVSDINDKEKKSSETEGWVVSSESCSFLSIGARYCHEVKPGEIVEISRHGVRTLDIIPRSNGDPVAFCIFEYVYFARPDSMFEDQMVYTVRYRCGQQLAVEAPVEADLVSTVPESATPAALGYATKCGLPYVEVLCKNRYVGRTFIQPNMRLRQLGVAKKFGVLSDNFKGKRIVLIDDSIVRGNTISPIIKLLKESGAKEVHIRVASPPIKHPCFMGINIPTKEELIANKPEFEYLAEYLGANSVVYLSVEGLVSSVQQEIKFKKQKVKKRDITIQENGNGLEYFEKTGHCTACLTGQYPVDLEW

SEQ ID NO: 30583 - DNA, 1497 bp, Rhizobium etli
  CDS (1)..(1497): transl_table=11
atgaaccagtcccattccttcccgaccgacgatccgctcgacggagatacgctgcatgaggaatgcggcgttttcggaatcctgggacatcccgatgccgcggctctcacggctctcggcctgcacgccctgcagcatcgtgggcaggaagcggccggcattgtctccttcgacggcaaacgcttctaccaggagcgccatatgggtctggtcggcgaccactataccaatccgatgacgctcgcccgcctgcccggcagcatctcaatcggccatactcgctattcgacgaccggcgaagtggcgatgcgcaacgtgcagccgctgtttgccgagttggaggaaggcggcatcgccattgcccataacggcaatttcaccaatggcctgacgctgcgccgccagatcatcgcaaccggcgccatctgtcagtcgacctccgataccgaagtcgtgctgcatctcatcgcccgctcgcgccacgcttccacgtccgaccggttcatcgacgccatccgccagatggaaggcggctattcgatgctcgccatgacccgcaccaagctgattgccgcgtcgcatcccaccggcatccgcccgcttgtcatgggcgaactcgacggcaagccgatcttctgctccgaaacctgtgcgctcgacatcattggcgccaaattcatccgcgacgtggaaaacggcgaggtcatcatctgcgaaatccagcccgacggctcgatcagcatcgatgcccgcaagcccagcaagccacagccggagcgtctctgcctgttcgaatatgtctatttcgcccgtccggattcggtcgtcggcggccgcaacgtttatacgacgcgcaagaacatgggcatgaacctcgccaaggaatcgcctgtcgatgccgatgtcgtcgtgccggtgccggatggcggcaccagtgcggctgggggctatgcgcaggaaagcggcatccccttcgaatacgaatacggaatcatccgcaaccattatgtcggacgcacctttatcgagccgacgcagcagatccgcgccttcggcgtcaagctgaagcattccgccaaccgggcgatgatcgaaggcaagcgcgtggtgctggtcgacgattccatcgtgcgcggcacgacgtcgctgaagatcgtgcagatgatccgcgaggctggtgcgcgcgaagtccatatccgtgtcgcaagcccgatgatcttcttccgggatttctacggatcgatacgcccgacgcccgacaaactgctcgccaatcaatatgccgacgtcgaagccatggccaaatatatcggcgcggattcgcttgccttcctgtcgatcaacggactttaccgcgccgtcggcggcgaggaccgcaatccggcccgcccgcagttcaccgaccactacttcaccggcgactatccaacccgcctgctcgacaagaacggcgagtcgatgggcaacaagctttcgatgcttgccagcaacggctga

SEQ ID NO: 30584 - protein, 498 aa, Rhizobium etli
MNQSHSFPTDDPLDGDTLHEECGVFGILGHPDAAALTALGLHALQHRGQEAAGIVSFDGKRFYQERHMGLVGDHYTNPMTLARLPGSISIGHTRYSTTGEVAMRNVQPLFAELEEGGIAIAHNGNFTNGLTLRRQIIATGAICQSTSDTEVVLHLIARSRHASTSDRFIDAIRQMEGGYSMLAMTRTKLIAASHPTGIRPLVMGELDGKPIFCSETCALDIIGAKFIRDVENGEVIICEIQPDGSISIDARKPSKPQPERLCLFEYVYFARPDSVVGGRNVYTTRKNMGMNLAKESPVDADVVVPVPDGGTSAAGGYAQESGIPFEYEYGIIRNHYVGRTFIEPTQQIRAFGVKLKHSANRAMIEGKRVVLVDDSIVRGTTSLKIVQMIREAGAREVHIRVASPMIFFRDFYGSIRPTPDKLLANQYADVEAMAKYIGADSLAFLSINGLYRAVGGEDRNPARPQFTDHYFTGDYPTRLLDKNGESMGNKLSMLASNG

SEQ ID NO: 30585 - DNA, 1533 bp, Saccharomyces kluyveri
  CDS (1)..(1533)
atgtgtggtattttaggtatcgctctagctgatcaatcaagtgttgttgccccagaattattcgatggctctttgttcctacaacatagaggccaagatgccgctggtatggctacatgtggtgaacgtggtagactatatcagtgcaagggtaacggtatggctcgtgatgtcttcacccaacatagaatgagtgggttggttgggtctatgggtatcgcccatttgcgttatccaactgctggttcctgtgctaactccgaagcccaacccttttatgtgaacagtccttacggtatctgtttaagtcacaacggtactttagtcaatacgttgtctctgaggagttatttggacgaggttgtccatagacacattaacacggacagtgattcggagctattactaaatgtattcgctgctgagttggagagacacaacaagtacagagttaacaatgacgatatattccatgctttggagggtgtttatcgccagtgtcgtggtgggtatgcctgtgtcggtatgctagctggttacagtttatttgggttcagagaccccaacggtatcagaccattgttatttggtgagagagtcaatccagatggtaccaaggattatatgttggcttcagagagcgttgttttgaaggcacataactttaacaaatttcgcgatttgaagcctggtgaagctgtcatcattcctaaggattgtaataaacaagagcccgaattcaggcaggtagtcccaaccaattcttacagaccagacttgtttgagtatgtttattttgccagaccggacagtgtgttagatggtatttctgtctaccacacaagattacaaatgggtatcaagctagcagaaaatgttaaaaaagttgtcgatccagatgaaattgatgttgtagtttctgttcctgatactgcacgtacttgtgccttgcaatgtgccaaccatctaaataaaccatatcgtgaagcattcgtcaaaaacagatatgttgggagaacctttattatgccgaaccaaaaagagcgtgtttcttccgttagacgtaaattgaatccaatggatttcgaatttaaggataagcgtgtcctgattgttgatgattccatcgtgagagggactacttctaaagaaattatcaacatggctaaagaatctggtgccaccaaggtgtacttcgcatctgctgctccagcaatccgctttaatcatatttacggtattgaccttgctgataccaaacagttagtcgcctacaataggaccactgacgaagttgcccaggagttaggttgtgaaaaggttatttatcaatccttggaagacctagtcgattgttgtaaaaccgataagattgacaaattcgaagttggtgtctttactggtaactacgtgaccggtgtagaggatggttatttacaagaattagaaagagttcgcgccctcaacaaggcaaaactaactacagcaaaggcagaggtggacattggattgtataatagtgccgattattaa

SEQ ID NO: 30586 - protein, 510 aa, Saccharomyces kluyveri
MCGILGIALADQSSVVAPELFDGSLFLQHRGQDAAGMATCGERGRLYQCKGNGMARDVFTQHRMSGLVGSMGIAHLRYPTAGSCANSEAQPFYVNSPYGICLSHNGTLVNTLSLRSYLDEVVHRHINTDSDSELLLNVFAAELERHNKYRVNNDDIFHALEGVYRQCRGGYACVGMLAGYSLFGFRDPNGIRPLLFGERVNPDGTKDYMLASESVVLKAHNFNKFRDLKPGEAVIIPKDCNKQEPEFRQVVPTNSYRPDLFEYVYFARPDSVLDGISVYHTRLQMGIKLAENVKKVVDPDEIDVVVSVPDTARTCALQCANHLNKPYREAFVKNRYVGRTFIMPNQKERVSSVRRKLNPMDFEFKDKRVLIVDDSIVRGTTSKEIINMAKESGATKVYFASAAPAIRFNHIYGIDLADTKQLVAYNRTTDEVAQELGCEKVIYQSLEDLVDCCKTDKIDKFEVGVFTGNYVTGVEDGYLQELERVRALNKAKLTTAKAEVDIGLYNSADY

SEQ ID NO: 30587 - DNA, 1602 bp, Schizosaccharomyces pombe
  CDS (1)..(1602)
atgtgcggaattttggcgttaatgcttgctgaccctcatcaacaggcatgtcctgaaatttatgagggtctttacagtttgcagcatcggggtcaagatgccgccggtattgtaaccgctggaaacaaaggtcgtctttaccaatgcaagggatccggcatggttgccgatgtttttagtcagcatcaacttcgccaactcgtaggtagtatgggtattggtcatttgcgctatcctactgctggaagttgtgctcactctgaagcacaacccttttatgttaactctccttatggtcttgtgttgggccataatggtaatttaattaatggacccgaattacgacgctttttggacactgaggcccatcgtcatgtaaacactggatctgattctgagcttttgcttaacatctttgcttacgagcttcaacggttggataaatttcgtataaacgaaaatgatattttcgaagctttgcgtaatgtatacgatcgcgttaatggtggttatgcatgtgttgctatgatcgcaggcttgggtgttttgggattccgtgatcccaatggcattcgtcctttagtgatcggtgaacgtgatacccccgaaggaaaggattacatgcttgctagtgagagtgttgtattgactcaatttggataccgtacattcagagatattcgccccggtgagtgtgtctttattcgtcgttccaatagggaagatatacttgcagggtttagaggccctcgcttgttttctcgtcaaatccttccctgcctaagatttactcccgatatatttgagtatgtctatttcgctcgtcccgactctgttattgacggattgtccgtataccaatcccgtttaaatatgggtgaaaagttagcgcatactataatgaaacggtttggtcccgattacatggaaaaaattgatgctgtcattcctgttccagattctgctcgaaccagtgcccttgcacttgcacagacagctcaactgccatacgtcgaagcttttattaaaaaccgatatattggtcgtaccttcattatgccaggtcaacagattcgtcgtaaatcggttcgtcgtaaattaaatgttcaacctcaagagttttttgataagaatgttttaattgtggatgacagtattgttcgtggtaccacctctcgtgagatcgttcaaatggctagggagtcgggtgcaaagaatgtctatttggctagttgcgctcctatgatcactcatcctcatgtctacggtattgatctcgctgattgtaaggatctcattgcttatggaaaaactgaggatgaggttgctgaagcaattagtgccgatggtgtcatttatcaaacattagaagatttattagattcttgtcgtacggctgagctgaccgaatttgaagttggtctctttactggcgaatacactactggcgctagtaaagaatatttagtccatcttgagcaaatgcgtattgctaacaatcgtgctcgtaagcatagctttgcagaagatgaggaacgtgaagctcccgaagacatttctctccataacacacattcagatgttacttttgattttgtttaa

SEQ ID NO: 30588 - protein, 533 aa, Schizosaccharomyces pombe
MCGILALMLADPHQQACPEIYEGLYSLQHRGQDAAGIVTAGNKGRLYQCKGSGMVADVFSQHQLRQLVGSMGIGHLRYPTAGSCAHSEAQPFYVNSPYGLVLGHNGNLINGPELRRFLDTEAHRHVNTGSDSELLLNIFAYELQRLDKFRINENDIFEALRNVYDRVNGGYACVAMIAGLGVLGFRDPNGIRPLVIGERDTPEGKDYMLASESVVLTQFGYRTFRDIRPGECVFIRRSNREDILAGFRGPRLFSRQILPCLRFTPDIFEYVYFARPDSVIDGLSVYQSRLNMGEKLAHTIMKRFGPDYMEKIDAVIPVPDSARTSALALAQTAQLPYVEAFIKNRYIGRTFIMPGQQIRRKSVRRKLNVQPQEFFDKNVLIVDDSIVRGTTSREIVQMARESGAKNVYLASCAPMITHPHVYGIDLADCKDLIAYGKTEDEVAEAISADGVIYQTLEDLLDSCRTAELTEFEVGLFTGEYTTGASKEYLVHLEQMRIANNRARKHSFAEDEEREAPEDISLHNTHSDVTFDFV

SEQ ID NO: 30589 - DNA, 1710 bp, Glycine max
  CDS (1)..(1710)
atggctgctgcgtctaatctctccactctctcctcctcttccctctccaaaccctcgtcctctttccctttccgcaacacaccaacaaacaacaacgcttcttttctccacaacaaatcccttccaaaccaaaactctctctctcacaaactctcttcccctctgcctctcgcatgcaacccaaaaaaccaaaacacttgtgtcttcttcgacgacgaagaccaaaagccccgtgaagagtgcggcgtggtgggcatctacggcgacccggaagcctcccgtctctgctccctggccctccacgccctccagcaccgcggccaagaaggtgccggcatcgtagccgtccacgacaaccacctccaatccgttaccggcgtcggcctcgtctccgacgtcttcgagcagtccaagctctcccgcctccccggcacctcggccattggccacgtccgctactccaccgccggccaatccatgctcaaaaacgtccaacccttcctggccgactaccgcttcgctgccgtcgccgtcgctcacaacggcaacttcgtcaactaccgctccctccgagccagactcgaacacaacaacggctccatcttcaacaccacctccgacaccgaggttgtcctccacctcatcgccacttcaaaacacaggccattcctcctcagaatcgtggacgcctgcgagcatctccaaggcgcctactccctcgtattcgtcacggaggacaagctcgtcgccgtcagagaccccttcgggttccgacccttggtgatgggtaggagaaccaacggcgctgtagttttggcctccgagacatgcgcgcttgatttaatcgaagccacgtacgagagagaggtgtacccgggtgaagttatcgtggtggaccacactggaatccaatccctctgcctcgtgtctcatcctgagccaaaacaatgcatcttcgagcacatatacttcgcgcttcctaactctgttgttttcgggaggtccgtgtacgagtctagaaaaaaattcggagaaatactagcctctgagagtcccgttgagtgtgacgttgtgatcgcggttcctgattctggcgttgtggctgcgcttggttatgctgcaaaagctggggtaccctttcagcaggggttgattaggtcccactatgtagggaggactttcatcgagccttcgcagaaaattagggattttggagtgaagcttaaactgtctccggttcatgctgtgcttgaagggaagagggttgtggttgtggatgattccatcgtgagaggcaccacgtcgtccaagattgtgaggctcttgaaggaggccggtgccaaggaagttcacatgaggattgcatgtcctcctattgttgcttcgtgttattatggagttgacacacccagttcagaggagttgatatccaaccggatgagtgtggaggagataaggaagtttattgggtcggattcgctggcttttcttcccttggataagttgaagacattgttaggggatgatgctcttaactactgctatgcttgcttctctgggaagtaccctgttgagcctgaggaacttcaaatgaagaggcttggtgttgctcacttcaattgggacgacgacttcaatgggaatttcgaatctattgatgtggggggttgggttacaaatcaagatgggtttaagattggtagtgtctaa

SEQ ID NO: 30590 - protein, 569 aa, Glycine max
MAAASNLSTLSSSSLSKPSSSFPFRNTPTNNNASFLHNKSLPNQNSLSHKLSSPLPLACNPKNQNTCVFFDDEDQKPREECGVVGIYGDPEASRLCSLALHALQHRGQEGAGIVAVHDNHLQSVTGVGLVSDVFEQSKLSRLPGTSAIGHVRYSTAGQSMLKNVQPFLADYRFAAVAVAHNGNFVNYRSLRARLEHNNGSIFNTTSDTEVVLHLIATSKHRPFLLRIVDACEHLQGAYSLVFVTEDKLVAVRDPFGFRPLVMGRRTNGAVVLASETCALDLIEATYEREVYPGEVIVVDHTGIQSLCLVSHPEPKQCIFEHIYFALPNSVVFGRSVYESRKKFGEILASESPVECDVVIAVPDSGVVAALGYAAKAGVPFQQGLIRSHYVGRTFIEPSQKIRDFGVKLKLSPVHAVLEGKRVVVVDDSIVRGTTSSKIVRLLKEAGAKEVHMRIACPPIVASCYYGVDTPSSEELISNRMSVEEIRKFIGSDSLAFLPLDKLKTLLGDDALNYCYACFSGKYPVEPEELQMKRLGVAHFNWDDDFNGNFESIDVGGWVTNQDGFKIGSV

SEQ ID NO: 30591 - DNA, 1485 bp, Staphylococcus aureus
  CDS (1)..(1485): transl_table=11
atgtttaactactcaggattaaacgaagaatgtggcgtgtttggtatttggaatcatcctgaagcagcgcaactaacatatatgggacttcatagtttgcaacatcgtggtcaagaaggtgcaggtatagttgtttctgatcaaaatgaattaaaaggcgagcgaggattaggcttactaactgaagcgattaacgatgatcaaatggaacgattaaaaggatatcaacatgcaattggtcacgtccgttatgctacttcaggtaataaaggtattgaaaatattcaaccgtttctgtatcacttttatgatatgagtgtaggtatttgtcataatggtaacctcattaatgctaaatcattgcgtcagaatttagaaaaacaaggtgctatcttccattcgtcttcagatactgaagtcattatgcatttgatacgtcgaagtaaagctcctacttttgaggaagcattgaaagaaagtttgcgaaaagttaaaggcggttttacatttgcgatattaactaaagatgcgttatatggcgcagtagatccaaatgctatcagaccacttgttgtaggtaaaatgaaagatggtacatacatccttgcaagtgaaacatgtgcaatagatgtgttaggtgcagaatttgttcaagatattcatgcaggtgaatatgtcgtgattaacgataaaggtattacagttaaatcttatacacatcatacgacaactgcaatttctgcgatggaatatatttattttgctagaccagactcaacaatagctggtaaaaatgtccatgcagtacgtaaagcttctggtaaaaaattagcccaagaaagccctgtaaatgctgatatggtcatcggtgtacccaattcatcgctatcagctgcgagtggttatgctgaagaaataggtttgccatatgaaatgggactagttaaaaatcaatatgttgcaagaacatttattcaaccaactcaagaattacgtgagcaaggtgtgagagtgaagttatctgcggtaaaagatatagtagatgggaaaaatatcattcttgttgatgattccattgttcgcggtacgacaattcgacgcattgtgaaaatgttaaaagattctggtgcaaataaagtgcatgtgcgtatagcatcaccggaatttatgttcccaagtttttatggaatcgatgtttcaactacggcagaattaatttctgcaagcaaatcacctgaagaaattaaagattatattggcgctgattcattagcatatctatctgtagatgggttaattgaatcaattggtttagattatgacgcgccatatagtggcttatgtgtagaaagtttcactggagattatcctgcagggttatatgattatgaagcaaattataaagcacatttaagtcatcgacaaaagcaatatatttctaaaaacaaacacttttttgatagcgagggaaatttaaatgtctaa

SEQ ID NO: 30592 - protein, 494 aa, Staphylococcus aureus
MFNYSGLNEECGVFGIWNHPEAAQLTYMGLHSLQHRGQEGAGIVVSDQNELKGERGLGLLTEAINDDQMERLKGYQHAIGHVRYATSGNKGIENIQPFLYHFYDMSVGICHNGNLINAKSLRQNLEKQGAIFHSSSDTEVIMHLIRRSKAPTFEEALKESLRKVKGGFTFAILTKDALYGAVDPNAIRPLVVGKMKDGTYILASETCAIDVLGAEFVQDIHAGEYVVINDKGITVKSYTHHTTTAISAMEYIYFARPDSTIAGKNVHAVRKASGKKLAQESPVNADMVIGVPNSSLSAASGYAEEIGLPYEMGLVKNQYVARTFIQPTQELREQGVRVKLSAVKDIVDGKNIILVDDSIVRGTTIRRIVKMLKDSGANKVHVRIASPEFMFPSFYGIDVSTTAELISASKSPEEIKDYIGADSLAYLSVDGLIESIGLDYDAPYSGLCVESFTGDYPAGLYDYEANYKAHLSHRQKQYISKNKHFFDSEGNLNV

SEQ ID NO: 30593 - DNA, 1482 bp, Synechococcus sp
  CDS (1)..(1482): transl_table=11
atgatcccgactcagccgctgaccgccgacctggattgcgatttgggcctggagcgacctgaccgccccgaagaagcctgtggggtttttgccctctacgcaccgggcgaagaagtggcgcgcatggcctatttcgggctgtacgcgctccagcatcgtggacaagagtctgctggcatcgccgtctttgaaggcgatcgcgtcatgctccacaaggacatgggcttggtctcccaagtctttgatcccgaaatcctgcagcaactgcaaggcagccttgcggtcggtcatacccgctactccaccacgggatcaagccgtattgccaacgctcaaccggcgttgctggaaacccgccttgggccggtggccttggcgcacaacggcaacttggtcaacacggttgagttgcgccaagagctgctagctaagaaccacgagctgacgaccaccaccgattcagaactgattgccttcgcgatcatggaagcagtggcagaaggccaggactggcgcggggcgatcgagtctgcctgccgccgcagccaaggagcctttagcctgacgatcggcactcctgaggcactctacggcacccgtgaccccaatggcattaggccgcttgtgctgggcacgctggagagcaatggccaaacgcgctatgtgctttcttctgaaacctgcggtctcgacatcattggtgcggactacgtgcgcgatatcgcaccgggtgaaatggtgcggattacagatgcaggtctggaaagctggacttgggccgaggcgccgcagccgaagctctgcgtcttcgagatgatttactttgcgcggcctgatagcctctttcacggcgagtcgctttacagctatcgccgccgcatcggccaacgcttagccaaggaagctccggcggatgttgacctcgtgctgggtgtgcctgactccggtattccggctgcgattggtttttctgaagcgctgggcattccctacgccgaagggttaatcaaaaaccgctacgtggggcggacgttcatccagcccacccaatcgatgcgggaaacgggcattcgcatgaagctcaaccctctcaaggatgtcttagcgggcaaacgcattgccatcattgacgattcgatcgtgcggggaacaaccagccgcaaactggtcaaagctctgcgggatgcgggtgcaacggaagtgcatatgcggatttcttcaccgcctgtgacgcatccctgcttctacggcattgataccgacacccaagatcagctgattgctgccacgcgatcggtcagtgaaatcactgagcagattggtgtcgattctctggcttacctgacggagcagggaatgctggaggcgacccgagaaagtattggtaacttctgcacggcttgctttaacggtcgctacccgatcgcaattcccgaggagatcaagcgatcgaagctgatgctcgaaactgtaacggcctaa

SEQ ID NO: 30594 - protein, 493 aa, Synechococcus sp
MIPTQPLTADLDCDLGLERPDRPEEACGVFALYAPGEEVARMAYFGLYALQHRGQESAGIAVFEGDRVMLHKDMGLVSQVFDPEILQQLQGSLAVGHTRYSTTGSSRIANAQPALLETRLGPVALAHNGNLVNTVELRQELLAKNHELTTTTDSELIAFAIMEAVAEGQDWRGAIESACRRSQGAFSLTIGTPEALYGTRDPNGIRPLVLGTLESNGQTRYVLSSETCGLDIIGADYVRDIAPGEMVRITDAGLESWTWAEAPQPKLCVFEMIYFARPDSLFHGESLYSYRRRIGQRLAKEAPADVDLVLGVPDSGIPAAIGFSEALGIPYAEGLIKNRYVGRTFIQPTQSMRETGIRMKLNPLKDVLAGKRIAIIDDSIVRGTTSRKLVKALRDAGATEVHMRISSPPVTHPCFYGIDTDTQDQLIAATRSVSEITEQIGVDSLAYLTEQGMLEATRESIGNFCTACFNGRYPIAIPEEIKRSKLMLETVTA

SEQ ID NO: 30595 - DNA, 1488 bp, Synechocystis sp
  CDS (1)..(1488): transl_table=11
atgtttcccccctccagtgatttgactgagttgaatgatggtcagcctttgtctggccaccatgccgataaaccagaagaagcatgtggggtgtttggcatttacgcccctgaagaagcggtggccaaattgacctattttggactttatgccctgcaacatcggggtcaggagtcggcgggtattgccacttttgccgggacaacggttcactgccacaaggatatggggctagtgtcccaggtttttcaagaatctaaactgaatgaaatggtgggtactctggctgtgggccacacccgctactccaccacgggatccagccatcgggtcaatgctcaaccggcagtgctccctacccgtttgggtcccctggccctggcccacaatggcaatttggttaacactaaccagttgcgagaagctttagcggaaaggggctgtgaggactttgtcaccaccaccgattcggaaatgattgcagtggcgatcgccaatgaggtggataaaggcaaagactgggtggaaggcaccattgcggccctgaccctttgtgcgggagcctatagcttagtgatcggcacaccggagggaatcattggagtcagggatccccatggcattcgccccctggtgatcggtgtgttagaagaagaaactccccgctatgtattggcatcggaaacctgtgccctggacatcatcggtgccacctatgtgcgcacggtggaagccggagaattggtccatatcaccgaatctggcctagtttcccatcgattagccgaaagcgctgaccgtaaactctgtgtgttcgagatgatttatttttctcgcccggatagcgtggttaacgatgaaagcctctacacctatcgcatgcgcattggcaaacatttagccaaagaatcccctgtggatgctgatctcgtgatgggggtacccgattccggtattccagcggcgatcggcttttcccaagcttccggtattccctatgccgaaggtttaatcaaaaatcgttacgtggggcgtacctttatccaacccacccaacatatgcgagagcacggcatccgcatgaaactcaatcctctcaaagacgtattggccggtaaacggatcattatcgtcgatgactctattgtgcggggcaccactagtcgcaaaattgtccgagcgttacgggaagctggagcaacagaggtacatatgcggatttcttctccgccagtgacccatccttgcttctatggcattgataccgacagtcaagatcaactaattgcggccagactgacagtggcggagattgctgagcaaattgaagtggactccctcgcttatctttcccaggaaggcatgttgttgtgcaccggcgaagatatttcccatttttgttctgcctgcttcaatggaagataccccatcactgtgccagatgcggtcaggcgctctaaattaatgctggagaatattactgcttga

SEQ ID NO: 30596 - protein, 495 aa, Synechocystis sp
MFPPSSDLTELNDGQPLSGHHADKPEEACGVFGIYAPEEAVAKLTYFGLYALQHRGQESAGIATFAGTTVHCHKDMGLVSQVFQESKLNEMVGTLAVGHTRYSTTGSSHRVNAQPAVLPTRLGPLALAHNGNLVNTNQLREALAERGCEDFVTTTDSEMIAVAIANEVDKGKDWVEGTIAALTLCAGAYSLVIGTPEGIIGVRDPHGIRPLVIGVLEEETPRYVLASETCALDIIGATYVRTVEAGELVHITESGLVSHRLAESADRKLCVFEMIYFSRPDSVVNDESLYTYRMRIGKHLAKESPVDADLVMGVPDSGIPAAIGFSQASGIPYAEGLIKNRYVGRTFIQPTQHMREHGIRMKLNPLKDVLAGKRIIIVDDSIVRGTTSRKIVRALREAGATEVHMRISSPPVTHPCFYGIDTDSQDQLIAARLTVAEIAEQIEVDSLAYLSQEGMLLCTGEDISHFCSACFNGRYPITVPDAVRRSKLMLENITA

SEQ ID NO: 30597 - DNA, 1533 bp, Saccharomyces cerevisiae
  CDS (1)..(1533)
atgtgtggtattttaggtattgtattagcaaaccaaaccactccagtagctccggagttatgtgatggatgcatttttctacaacatcgtggacaagatgcagctggtatagctacctgtggttctcgtggtagaatctaccaatgtaaaggtaatggtatggctcgtgacgtatttacccaacaacgtgtttccggtcttgctggttccatgggtattgcccacttgagatatcctacagccgggtcttcggctaattcagaagcgcaaccattttacgtcaatagtccttacggtattaacttggcacataacggtaacttggtgaatactgcatcattgaagagatatatggatgaagacgttcatagacatattaacacggacagtgattcggagttactattgaatatttttgctgctgaactggaaaaacataacaagtacagagttaacaatgaagatgttttccacgcgttagaaggtgtttaccgtttatgccgtggcggttatgcttgcgttggtttacttgccggttttgcattatttggtttcagagatccaaatggtattaggccattattgttcggtgaaagagaaaatccggacggcactaaggactatatgttagcttcagaaagtgttgttttcaaagctcacaactttactaaatatcgtgacttaaagcctggcgaggcagttatcatccctaagaactgtagcaaaggtgaacctgagttcaaacaagtggttcctattaactcttatagacctgatttatttgaatacgtatatttcgccagaccggacagtgtcttggatggaatatcagtttatcacacaagattggctatgggttctaaattagcggaaaatattctaaagcaactgaagccagaagatattgatgttgttattcccgtcccagatactgcaagaacatgtgcactagaatgtgctaatgtgttagggaagccttatagagagggctttgttaaaaacagatacgtgggcaggacatttatcatgccaaaccagagggaaagggtttcttcagtaaggaggaagcttaaccctatggagtctgaatttaagggtaagaaggttctgatagtggatgattctattgtcagaggtactacttcaaaagagattgttaacatggccaaggaatccggtgcaacaaaggtttacttcgcttcagctgccccagccattcgttacaaccatatttatggtattgacttaacagacacaaagaacttgattgcttataacagaaccgatgaagaagtggcggaagtaatcggttgtgaaagagtcatttaccaatcattggaagatttgattgattgttgtaaaactgataaaataaccaaattcgaagatggtgtatttaccggaaattatgtcactggtgttgaagacggttatattcaagaattggaagaaaaacgtgaatcgatcgcaaataattcatcagatatgaaggctgaagtcgatatcggattatataattgtgcagattattga

SEQ ID NO: 30598 - protein, 510 aa, Saccharomyces cerevisiae
MCGILGIVLANQTTPVAPELCDGCIFLQHRGQDAAGIATCGSRGRIYQCKGNGMARDVFTQQRVSGLAGSMGIAHLRYPTAGSSANSEAQPFYVNSPYGINLAHNGNLVNTASLKRYMDEDVHRHINTDSDSELLLNIFAAELEKHNKYRVNNEDVFHALEGVYRLCRGGYACVGLLAGFALFGFRDPNGIRPLLFGERENPDGTKDYMLASESVVFKAHNFTKYRDLKPGEAVIIPKNCSKGEPEFKQVVPINSYRPDLFEYVYFARPDSVLDGISVYHTRLAMGSKLAENILKQLKPEDIDVVIPVPDTARTCALECANVLGKPYREGFVKNRYVGRTFIMPNQRERVSSVRRKLNPMESEFKGKKVLIVDDSIVRGTTSKEIVNMAKESGATKVYFASAAPAIRYNHIYGIDLTDTKNLIAYNRTDEEVAEVIGCERVIYQSLEDLIDCCKTDKITKFEDGVFTGNYVTGVEDGYIQELEEKRESIANNSSDMKAEVDIGLYNCADY

SEQ ID NO: 30599 - DNA, 23 bp, Artificial sequence
  (1)..(23): primer
atgtgcggtattgtcggtatcgc

SEQ ID NO: 30600 - DNA, 27 bp, Artificial sequence
  (1)..(27): primer
ttatccttcgttatgcatttcgagatt

SEQ ID NO: 30601 - protein, 641 aa, Artificial sequence
  Variant (4)..(4): xaa in position 4 is any amino acid
  Variant (7)..(17): xaa in position 7 to 17 is any amino acid
  Variant (18)..(33): xaa in position 18 to 33 is any or no amino acid
  Variant (36)..(37): xaa in position 36 to 37 is any amino acid
  Variant (45)..(45): xaa in position 45 is any amino acid
  Variant (49)..(55): xaa in position 49 to 55 is any amino acid
  Variant (56)..(67): xaa in position 56 to 67 is any or no amino acid
  Variant (69)..(70): xaa in position 69 to 70 is any amino acid
  Variant (74)..(75): xaa in position 74 to 75 is any amino acid
  Variant (78)..(79): xaa in position 78 to 79 is any amino acid
  Variant (80)..(88): xaa in position 80 to 88 is any or no amino acid
  Variant (90)..(103): xaa in position 90 to 103 is any or no amino acid
  Variant (105)..(105): xaa in position 105 is any or no amino acid
  Variant (107)..(108): xaa in position 107 to 108 is any or no amino acid
  Variant (113)..(113): xaa in position 113 is any amino acid
  Variant (116)..(116): xaa in position 116 is any amino acid
  Variant (118)..(118): xaa in position 118 is any amino acid
  Variant (120)..(123): xaa in position 120 to 123 is any amino acid
  Variant (124)..(129): xaa in position 124 to 129 is any or no amino acid
  Variant (132)..(139): xaa in position 132 to 139 is any or no amino acid
  Variant (141)..(142): xaa in position 141 to 142 is any or no amino acid
  Variant (144)..(144): xaa in position 144 is any or no amino acid
  Variant (146)..(146): xaa in position 146 is any or no amino acid
  Variant (152)..(152): xaa in position 152 is any or no amino acid
  Variant (154)..(155): xaa in position 154 to 155 is any amino acid
  Variant (156)..(156): xaa in position 156 is any or no amino acid
  Variant (158)..(163): xaa in position 158 to 163 is any or no amino acid
  Variant (165)..(180): xaa in position 165 to 180 is any or no amino acid
  Variant (182)..(184): xaa in position 182 to 184 is any or no amino acid
  Variant (191)..(192): xaa in position 191 to 192 is any amino acid
  Variant (194)..(205): xaa in position 194 to 205 is any amino acid
  Variant (206)..(228): xaa in position 206 to 228 is any or no amino acid
  Variant (233)..(235): xaa in position 233 to 235 is any amino acid
  Variant (236)..(236): xaa in position 236 is any or no amino acid
  Variant (238)..(241): xaa in position 238 to 241 is any amino acid
  Variant (243)..(243): xaa in position 243 is any amino acid
  Variant (245)..(245): xaa in position 245 is any amino acid
  Variant (249)..(249): xaa in position 249 is any amino acid
  Variant (251)..(251): xaa in position 251 is any amino acid
  Variant (255)..(255): xaa in position 255 is any amino acid
  Variant (258)..(261): xaa in position 258 to 261 is any amino acid
  Variant (262)..(277): xaa in position 262 to 277 is any or no amino acid
  Variant (285)..(285): xaa in position 285 is any amino acid
  Variant (287)..(288): xaa in position 287 to 288 is any amino acid
  Variant (289)..(289): xaa in position 289 is any or no amino acid
  Variant (291)..(293): xaa in position 291 to 293 is any amino acid
  Variant (294)..(299): xaa in position 294 to 299 is any or no amino acid
  Variant (303)..(303): xaa in position 303 is any amino acid
  Variant (307)..(307): xaa in position 307 is any amino acid
  Variant (309)..(309): xaa in position 309 is any amino acid
  Variant (311)..(326): xaa in position 311 to 326 is any amino acid
  Variant (327)..(343): xaa in position 327 to 343 is any or no amino acid
  Variant (345)..(345): xaa in position 345 is any amino acid
  Variant (357)..(357): xaa in position 357 is any or no amino acid
  Variant (359)..(361): xaa in position 359 to 361 is any amino acid
  Variant (362)..(362): xaa in position 362 is any or no amino acid
  Variant (365)..(366): xaa in position 365 to 366 is any amino acid
  Variant (368)..(370): xaa in position 368 to 370 is any amino acid
  Variant (372)..(373): xaa in position 372 to 373 is any amino acid
  Variant (376)..(382): xaa in position 376 to 382 is any amino acid
  Variant (383)..(390): xaa in position 383 to 390 is any or no amino acid
  Variant (395)..(395): xaa in position 395 is any amino acid
  Variant (400)..(402): xaa in position 400 to 402 is any amino acid
  Variant (406)..(407): xaa in position 406 to 407 is any amino acid
  Variant (409)..(412): xaa in position 409 to 412 is any amino acid
  Variant (414)..(414): xaa in position 414 is any amino acid
  Variant (415)..(443): xaa in position 415 to 443 is any or no amino acid
  Variant (445)..(446): xaa in position 445 to 446 is any amino acid
  Variant (448)..(448): xaa in position 448 is any amino acid
  Variant (452)..(452): xaa in position 452 is any amino acid
  Variant (460)..(460): xaa in position 460 is any amino acid
  Variant (462)..(463): xaa in position 462 to 463 is any or no amino acid
  Variant (465)..(466): xaa in position 465 to 466 is any or no amino acid
  Variant (468)..(470): xaa in position 468 to 470 is any amino acid
  Variant (473)..(473): xaa in position 473 is any amino acid
  Variant (475)..(477): xaa in position 475 to 477 is any amino acid
  Variant (479)..(483): xaa in position 479 to 483 is any amino acid
  Variant (484)..(484): xaa in position 484 is any or no amino acid
  Variant (486)..(486): xaa in position 486 is any amino acid
  Variant (500)..(502): xaa in position 500 to 502 is any amino acid
  Variant (505)..(505): xaa in position 505 is any amino acid
  Variant (507)..(507): xaa in position 507 is any amino acid
  Variant (509)..(509): xaa in position 509 is any amino acid
  Variant (512)..(512): xaa in position 512 is any or no amino acid
  Variant (514)..(515): xaa in position 514 to 515 is any amino acid
  Variant (518)..(520): xaa in position 518 to 520 is any amino acid
  Variant (524)..(524): xaa in position 524 is any amino acid
  Variant (526)..(527): xaa in position 526 to 527 is any amino acid
  Variant (529)..(530): xaa in position 529 to 530 is any amino acid
  Variant (535)..(540): xaa in position 535 to 540 is any amino acid
  Variant (544)..(550): xaa in position 544 to 550 is any amino acid
  Variant (551)..(577): xaa in position 551 to 577 is any or no amino acid
  Variant (579)..(581): xaa in position 579 to 581 is any amino acid
  Variant (584)..(584): xaa in position 584 is any amino acid
  Variant (586)..(586): xaa in position 586 is any amino acid
  Variant (588)..(588): xaa in position 588 is any amino acid
  Variant (590)..(591): xaa in position 590 to 591 is any amino acid
  Variant (593)..(594): xaa in position 593 to 594 is any amino acid
  Variant (596)..(597): xaa in position 596 to 597 is any amino acid
  Variant (600)..(608): xaa in position 600 to 608 is any amino acid
  Variant (609)..(638): xaa in position 609 to 638 is any or no amino acid
  Variant (640)..(640): xaa in position 640 is any amino acid
CGVXGIXXXXXXXXXXXXXXXXXXXXXXXXXXXGLXXLQHRGQEXAGIXXXXXXXXXXXXXXXXXXXKXXGLVXXVFXXXXXXXXXXXLXXXXXXXXXXXXXXLXGXXGIGHXRYXTXGXXXXXXXXXXQPXXXXXXXXGXXIXLXHNGNLXNXXXLXXXXXXLXXXXXXXXXXXXXXXXTXXXSDSEVLXXLXXXXXXXXXXXXXXXXXXXXXXXXXXXXXXXXXXXGAYAXXXXMXXXXLXAXRDPXGXRPLXLGXXXXXXXXXXXXXXXXXXXXYVVASETXAXXXIXXXXXXXXXRDVXPGEXVXIXXXXXXXXXXXXXXXXXXXXXXXXXXXXXXXXXCXFEYVYFARPDSXIXXXXVYXXRXXXGXXLAXXXXXXXXXXXXXXXDVVIXVPDSXXXAALXXAXXXXIXXXXXXXXXXXXXXXXXXXXXXXXXXXXXXYXXGXIKNXYVGRTFIXPXXQXXRXXXVRXKXXXVXXXXXXKXVVLVDDSIVRGTTXXXIVXMXRXAGXAXXVHXXXASPXIXXPXXYGIDXXXXXXLIAXXXXXXXXXXXXXXXXXXXXXXXXXXXXXXXXXXIXXXIGXDXLXYXXLXXLXXAVXXXXXXXXXXXXXXXXXXXXXXXXXXXXXXXXXXXXXXXGXY

SEQ ID NO: 30602 - protein, 15 aa, Artificial sequence
  Variant (2)..(3): xaa in position 2 to 3 is any or no amino acid
  Variant (5)..(5): xaa in position 5 is any or no amino acid
  Variant (11)..(11): xaa in position 11 is Asp or Glu
  Variant (12)..(12): xaa in position 12 is Ala, Gly or Ser
  Variant (13)..(13): xaa in position 13 is Ala, Ser or Thr
LXXLXQHRGQXXXGI

SEQ ID NO: 30603 - protein, 41 aa, Artificial sequence
  Variant (3)..(3): xaa in position 3 is Ala, Pro or Ser
  Variant (5)..(5): xaa in position 5 is Ala, Gln, Ser or Thr
  Variant (7)..(13): xaa in position 7 to 13 is any amino acid
  Variant (14)..(14): xaa in position 14 is any or no amino acid
  Variant (17)..(28): xaa in position 17 to 28 is any amino acid
  Variant (29)..(30): xaa in position 29 to 30 is any or no amino acid
  Variant (34)..(34): xaa in position 34 is Asp, Glu or Asn
  Variant (35)..(35): xaa in position 35 is Phe, Ile or Leu
  Variant (36)..(36): xaa in position 36 is any amino acid
  Variant (38)..(40): xaa in position 38 to 40 is any amino acid
  Variant (41)..(41): xaa in position 41 is Ile, Leu or Val
RYXTXGXXXXXXXXQPXXXXXXXXXXXXXXHNGXXXNXXXX

SEQ ID NO: 30604 - protein, 41 aa, Artificial sequence; identical to SEQ ID NO: 30603
  Variant (3)..(3): xaa in position 3 is Ala, Pro or Ser
  Variant (5)..(5): xaa in position 5 is Ala, Gln, Ser or Thr
  Variant (7)..(13): xaa in position 7 to 13 is any amino acid
  Variant (14)..(14): xaa in position 14 is any or no amino acid
  Variant (17)..(28): xaa in position 17 to 28 is any amino acid
  Variant (29)..(30): xaa in position 29 to 30 is any or no amino acid
  Variant (34)..(34): xaa in position 34 is Asp, Glu or Asn
  Variant (35)..(35): xaa in position 35 is Phe, Ile or Leu
  Variant (36)..(36): xaa in position 36 is any amino acid
  Variant (38)..(40): xaa in position 38 to 40 is any amino acid
  Variant (41)..(41): xaa in position 41 is Ile, Leu or Val

SEQ ID NO: 30605 - protein, 20 aa, Artificial sequence
  Variant (3)..(3): xaa in position 3 is Ser or Thr
  Variant (4)..(4): xaa in position 4 is any amino acid
  Variant (5)..(5): xaa in position 5 is Ala, Gly, Ser or Val
  Variant (6)..(6): xaa in position 6 is Phe, Ile, Leu or Val
  Variant (7)..(14): xaa in position 7 to 14 is any amino acid
  Variant (16)..(16): xaa in position 16 is Asp, Glu, Asn, Gln, Ser or Thr
  Variant (17)..(17): xaa in position 17 is Phe, Ile, Leu or Val
  Variant (18)..(19): xaa in position 18 to 19 is any amino acid
SEXXXXXXXXXXXXRXXXXG

SEQ ID NO: 30606 - protein, 28 aa, Artificial sequence
  Variant (2)..(2): xaa in position 2 is any amino acid
  Variant (3)..(3): xaa in position 3 is Ile or Val
  Variant (5)..(5): xaa in position 5 is Phe or Leu
  Variant (6)..(6): xaa in position 6 is Ala or Ser
  Variant (11)..(11): xaa in position 11 is any amino acid
  Variant (12)..(12): xaa in position 12 is Phe, Ile, Leu, Met or Val
  Variant (13)..(16): xaa in position 13 to 16 is any amino acid
  Variant (17)..(17): xaa in position 17 is Ile, Leu or Val
  Variant (18)..(20): xaa in position 18 to 20 is any amino acid
  Variant (22)..(24): xaa in position 22 to 24 is any amino acid
  Variant (26)..(27): xaa in position 26 to 27 is any amino acid
EXXYXXRPDSXXXXXXXXXXRXXXGXXL

SEQ ID NO: 30607 - protein, 86 aa, Artificial sequence
  Variant (5)..(5): xaa in position 5 is any amino acid
  Variant (7)..(8): xaa in position 7 to 8 is any amino acid
  Variant (9)..(10): xaa in position 9 to 10 is any or no amino acid
  Variant (12)..(14): xaa in position 12 to 14 is any amino acid
  Variant (15)..(15): xaa in position 15 is Ile or Val
  Variant (16)..(17): xaa in position 16 to 17 is any amino acid
  Variant (19)..(19): xaa in position 19 is any amino acid
  Variant (20)..(20): xaa in position 20 is Gly, Asn, Ser or Thr
  Variant (21)..(21): xaa in position 21 is Ala, Pro, Thr or Val
  Variant (22)..(25): xaa in position 22 to 25 is any amino acid
  Variant (26)..(26): xaa in position 26 is Phe, Ile, Leu or Val
  Variant (27)..(30): xaa in position 27 to 30 is any amino acid
  Variant (31)..(31): xaa in position 31 is Ile, Leu or Val
  Variant (32)..(32): xaa in position 32 is any amino acid
  Variant (33)..(33): xaa in position 33 is Ile, Leu, Met or Val
  Variant (34)..(34): xaa in position 34 is Ile or Val
  Variant (42)..(42): xaa in position 42 is Asn or Thr
  Variant (44)..(46): xaa in position 44 to 46 is any amino acid
  Variant (47)..(47): xaa in position 47 is Ile, Leu or Val
  Variant (48)..(48): xaa in position 48 is Ile, Leu, Met or Val
  Variant (49)..(54): xaa in position 49 to 54 is any amino acid
  Variant (57)..(58): xaa in position 57 to 58 is any amino acid
  Variant (59)..(59): xaa in position 59 is Ile, Leu or Val
  Variant (60)..(63): xaa in position 60 to 63 is any amino acid
  Variant (64)..(64): xaa in position 64 is Ala, Cys, Gly, Ser, Thr or Val
  Variant (65)..(65): xaa in position 65 is any amino acid
  Variant (67)..(74): xaa in position 67 to 74 is any amino acid
  Variant (76)..(83): xaa in position 76 to 83 is any amino acid
  Variant (84)..(84): xaa in position 84 is Phe or Leu
  Variant (85)..(85): xaa in position 85 is Ile, Leu, Met or Val
  Variant (86)..(86): xaa in position 86 is Ala, Cys, Gly or Ser
RTFIXPXXXXRXXXXXXKXXXXXXXXXXXXXXXXDDSIVRGXTXXXXXXXXXXXGAXXXXXXXXXPXXXXXXXXGXXXXXXXXXXX

SEQ ID NO: 30608 - DNA, 1329 bp, Escherichia coli
  CDS (1)..(1329)
atggaaaacgctaaaatgaactcgctcatcgcccagtatccgttggtaaaggatctggttgctcttaaagaaaccacctggtttaatcctggcacgacctcattggctgaaggtttaccttatgttggcctgaccgaacaggatgttcaggacgcccatgcgcgcttatcccgttttgcaccctatctggcaaaagcatttcctgaaactgctgccactggggggattattgaatcagaactggttgccattccagctatgcaaaaacggctggaaaaagaatatcagcaaccgatcagcgggcaactgttactgaaaaaagatagccatttgcccatttccggctccataaaagcacgcggcgggatttatgaagtcctggcacacgcagaaaaactggctctggaagcggggttgctgacgcttgatgatgactacagcaaactgctttctccggagtttaaacagttctttagccaatacagcattgctgtgggctcaaccggaaatctggggttatcaatcggcattatgagcgcccgcattggctttaaggtgacagttcatatgtctgctgatgcccgggcatggaaaaaagcgaaactgcgcagccatggcgttacggtcgtggaatatgagcaagattatggtgttgccgtcgaggaaggacgtaaagcagcgcagtctgacccgaactgtttctttattgatgacgaaaattcccgcacgttgttccttgggtattccgtcgctggccagcgtcttaaagcgcaatttgcccagcaaggccgtatcgtcgatgctgataaccctctgtttgtctatctgccgtgtggtgttggcggtggtcctggtggcgtcgcattcgggcttaaactggcgtttggcgatcatgttcactgcttttttgccgaaccaacgcactccccttgtatgttgttaggcgtccatacaggattacacgatcagatttctgttcaggatattggtatcgacaaccttaccgcagcggatggccttgcagttggtcgcgcatcaggctttgtcgggcgggcaatggagcgtctgctggatggcttctatacccttagcgatcaaaccatgtatgacatgcttggctggctggcgcaggaagaaggtattcgtcttgaaccttcggcactggcgggtatggccggacctcagcgcgtgtgtgcatcagtaagttaccaacagatgcacggtttcagcgcagaacaactgcgtaataccactcatctggtgtgggcgacgggaggtggaatggtgccggaagaagagatgaatcaatatctggcaaaaggccgttaa

SEQ ID NO: 30609 - protein, 442 aa, Escherichia coli
MENAKMNSLIAQYPLVKDLVALKETTWFNPGTTSLAEGLPYVGLTEQDVQDAHARLSRFAPYLAKAFPETAATGGIIESELVAIPAMQKRLEKEYQQPISGQLLLKKDSHLPISGSIKARGGIYEVLAHAEKLALEAGLLTLDDDYSKLLSPEFKQFFSQYSIAVGSTGNLGLSIGIMSARIGFKVTVHMSADARAWKKAKLRSHGVTVVEYEQDYGVAVEEGRKAAQSDPNCFFIDDENSRTLFLGYSVAGQRLKAQFAQQGRIVDADNPLFVYLPCGVGGGPGGVAFGLKLAFGDHVHCFFAEPTHSPCMLLGVHTGLHDQISVQDIGIDNLTAADGLAVGRASGFVGRAMERLLDGFYTLSDQTMYDMLGWLAQEEGIRLEPSALAGMAGPQRVCASVSYQQMHGFSAEQLRNTTHLVWATGGGMVPEEEMNQYLAKGR

SEQ ID NO: 30610 - DNA, 1311 bp, Lactobacillus plantarum WCFS1
  CDS (1)..(1311): transl_table=11
atggatacaacggtaatgattgaagaacacccacagattaaggaattgatagcaaaacgaccaattgtttggcagaacccagattatgggaagcgggcggacctgccgttaacgcgggccgatatttttgacgcggtcgcacgttgggaacgtttcgcaccatttttggccgttgcttttccagaaacggcagctatgaatgggattattgagtcaccattgttaccacttgagcagatgaaaccagcatgggaggctctcaaccaccagtcattggcggggcagctttatttaaaagctgatagtcagttgccgatttcgggttcgatcaagtcacgtggtgggatttacgaagtgctcaagtttgctgaacaggtagccatggcccatacggatttaacgtatatggatgattacagtgtcttggcaacggctaagtatcacgagttatttgcacaatacggcgtcatcgttgcatcgacgggaaacttggcactcagtgtgggcatcatggccgcaacgtttggatttaagacgaccgtttatatgtctcacgatgctcgtcagtggaagaaggataaactgcgggcaaatggcgtcaccgttgaggaactaaataccgacttttcaagtgtgattccggtggcccgtgccgccgcggccaaggatgaccatacgcactttgttgatgatgaaggttcacgtgacttattcctcgggtacgctgttgctggggtacggttacaacatcaattaaaagtacaaggtatcaagatggatgctgcacacccggttgtcgtttatttaccggccggggtcggtggcagtcctagtggcgttgcttttggcctcaagatgattatgggagctaatatttatcccgtcttttgtgaaccgacccacgtgccgtccgtgaccttagggatgatgaccaagctgaatgaaaaaattgctgttcaagacattggtttagatggcctgactgccgctgatgggttagccgttagccggccatcacgattggcgggcaaggtgatgcgaacgctattactcggaacagcaacatttgaagatgatgatttataccgttatttgacgaagctcgtcgataccgaagatgtaatagtcgaaccatccgctgcagccggctttaccgcgatcgcccccatcatggcccaatttcccacgcttgctggcaaagacgtcacccacattgtctgggcaactggcggcgacatgatgccggaatcggagcgtcagttggattatgagctaggacaaaaattgctgaccaagattaacaatcgttaa

SEQ ID NO: 30611 - protein, 436 aa, Lactobacillus plantarum WCFS1
MDTTVMIEEHPQIKELIAKRPIVWQNPDYGKRADLPLTRADIFDAVARWERFAPFLAVAFPETAAMNGIIESPLLPLEQMKPAWEALNHQSLAGQLYLKADSQLPISGSIKSRGGIYEVLKFAEQVAMAHTDLTYMDDYSVLATAKYHELFAQYGVIVASTGNLALSVGIMAATFGFKTTVYMSHDARQWKKDKLRANGVTVEELNTDFSSVIPVARAAAAKDDHTHFVDDEGSRDLFLGYAVAGVRLQHQLKVQGIKMDAAHPVVVYLPAGVGGSPSGVAFGLKMIMGANIYPVFCEPTHVPSVTLGMMTKLNEKIAVQDIGLDGLTAADGLAVSRPSRLAGKVMRTLLLGTATFEDDDLYRYLTKLVDTEDVIVEPSAAAGFTAIAPIMAQFPTLAGKDVTHIVWATGGDMMPESERQLDYELGQKLLTKINNR

SEQ ID NO: 30612 - DNA, 1347 bp, Chromobacterium violaceum ATCC 12472
  CDS (1)..(1347): transl_table=11
atgattcatggaaaaacgctggctgaatggcagcagtcccatcccgagattcgcgaattgaccggcctgcgcgagtgcgcctggttcaatcccgccgccgcccccgccgccgaggcattgcccgatgtcggacttggcgcggcagacatcgccgacgcatccgcccgcctgcggcgtttcgcgccatacatatcccgcgcattccccgaaaccgccgccagcggcgggatcatagaatcgccgctgctgcccgtacccgccttccagcaagcgctggcccgccgccgcggacgcgagttgccgggacgcctttggctgaaggcggacagccacttgcccatctcgggctcgatcaaagcacgcggcggcatctacgaggtgctgaagcatgcggaagacctggcgctggccaacggcctgctccagcccggcgacgactacgccaggctggcctccccggaagcccgctcgctgttcagccgccatggcatcgccgtcggctccaccggcaatctgggcctgtcgataggcatcatggcggccaagctgggcttccaggccgccgtccacatgtcggccgacgccaggcaatggaaaaaggacaagttgcgcgcgcacggcgtaaccgtggtcgaataccagaccgactacagcgcggcggtggcgcggggacgggaacaggcggcgcgcgacccggattgccatttcgtcgacgacgaaaattccatccacctgttcttgggctacgccgtggcggcggaacggctgaaggctcaattggcggaagccggcgtgcgcgtggacgccgatcatccgctgttcgtctatctgccctgcggcgtgggaggcgggcccggcggcgtggccttcgggctcaagcaggccttcggcgacgcggtccattgcctgttcgcggaacccacccgctcgccctgcatgctgctgggcgtgctcaccggcctgcatgacaaggtctcggtgcaggacttcggcatcgacaaccgcaccgtcgcggacggtctggccgtcggccggccgtcgggattcgtcggccgcgcgatgcagaggctgatagacggctattacacggtggacgacgatgagctgttccgcctgctggcgatgctggaacagacggaaggcctgcggctggagccgtcggcgctggcaggcgcgccgggcatcgcccgcgtgctggaggaaaaccagggctaccgccagcgcatggggctggacgcggatcgcctcgcctgcgccacccatctgatctgggcgaccggcggcagcatggtgccggaagcggagatggacggctacctgcggcgcggccgcgcgctgctgggctga

SEQ ID NO: 30613 - protein, 448 aa, Chromobacterium violaceum ATCC 12472
MIHGKTLAEWQQSHPEIRELTGLRECAWFNPAAAPAAEALPDVGLGAADIADASARLRRFAPYISRAFPETAASGGIIESPLLPVPAFQQALARRRGRELPGRLWLKADSHLPISGSIKARGGIYEVLKHAEDLALANGLLQPGDDYARLASPEARSLFSRHGIAVGSTGNLGLSIGIMAAKLGFQAAVHMSADARQWKKDKLRAHGVTVVEYQTDYSAAVARGREQAARDPDCHFVDDENSIHLFLGYAVAAERLKAQLAEAGVRVDADHPLFVYLPCGVGGGPGGVAFGLKQAFGDAVHCLFAEPTRSPCMLLGVLTGLHDKVSVQDFGIDNRTVADGLAVGRPSGFVGRAMQRLIDGYYTVDDDELFRLLAMLEQTEGLRLEPSALAGAPGIARVLEENQGYRQRMGLDADRLACATHLIWATGGSMVPEAEMDGYLRRGRALLG

SEQ ID NO: 30614 - DNA, 1332 bp, Photorhabdus luminescens subsp. laumondii TTO1
  CDS (1)..(1332): transl_table=11
atgaaacgtactgaaattcaacaattactaaatgaatatccgttagtaaaaaatttgatggaattagaggaaatcttctggtttaacccttgtaataccaccttgaaagagggattgccttttgtcggtttgggcgctgatgatgttgaggatgctgaagcacgcttggatcgttttgcgtcttatttatgtaaagcttttccagaaacagccgtcacacatggcattattgaatcagaaatagtggctatacctacgatgcaaaaaacactggagcaacattatggtgtgggtatcacagggagaattttgcttaaaaaagatagccatttgcccatttccggttcgattaaagcccgtggtggaatttatgaagtgttaactcacgcggaaaaactggcattacaagcggggttgcttgctgaaaacgatgattacagcaaactgttttcagaagagcttagacggttctttaatcaatacagcattgctgtaggttctaccggcaatttggggctttccataggtattgccagtgcaaaattaggctttaatgtcagcgtgcatatgtccgccgatgctcgtgaatggaagaagcaaaagctacgttcacatggggtcaatgtcgtggagcatgagctagattatggggtagccgtggcccgagggcgtaaagaagccgaatctgctcctaactgtttctttattgacgatgaaaactcccaaacgttgtttctgggatactctgtcgcaggtggacgggtaaaggcgcagtttgagcagatgaatattgtggttgatgaagatcacccactcttcgtttatttgccgtgtggcgtcggtggcggtccggggggggttgcatttggattgaaactggcttttggtgatcatgtgcactgcatttttgctgaaccgacccattctcccagtatgttgttgggggtatatactggtttgcatgacaatatttgcgtgcaggatatcgggatcgacaatatcactgctgctgatggtcttgcggtaggcagggcttccggctttgttgggcgtgcgatggaacgtttgctggatggattttatactgttcaagatcaggaaatgtataacctgttgggcttactggatcgtgatgaaggtatccggttagagccttcggcgctagttgggatggcgggccctgctcgtgtgagtggaaaccttgattacctgaacaataagaacctttcagcagaaaagatgaaacaggctacgcatttggtctgggcaaccggtggtggtatggtacccgatgatgaaatgacaaaatatttggcgacagccaagatctaa

SEQ ID NO: 30615 - protein, 443 aa, Photorhabdus luminescens subsp. laumondii TTO1
MKRTEIQQLLNEYPLVKNLMELEEIFWFNPCNTTLKEGLPFVGLGADDVEDAEARLDRFASYLCKAFPETAVTHGIIESEIVAIPTMQKTLEQHYGVGITGRILLKKDSHLPISGSIKARGGIYEVLTHAEKLALQAGLLAENDDYSKLFSEELRRFFNQYSIAVGSTGNLGLSIGIASAKLGFNVSVHMSADAREWKKQKLRSHGVNVVEHELDYGVAVARGRKEAESAPNCFFIDDENSQTLFLGYSVAGGRVKAQFEQMNIVVDEDHPLFVYLPCGVGGGPGGVAFGLKLAFGDHVHCIFAEPTHSPSMLLGVYTGLHDNICVQDIGIDNITAADGLAVGRASGFVGRAMERLLDGFYTVQDQEMYNLLGLLDRDEGIRLEPSALVGMAGPARVSGNLDYLNNKNLSAEKMKQATHLVWATGGGMVPDDEMTKYLATAKI

SEQ ID NO: 30616 - DNA, 1332 bp, Bacillus cereus ATCC 10987
  CDS (1)..(1332): transl_table=11
atgaaggaaatagagaaattaaaagaggaatatccactcttaaataaattaatcgcaacagaagaagtgttttgggtgaatccgaacatggaaaagtatgaaacggcaataaaagattcgccactgaatgaagagaatgtaaaagatgcggaagagaggttaaagcgttttgcaccatatattgcgaaagtttttcctgaaacgaaagagactaacggcataattgaatcacctttagtgaaaatcccttcaatgaaacaagctttagagaaaaattatgagcaacctattttaggagaattattattaaaatgtgatagtcatcttccgatatcagggtcaattaaagctaggggcggcatttatgaagtgttgaagcatgctgagcaattagcgttgcagtatggtatgttaacagaagaagatgattattccattttagatagtgatacatgtagagagttttttgccacgtattctatcgcagtcggttcaacaggaaatttagggctaagcattgggattatgagtgcgaaactaggttttaacgtaacggttcatatgtcagcagatgcgaaacaatggaaaaaagatttattaagaagtaaaggtgtaaatgttattgaatatgaagctgattacagtaaagctgtagaagaaggaagaaggcaagcagatgcagatcctagctgttattttgtagatgatgaaaactcacatgatttatttttaggatacgcagtagcagcctcgcgtttacaaaaacaattagaagagttagagattgtagtggatgaagaacatcctttattcgtttatctaccatgcggagtagggggcggacctggcggagtcgcatttggtttaaagttattgtataaagacaacgtacactgtttctttgccgagcctacgcattctccatgcatgttactcggtttaatgacaggacttcatgataaaattgccgttcaagatatcgggattgataatgtaacagacgcggacggactagcggtaggaagaccgtctggatttgtcggtaaaacgatagaaccatttttgagtggaaattacacagtaagtgatgaagagttatatagattattaaaagaactagctgatacggaaaagatttatttagagccttctgcattagccggtatgataggaccagtgaaagtatgtgcagaagatgagtatttacaaaaacaacagttaacagagaagatgaagaaaggtactcatattgtgtggggaactggcggtagtatggttccagaagatgtgatgaatgggtattataagaaaggtttagaattaatactgtaa

SEQ ID NO: 30617 - protein, 443 aa, Bacillus cereus ATCC 10987
MKEIEKLKEEYPLLNKLIATEEVFWVNPNMEKYETAIKDSPLNEENVKDAEERLKRFAPYIAKVFPETKETNGIIESPLVKIPSMKQALEKNYEQPILGELLLKCDSHLPISGSIKARGGIYEVLKHAEQLALQYGMLTEEDDYSILDSDTCREFFATYSIAVGSTGNLGLSIGIMSAKLGFNVTVHMSADAKQWKKDLLRSKGVNVIEYEADYSKAVEEGRRQADADPSCYFVDDENSHDLFLGYAVAASRLQKQLEELEIVVDEEHPLFVYLPCGVGGGPGGVAFGLKLLYKDNVHCFFAEPTHSPCMLLGLMTGLHDKIAVQDIGIDNVTDADGLAVGRPSGFVGKTIEPFLSGNYTVSDEELYRLLKELADTEKIYLEPSALAGMIGPVKVCAEDEYLQKQQLTEKMKKGTHIVWGTGGSMVPEDVMNGYYKKGLELIL

SEQ ID NO: 30618 - DNA, 1326 bp, Acinetobacter sp. ADP1
  CDS (1)..(1326): transl_table=11
atgactacattaaatattcaagccatacaacaagattcattaatcaagtcgctaaaaaattacgaagaaattttttggtttcagccagaacccacgccgattgagcagggattaaaacgtaccagtcttactcttgccgatattcaggatgccgaagcacgtttaacacgatttgcaccttatctggaaaaagtatttcctgaactgagaagtacacagggcaaaattgagtctgagattgtatctatcccaacaatgcaacatgactgtagcaaacgctttgcaatcgaaccaaatggaacatggtggctgaaaaaagatagtcatttacctatttctggttcaattaaggcgcgtggtggaatctatgaggtactggctcatgctgaaaagttggcacttaaagcgggtttagttacattgcaagataactattcacaactcgatagtgatcaggcacgtcaatttttctcaaattatcaaattgcagtaggatcaactggaaatttggggttatcgattggaattatgagtgccaaactaggctttcgagtgagtgtgcatatgtcagcagatgcacgtcagtggaaaaaagacaagctacgttcactgggtgtcaatgtggttgaatatgccagtgattatggtgttgcagtagagcagggacgcaaagctgcagagtcagatccaaactgctttttcattgatgatgagaactcgaccactttatttttaggctatgctgttgctggcttacgtttaaaacagcaattaatcgatcagaatattcaagttgatgctgagcatcctttatttgtttatttaccttgtggagtaggcggtggccctggtggtgtgagttttggacttaaacatgcccttggtgagcatgtacactgtatttttgccgaaccgactcactcaccttgcatgctgctcggggtttatacgggtttacatgatcagatttgtgtagcagatattggattggataatgctaccgctgccgatgggcttgcggtgggacgtgcttcaggttttgttggacgggctatgcaagatctgattgatggttactacactatttcagatcaacacttatttgagtttattcgcttaatggatcaaacccaatccatccaacttgaaccttctgctgtggcaggggtgttgggcatttatcatgtcaatacaaataaatcctatcaacaggcttatcatttaaatgcgatacaactaaaaaatgcaacacatttaatttgggcaacgggtggcggtatggttccgcccaatgaaatgcaaaaatatttaaagcagtgtgaataa

SEQ ID NO: 30619 - protein, 441 aa, Acinetobacter sp. ADP1
MTTLNIQAIQQDSLIKSLKNYEEIFWFQPEPTPIEQGLKRTSLTLADIQDAEARLTRFAPYLEKVFPELRSTQGKIESEIVSIPTMQHDCSKRFAIEPNGTWWLKKDSHLPISGSIKARGGIYEVLAHAEKLALKAGLVTLQDNYSQLDSDQARQFFSNYQIAVGSTGNLGLSIGIMSAKLGFRVSVHMSADARQWKKDKLRSLGVNVVEYASDYGVAVEQGRKAAESDPNCFFIDDENSTTLFLGYAVAGLRLKQQLIDQNIQVDAEHPLFVYLPCGVGGGPGGVSFGLKHALGEHVHCIFAEPTHSPCMLLGVYTGLHDQICVADIGLDNATAADGLAVGRASGFVGRAMQDLIDGYYTISDQHLFEFIRLMDQTQSIQLEPSAVAGVLGIYHVNTNKSYQQAYHLNAIQLKNATHLIWATGGGMVPPNEMQKYLKQCE

SEQ ID NO: 30620 - DNA, 1338 bp, Burkholderia pseudomallei K96243
  CDS (1)..(1338): transl_table=11
atgccagtcggccgttcgctttcgctcgatcccaatctattagctcagcttcaatcgcattcgccgacgctgtggctcaatccgcatcaaggcatgccgctgccggacttcgcgccgaccgccgcggatctcgccgatgccgacgcgcgcctgcgccgctgcgccggcttgctggccgagctatttgccgaactgcggccgtcgggcgggctcatcgcatcgccgttgcagccggccgagccgttgaagcgcgccgctcgagccggccatgcgcaggcgggcgcgtggtacgtcaagcgcgacgatgcattgccggtggccggctcgatcaaggcgcgcggcggttttcacgaggtgctcgcgctcgccgaatcgatcgccgagcggcacggcctcgcgggcgccgacaccgaccggcgcgcgctcgcgagcggcgcggcgcgtgcgcggttcgcgcgtcatacggtgatggtcggcagcaccggcaatctcggcttgagcatcgggatgctcgcgtcggcgctcgggttccgcaccgtcgtgcatatgtcggccgatgcgaaggcatggaagaaggcgcgcctgcgcacgcgcggcgtggaagtcgtcgagcatgcgggcgattatgcgaaagcggtggacgccgggcggcggcaggccgccgggatgccgtgctgccatttcgtcgacgatgaaggctcgcggatgctgttcctcggctacgcgacggccgccgccgagctcgccgcgcaactcgcgcaggcgggccgcccggtcgacgcgcgccatccgctgttcgtccatcttccgtgcggcgtcggcggcgcgccgggcggcatcgtgtacgggctgaaggcgctgtacggcgagcacgtgcatgcgttcgtcgccgagcccaccgcgtcgccttgcgtgctcgtgcagctcgcgggcgacgccgcgcatccgcgctccgtctacgacatcggcctcgacaatcggaccgaggccgacgggctggcggtcgcgcaggcgtcgcctctcgccgctgcgctgttgcgcgcgcaggccgccggcgcgttcaccgtcgacgatcgccagttgttcgcccatttgctcgacgcgcgcgagcggctcggcatcgacctcgagccgtccgcggcggccgcgttcggcggcccggcgtggatcgcgggatcggacgcggggcgcgcctatctgcgcggccggggcatcgatccggatgcggcgacgcacgtgatctgggccaccggcggctcgctcgtgccggcgcaagagcatcggcgctttcaggcgcatgcgcgcgcgcagcggcaggtgggcggcgcgggcgcgtga

SEQ ID NO: 30621 - protein, 445 aa, Burkholderia pseudomallei K96243
MPVGRSLSLDPNLLAQLQSHSPTLWLNPHQGMPLPDFAPTAADLADADARLRRCAGLLAELFAELRPSGGLIASPLQPAEPLKRAARAGHAQAGAWYVKRDDALPVAGSIKARGGFHEVLALAESIAERHGLAGADTDRRALASGAARARFARHTVMVGSTGNLGLSIGMLASALGFRTVVHMSADAKAWKKARLRTRGVEVVEHAGDYAKAVDAGRRQAAGMPCCHFVDDEGSRMLFLGYATAAAELAAQLAQAGRPVDARHPLFVHLPCGVGGAPGGIVYGLKALYGEHVHAFVAEPTASPCVLVQLAGDAAHPRSVYDIGLDNRTEADGLAVAQASPLAAALLRAQAAGAFTVDDRQLFAHLLDARERLGIDLEPSAAAAFGGPAWIAGSDAGRAYLRGRGIDPDAATHVIWATGGSLVPAQEHRRFQAHARAQRQVGGAGA

SEQ ID NO: 30622 - DNA, 1332 bp, Photobacterium profundum SS9
  CDS (1)..(1332): transl_table=11
atgagcacattaaatattcaacaattagttactgaatttcctctggttgaaaaactaatcgccttagacgatgtaagttggtttaacccaaatattacaactctggctgaaggcctgccttatgtagggcttgataaaacagatataaaagatgcaagtgaccgactaaaaagatttgctccttatttggcgaaggcatttcctgaaacagccaaaacaaatggcattatagaatctgatgttgttgctattccagccatgaaaacggttcttgaacagcagtaccacatagcgattcaaggaaccttactactgaaaaaagatagtcatctgccgatttctggttcaatcaaagcgcgtggtggtatctatgaagtgctaactcatgctgaaaagttagcaatccaagctggcttgttgtctgagtctgatgattacagcaaattgtttacggatgaatttagagctttctttaagcagtttagtatcgcggtaggttctaccggtaatctaggcatgtctatcggtattatgagcgcaaaaattggcttttctgtatcggttcatatgtcggcagatgcccgtcaatggaaaaaagacaaacttcgctctcatggtgtaatcgttgttgaatacaaagaagactacggtgtagcggttgcacagggacgtaaagaagcagaaaaagatccaacgtgcttctttattgatgatgaaaattcgccaacacttttcttaggctattctgttgcaggagagcgactaaagagccagttcgaagccatgaatattctggtagatgagctgcatccactgtttgtctatttaccttgtggtgttggtggcggccctggcggtgtggcgtttggtttaaaaatggcatttggtgataatgttcattgtatctttgcggaacctacccactcaccttgcatgttattgggtattcatactggcctgcatgatgaaatttcagttcaggatattggtatcgataatataacagctgctgacggcctagctgttggtcgtggttctggatttgtgggaagagcaatggaaagattacttgatggtttttataccataagtgatgaaaggatgtatcaccaccttggagagatgagcaagtatgaagatattcagctagagccttcagctttagccggaatgctaggccctgttgtagtttctgacaatgaagaatatcttcagcgaatccaaatggatgagcaaaaactgaaaaacgcgacccacttagtttgggctacgggtggtggtatggttccaagtgaagagatggcatcgtacctcgctaagtctggaatttaa

SEQ ID NO: 30623 - protein, 443 aa, Photobacterium profundum SS9
MSTLNIQQLVTEFPLVEKLIALDDVSWFNPNITTLAEGLPYVGLDKTDIKDASDRLKRFAPYLAKAFPETAKTNGIIESDVVAIPAMKTVLEQQYHIAIQGTLLLKKDSHLPISGSIKARGGIYEVLTHAEKLAIQAGLLSESDDYSKLFTDEFRAFFKQFSIAVGSTGNLGMSIGIMSAKIGFSVSVHMSADARQWKKDKLRSHGVIVVEYKEDYGVAVAQGRKEAEKDPTCFFIDDENSPTLFLGYSVAGERLKSQFEAMNILVDELHPLFVYLPCGVGGGPGGVAFGLKMAFGDNVHCIFAEPTHSPCMLLGIHTGLHDEISVQDIGIDNITAADGLAVGRGSGFVGRAMERLLDGFYTISDERMYHHLGEMSKYEDIQLEPSALAGMLGPVVVSDNEEYLQRIQMDEQKLKNATHLVWATGGGMVPSEEMASYLAKSGI

SEQ ID NO: 30624 - DNA, 1317 bp, Haemophilus somnus 129PT
  CDS (1)..(1317)
atgaaaattcaacatttaatgcaagatcctttcattcaaaaattaatgcgttttgaagaagtgatgtggtttaatcctaaaagtgcgggggtaaaaacaggattgtcttacgttgggttggatgtatccgacactcaacaggcggcggaacgtttgcagcgttttgctccttatttttgtcgtgcttttcctgaaactcaaaaaacgaaaggtattttagaatctgaactggtatctattgataagatgaaatcggccttaatcgatcattatcatatgccgatacaaggacgtttattgctcaaaaaagacagtcatttaccaatttcaggatcaattaaagcaagaggcggaatatatgaagtgttggcttacgcagaaaaattggcattagaacaccatttaattaccgaaaatgatgattatagtcaattgtgcgatgaaaagatcaaagattttttcagccgttatagtattgcagtaggatcaacggggaatttggggctttccatcggtattatgggggctgtactcggcttcaaagttagtgtgcatatgtcagccgatgcaagagaatggaaaaagcaaaagttgcgttcatacggtgtgaatgttgtggaatatacacaagattacggtgtagctgtcgctcaaggacggaaggcagctctttccgatccgaactgcttttttattgatgatgagaattcgacaacactttttttaggttattccgttgcaggtcaacgactaaaacaacaatttttggaacaaggtataaaagtagatgaaaatcatccgctctttgtttatcttccttgtggtgttggcggtggacctggcggtgttgcattcggattgaaattggcatttggcgattatgtacactgcatttttgctgaaccgactcattcaccttgtatgctgctcggtgtttatacagggttacatgataaaattgcggtacaagacttgggtattgataatatcacagctgctgatggtttagcagtagggcgtgcatcaggatttgttggtcgggcaatggaacatttgttagacggtttttatactattgaagatcaaaagttatatgatttactggggctattgcataagacagaaaatattcaacttgagccttctgctttggcaggaatgataggtccgttgcatatcaatcactccgattatttaagaagatatcacatcacacaagaacaattggcaaatgcaacacatatagtgtgggcgactggtggtggaatggtgcctgatgttgagatgcaaaaatatttgtcactcgggcgattttaa

SEQ ID NO: 30625 - protein, 438 aa, Haemophilus somnus 129PT
MKIQHLMQDPFIQKLMRFEEVMWFNPKSAGVKTGLSYVGLDVSDTQQAAERLQRFAPYFCRAFPETQKTKGILESELVSIDKMKSALIDHYHMPIQGRLLLKKDSHLPISGSIKARGGIYEVLAYAEKLALEHHLITENDDYSQLCDEKIKDFFSRYSIAVGSTGNLGLSIGIMGAVLGFKVSVHMSADAREWKKQKLRSYGVNVVEYTQDYGVAVAQGRKAALSDPNCFFIDDENSTTLFLGYSVAGQRLKQQFLEQGIKVDENHPLFVYLPCGVGGGPGGVAFGLKLAFGDYVHCIFAEPTHSPCMLLGVYTGLHDKIAVQDLGIDNITAADGLAVGRASGFVGRAMEHLLDGFYTIEDQKLYDLLGLLHKTENIQLEPSALAGMIGPLHINHSDYLRRYHITQEQLANATHIVWATGGGMVPDVEMQKYLSLGRF

SEQ ID NO: 30626 - DNA, 1362 bp, Burkholderia cepacia R1808
  CDS (1)..(1362)
atgaccgattccatctacggcaagccactcgaatcctggcttcgcgactacccgcttctgcgcccattgatggcgctcgagccggtcgagtggttcaaccccgccgtcgcgccgctgaccgaagcgctcgatgacattgcgctggacgcctcgcatatcgccgatgcgagcgcgcgcctgcaacgcttcgcgccgctgctggccgacctgttcgcagatgtgtgcgacacgggcggcatcatcgaatcgccgctcaccgacgtgcctgcgttcgcgcaggcattgagcgaacgttacggcgtggaaacgccgcggcgcctgctgctcaagcaggacagccatctgccgatctccggctcgatcaaggcgcgtggcggcatctatgaagtgctcttctacgccgagcagcttgcgctgcgccacggcttgctcaacgacggcgacgattaccgcgtcctcgccggcgacgcatgtcgcgcgctgtttcgcgagcaccgcatcgcggtcgggtcgaccggcaatctcggcatgtcgatcggcatcgcgagcgcgacgctcggctttgcggcgaccgtgcatatgtccaccgatgcgcgccaatggaagaaggaccgcctgcgcgcgcatggcgtgacggtcgtggagtatgcgggcgattacggcgaagcgatcgagaacggccggcgtcttgcggctaacgatccgatgtgccacttcgtcgacgacgaaaattcgacgacgctgttcctcggctatgcggtcgcgggtgagcgcctgaagcgtcagctcgaagcgtcgaacgtgcgtgtcgatgcgacgcatccgctcttcgtgtatctgccttgcggcgtaggcggcggcccgggcggtgtcgcgttcggcttgaagctcgccttcggcgatgcggtgcactgtgttttcgcggagccgacccattcgccgtgcatgttgatgggcgtgctgaccggcttgcacgagcagcttgcggtgcaggatttcggtatcgacaacgtgacggccgccgacggcctcgcggtcggacgcccttccggattcgtcggtcgtgcgatgcaacggatgatcgatggctatttcaccgtcgaggatcgcgagctatatgcaatgctcgcgctgatggcgcagacgagcgacatccggctggagccgtcggcgctggccggcgcgccgggtttcgcgcgcgtgtcgacggagcggcaaggttaccgtgcccgcatgcagctggacgactccgtgatgcgggacgcgacgcatgtgatctgggcaacgggcggcggtatggtgccgcaagctgagatgaacgcatatctgcaggccgggcggcaggcactggcggggtcttga

SEQ ID NO: 30627 - protein, 453 aa, Burkholderia cepacia R1808
MTDSIYGKPLESWLRDYPLLRPLMALEPVEWFNPAVAPLTEALDDIALDASHIADASARLQRFAPLLADLFADVCDTGGIIESPLTDVPAFAQALSERYGVETPRRLLLKQDSHLPISGSIKARGGIYEVLFYAEQLALRHGLLNDGDDYRVLAGDACRALFREHRIAVGSTGNLGMSIGIASATLGFAATVHMSTDARQWKKDRLRAHGVTVVEYAGDYGEAIENGRRLAANDPMCHFVDDENSTTLFLGYAVAGERLKRQLEASNVRVDATHPLFVYLPCGVGGGPGGVAFGLKLAFGDAVHCVFAEPTHSPCMLMGVLTGLHEQLAVQDFGIDNVTAADGLAVGRPSGFVGRAMQRMIDGYFTVEDRELYAMLALMAQTSDIRLEPSALAGAPGFARVSTERQGYRARMQLDDSVMRDATHVIWATGGGMVPQAEMNAYLQAGRQALAGS

SEQ ID NO: 30628 - DNA, 1605 bp, Oenococcus oeni PSU-1
  CDS (1)..(1605)
ttgattaacagtgttaaattactattcggttatcagcgcgcaagtactgagtgtcgtgttaattccgatgaggccacacctgttcccattccgaacacagaagttaagcttgtcagggcccaaagtagttacaggaacgcctgttgcaaggttaggtcgatgcgatgcaattcacccgtttgggtgtttttttttgcccagcctacgactttaacgattgctttgattcgtgttaattatcctcacaggatttgtctgccgactgactcgatcattataattaagcaggtatacgagggcgaaatgacagagactttattgaaaaagaaattgaatcttaatgatcaatttttattgaatttaaaaaactatcaagaaatcttttggaaaaatcctaattatggagatgaattacccgacctggatgtgaaccgggaaacgatttttcaggctaatcgtcgtttggaacgttttgcaccctatttagagtcggttttttcagacactaagcgaagtaaaggcattattgaatccccaattcaaagaatggattcaatcaaagatttgctttcagttaaaggttctcttcttattaagagagacgatttaatgcctgtaagtggttcgattaaaagtcggggcggaatttatgaagtattatgttttgctgaaaaaatagcaattgaaaatggttttgatttaaaaaaagataattatcaagaccttcgaaaagataagtatcgaaagcttttcaaccaatggagaatcgaggttgctagcaccggcaatctgggactaagcgttggcttaatggccagtacgcttggatttaaagcaaggattcacatgtcccatgatgccactgactggaaaattaacaaacttcttcaaaatggtgtcgaagttaagatttatgatgacaatttttcaaatgcagtcgcggcggctcgtgtatcctcgcaaagggatccatatagttattttatcgatgatgaaggttctaaattgctttttgccggctatgctaccgctggtgaaagagttaagaaacagttatcaaagatgcaaatagaggtttcaaaagaacatcctctagttgtttaccttccggctggtgtgggtggttcacctagtggggtcgcttttggtttaaaattgcaatttgctgatgctgttatccctattttcgttgagcctacacacatgccgtctgttcttttaggcatggccagtggactcaatcatgatatttcggtttacgatattggaattgatggtaagacagcagctgatggccttgccgtcggtagaccatcaatgattgccgggaaatacatgaaagataaattattcggtattgcaactgtttctgactcagatatgtttgcttatcagggaatgcttaaaaagctggaaaatattgaagtagaaccttctgcggcggttggaatccgtggattaattcaatccaaggaaatatccgaaattccagattcggcaactcatatggtctgggctaccgggggatcgatggtaccaaaaaatacaatgcataaatatgaagataaagcggttagaatctttaatacttggaagtctgaatga

SEQ ID NO: 30629 - protein, 534 aa, Oenococcus oeni PSU-1
MINSVKLLFGYQRASTECRVNSDEATPVPIPNTEVKLVRAQSSYRNACCKVRSMRCNSPVWVFFFAQPTTLTIALIRVNYPHRICLPTDSIIIIKQVYEGEMTETLLKKKLNLNDQFLLNLKNYQEIFWKNPNYGDELPDLDVNRETIFQANRRLERFAPYLESVFSDTKRSKGIIESPIQRMDSIKDLLSVKGSLLIKRDDLMPVSGSIKSRGGIYEVLCFAEKIAIENGFDLKKDNYQDLRKDKYRKLFNQWRIEVASTGNLGLSVGLMASTLGFKARIHMSHDATDWKINKLLQNGVEVKIYDDNFSNAVAAARVSSQRDPYSYFIDDEGSKLLFAGYATAGERVKKQLSKMQIEVSKEHPLVVYLPAGVGGSPSGVAFGLKLQFADAVIPIFVEPTHMPSVLLGMASGLNHDISVYDIGIDGKTAADGLAVGRPSMIAGKYMKDKLFGIATVSDSDMFAYQGMLKKLENIEVEPSAAVGIRGLIQSKEISEIPDSATHMVWATGGSMVPKNTMHKYEDKAVRIFNTWKSE

SEQ ID NO: 30630 - DNA, 1299 bp, Pediococcus pentosaceus ATCC 25745
  CDS (1)..(1299)
atgattgatgttgatgctctaagcaaaaaatatccagcgattaagcagatgcaagcttacgaaccaattttttggaagaacctgaattataaaaaggaagctgaattaccggttggagttgaacatatcttcgatgctgaagctcgttttcaacggtttgcaccttattttgaggtagcattcccagaaactttaccaacacatggaattttagaatcccctttgctcaaaatggataagatgaaggctgttttaaatgccgaagctcaaaaccaagttaagggtgatttgtatcttaaggctgataattatctaccaatttcgggctcaattaagtcacgtggtggaatctacgaagtgttgaaatttgccgaaaaagtagcaatgaaacacggtgaaattgtatatggtgataattatgctaaattaaatgaaccacgcttcaaggatttatttggacaatatggaattgtcgtgggctcaacgggaaatcttggactatcgattggtattgtagcttgtaaactaggttttagaactagcgtacatatgtcgagcgatgccgctcaatggaagaaggatatgttacgtgaaaagggcgttaatgttgttgaatataacgacaatttcactcatgctattacagaagcacgtaaatctgctgaagcagatcctatggcttacttcatcgatgatgaagggtcgtacgatttattcttgggatattcggttgctgcagttcgtcttcaagctcaattgaaggctcaaaatatcaaagttgatgcagaacatccattatttgtatatctacctgctggagtaggtggcagtcccagtggtgtagcctttggtctaaagaagattattggcgaaaacgttcatccaatttttgcggaaccaactcatattccatctgtttcactaggaatgatgaccggcttaaatgatcaaatttcagtttatgatgctggaattgatggagtaactaaggctgacggtcttgctgttgggcgtccatctagaattgctggtaagatgatggatacattattatatggaattcaaacttttgatgatcaaaagatgatgaagaatgttgcagaattgcatgactcagaaaatgtggatgttgaaccatcagctgcttctggttttacgattttagatgacgttcaagctcaattggaacaggattatccaatggaaaatgctagccatattgtttgggcgacgggtggtagcatggtgcctaagaatgatatggaccagtatgtggctgaaggacatcaagttaaataa

SEQ ID NO: 30631 - protein, 432 aa, Pediococcus pentosaceus ATCC 25745
MIDVDALSKKYPAIKQMQAYEPIFWKNLNYKKEAELPVGVEHIFDAEARFQRFAPYFEVAFPETLPTHGILESPLLKMDKMKAVLNAEAQNQVKGDLYLKADNYLPISGSIKSRGGIYEVLKFAEKVAMKHGEIVYGDNYAKLNEPRFKDLFGQYGIVVGSTGNLGLSIGIVACKLGFRTSVHMSSDAAQWKKDMLREKGVNVVEYNDNFTHAITEARKSAEADPMAYFIDDEGSYDLFLGYSVAAVRLQAQLKAQNIKVDAEHPLFVYLPAGVGGSPSGVAFGLKKIIGENVHPIFAEPTHIPSVSLGMMTGLNDQISVYDAGIDGVTKADGLAVGRPSRIAGKMMDTLLYGIQTFDDQKMMKNVAELHDSENVDVEPSAASGFTILDDVQAQLEQDYPMENASHIVWATGGSMVPKNDMDQYVAEGHQVK

SEQ ID NO: 30632 - DNA, 1323 bp, Bacillus clausii
  CDS (1)..(1323)
atggacatagcaggcaaaaacagagagcaatggttggcagcttacccacttttacaacaaattgtattgacaaaggaagtgtggtgggccaatccgaacaggcagcctgctagcgaagggctagcacgcctttctttaaaggaagaggacgtgaaggaagcagaacagcggttgcgacgctttgccccatacatagcaagcgtgtttccggaaacgaaaggggcagggggcttgatcgaatcgccgcttatcgacattcccacaatgaagcacaagcttgaccaacgatttggccaaaacgtgccaggccgacttttgctgaaaggcgatcacgcgctgcctatttcaggctccattaaagcgcggggcggtatttatgaagtgttgaaacatgcggaaagcttgttggtcgaccaacaaattctcactaaacaagacgattattcattgatcgccactgacgcagtccaatcgtttttctcgtcttatgccattgttgttggatcaacaggtaatttaggattaagcattggcatcattagcgcaaagctaggttttcgcgtgacggtacacatgtcagatgatgcaaagcaatggaaaaaagacatgttgcgagaaaaaggcgtgcgtgtggtcgaacattccgccgattacagcaaggcagtcgaagagggaagaaaagaatcagacgccgatccgaacagctattttattgatgacgaacattcaattgatctatttgtagggtatgctgtcgctgcatttcgcttaaaagaacagttgcaggaaaagggaattgccgtcacaaaagaccaaccgctccacgtctatcttccatgtggcgttggcggcggtcctggcggggttgctttcggcttgaagctcgttttcggtgacgctgtccgctgttttttcgcagagcctacccattcgccatgtatgttaattggtatgttaactggaaagcaccagcacatttctgtccaagactttggaatcgacaaccaaacagcagccgacggtcttgcggtagggagaccgtctggctttgttggccgcatgatggctccattgcttgagggcatctacacaatcgccgacccgatgctttatacactcttggctgatctcgccgacgcagaaggcctctatttggagccatcagcagttgcgggattatacggccctgtacagcttgaaaagagagggctatataccgatgcagcgactcatcttgtctgggcgacaggaggaagcatggtgcctaaagagatcatggaaacggattaccaactaggtgtcaacttacggactgagcagtag

SEQ ID NO: 30633 - protein, 440 aa, Bacillus clausii
MDIAGKNREQWLAAYPLLQQIVLTKEVWWANPNRQPASEGLARLSLKEEDVKEAEQRLRRFAPYIASVFPETKGAGGLIESPLIDIPTMKHKLDQRFGQNVPGRLLLKGDHALPISGSIKARGGIYEVLKHAESLLVDQQILTKQDDYSLIATDAVQSFFSSYAIVVGSTGNLGLSIGIISAKLGFRVTVHMSDDAKQWKKDMLREKGVRVVEHSADYSKAVEEGRKESDADPNSYFIDDEHSIDLFVGYAVAAFRLKEQLQEKGIAVTKDQPLHVYLPCGVGGGPGGVAFGLKLVFGDAVRCFFAEPTHSPCMLIGMLTGKHQHISVQDFGIDNQTAADGLAVGRPSGFVGRMMAPLLEGIYTIADPMLYTLLADLADAEGLYLEPSAVAGLYGPVQLEKRGLYTDAATHLVWATGGSMVPKEIMETDYQLGVNLRTEQ

SEQ ID NO: 30634 - DNA, 1326 bp, Geobacillus kaustophilus
  CDS (1)..(1326): transl_table=11
atgatcatggcggccgaagaggtgttttggcgcaatccaaaatatcacgcgtttgcgcaagccattcgaacgattcctttacgcgaacgcgatgtcaaggaggcggaagaacgattgcgccgctttgccccctacatcgcgaaagtgtttcccgagacgcagccagcccatggcatcatcgaatcccctttagtccggattccgaacatgcaacggcgtttggaaaagatgtttcagaccaacatcgagggggatctgttgctaaaatgcgacagccatctcccgatttccgggtcgatcaaggcgcgtgggggcatttacgaagtgttgaaacacgcggaagatcttgcgctcgcaaatgggatgatcgccataggagaggactatgcggttatggccagcgaagaattccggcagttcttttcccgctattcgcttgtcgtcggttcgacaggaaatttaggcttgagcatcggcatcatcggggcgcagcttgggttccgcgtcaccgttcatatgtcagccgatgcgaaacaatggaaaaaagacttattgcgaagcaaaggggtcaccgtcatcgaacatctcactgattacaacaaagtggtggaagaggcgcgaagacagtccgccgaggatccaacgtcgtattttatcgatgatgagaactcgatccatctgtttttaggctatgcggtggcggcgtttcggctgaaaaagcaattagaggacatgaacatcacggttgatgaaacccatccgctctttgtgtatcttccttgcggcgtcggcggcggtccgggcggggtgacgtttgggctgaagctcgtgtacggcgatcatgtccattgctttttcgctgagccgacgcattcgccttgcatgctgcttgggttgatgacaggagagcacgaccgcgtgtcggtgcaagattttggcctcgacaataagaccgaagcggacgggctagcggtgggccggccgtcgaggttggtggggaacatgcttgagaacgtcatcagcggcgtctatacggtggacgattcgacgctttaccgcttgctcgcggctatggttgaaacggaggaaatctatttagagccgtccgccttggcgggggtggcggggcctgttcggttgtttcgcgattcggcgggacaaacgtatgtagaggaaaacgatttgaaagaaaaaatgaaaaacgccgtccatatttgctgggctaccggtggaagcatggtgccaaagggtgtgatggaggcctattatcgggaaggcatgcgcatcgaaactatgacagggaactgtttttccgaaggacgataa

SEQ ID NO: 30635 - protein, 441 aa, Geobacillus kaustophilus
MIMAAEEVFWRNPKYHAFAQAIRTIPLRERDVKEAEERLRRFAPYIAKVFPETQPAHGIIESPLVRIPNMQRRLEKMFQTNIEGDLLLKCDSHLPISGSIKARGGIYEVLKHAEDLALANGMIAIGEDYAVMASEEFRQFFSRYSLVVGSTGNLGLSIGIIGAQLGFRVTVHMSADAKQWKKDLLRSKGVTVIEHLTDYNKVVEEARRQSAEDPTSYFIDDENSIHLFLGYAVAAFRLKKQLEDMNITVDETHPLFVYLPCGVGGGPGGVTFGLKLVYGDHVHCFFAEPTHSPCMLLGLMTGEHDRVSVQDFGLDNKTEADGLAVGRPSRLVGNMLENVISGVYTVDDSTLYRLLAAMVETEEIYLEPSALAGVAGPVRLFRDSAGQTYVEENDLKEKMKNAVHICWATGGSMVPKGVMEAYYREGMRIETMTGNCFSEGR

SEQ ID NO: 30636 - DNA, 1380 bp, Bacillus stearothermophilus
  CDS (1)..(1380): transl_table=11
atgatgaccaaaaacgaaatccaaaagtgggtaaaggaattcccgctgcttaaaacgatcatggcggccgaagaggtgttttggcgcaatccaaaatatcacgcgttcgcgcaagccattcgaacgattcctttacgcgaacgcgatgtcaaggaggcggaagaacgattgcgccgctttgccccctacatcgcgaaggcatttcccgagacgcgaacggcccacggcatcatcgaatcccctttagtccggatttcgaacatgaaacagcgtttagaaaagatgtttcagaccaacattgagggggagctgttgctaaaatgcgacagccatctcccgatttccgggtcgatcaaggcgcgtgggggcatttacgaagtgttgaaacacgcggaagatcttgcgctcgccaacgggatgatcaccataggagacgactatgcggtcatggacagcgagaaattcaggcaattcttttcccgctattcgcttgtcgtcggttcgacagggaacttgggcttgagcatcggcatcatcggggcaaagcttggattccgcgtcaccgttcatatgtcagccgatgcgaaacaatggaaaaaagacttgttgcgaagcaaaggggtcaccgtcatcgaacatctcaccgattacaacaaagtggtggaagaggcgcgaagacagtccgccgaggatccaacgtcgtattttatcgatgatgaaaactcgatccatctgtttttaggctatgcggtggcggcgtttcggctgaaaaagcaattagaggacatgaacatcacggttgatgaaaaccacccgctctttgtgtatcttccttgcggcgtcggcggcggtccgggcggggtgacgtttgggctgaagctcgtgtacggcgatcatgtgcattgctttttcgctgagccgacgcattcgccttgcatgctgcttgggttgatgacaggagagcacgaccgcgtgtcggtgcaagattttggcctcgacaataagaccgaagcggacgggctagcggtgggccggccgtcgcggctggtggggaacatgcttgagaacgtcatcagcggcgtctatacggtggacgattcgacgctttaccgcttgctcgcggcgatggtggaaacggaggaaatctatttagagccgtccgccttggcgggggtggcggggcctgttcggctgtttcgtgatttggcggggcaaacgtacgtagaggcaaacggtttgaaagaaaagatgaaaaacgccacccatattggctgggcgacgggtggaagcatggtgccaaaggatgtgatggaggcctattatcgggaaggcgtgcggattgaaacgatgacagggaacggtttttctgaaggacgataa

SEQ ID NO: 30637 - protein, 459 aa, Bacillus stearothermophilus
MMTKNEIQKWVKEFPLLKTIMAAEEVFWRNPKYHAFAQAIRTIPLRERDVKEAEERLRRFAPYIAKAFPETRTAHGIIESPLVRISNMKQRLEKMFQTNIEGELLLKCDSHLPISGSIKARGGIYEVLKHAEDLALANGMITIGDDYAVMDSEKFRQFFSRYSLVVGSTGNLGLSIGIIGAKLGFRVTVHMSADAKQWKKDLLRSKGVTVIEHLTDYNKVVEEARRQSAEDPTSYFIDDENSIHLFLGYAVAAFRLKKQLEDMNITVDENHPLFVYLPCGVGGGPGGVTFGLKLVYGDHVHCFFAEPTHSPCMLLGLMTGEHDRVSVQDFGLDNKTEADGLAVGRPSRLVGNMLENVISGVYTVDDSTLYRLLAAMVETEEIYLEPSALAGVAGPVRLFRDLAGQTYVEANGLKEKMKNATHIGWATGGSMVPKDVMEAYYREGVRIETMTGNGFSEGR

SEQ ID NO: 30638 - DNA, 1329 bp, Bacillus halodurans
  CDS (1)..(1329)
atgaacgagcttgaacaatggagaaaagatccacttgtaattaaactaatggcgaccgaggaagttttttggctcaatcctcatatagattcgtttaagtcagcagttcgaaagcttagtctacacgaagacgacgtcaaggatgccgagaagcgattagatcggtttgcgccatatatcgcgaaagtttttcctggaacaaaccaagcgcacggaatgatcgaatctcccttagtgcaaatcccttcgatgaaacaatcgttagaacagaagtatctgcaaccaattacggggaacttattgctaaaatgcgatagtcatttacctatttccggatcgatcaaagcgaggggcggcatttatgaagtgctgaaacatgctgaacaactagctttgcagcatgggcttttaacagttcaagatgattattcgatccttgacagcgaaacttgccgggacttcttcgcgaattattcgattgccgttggttcgacggggaatttagggctcagcattggcatcattagcgcaaaacttggctttaacgtgtcggtccatatgtcggcagacgcaaagcaatggaaaaaagacttgcttcgaagtaaaaacgtcaacgtcattgaatatgaggatgattatagtcaagcggtagaggaagggcgaagagaggctgagcaggatcccacctgttattttgtggacgatgaacaatctcaagatctttttttaggctatgctgtggcagcctttcgactgaaaaaacaattggctgaacagaagattacggtcgatgagagtcaccctttgtttgtctatctcccatgcggggttggtggcgccccaggtgggattaccttcggtttaaagctgttgtttgaagatcatgtccactgcttttttgcagagcctacccactctccatccatgttgcttggacttttgacaggccttcatgagcggatttcggttcaagaaatcggtctcgacaaccgaacagaggcagatggacttgctgtcggcagaccttcgcgacttgtgtcaaggttaatgaagcctttattaagtgggagctttacgatagacgatgacaagctttttaccttactgaaagagctagccgatgcagaagggctgttccttgaaccttcagcgctggcaggaatgcttggaccgataaaattagttcaggaaggcaatcactatttaaaagcaaacaacttagctgaaaaaatgaacaatgccacgcatattatatggggaacaggcggcagcatggtacctgaagaggagatgatggcttattacagacggggaggaactattaagtga

SEQ ID NO: 30639 - protein, 442 aa, Bacillus halodurans
MNELEQWRKDPLVIKLMATEEVFWLNPHIDSFKSAVRKLSLHEDDVKDAEKRLDRFAPYIAKVFPGTNQAHGMIESPLVQIPSMKQSLEQKYLQPITGNLLLKCDSHLPISGSIKARGGIYEVLKHAEQLALQHGLLTVQDDYSILDSETCRDFFANYSIAVGSTGNLGLSIGIISAKLGFNVSVHMSADAKQWKKDLLRSKNVNVIEYEDDYSQAVEEGRREAEQDPTCYFVDDEQSQDLFLGYAVAAFRLKKQLAEQKITVDESHPLFVYLPCGVGGAPGGITFGLKLLFEDHVHCFFAEPTHSPSMLLGLLTGLHERISVQEIGLDNRTEADGLAVGRPSRLVSRLMKPLLSGSFTIDDDKLFTLLKELADAEGLFLEPSALAGMLGPIKLVQEGNHYLKANNLAEKMNNATHIIWGTGGSMVPEEEMMAYYRRGGTIK

SEQ ID NO: 30640 - DNA, 1347 bp, Bacillus subtilis
  CDS (1)..(1347): transl_table=11
atgtcagttcattcagaagtccttcatgctctgcttaaagatccgtttattcagaaactgattgatgcagagcctgtattctgggcaaattcaggcaagaaagaggggccattaccccgtgcagatgagtgggcaaccgagatagcggaagcggaaaaaagaatgcagcggtttgcaccttacattgccgaggtgtttcctgagacgaaaggcgctaaaggaatcatcgagtctccgctttttgaggtgcagcatatgaagggaaagctggaagcggcatatcagcagccatttcccggaagatggcttttaaagtgcgaccatgagcttccgatttcaggatcgattaaagcgaggggcgggatttatgaagtgttaaagtatgctgaaaatctcgcgcttcaagaaggaatgcttcaggaaaccgatgattaccgcatcttacaggaagagcggtttaccgggtttttctcccgctattcgattgctgtcggttcgacaggaaatctaggtttaagcatcggcatcatcggcgcggcactcgggtttcgcgtgacagtgcatatgtccgccgatgctaagcagtggaaaaaggatctcctccgccaaaagggagtcactgttatggagtacgaaacagattacagtgaagcggtgaacgaagggagacggcaggcggaacaagatccattctgttattttattgatgatgaacattctcgtcagctgttcttaggatatgctgttgctgcaagccgattaaaaacacagcttgactgtatgaatataaagccaagtcttgagacgcccttgtttgtgtatctgccgtgcggagtcggcggaggaccgggcggtgtagcatttgggctgaagcttttatacggagatgatgttcatgtgtttttcgcagaaccaactcattcaccttgtatgctgttagggctttattcaggacttcacgagaagatctccgtccaggatatcggcctggataatcagacggctgctgacggacttgccgtagggaggccgtcaggatttgtcggcaagctgattgaaccgcttctgagcggctgttatacggtagaggacaatacgctttatactttgcttcatatgctggctgtatctgaagataaatatttagagccctctgctcttgctggcatgttcgggccggttcagcttttttcgacagaagagggaaggcgctatgctcagaaatataagatggaacatgccgtacatgtcgtctggggaacgggaggaagcatggttccaaaagatgaaatggctgcgtataaccgaatcggtgctgatttgctaaaaaaacgaaatggaaaataa

SEQ ID NO: 30641 - protein, 448 aa, Bacillus subtilis
MSVHSEVLHALLKDPFIQKLIDAEPVFWANSGKKEGPLPRADEWATEIAEAEKRMQRFAPYIAEVFPETKGAKGIIESPLFEVQHMKGKLEAAYQQPFPGRWLLKCDHELPISGSIKARGGIYEVLKYAENLALQEGMLQETDDYRILQEERFTGFFSRYSIAVGSTGNLGLSIGIIGAALGFRVTVHMSADAKQWKKDLLRQKGVTVMEYETDYSEAVNEGRRQAEQDPFCYFIDDEHSRQLFLGYAVAASRLKTQLDCMNIKPSLETPLFVYLPCGVGGGPGGVAFGLKLLYGDDVHVFFAEPTHSPCMLLGLYSGLHEKISVQDIGLDNQTAADGLAVGRPSGFVGKLIEPLLSGCYTVEDNTLYTLLHMLAVSEDKYLEPSALAGMFGPVQLFSTEEGRRYAQKYKMEHAVHVVWGTGGSMVPKDEMAAYNRIGADLLKKRNGK

SEQ ID NO: 30642 - DNA, 1326 bp, Fusobacterium nucleatum
  CDS (1)..(1326): transl_table=11
atggatataaaaaatatgattataaataaccctttaataaaaaatatgatagataaaaaagaagttggttggacaaatccaaaagaaatgaactacacagaatatgaaaaaaaacttcctcttaaggatcaagaattaaaagaagcagaagaaagattaaaacgttttgctccttttatcaaaaaagttttcccagaaacagaagaaacatacggaattattgaatctcctttagaagaaatatttaatatgcaaaaagaattagaaaaaaaatatcatactgaaattctaggaaaattatatttgaaaatggatagtcatctcccagtagctggctctattaaagctagaggtggagtttatgaagttttaaaacatgcagaagaattagctatggaagcaggcttattaaaattagaagatgattattccatcttagcagataaaaaatttaaagattttttctcaaaatataaaatacaagttggttctactggaaatttaggattaagtataggaattacaagcgctgccttaggttttcaagtaattgtccatatgtctgcagatgctaaaaaatggaaaaaagatatgttaagatccaaaggagttcaagtaattgaatatgaaagtgattatggaaaggctgtggaagaaggaagaaaaaattctgatgcagatccgatgagttattttgtagatgatgaaaaatcaatgaatctatttttaggatacacagtagctgcttcaagaataaaaaaacaatttgataaaaaaggaattgtaattaataaagaacatcctcttattgtatatattccttgtggcgttggtggagctcctggaggagttgcttatggtcttaaaagaatatttaaagaaaatgtatatattttctttgttgaacctgtactagctccttgtatgttattaggaatgcaaacaggtttacatgaaaaaattagtgtctatgatgtaggaattcatggaattacacatgctgatggtttagctgtagcaagaccttctggtttggttggaagacttatggaacctattttaagtggaatttttactgtagatgattacaaattatatgattatttaagaattttaaatgaaacagaaaacaaaagaatcgaaccttcttcttgtgcagcatttgaaggagtagtttctctattaaaatatgaggatagtaaaaaatatattgaaaatagaattggaaaaaatattaataatgtatatcatgtatgctgggcaacaggtggaaaaatggttcctcaagaagatatggaaatatttttaaatacttatttaaaatag

SEQ ID NO: 30643 - protein, 441 aa, Fusobacterium nucleatum
MDIKNMIINNPLIKNMIDKKEVGWTNPKEMNYTEYEKKLPLKDQELKEAEERLKRFAPFIKKVFPETEETYGIIESPLEEIFNMQKELEKKYHTEILGKLYLKMDSHLPVAGSIKARGGVYEVLKHAEELAMEAGLLKLEDDYSILADKKFKDFFSKYKIQVGSTGNLGLSIGITSAALGFQVIVHMSADAKKWKKDMLRSKGVQVIEYESDYGKAVEEGRKNSDADPMSYFVDDEKSMNLFLGYTVAASRIKKQFDKKGIVINKEHPLIVYIPCGVGGAPGGVAYGLKRIFKENVYIFFVEPVLAPCMLLGMQTGLHEKISVYDVGIHGITHADGLAVARPSGLVGRLMEPILSGIFTVDDYKLYDYLRILNETENKRIEPSSCAAFEGVVSLLKYEDSKKYIENRIGKNINNVYHVCWATGGKMVPQEDMEIFLNTYLK

SEQ ID NO: 30644 - DNA, 1347 bp, Pseudomonas aeruginosa
  CDS (1)..(1347): transl_table=11
ttgattctcggaacacccaaggccgactggctcgccgaattcccgcgcctggccgacctcatcgccctgcgtccgagcgagtggttcaacccggccatcgcgccgagcgccgaagccctggccgacgtcggcctcggcgccgccgacgtggccgacgccagcgcccgcctgcagcgcttcgccccgctgatcgcccggctgtttccggaaaccgccgccagcggcggcatcatcgagtccgacctggtcgaggtcgccaccttccacgatgccctgcgccagcattacgccgccgaactgcccggccggctctggctgaaacgcgatagccacctgccgatctccggctcgatcaaggcccgcggcggcatctatgaagtgctcgcccatgccgagcgcctggccctggagcacggcctggtcggcctcgacgacgactactcgcggctggccgaggcggattgccgggcattcttcgcccgccaccggatagcggtgggctccaccggcaacctgggcctttccatcggcatcatcggcgccgcgctgggcttccaggccagcgtgcacatgtccgccgacgcccgccagtggaagaaggacaagctgcgcgcccacggcgtgacggtggtggagtacgcctccgactacagtgtcgcggtggaacagggccgccgcgaagcggccggcgatccctacacccatttcgtcgacgacgaaaactcccgcgacctgttcctcggctacgccgtcgccgccgagcgactgcgcggccagttggacgccgccggcatccgcgtcgacagcgagcacccgctgttcgtccatctgccctgcggggtcggcggcggtcccggcggggtggccttcggcctcaagctggcgttcggcgacgcggtgcactgcctgttcgccgagccgacccattcgccctgcatgttcctcggcgtctataccggccgccacgagcaggtttcggtgcaggacttcggcatcgacaaccgcaccgccgccgatggcctggcggtggggcgtccgtcgggcttcgtcggccgcgccatgcagcgcctgctcgacggctactacacggtggacgacgacgagttgttccgcctgctcgccttgctcgagcgcagccagggcatccgcctggaaccctcggccctggccggcgcgacgggcatcgcccgggtcacccgtgagccgcagggctatcgcgaacgcatggggctgacctcggcgcgcctggccaatgctacccacctggtctgggccaccggcggcggcatggtgcccgagacggaaatgcgcgcctacctggagcgaggccgctcgctgctggactga

SEQ ID NO: 30645 - protein, 448 aa, Pseudomonas aeruginosa
MILGTPKADWLAEFPRLADLIALRPSEWFNPAIAPSAEALADVGLGAADVADASARLQRFAPLIARLFPETAASGGIIESDLVEVATFHDALRQHYAAELPGRLWLKRDSHLPISGSIKARGGIYEVLAHAERLALEHGLVGLDDDYSRLAEADCRAFFARHRIAVGSTGNLGLSIGIIGAALGFQASVHMSADARQWKKDKLRAHGVTVVEYASDYSVAVEQGRREAAGDPYTHFVDDENSRDLFLGYAVAAERLRGQLDAAGIRVDSEHPLFVHLPCGVGGGPGGVAFGLKLAFGDAVHCLFAEPTHSPCMFLGVYTGRHEQVSVQDFGIDNRTAADGLAVGRPSGFVGRAMQRLLDGYYTVDDDELFRLLALLERSQGIRLEPSALAGATGIARVTREPQGYRERMGLTSARLANATHLVWATGGGMVPETEMRAYLERGRSLLD

SEQ ID NO: 30646 - DNA, 1323 bp, Salmonella typhimurium
  CDS (1)..(1323): transl_table=11
atggaaaacatacaaaagctcatcgcccggtatcctttggtcgaggatctggtcgccctcaaagaaaccacctggtttaacccgggcgccacctctcttgcacaaggtctaccgtatgtcggcctgacggagcaggacgtaaacgccgcccatgaccgtctggcgcgctttgcgccgtatctggcgaaagcgtttccgcaaaccgccgccgctggcggcatgatcgaatctgacgtggtcgctattccggccatgcaaaaacggctggaaaaagagtatgggcaaacgatcaacggtgaaatgctgttaaaaaaagacagtcacctggcaatctctggttccattaaagcgcgcggcggcatctacgaggtgctaacgcacgcggaaaaactggcgctggaggcgggtctgttaaccaccgacgatgactatagcgtgttgctttcgccggaatttaaacaattcttcagccagtacagtatcgccgtcggttcaaccggcaatctggggctatcgatcggtatcatgagcgcctgcatcggttttaaagtgacggtacatatgtctgccgacgcccgcgcctggaaaaaagcgaagctgcgtagccacggcgtgacggtcgtagaatacgaagatgattacggcgtggcggttgagcagggccgtaaagcagcgcaatccgatccaaactgtttctttatcgacgacgaaaactctcgcacgctatttctgggctatgcggtagcgggccagcgcctgaaagcgcaattcgcgcaacagggacgcgtcgttgacgccagtcacccactgtttgtttatctgccgtgcggcgttggcggcggccctggcggcgtcgcctttggcctgaaactggcgtttggcgacaacgtccactgtttctttgccgaaccgacccattccccctgcatgttactcggcgtttataccggtctgcacgatgccatctcagttcaagatatcggtattgataacctgacggcggctgacggcctggcggtaggtcgcgcttcgggttttgttggtcgggcaatggagcgtctgcttgacggcctctataccttagacgatcaaacaatgtatgacatgctgggctggctggcgcaggaggaaggaattcgactggagccatcagctctggcggggatggccgggccacagcgcatttgcgcctccgtcgcgtatcagcaaaggcatggattcagtcagacgcagctcggcaacgcgacgcatctggtatgggcaaccgggggcggcatggtgccggaagatgaaatggaacaatacctggcaaaaggacgctaa

SEQ ID NO: 30647 - protein, 440 aa, Salmonella typhimurium
MENIQKLIARYPLVEDLVALKETTWFNPGATSLAQGLPYVGLTEQDVNAAHDRLARFAPYLAKAFPQTAAAGGMIESDVVAIPAMQKRLEKEYGQTINGEMLLKKDSHLAISGSIKARGGIYEVLTHAEKLALEAGLLTTDDDYSVLLSPEFKQFFSQYSIAVGSTGNLGLSIGIMSACIGFKVTVHMSADARAWKKAKLRSHGVTVVEYEDDYGVAVEQGRKAAQSDPNCFFIDDENSRTLFLGYAVAGQRLKAQFAQQGRVVDASHPLFVYLPCGVGGGPGGVAFGLKLAFGDNVHCFFAEPTHSPCMLLGVYTGLHDAISVQDIGIDNLTAADGLAVGRASGFVGRAMERLLDGLYTLDDQTMYDMLGWLAQEEGIRLEPSALAGMAGPQRICASVAYQQRHGFSQTQLGNATHLVWATGGGMVPEDEMEQYLAKGR

SEQ ID NO: 30648 - DNA, 1326 bp, Vibrio cholerae
  CDS (1)..(1326): transl_table=11
atgatgacgatcaacatagagcaacttaccgagcaatatccgctagtcaaagagctcatcgagcttaaagaggtatcttggtttaacccatccattactcgccttgaggaagggttaagctacgttggacttggttctgaggatattcaagatgcgagtcaacgcttaaaacgattcgcaccttatcttgcaaaagcgtttccagaaaccgcgaaaacaaacggaattattgagtctgaggtcgttcccatttcagagatgcaaagcgtgcttgagcgtgaatatgacaccccaatacaaggtcgattactcctcaaaaaagacagtcacttacccatttctggctctataaaagcgcgaggcgggatctatgaagtgttgactcacgcagaaaaactcgcgatagaggccggattgctgacggagtcagatgactacagcaaactcttaaacgaagaatttcgtgatttctttaaacggttcagtattgcagtgggttcgaccggaaatctggggatgtcgattgggattatgagtgctaagttaggtttctcggtttctgtgcatatgtcagccgatgcaagggcgtggaagaaaaacagactccgtgctcttggggtcaatgtgattgagtacgcccaagattatggtgttgcggtcgctcaggggcgcaaagaagctgaaaatgatccgacgtgctttttcattgatgatgaaaattcgcaaactctatttctagggtattcggttgcaggtgaacgcctcaagaaacagttcgatgaaaaaggtattgtagtcgacgcgcagcaccctttatttgtttacctaccctgcggcgttggtgggggaccgggaggggttgctttcggtctgaaaatggcttttggggacaatgttcattgtatttttgctgagccgactcattctccatgcatgatgcttggtgttcatactggcttgcatgacgcaatcagtgttcaagatatcgggattgataacatcactgcagctgatggtttagcggtggggagagcttctggttttgtcggtcgagcaatggaaaggctgctggatggctatttaaccatcagtgatgagcgtatgtaccgactgcttgggcaattgaatgaagcggagaatatccagctcgagccttctgcattagccggtatgattggccctatcgtggtcacaaagagtgttgaatatcgagctcgaatgcagtttgatgataccgtgatggggaatgccacgcatcttgtttgggcgactggcgggggaatggttccagcagaagagatggactcttacctaaaaaatcgttga

SEQ ID NO: 30649 - protein, 441 aa, Vibrio cholerae
MMTINIEQLTEQYPLVKELIELKEVSWFNPSITRLEEGLSYVGLGSEDIQDASQRLKRFAPYLAKAFPETAKTNGIIESEVVPISEMQSVLEREYDTPIQGRLLLKKDSHLPISGSIKARGGIYEVLTHAEKLAIEAGLLTESDDYSKLLNEEFRDFFKRFSIAVGSTGNLGMSIGIMSAKLGFSVSVHMSADARAWKKNRLRALGVNVIEYAQDYGVAVAQGRKEAENDPTCFFIDDENSQTLFLGYSVAGERLKKQFDEKGIVVDAQHPLFVYLPCGVGGGPGGVAFGLKMAFGDNVHCIFAEPTHSPCMMLGVHTGLHDAISVQDIGIDNITAADGLAVGRASGFVGRAMERLLDGYLTISDERMYRLLGQLNEAENIQLEPSALAGMIGPIVVTKSVEYRARMQFDDTVMGNATHLVWATGGGMVPAEEMDSYLKNR

SEQ ID NO: 30650 - DNA, 25 bp, Artificial sequence
  (1)..(25): primer
atggaaaacgctaaaatgaactcgc

SEQ ID NO: 30651 - DNA, 24 bp, Artificial sequence
  (1)..(24): primer
ttaacggccttttgccagatattg

SEQ ID NO: 30652 - protein, 430 aa, Artificial sequence
  Variant (2)..(2): xaa in position 2 is any amino acid
  Variant (4)..(5): xaa in position 4 to 5 is any amino acid
  Variant (7)..(13): xaa in position 7 to 13 is any amino acid
  Variant (15)..(15): xaa in position 15 is any amino acid
  Variant (18)..(21): xaa in position 18 to 21 is any amino acid
  Variant (22)..(25): xaa in position 22 to 25 is any or no amino acid
  Variant (27)..(28): xaa in position 27 to 28 is any amino acid
  Variant (30)..(30): xaa in position 30 is any amino acid
  Variant (32)..(34): xaa in position 32 to 34 is any amino acid
  Variant (37)..(37): xaa in position 37 is any amino acid
  Variant (40)..(41): xaa in position 40 to 41 is any amino acid
  Variant (44)..(44): xaa in position 44 is any amino acid
  Variant (51)..(53): xaa in position 51 to 53 is any amino acid
  Variant (58)..(61): xaa in position 58 to 61 is any amino acid
  Variant (67)..(67): xaa in position 67 is any amino acid
  Variant (69)..(70): xaa in position 69 to 70 is any amino acid
  Variant (72)..(73): xaa in position 72 to 73 is any amino acid
  Variant (75)..(77): xaa in position 75 to 77 is any amino acid
  Variant (79)..(79): xaa in position 79 is any amino acid
  Variant (80)..(85): xaa in position 80 to 85 is any or no amino acid
  Variant (87)..(87): xaa in position 87 is any amino acid
  Variant (89)..(89): xaa in position 89 is any amino acid
  Variant (91)..(91): xaa in position 91 is any amino acid
  Variant (94)..(94): xaa in position 94 is any amino acid
  Variant (96)..(97): xaa in position 96 to 97 is any amino acid
  Variant (115)..(115): xaa in position 115 is any amino acid
  Variant (119)..(119): xaa in position 119 is any amino acid
  Variant (123)..(124): xaa in position 123 to 124 is any amino acid
  Variant (128)..(130): xaa in position 128 to 130 is any amino acid
  Variant (135)..(135): xaa in position 135 is any amino acid
  Variant (137)..(141): xaa in position 137 to 141 is any amino acid
  Variant (143)..(144): xaa in position 143 to 144 is any amino acid
  Variant (146)..(147): xaa in position 146 to 147 is any amino acid
  Variant (149)..(149): xaa in position 149 is any amino acid
  Variant (151)..(151): xaa in position 151 is any amino acid
  Variant (166)..(166): xaa in position 166 is any amino acid
  Variant (168)..(168): xaa in position 168 is any amino acid
  Variant (172)..(173): xaa in position 172 to 173 is any amino acid
  Variant (183)..(183): xaa in position 183 is any amino acid
  Variant (187)..(188): xaa in position 187 to 188 is any amino acid
  Variant (191)..(192): xaa in position 191 to 192 is any amino acid
  Variant (195)..(195): xaa in position 195 is any amino acid
  Variant (200)..(201): xaa in position 200 to 201 is any amino acid
  Variant (204)..(205): xaa in position 204 to 205 is any amino acid
  Variant (208)..(209): xaa in position 208 to 209 is any amino acid
  Variant (213)..(213): xaa in position 213 is any amino acid
  Variant (215)..(216): xaa in position 215 to 216 is any amino acid
  Variant (219)..(221): xaa in position 219 to 221 is any amino acid
  Variant (227)..(227): xaa in position 227 is any amino acid
  Variant (229)..(230): xaa in position 229 to 230 is any amino acid
  Variant (240)..(240): xaa in position 240 is any amino acid
  Variant (244)..(244): xaa in position 244 is any amino acid
  Variant (246)..(250): xaa in position 246 to 250 is any amino acid
  Variant (252)..(252): xaa in position 252 is any amino acid
  Variant (255)..(256): xaa in position 255 to 256 is any amino acid
  Variant (280)..(281): xaa in position 280 to 281 is any amino acid
  Variant (285)..(285): xaa in position 285 is any amino acid
  Variant (288)..(289): xaa in position 288 to 289 is any amino acid
  Variant (298)..(298): xaa in position 298 is any amino acid
  Variant (304)..(304): xaa in position 304 is any amino acid
  Variant (307)..(307): xaa in position 307 is any amino acid
  Variant (310)..(310): xaa in position 310 is any amino acid
  Variant (314)..(314): xaa in position 314 is any amino acid
  Variant (316)..(316): xaa in position 316 is any amino acid
  Variant (321)..(321): xaa in position 321 is any amino acid
  Variant (323)..(323): xaa in position 323 is any amino acid
  Variant (332)..(332): xaa in position 332 is any amino acid
  Variant (334)..(335): xaa in position 334 to 335 is any amino acid
  Variant (339)..(339): xaa in position 339 is any amino acid
  Variant (341)..(342): xaa in position 341 to 342 is any amino acid
  Variant (345)..(345): xaa in position 345 is any amino acid
  Variant (347)..(347): xaa in position 347 is any amino acid
  Variant (351)..(351): xaa in position 351 is any amino acid
  Variant (353)..(354): xaa in position 353 to 354 is any amino acid
  Variant (357)..(358): xaa in position 357 to 358 is any amino acid
  Variant (360)..(361): xaa in position 360 to 361 is any amino acid
  Variant (363)..(365): xaa in position 363 to 365 is any amino acid
  Variant (367)..(367): xaa in position 367 is any amino acid
  Variant (369)..(369): xaa in position 369 is any amino acid
  Variant (375)..(375): xaa in position 375 is any amino acid
  Variant (378)..(379): xaa in position 378 to 379 is any amino acid
  Variant (381)..(383): xaa in position 381 to 383 is any amino acid
  Variant (385)..(390): xaa in position 385 to 390 is any amino acid
  Variant (391)..(402): xaa in position 391 to 402 is any or no amino acid
  Variant (404)..(405): xaa in position 404 to 405 is any amino acid
  Variant (416)..(416): xaa in position 416 is any amino acid
  Variant (420)..(422): xaa in position 420 to 422 is any amino acid
  Variant (424)..(425): xaa in position 424 to 425 is any amino acid
  Variant (427)..(429): xaa in position 427 to 429 is any amino acid
PXIXXLXXXXXXXWXNPXXXXXXXXLXXVXLXXXDIXDAXXRLXRFAPYLXXXFPETXXXXGIIESXLXXIXXMXXXLXXXXXXXIXGXLXLKXDXXLPISGSIKARGGIYEVLXHAEXLALXXGLLXXXDDYSXLXXXXXRXXFXXYXIXVGSTGNLGLSIGIMXAXLGFXXTVHMSADARXWKKXXLRXXGVXVVEYXXDYXXAVXXGRKXAXXDPXXXFIDDEXSXXLFLGYAVAAXRLKXQXXXXXIXVDXXHPLFVYLPCGVGGGPGGVAFGLKXXFGDXVHXXFAEPTHSPXMLLGVXTGXHDXISVXDXGIDNXTXADGLAVGRXSXXVGRXMXXLLXGXYTVXDXXLYXXLXXLXXXEXIXLEPSAXAGXXGXXXVXXXXXXXXXXXXXXXXXXMXXATHLVWATGGXMVPXXXMXXYXXXG

SEQ ID NO: 30653 - protein, 17 aa, Artificial sequence
  Variant (9)..(9): xaa in position 9 is Ile or Val
  Variant (14)..(14): xaa in position 14 is any amino acid
  Variant (15)..(15): xaa in position 15 is His or Tyr
GSIKARGGXYEVLXXAE

SEQ ID NO: 30654 - protein, 46 aa, Artificial sequence
  Variant (2)..(2): xaa in position 2 is any or no amino acid
  Variant (10)..(10): xaa in position 10 is Leu or Met
  Variant (15)..(15): xaa in position 15 is any amino acid
  Variant (16)..(16): xaa in position 16 is Ala, Gly or Ser
  Variant (18)..(18): xaa in position 18 is any amino acid
  Variant (19)..(19): xaa in position 19 is Ile or Leu
  Variant (22)..(22): xaa in position 22 is any amino acid
  Variant (23)..(23): xaa in position 23 is Ala or Val
  Variant (24)..(24): xaa in position 24 is any amino acid
  Variant (29)..(29): xaa in position 29 is Ala, Asp or Thr
  Variant (32)..(32): xaa in position 32 is Lys or Arg
  Variant (33)..(33): xaa in position 33 is any amino acid
  Variant (37)..(37): xaa in position 37 is Ala, Asp, Asn or Gln
  Variant (38)..(38): xaa in position 38 is any amino acid
  Variant (41)..(41): xaa in position 41 is Ala, Glu, Gln or Ser
  Variant (42)..(42): xaa in position 42 is any amino acid
  Variant (43)..(43): xaa in position 43 is Gly or Asn
  Variant (45)..(45): xaa in position 45 is any amino acid
VXGSTGNLGXSIGIXXAXXGFXXXVHMSXDAXXWKKXXLRXXXVXV

SEQ ID NO: 30655 - protein, 24 aa, Artificial sequence
  Variant (2)..(2): xaa in position 2 is Ile or Val
  Variant (6)..(6): xaa in position 6 is any amino acid
  Variant (8)..(9): xaa in position 8 to 9 is any amino acid
  Variant (15)..(15): xaa in position 15 is Ala or Ser
  Variant (18)..(18): xaa in position 18 is Ala or Gly
  Variant (19)..(19): xaa in position 19 is any amino acid
  Variant (21)..(21): xaa in position 21 is Leu or Val
  Variant (22)..(23): xaa in position 22 to 23 is any amino acid
FXDDEXSXXLFLGYXVAXXRXXXQ

SEQ ID NO: 30656 - protein, 40 aa, Artificial sequence
  Variant (5)..(5): xaa in position 5 is His or Tyr
  Variant (8)..(8): xaa in position 8 is Ala or Cys
  Variant (13)..(13): xaa in position 13 is Ala, Gly or Ser
  Variant (15)..(15): xaa in position 15 is Gly or Ser
  Variant (17)..(17): xaa in position 17 is Ile or Val
  Variant (18)..(18): xaa in position 18 is Ala, Ser, Thr or Val
  Variant (19)..(19): xaa in position 19 is Phe or Tyr
  Variant (23)..(23): xaa in position 23 is any amino acid
  Variant (24)..(24): xaa in position 24 is Ala, Ile, Leu or Val
  Variant (25)..(26): xaa in position 25 to 26 is any amino acid
  Variant (27)..(27): xaa in position 27 is Asp or Glu
  Variant (28)..(28): xaa in position 28 is any amino acid
  Variant (31)..(31): xaa in position 31 is Ala, Cys, Pro or Val
  Variant (32)..(32): xaa in position 32 is Phe, Ile, Leu or Val
  Variant (33)..(33): xaa in position 33 is Phe or Val
  Variant (38)..(39): xaa in position 38 to 39 is any amino acid
PLFVXLPXGVGGXPXGXXXGLKXXXXXXVHXXXAEPTXXP

SEQ ID NO: 30657 - protein, 62 aa, Artificial sequence
  Variant (2)..(4): xaa in position 2 to 4 is any amino acid
  Variant (6)..(6): xaa in position 6 is Ile or Leu
  Variant (9)..(9): xaa in position 9 is any amino acid
  Variant (11)..(11): xaa in position 11 is any or no amino acid
  Variant (13)..(13): xaa in position 13 is any or no amino acid
  Variant (19)..(19): xaa in position 19 is Ala or Gly
  Variant (20)..(20): xaa in position 20 is Gln or Arg
  Variant (21)..(21): xaa in position 21 is Ala, Gly or Pro
  Variant (23)..(23): xaa in position 23 is any amino acid
  Variant (24)..(24): xaa in position 24 is Phe or Leu
  Variant (25)..(25): xaa in position 25 is Ala or Val
  Variant (26)..(26): xaa in position 26 is Ala, Gly or Ser
  Variant (27)..(28): xaa in position 27 to 28 is any amino acid
  Variant (29)..(29): xaa in position 29 is Ile, Leu or Met
  Variant (30)..(32): xaa in position 30 to 32 is any amino acid
  Variant (33)..(33): xaa in position 33 is Ala, Ile or Leu
  Variant (34)..(34): xaa in position 34 is Ala, Asp, Glu or Ser
  Variant (36)..(37): xaa in position 36 to 37 is any amino acid
  Variant (39)..(39): xaa in position 39 is Ile, Leu or Val
  Variant (40)..(40): xaa in position 40 is Ala, Asp, Glu, Gln or Ser
  Variant (42)..(43): xaa in position 42 to 43 is any amino acid
  Variant (44)..(44): xaa in position 44 is Leu or Met
  Variant (45)..(45): xaa in position 45 is Phe or Tyr
  Variant (46)..(47): xaa in position 46 to 47 is any amino acid
  Variant (48)..(48): xaa in position 48 is Ile or Leu
  Variant (49)..(58): xaa in position 49 to 58 is any amino acid
VXXXGXDNXTXAXDGLAVXXXSXXXXXXXXXXXXGXXTXXDXXXXXXXXXXXXXXXXXLEPS

SEQ ID NO: 30658 - protein, 12 aa, Artificial sequence
  Variant (2)..(2): xaa in position 2 is Ile, Leu, Met or Val
  Variant (3)..(3): xaa in position 3 is any amino acid
  Variant (9)..(9): xaa in position 9 is any amino acid
  Variant (11)..(11): xaa in position 11 is Met or Val
HXXWATGGXMXP

SEQ ID NO: 30659 - DNA, 1122 bp, Escherichia coli K12; identical to SEQ ID NO: 21814
  CDS (1)..(1122)

SEQ ID NO: 30660 - protein, 373 aa, Escherichia coli K12; identical to SEQ ID NO: 21815

SEQ ID NO: 30661 - DNA, 1122 bp, Yersinia pestis; identical to SEQ ID NO: 21816
  CDS (1)..(1122)

SEQ ID NO: 30662 - protein, 373 aa, Yersinia pestis; identical to SEQ ID NO: 21817

SEQ ID NO: 30663 - DNA, 1122 bp, Salmonella enterica subsp. enterica serovar Typhi; identical to SEQ ID NO: 21818
  CDS (1)..(1122)

SEQ ID NO: 30664 - protein, 373 aa, Salmonella enterica subsp. enterica serovar Typhi; identical to SEQ ID NO: 21819

SEQ ID NO: 30665 - DNA, 1128 bp, Vibrio cholerae; identical to SEQ ID NO: 21820
  CDS (1)..(1128)

SEQ ID NO: 30666 - protein, 375 aa, Vibrio cholerae; identical to SEQ ID NO: 21821

SEQ ID NO: 30667 - DNA, 1134 bp, Haemophilus influenzae; identical to SEQ ID NO: 21822
  CDS (1)..(1134)

SEQ ID NO: 30668 - protein, 377 aa, Haemophilus influenzae; identical to SEQ ID NO: 21823

SEQ ID NO: 30669 - DNA, 1122 bp, Erwinia herbicola; identical to SEQ ID NO: 21824
  CDS (1)..(1122)

SEQ ID NO: 30670 - protein, 373 aa, Erwinia herbicola; identical to SEQ ID NO: 21825

SEQ ID NO: 30671 - DNA, 1131 bp, Mannheimia succiniciproducens MBEL55E; identical to SEQ ID NO: 21826
  CDS (1)..(1131)

SEQ ID NO: 30672 - protein, 376 aa, Mannheimia succiniciproducens MBEL55E; identical to SEQ ID NO: 21827

SEQ ID NO: 30673 - DNA, 1122 bp, Erwinia carotovora; identical to SEQ ID NO: 21828
  CDS (1)..(1122)

SEQ ID NO: 30674 - protein, 373 aa, Erwinia carotovora; identical to SEQ ID NO: 21829

SEQ ID NO: 30675 - DNA, 1128 bp, Photobacterium profundum; identical to SEQ ID NO: 21830
  CDS (1)..(1128)

SEQ ID NO: 30676 - protein, 375 aa, Photobacterium profundum; identical to SEQ ID NO: 21831

SEQ ID NO: 30677 - DNA, 1128 bp, Vibrio vulnificus; identical to SEQ ID NO: 21832
  CDS (1)..(1128)

SEQ ID NO: 30678 - protein, 375 aa, Vibrio vulnificus; identical to SEQ ID NO: 21833

SEQ ID NO: 30679 - DNA, 1122 bp, Photorhabdus luminescens; identical to SEQ ID NO: 21834
  CDS (1)..(1122)

SEQ ID NO: 30680 - protein, 373 aa, Photorhabdus luminescens; identical to SEQ ID NO: 21835

SEQ ID NO: 30681 - DNA, 1134 bp, Candidatus Blochmannia floridanus; identical to SEQ ID NO: 21836
  CDS (1)..(1134)

SEQ ID NO: 30682 - protein, 377 aa, Candidatus Blochmannia floridanus; identical to SEQ ID NO: 21837

SEQ ID NO: 30683 - DNA, 1128 bp, Vibrio parahaemolyticus; identical to SEQ ID NO: 21838
  CDS (1)..(1128)

SEQ ID NO: 30684 - protein, 375 aa, Vibrio parahaemolyticus; identical to SEQ ID NO: 21839

SEQ ID NO: 30685 - DNA, 1140 bp, Shewanella oneidensis; identical to SEQ ID NO: 21840
  CDS (1)..(1140)

SEQ ID NO: 30686 - protein, 379 aa, Shewanella oneidensis; identical to SEQ ID NO: 21841

SEQ ID NO: 30687 - DNA, 1125 bp, Pasteurella multocida; identical to SEQ ID NO: 21842
  CDS (1)..(1125)

SEQ ID NO: 30688 - protein, 374 aa, Pasteurella multocida; identical to SEQ ID NO: 21843

SEQ ID NO: 30689 - DNA, 24 bp, Artificial sequence
  (1)..(24): primer
atggttgctgaattgaccgcatta

SEQ ID NO: 30690 - DNA, 23 bp, Artificial sequence
  (1)..(23): primer
ttactggcgattgtcattcgcct

SEQ ID NO: 30691 - protein, 370 aa, Artificial sequence; identical to SEQ ID NO: 21846
  Variant (2)..(4): xaa in position 2 to 4 is any amino acid
  Variant (6)..(7): xaa in position 6 to 7 is any amino acid
  Variant (10)..(11): xaa in position 10 to 11 is any amino acid
  Variant (13)..(21): xaa in position 13 to 21 is any amino acid
  Variant (24)..(24): xaa in position 24 is any amino acid
  Variant (27)..(29): xaa in position 27 to 29 is any amino acid
  Variant (31)..(32): xaa in position 31 to 32 is any amino acid
  Variant (34)..(36): xaa in position 34 to 36 is any amino acid
  Variant (39)..(39): xaa in position 39 is any amino acid
  Variant (42)..(42): xaa in position 42 is any amino acid
  Variant (44)..(44): xaa in position 44 is any amino acid
  Variant (47)..(49): xaa in position 47 to 49 is any amino acid
  Variant (51)..(52): xaa in position 51 to 52 is any amino acid
  Variant (54)..(55): xaa in position 54 to 55 is any amino acid
  Variant (58)..(60): xaa in position 58 to 60 is any amino acid
  Variant (62)..(65): xaa in position 62 to 65 is any amino acid
  Variant (67)..(68): xaa in position 67 to 68 is any amino acid
  Variant (70)..(70): xaa in position 70 is any amino acid
  Variant (74)..(74): xaa in position 74 is any amino acid
  Variant (80)..(81): xaa in position 80 to 81 is any amino acid
  Variant (83)..(85): xaa in position 83 to 85 is any amino acid
  Variant (89)..(97): xaa in position 89 to 97 is any amino acid
  Variant (99)..(100): xaa in position 99 to 100 is any amino acid
  Variant (103)..(103): xaa in position 103 is any amino acid
  Variant (105)..(106): xaa in position 105 to 106 is any amino acid
  Variant (108)..(109): xaa in position 108 to 109 is any amino acid
  Variant (111)..(116): xaa in position 111 to 116 is any amino acid
  Variant (120)..(123): xaa in position 120 to 123 is any amino acid
  Variant (125)..(127): xaa in position 125 to 127 is any amino acid
  Variant (130)..(131): xaa in position 130 to 131 is any amino acid
  Variant (133)..(145): xaa in position 133 to 145 is any amino acid
  Variant (149)..(154): xaa in position 149 to 154 is any amino acid
  Variant (156)..(161): xaa in position 156 to 161 is any amino acid
  Variant (163)..(169): xaa in position 163 to 169 is any amino acid
  Variant (172)..(172): xaa in position 172 is any amino acid
  Variant (174)..(174): xaa in position 174 is any amino acid
  Variant (176)..(182): xaa in position 176 to 182 is any amino acid
  Variant (184)..(185): xaa in position 184 to 185 is any amino acid
  Variant (187)..(187): xaa in position 187 is any amino acid
  Variant (189)..(189): xaa in position 189 is any amino acid
  Variant (191)..(191): xaa in position 191 is any amino acid
  Variant (193)..(193): xaa in position 193 is any amino acid
  Variant (198)..(199): xaa in position 198 to 199 is any amino acid
  Variant (201)..(205): xaa in position 201 to 205 is any amino acid
  Variant (207)..(208): xaa in position 207 to 208 is any amino acid
  Variant (210)..(210): xaa in position 210 is any amino acid
  Variant (212)..(214): xaa in position 212 to 214 is any amino acid
  Variant (216)..(216): xaa in position 216 is any amino acid
  Variant (219)..(222): xaa in position 219 to 222 is any amino acid
  Variant (224)..(224): xaa in position 224 is any amino acid
  Variant (226)..(228): xaa in position 226 to 228 is any amino acid
  Variant (230)..(232): xaa in position 230 to 232 is any amino acid
  Variant (236)..(244): xaa in position 236 to 244 is any amino acid
  Variant (247)..(248): xaa in position 247 to 248 is any amino acid
  Variant (250)..(252): xaa in position 250 to 252 is any amino acid
  Variant (254)..(256): xaa in position 254 to 256 is any amino acid
  Variant (259)..(260): xaa in position 259 to 260 is any amino acid
  Variant (262)..(263): xaa in position 262 to 263 is any amino acid
  Variant (265)..(266): xaa in position 265 to 266 is any amino acid
  Variant (268)..(280): xaa in position 268 to 280 is any amino acid
  Variant (284)..(286): xaa in position 284 to 286 is any amino acid
  Variant (290)..(292): xaa in position 290 to 292 is any amino acid
  Variant (297)..(297): xaa in position 297 is any amino acid
  Variant (299)..(301): xaa in position 299 to 301 is any amino acid
  Variant (304)..(304): xaa in position 304 is any amino acid
  Variant (308)..(316): xaa in position 308 to 316 is any amino acid
  Variant (318)..(338): xaa in position 318 to 338 is any amino acid
  Variant (340)..(342): xaa in position 340 to 342 is any amino acid
  Variant (344)..(348): xaa in position 344 to 348 is any amino acid
  Variant (350)..(356): xaa in position 350 to 356 is any amino acid
  Variant (358)..(360): xaa in position 358 to 360 is any amino acid
  Variant (362)..(364): xaa in position 362 to 364 is any amino acid
  Variant (366)..(369): xaa in position 366 to 369 is any amino acid

SEQ ID NO: 30692 - protein, 370 aa, Artificial sequence; identical to SEQ ID NO: 21847
  Variant (2)..(3): xaa in position 2 to 3 is any amino acid
  Variant (6)..(7): xaa in position 6 to 7 is any amino acid
  Variant (10)..(10): xaa in position 10 is any amino acid
  Variant (13)..(17): xaa in position 13 to 17 is any amino acid
  Variant (21)..(21): xaa in position 21 is any amino acid
  Variant (24)..(24): xaa in position 24 is any amino acid
  Variant (27)..(28): xaa in position 27 to 28 is any amino acid
  Variant (31)..(31): xaa in position 31 is any amino acid
  Variant (34)..(36): xaa in position 34 to 36 is any amino acid
  Variant (42)..(42): xaa in position 42 is any amino acid
  Variant (44)..(44): xaa in position 44 is any amino acid
  Variant (48)..(48): xaa in position 48 is any amino acid
  Variant (51)..(52): xaa in position 51 to 52 is any amino acid
  Variant (55)..(55): xaa in position 55 is any amino acid
  Variant (58)..(60): xaa in position 58 to 60 is any amino acid
  Variant (62)..(63): xaa in position 62 to 63 is any amino acid
  Variant (65)..(65): xaa in position 65 is any amino acid
  Variant (70)..(70): xaa in position 70 is any amino acid
  Variant (74)..(74): xaa in position 74 is any amino acid
  Variant (80)..(81): xaa in position 80 to 81 is any amino acid
  Variant (83)..(85): xaa in position 83 to 85 is any amino acid
  Variant (89)..(91): xaa in position 89 to 91 is any amino acid
  Variant (93)..(97): xaa in position 93 to 97 is any amino acid
  Variant (100)..(100): xaa in position 100 is any amino acid
  Variant (103)..(103): xaa in position 103 is any amino acid
  Variant (105)..(106): xaa in position 105 to 106 is any amino acid
  Variant (108)..(108): xaa in position 108 is any amino acid
  Variant (111)..(115): xaa in position 111 to 115 is any amino acid
  Variant (120)..(120): xaa in position 120 is any amino acid
  Variant (122)..(123): xaa in position 122 to 123 is any amino acid
  Variant (125)..(127): xaa in position 125 to 127 is any amino acid
  Variant (130)..(131): xaa in position 130 to 131 is any amino acid
  Variant (133)..(135): xaa in position 133 to 135 is any amino acid
  Variant (137)..(138): xaa in position 137 to 138 is any amino acid
  Variant (141)..(141): xaa in position 141 is any amino acid
  Variant (143)..(143): xaa in position 143 is any amino acid
  Variant (145)..(145): xaa in position 145 is any amino acid
  Variant (149)..(150): xaa in position 149 to 150 is any amino acid
  Variant (152)..(154): xaa in position 152 to 154 is any amino acid
  Variant (156)..(157): xaa in position 156 to 157 is any amino acid
  Variant (159)..(161): xaa in position 159 to 161 is any amino acid
  Variant (163)..(164): xaa in position 163 to 164 is any amino acid
  Variant (169)..(169): xaa in position 169 is any amino acid
  Variant (172)..(172): xaa in position 172 is any amino acid
  Variant (174)..(174): xaa in position 174 is any amino acid
  Variant (176)..(177): xaa in position 176 to 177 is any amino acid
  Variant (180)..(180): xaa in position 180 is any amino acid
  Variant (184)..(185): xaa in position 184 to 185 is any amino acid
  Variant (187)..(187): xaa in position 187 is any amino acid
  Variant (191)..(191): xaa in position 191 is any amino acid
  Variant (201)..(205): xaa in position 201 to 205 is any amino acid
  Variant (207)..(207): xaa in position 207 is any amino acid
  Variant (212)..(212): xaa in position 212 is any amino acid
  Variant (214)..(214): xaa in position 214 is any amino acid
  Variant (219)..(222): xaa in position 219 to 222 is any amino acid
  Variant (226)..(226): xaa in position 226 is any amino acid
  Variant (228)..(228): xaa in position 228 is any amino acid
  Variant (230)..(232): xaa in position 230 to 232 is any amino acid
  Variant (236)..(241): xaa in position 236 to 241 is any amino acid
  Variant (243)..(243): xaa in position 243 is any amino acid
  Variant (247)..(248): xaa in position 247 to 248 is any amino acid
  Variant (250)..(251): xaa in position 250 to 251 is any amino acid
  Variant (259)..(260): xaa in position 259 to 260 is any amino acid
  Variant (263)..(263): xaa in position 263 is any amino acid
  Variant (265)..(265): xaa in position 265 is any amino acid
  Variant (268)..(269): xaa in position 268 to 269 is any amino acid
  Variant (271)..(273): xaa in position 271 to 273 is any amino acid
  Variant (275)..(276): xaa in position 275 to 276 is any amino acid
  Variant (279)..(279): xaa in position 279 is any amino acid
  Variant (292)..(292): xaa in position 292 is any amino acid
  Variant (300)..(301): xaa in position 300 to 301 is any amino acid
  Variant (308)..(312): xaa in position 308 to 312 is any amino acid
  Variant (314)..(316): xaa in position 314 to 316 is any amino acid
  Variant (318)..(326): xaa in position 318 to 326 is any amino acid
  Variant (328)..(334): xaa in position 328 to 334 is any amino acid
  Variant (337)..(338): xaa in position 337 to 338 is any amino acid
  Variant (340)..(342): xaa in position 340 to 342 is any amino acid
  Variant (344)..(345): xaa in position 344 to 345 is any amino acid
  Variant (347)..(348): xaa in position 347 to 348 is any amino acid
  Variant (352)..(352): xaa in position 352 is any amino acid
  Variant (354)..(356): xaa in position 354 to 356 is any amino acid
  Variant (358)..(359): xaa in position 358 to 359 is any amino acid
  Variant (362)..(363): xaa in position 362 to 363 is any amino acid
  Variant (366)..(366): xaa in position 366 is any amino acid

SEQ ID NO: 30693 - protein, 62 aa, Artificial sequence; identical to SEQ ID NO: 21848
  Variant (2)..(3): xaa in position 2 to 3 is any amino acid
  Variant (4)..(4): xaa in position 4 is Leu or Ile
  Variant (6)..(7): xaa in position 6 to 7 is any amino acid
  Variant (10)..(10): xaa in position 10 is any amino acid
  Variant (11)..(11): xaa in position 11 is Val, Leu or Ile
  Variant (13)..(13): xaa in position 13 is Lys, Gln or Arg
  Variant (14)..(14): xaa in position 14 is any amino acid
  Variant (15)..(15): xaa in position 15 is Leu or Met
  Variant (16)..(16): xaa in position 16 is Leu, Val or Ile
  Variant (17)..(17): xaa in position 17 is any amino acid
  Variant (18)..(18): xaa in position 18 is Leu or Val
  Variant (19)..(19): xaa in position 19 is Leu or Phe
  Variant (20)..(20): xaa in position 20 is Ala, Ser or Arg
  Variant (21)..(21): xaa in position 21 is Lys, Gln or Arg
  Variant (24)..(24): xaa in position 24 is any amino acid
  Variant (27)..(27): xaa in position 27 is any amino acid
  Variant (28)..(28): xaa in position 28 is Gln, Glu or Lys
  Variant (29)..(29): xaa in position 29 is Val or Ile
  Variant (31)..(31): xaa in position 31 is any amino acid
  Variant (32)..(32): xaa in position 32 is Val or Ile
  Variant (34)..(34): xaa in position 34 is Ser or His
  Variant (35)..(36): xaa in position 35 to 36 is any amino acid
  Variant (39)..(39): xaa in position 39 is any amino acid
  Variant (42)..(42): xaa in position 42 is Ala, Val or Asp
  Variant (44)..(44): xaa in position 44 is Asp, Glu or Gln
  Variant (47)..(48): xaa in position 47 to 48 is any amino acid
  Variant (49)..(49): xaa in position 49 is Met or Ile
  Variant (51)..(52): xaa in position 51 to 52 is any amino acid
  Variant (54)..(54): xaa in position 54 is Arg or Lys
  Variant (55)..(55): xaa in position 55 is any amino acid
  Variant (58)..(60): xaa in position 58 to 60 is any amino acid
  Variant (62)..(62): xaa in position 62 is Val or Ile

SEQ ID NO: 30694 - protein, 23 aa, Artificial sequence
  Variant (2)..(2): xaa in position 2 is Ile, Val or Leu
  Variant (3)..(3): xaa in position 3 is Glu or Arg
  Variant (5)..(5): xaa in position 5 is Ile, Val or Leu
  Variant (9)..(9): xaa in position 9 is any amino acid
  Variant (15)..(16): xaa in position 15 to 16 is any amino acid
  Variant (18)..(18): xaa in position 18 is Asn, Lys or His
  Variant (19)..(20): xaa in position 19 to 20 is any amino acid
LXXDXLRRXMRESYXXEXXXGFK

SEQ ID NO: 30695 - protein, 52 aa, Artificial sequence; identical to SEQ ID NO: 21850
  Variant (1)..(1): xaa in position 1 is Val, Ile or Leu
  Variant (3)..(3): xaa in position 3 is Ile, Val or Leu
  Variant (4)..(4): xaa in position 4 is Val, Ile or Leu
  Variant (7)..(7): xaa in position 7 is any amino acid
  Variant (9)..(9): xaa in position 9 is Gln, Lys or Arg
  Variant (10)..(10): xaa in position 10 is Leu or Met
  Variant (12)..(12): xaa in position 12 is any amino acid
  Variant (13)..(13): xaa in position 13 is Leu or Phe
  Variant (15)..(15): xaa in position 15 is any amino acid
  Variant (16)..(16): xaa in position 16 is Arg, Lys or Gln
  Variant (17)..(17): xaa in position 17 is any amino acid
  Variant (18)..(18): xaa in position 18 is Leu or Phe
  Variant (19)..(19): xaa in position 19 is any amino acid
  Variant (20)..(20): xaa in position 20 is Leu or Ala
  Variant (24)..(24): xaa in position 24 is any amino acid
  Variant (25)..(25): xaa in position 25 is Val or Ile
  Variant (26)..(27): xaa in position 26 to 27 is any amino acid
  Variant (29)..(29): xaa in position 29 is Glu, Gly or Asp
  Variant (30)..(31): xaa in position 30 to 31 is any amino acid
  Variant (34)..(35): xaa in position 34 to 35 is any amino acid
  Variant (37)..(38): xaa in position 37 to 38 is any amino acid
  Variant (39)..(39): xaa in position 39 is Ile or Leu
  Variant (40)..(40): xaa in position 40 is Leu, Val or Phe
  Variant (41)..(42): xaa in position 41 to 42 is any amino acid
  Variant (43)..(43): xaa in position 43 is Ala, Val or Thr
  Variant (44)..(44): xaa in position 44 is Gly, Asp or Asn
  Variant (45)..(45): xaa in position 45 is Met, Leu, Val or Ala
  Variant (46)..(46): xaa in position 46 is Val, Ile or Leu
  Variant (47)..(47): xaa in position 47 is Ile, Leu, Val or Phe
  Variant (48)..(48): xaa in position 48 is Val, Ile or Leu
  Variant (49)..(49): xaa in position 49 is Ser, Thr or Cys

SEQ ID NO: 30696 - protein, 34 aa, Artificial sequence; identical to SEQ ID NO: 21851
  Variant (1)..(1): xaa in position 1 is Ile, Leu or Val
  Variant (2)..(2): xaa in position 2 is Leu, Ile or Val
  Variant (3)..(3): xaa in position 3 is any amino acid
  Variant (6)..(6): xaa in position 6 is Thr, Ala or Ser
  Variant (8)..(8): xaa in position 8 is Val, Ile or Leu
  Variant (10)..(11): xaa in position 10 to 11 is any amino acid
  Variant (12)..(12): xaa in position 12 is Pro or Ser
  Variant (13)..(13): xaa in position 13 is Leu or Met
  Variant (14)..(15): xaa in position 14 to 15 is any amino acid
  Variant (16)..(16): xaa in position 16 is Met or Ile
  Variant (18)..(18): xaa in position 18 is any amino acid
  Variant (19)..(19): xaa in position 19 is Val, Ala or Ile
  Variant (21)..(21): xaa in position 21 is any amino acid
  Variant (23)..(23): xaa in position 23 is Pro or Ala
  Variant (25)..(25): xaa in position 25 is Leu, Val or Ile
  Variant (27)..(27): xaa in position 27 is Leu or Phe
  Variant (32)..(32): xaa in position 32 is Gly or Ser
  Variant (33)..(33): xaa in position 33 is Pro or Ala

SEQ ID NO: 30697 - protein, 30 aa, Artificial sequence; identical to SEQ ID NO: 21852
  Variant (2)..(2): xaa in position 2 is Leu or Met
  Variant (3)..(3): xaa in position 3 is Ala, Ile or Val
  Variant (5)..(5): xaa in position 5 is Gln or Lys
  Variant (7)..(8): xaa in position 7 to 8 is Val, Ile or Leu
  Variant (9)..(9): xaa in position 9 is any amino acid
  Variant (11)..(11): xaa in position 11 is Asp or His
  Variant (14)..(17): xaa in position 14 to 17 is any amino acid
  Variant (19)..(19): xaa in position 19 is Gln or Glu
  Variant (21)..(21): xaa in position 21 is Leu or Phe
  Variant (22)..(22): xaa in position 22 is Leu, Ile or Val
  Variant (23)..(23): xaa in position 23 is Glu, Gln or Thr
  Variant (25)..(25): xaa in position 25 is Ile, Phe or Leu
  Variant (26)..(26): xaa in position 26 is any amino acid
  Variant (27)..(27): xaa in position 27 is Ile, Val, Leu or Met

SEQ ID NO: 30698 - protein, 23 aa, Artificial sequence
  Variant (3)..(4): xaa in position 3 to 4 is any amino acid
  Variant (6)..(6): xaa in position 6 is any amino acid
  Variant (7)..(7): xaa in position 7 is Phe, Leu or Tyr
  Variant (8)..(8): xaa in position 8 is Ile or Val
  Variant (10)..(10): xaa in position 10 is Ala or Ser
  Variant (11)..(11): xaa in position 11 is Leu or Met
  Variant (12)..(12): xaa in position 12 is Arg or Cys
  Variant (15)..(15): xaa in position 15 is Ala, Thr or Ser
  Variant (16)..(16): xaa in position 16 is Thr, Ser or Ile
  Variant (18)..(18): xaa in position 18 is Ala or Val
  Variant (19)..(19): xaa in position 19 is any amino acid
  Variant (21)..(21): xaa in position 21 is any amino acid
  Variant (22)..(22): xaa in position 22 is His or Asn
HDXXMXXXQXXXHFXXFXXGXXL

SEQ ID NO: 30699 - protein, 37 aa, Artificial sequence; identical to SEQ ID NO: 21854
  Variant (4)..(4): xaa in position 4 is Ile, Met, Leu or Phe
  Variant (5)..(5): xaa in position 5 is Tyr or Phe
  Variant (6)..(6): xaa in position 6 is Arg, Gln or Cys
  Variant (10)..(10): xaa in position 10 is Ala or Ile
  Variant (11)..(11): xaa in position 11 is Met, Leu, Val or Ile
  Variant (12)..(12): xaa in position 12 is Val, Ile or Leu
  Variant (17)..(17): xaa in position 17 is Ala, Gly or Thr
  Variant (19)..(21): xaa in position 19 to 21 is any amino acid
  Variant (24)..(24): xaa in position 24 is Ala or Gly
  Variant (28)..(28): xaa in position 28 is Met, Leu or Phe
  Variant (29)..(29): xaa in position 29 is Ser, Asp or Ala
  Variant (30)..(32): xaa in position 30 to 32 is any amino acid
  Variant (33)..(33): xaa in position 33 is Asn or Ser
  Variant (34)..(34): xaa in position 34 is Leu, Ile, Val or Gln
  Variant (35)..(35): xaa in position 35 is any amino acid
  Variant (36)..(36): xaa in position 36 is Leu, Met, Val or Ala

SEQ ID NO: 30700 - DNA, 1071 bp, Escherichia coli K12; identical to SEQ ID NO: 1333
  CDS (1)..(1071)

SEQ ID NO: 30701 - protein, 356 aa, Escherichia coli K12; identical to SEQ ID NO: 1334

SEQ ID NO: 30702 - DNA, 1235 bp, Salmonella typhimurium; identical to SEQ ID NO: 1325
  CDS (165)..(1235)

SEQ ID NO: 30703 - protein, 356 aa, Salmonella typhimurium; identical to SEQ ID NO: 1326

SEQ ID NO: 30704 - DNA, 1086 bp, Deinococcus radiodurans; identical to SEQ ID NO: 1327
  CDS (1)..(1086)

SEQ ID NO: 30705 - protein, 361 aa, Deinococcus radiodurans; identical to SEQ ID NO: 1328

SEQ ID NO: 30706 - DNA, 1056 bp, Neisseria meningitidis; identical to SEQ ID NO: 1329
  CDS (1)..(1056)

SEQ ID NO: 30707 - protein, 351 aa, Neisseria meningitidis; identical to SEQ ID NO: 1330

SEQ ID NO: 30708 - DNA, 1047 bp, Yersinia pestis; identical to SEQ ID NO: 1331
  CDS (1)..(1047)

SEQ ID NO: 30709 - protein, 348 aa, Yersinia pestis; identical to SEQ ID NO: 1332

SEQ ID NO: 30710 - DNA, 1047 bp, Salmonella enterica subsp. enterica serovar Typhi; identical to SEQ ID NO: 1575
  CDS (1)..(1047)

SEQ ID NO: 30711 - protein, 348 aa, Salmonella enterica subsp. enterica serovar Typhi; identical to SEQ ID NO: 1576

SEQ ID NO: 30712 - DNA, 1047 bp, Escherichia coli; identical to SEQ ID NO: 1323
  CDS (1)..(1047)

SEQ ID NO: 30713 - protein, 348 aa, Escherichia coli; identical to SEQ ID NO: 1324

SEQ ID NO: 30714 - DNA, 1188 bp, Escherichia coli; identical to SEQ ID NO: 1579
  CDS (92)..(1144)

SEQ ID NO: 30715 - protein, 350 aa, Escherichia coli; identical to SEQ ID NO: 1580

SEQ ID NO: 30716 - DNA, 1131 bp, Nostoc sp. PCC 7120; identical to SEQ ID NO: 1335
  CDS (1)..(1131)

SEQ ID NO: 30717 - protein, 376 aa, Nostoc sp. PCC 7120; identical to SEQ ID NO: 1336

SEQ ID NO: 30718 - DNA, 1053 bp, Salmonella enterica subsp. enterica serovar Typhi; identical to SEQ ID NO: 1337
  CDS (1)..(1053)

SEQ ID NO: 30719 - protein, 350 aa, Salmonella enterica subsp. enterica serovar Typhi; identical to SEQ ID NO: 1338

SEQ ID NO: 30720 - DNA, 1077 bp, Pseudomonas aeruginosa; identical to SEQ ID NO: 1339
  CDS (1)..(1077)

SEQ ID NO: 30721 - protein, 358 aa, Pseudomonas aeruginosa; identical to SEQ ID NO: 1340

SEQ ID NO: 30722 - DNA, 1047 bp, Buchnera sp; identical to SEQ ID NO: 1341
  CDS (1)..(1047)

SEQ ID NO: 30723 - protein, 348 aa, Buchnera sp; identical to SEQ ID NO: 1342

SEQ ID NO: 30724 - DNA, 1032 bp, Streptococcus pneumoniae; identical to SEQ ID NO: 1589
  CDS (1)..(1032)

SEQ ID NO: 30725 - protein, 343 aa, Streptococcus pneumoniae; identical to SEQ ID NO: 1590

SEQ ID NO: 30726 - DNA, 1074 bp, Vibrio cholerae; identical to SEQ ID NO: 1343
  CDS (1)..(1074)

SEQ ID NO: 30727 - protein, 357 aa, Vibrio cholerae; identical to SEQ ID NO: 1344

SEQ ID NO: 30728 - DNA, 1038 bp, Lactococcus lactis subsp. lactis; identical to SEQ ID NO: 1345
  CDS (1)..(1038)

SEQ ID NO: 30729 - protein, 345 aa, Lactococcus lactis subsp. lactis; identical to SEQ ID NO: 1346

SEQ ID NO: 30730 - DNA, 1023 bp, Lactococcus lactis subsp. lactis; identical to SEQ ID NO: 1347
  CDS (1)..(1023)

SEQ ID NO: 30731 - protein, 340 aa, Lactococcus lactis subsp. lactis; identical to SEQ ID NO: 1348

SEQ ID NO: 30732 - DNA, 1032 bp, Streptococcus pneumoniae; identical to SEQ ID NO: 1597
  CDS (1)..(1032)

SEQ ID NO: 30733 - protein, 343 aa, Streptococcus pneumoniae; identical to SEQ ID NO: 1350

SEQ ID NO: 30734 - DNA, 1095 bp, Pseudomonas aeruginosa; identical to SEQ ID NO: 1351
  CDS (1)..(1095)

SEQ ID NO: 30735 - protein, 364 aa, Pseudomonas aeruginosa; identical to SEQ ID NO: 1352

SEQ ID NO: 30736 - DNA, 1110 bp, Caulobacter crescentus; identical to SEQ ID NO: 1353
  CDS (1)..(1110)

SEQ ID NO: 30737 - protein, 369 aa, Caulobacter crescentus; identical to SEQ ID NO: 1354

SEQ ID NO: 30738 - DNA, 1143 bp, Xylella fastidiosa; identical to SEQ ID NO: 1603
  CDS (1)..(1143)

SEQ ID NO: 30739 - protein, 380 aa, Xylella fastidiosa; identical to SEQ ID NO: 1604

SEQ ID NO: 30740 - DNA, 1047 bp, Buchnera aphidicola; identical to SEQ ID NO: 1357
  CDS (1)..(1047)

SEQ ID NO: 30741 - protein, 348 aa, Buchnera aphidicola; identical to SEQ ID NO: 1358

SEQ ID NO: 30742 - DNA, 1089 bp, Haemophilus influenzae; identical to SEQ ID NO: 1359
  CDS (1)..(1089)

SEQ ID NO: 30743 - protein, 362 aa, Haemophilus influenzae; identical to SEQ ID NO: 1360

SEQ ID NO: 30744 - DNA, 1502 bp, Candida albicans; identical to SEQ ID NO: 1361
  CDS (336)..(1442)

SEQ ID NO: 30745 - protein, 368 aa, Candida albicans; identical to SEQ ID NO: 1362

SEQ ID NO: 30746 - DNA, 1113 bp, Saccharomyces cerevisiae; identical to SEQ ID NO: 1363
  CDS (1)..(1113)

SEQ ID NO: 30747 - protein, 370 aa, Saccharomyces cerevisiae; identical to SEQ ID NO: 1364

SEQ ID NO: 30748 - DNA, 2048 bp, Saccharomyces cerevisiae; identical to SEQ ID NO: 1365
  CDS (619)..(1731)

SEQ ID NO: 30749 - protein, 370 aa, Saccharomyces cerevisiae; identical to SEQ ID NO: 1366

SEQ ID NO: 30750 - DNA, 1107 bp, Schizosaccharomyces pombe; identical to SEQ ID NO: 1367
  CDS (1)..(1107)

SEQ ID NO: 30751 - protein, 368 aa, Schizosaccharomyces pombe; identical to SEQ ID NO: 1368

SEQ ID NO: 30752 - DNA, 1089 bp, Amycolatopsis orientalis; identical to SEQ ID NO: 1369
  CDS (1)..(1089)

SEQ ID NO: 30753 - protein, 362 aa, Amycolatopsis orientalis; identical to SEQ ID NO: 1370

SEQ ID NO: 30754 - DNA, 1248 bp, Corynebacterium glutamicum; identical to SEQ ID NO: 1373
  CDS (101)..(1228)

SEQ ID NO: 30755 - protein, 375 aa, Corynebacterium glutamicum; identical to SEQ ID NO: 1374

SEQ ID NO: 30756 - DNA, 1083 bp, Methylophilus methylotrophus; identical to SEQ ID NO: 1375
  CDS (1)..(1083)

SEQ ID NO: 30757 - protein, 360 aa, Methylophilus methylotrophus; identical to SEQ ID NO: 1376

SEQ ID NO: 30758 - DNA, 1047 bp, Yersinia pseudotuberculosis IP 32953; identical to SEQ ID NO: 1623
  CDS (1)..(1047)

SEQ ID NO: 30759 - protein, 348 aa, Yersinia pseudotuberculosis IP 32953; identical to SEQ ID NO: 1624

SEQ ID NO: 30760 - DNA, 1053 bp, Yersinia pseudotuberculosis IP 32953; identical to SEQ ID NO: 1487
  CDS (1)..(1053)

SEQ ID NO: 30761 - protein, 350 aa, Yersinia pseudotuberculosis IP 32953; identical to SEQ ID NO: 1488

SEQ ID NO: 30762 - DNA, 1107 bp, Debaryomyces hansenii CBS767; identical to SEQ ID NO: 1377
  CDS (1)..(1107)

SEQ ID NO: 30763 - protein, 368 aa, Debaryomyces hansenii CBS767; identical to SEQ ID NO: 1378

SEQ ID NO: 30764 - DNA, 1074 bp, Yarrowia lipolytica CLIB99; identical to SEQ ID NO: 1379
  CDS (1)..(1074)

SEQ ID NO: 30765 - protein, 357 aa, Yarrowia lipolytica CLIB99; identical to SEQ ID NO: 1380

SEQ ID NO: 30766 - DNA, 1089 bp, Yarrowia lipolytica CLIB99; identical to SEQ ID NO: 1381
  CDS (1)..(1089)

SEQ ID NO: 30767 - protein, 362 aa, Yarrowia lipolytica CLIB99; identical to SEQ ID NO: 1382

SEQ ID NO: 30768 - DNA, 1119 bp, Kluyveromyces lactis NRRL Y; identical to SEQ ID NO: 1383
  CDS (1)..(1119)

SEQ ID NO: 30769 - protein, 372 aa, Kluyveromyces lactis NRRL Y; identical to SEQ ID NO: 1384

SEQ ID NO: 30770 - DNA, 1095 bp, Kluyveromyces lactis NRRL Y; identical to SEQ ID NO: 1385
  CDS (1)..(1095)

SEQ ID NO: 30771 - protein, 364 aa, Kluyveromyces lactis NRRL Y; identical to SEQ ID NO: 1386

SEQ ID NO: 30772 - DNA, 1074 bp, Erwinia carotovora; identical to SEQ ID NO: 1387
  CDS (1)..(1074)

SEQ ID NO: 30773 - protein, 357 aa, Erwinia carotovora; identical to SEQ ID NO: 1388

SEQ ID NO: 30774 - DNA, 1047 bp, Erwinia carotovora; identical to SEQ ID NO: 1389
  CDS (1)..(1047)

SEQ ID NO: 30775 - protein, 348 aa, Erwinia carotovora; identical to SEQ ID NO: 1390

SEQ ID NO: 30776 - DNA, 1056 bp, Erwinia carotovora; identical to SEQ ID NO: 1391
  CDS (1)..(1056)

SEQ ID NO: 30777 - protein, 351 aa, Erwinia carotovora; identical to SEQ ID NO: 1392

SEQ ID NO: 30778 - DNA, 1113 bp, Acinetobacter sp; identical to SEQ ID NO: 1393
  CDS (1)..(1113)

SEQ ID NO: 30779 - protein, 370 aa, Acinetobacter sp; identical to SEQ ID NO: 1394

SEQ ID NO: 30780 - DNA, 1056 bp, Acinetobacter sp; identical to SEQ ID NO: 1395
  CDS (1)..(1056)

SEQ ID NO: 30781 - protein, 351 aa, Acinetobacter sp; identical to SEQ ID NO: 1396

SEQ ID NO: 30782 - DNA, 1119 bp, Candida glabrata CBS138; identical to SEQ ID NO: 1397
  CDS (1)..(1119)

SEQ ID NO: 30783 - protein, 372 aa, Candida glabrata CBS138; identical to SEQ ID NO: 1398

SEQ ID NO: 30784 - DNA, 1071 bp, Candida glabrata CBS138; identical to SEQ ID NO: 1399
  CDS (1)..(1071)

SEQ ID NO: 30785 - protein, 356 aa, Candida glabrata CBS138; identical to SEQ ID NO: 1400

SEQ ID NO: 30786 - DNA, 1083 bp, Photobacterium profundum; identical to SEQ ID NO: 1401
  CDS (1)..(1083)

SEQ ID NO: 30787 - protein, 360 aa, Photobacterium profundum; identical to SEQ ID NO: 1402

SEQ ID NO: 30788 - DNA, 1053 bp, Photobacterium profundum; identical to SEQ ID NO: 1403
  CDS (1)..(1053)

SEQ ID NO: 30789 - protein, 350 aa, Photobacterium profundum; identical to SEQ ID NO: 1404

SEQ ID NO: 30790 - DNA, 1113 bp, Photobacterium profundum; identical to SEQ ID NO: 1405
  CDS (1)..(1113)

SEQ ID NO: 30791 - protein, 370 aa, Photobacterium profundum; identical to SEQ ID NO: 1406

SEQ ID NO: 30792 - DNA, 1056 bp, Photobacterium profundum; identical to SEQ ID NO: 1407
  CDS (1)..(1056)

SEQ ID NO: 30793 - protein, 351 aa, Photobacterium profundum; identical to SEQ ID NO: 1408

SEQ ID NO: 30794 - DNA, 1092 bp, Parachlamydia sp; identical to SEQ ID NO: 1409
  CDS (1)..(1092)

SEQ ID NO: 30795 - protein, 363 aa, Parachlamydia sp; identical to SEQ ID NO: 1410

SEQ ID NO: 30796 - DNA, 1095 bp, Rhodopseudomonas palustris; identical to SEQ ID NO: 1411
  CDS (1)..(1095)

SEQ ID NO: 30797 - protein, 364 aa, Rhodopseudomonas palustris; identical to SEQ ID NO: 1412

SEQ ID NO: 30798 - DNA, 1100 bp, Amycolatopsis methanolica; identical to SEQ ID NO: 1413
  CDS (1)..(1086)

SEQ ID NO: 30799 - protein, 361 aa, Amycolatopsis methanolica; identical to SEQ ID NO: 1414

SEQ ID NO: 30800 - DNA, 1071 bp, Treponema denticola; identical to SEQ ID NO: 1415
  CDS (1)..(1071)

SEQ ID NO: 30801 - protein, 356 aa, Treponema denticola; identical to SEQ ID NO: 1416

SEQ ID NO: 30802 - DNA, 1020 bp, Geobacter sulfurreducens; identical to SEQ ID NO: 1667
  CDS (1)..(1020)

SEQ ID NO: 30803 - protein, 339 aa, Geobacter sulfurreducens; identical to SEQ ID NO: 1668

SEQ ID NO: 30804 - DNA, 1068 bp, Geobacter sulfurreducens; identical to SEQ ID NO: 1417
  CDS (1)..(1068)

SEQ ID NO: 30805 - protein, 355 aa, Geobacter sulfurreducens; identical to SEQ ID NO: 1418

SEQ ID NO: 30806 - DNA, 1122 bp, Ashbya gossypii; identical to SEQ ID NO: 1421
  CDS (1)..(1122)

SEQ ID NO: 30807 - protein, 373 aa, Ashbya gossypii; identical to SEQ ID NO: 1422

SEQ ID NO: 30808 - DNA, 1098 bp, Amycolatopsis balhimycina; identical to SEQ ID NO: 1423
  CDS (1)..(1098)

SEQ ID NO: 30809 - protein, 365 aa, Amycolatopsis balhimycina; identical to SEQ ID NO: 1424

SEQ ID NO: 30810 - DNA, 1053 bp, Vibrio vulnificus; identical to SEQ ID NO: 1675
  CDS (1)..(1053)

SEQ ID NO: 30811 - protein, 350 aa, Vibrio vulnificus; identical to SEQ ID NO: 1676

SEQ ID NO: 30812 - DNA, 1047 bp, Photorhabdus luminescens; identical to SEQ ID NO: 1427
  CDS (1)..(1047)

SEQ ID NO: 30813 - protein, 348 aa, Photorhabdus luminescens; identical to SEQ ID NO: 1428

SEQ ID NO: 30814 - DNA, 1053 bp, Photorhabdus luminescens; identical to SEQ ID NO: 1429
  CDS (1)..(1053)

SEQ ID NO: 30815 - protein, 350 aa, Photorhabdus luminescens; identical to SEQ ID NO: 1430

SEQ ID NO: 30816 - DNA, 1095 bp, Photorhabdus luminescens; identical to SEQ ID NO: 1431
  CDS (1)..(1095)

SEQ ID NO: 30817 - protein, 364 aa, Photorhabdus luminescens; identical to SEQ ID NO: 1432

SEQ ID NO: 30818 - DNA, 1119 bp, Gloeobacter violaceus; identical to SEQ ID NO: 1433
  CDS (1)..(1119)

SEQ ID NO: 30819 - protein, 372 aa, Gloeobacter violaceus; identical to SEQ ID NO: 1434

SEQ ID NO: 30820 - DNA, 1107 bp, Chromobacterium violaceum; identical to SEQ ID NO: 1435
  CDS (1)..(1107)

SEQ ID NO: 30821 - protein, 368 aa, Chromobacterium violaceum; identical to SEQ ID NO: 1436

SEQ ID NO: 30822 - DNA, 1059 bp, Chromobacterium violaceum; identical to SEQ ID NO: 1437
  CDS (1)..(1059)

SEQ ID NO: 30823 - protein, 352 aa, Chromobacterium violaceum; identical to SEQ ID NO: 1438

SEQ ID NO: 30824 - DNA, 1140 bp, Neurospora crassa; identical to SEQ ID NO: 1439
  CDS (1)..(1140)

SEQ ID NO: 30825 - protein, 379 aa, Neurospora crassa; identical to SEQ ID NO: 1440

SEQ ID NO: 30826 - DNA, 1092 bp, Neurospora crassa; identical to SEQ ID NO: 1441
  CDS (1)..(1092)

SEQ ID NO: 30827 - protein, 363 aa, Neurospora crassa; identical to SEQ ID NO: 1442

SEQ ID NO: 30828 - DNA, 1068 bp, Synechococcus sp; identical to SEQ ID NO: 1443
  CDS (1)..(1068)

SEQ ID NO: 30829 - protein, 355 aa, Synechococcus sp; identical to SEQ ID NO: 1444

SEQ ID NO: 30830 - DNA, 1053 bp, Rhodopirellula baltica; identical to SEQ ID NO: 1445
  CDS (1)..(1053)

SEQ ID NO: 30831 - protein, 350 aa, Rhodopirellula baltica; identical to SEQ ID NO: 1446

SEQ ID NO: 30832 - DNA, 1068 bp, Prochlorococcus marinus subsp; identical to SEQ ID NO: 1447
  CDS (1)..(1068)

SEQ ID NO: 30833 - protein, 355 aa, Prochlorococcus marinus subsp; identical to SEQ ID NO: 1448

SEQ ID NO: 30834 - DNA, 1083 bp, Prochlorococcus marinus; identical to SEQ ID NO: 1449
  CDS (1)..(1083)

SEQ ID NO: 30835 - protein, 360 aa, Prochlorococcus marinus; identical to SEQ ID NO: 1450

SEQ ID NO: 30836 - DNA, 1074 bp, Prochlorococcus marinus; identical to SEQ ID NO: 1451
  CDS (1)..(1074)

SEQ ID NO: 30837 - protein, 357 aa, Prochlorococcus marinus; identical to SEQ ID NO: 1452

SEQ ID NO: 30838 - DNA, 1113 bp, Haemophilus ducreyi; identical to SEQ ID NO: 1453
  CDS (1)..(1113)

SEQ ID NO: 30839 - protein, 370 aa, Haemophilus ducreyi; identical to SEQ ID NO: 1454

SEQ ID NO: 30840 - DNA, 1080 bp, Haemophilus ducreyi; identical to SEQ ID NO: 1455
  CDS (1)..(1080)

SEQ ID NO: 30841 - protein, 359 aa, Haemophilus ducreyi; identical to SEQ ID NO: 1456

SEQ ID NO: 30842 - DNA, 1086 bp, Candidatus Blochmannia floridanus; identical to SEQ ID NO: 1457
  CDS (1)..(1086)

SEQ ID NO: 30843 - protein, 361 aa, Candidatus Blochmannia floridanus; identical to SEQ ID NO: 1458

SEQ ID NO: 30844 - DNA, 1074 bp, Bordetella pertussis; identical to SEQ ID NO: 1459
  CDS (1)..(1074)

SEQ ID NO: 30845 - protein, 357 aa, Bordetella pertussis; identical to SEQ ID NO: 1460

SEQ ID NO: 30846 - DNA, 1119 bp, Bordetella bronchiseptica; identical to SEQ ID NO: 1461
  CDS (1)..(1119)

SEQ ID NO: 30847 - protein, 372 aa, Bordetella bronchiseptica; identical to SEQ ID NO: 1462

SEQ ID NO: 30848 - DNA, 1179 bp, Nitrosomonas europaea; identical to SEQ ID NO: 1463
  CDS (1)..(1179)

SEQ ID NO: 30849 - protein, 392 aa, Nitrosomonas europaea; identical to SEQ ID NO: 1464

SEQ ID NO: 30850 - DNA, 1083 bp, Coxiella burnetii; identical to SEQ ID NO: 1465
  CDS (1)..(1083)

SEQ ID NO: 30851 - protein, 360 aa, Coxiella burnetii; identical to SEQ ID NO: 1466

SEQ ID NO: 30852 - DNA, 1143 bp, Xylella fastidiosa; identical to SEQ ID NO: 1469
  CDS (1)..(1143)

SEQ ID NO: 30853 - protein, 380 aa, Xylella fastidiosa; identical to SEQ ID NO: 1470

SEQ ID NO: 30854 - DNA, 1053 bp, Vibrio parahaemolyticus; identical to SEQ ID NO: 1471
  CDS (1)..(1053)

SEQ ID NO: 30855 - protein, 350 aa, Vibrio parahaemolyticus; identical to SEQ ID NO: 1472

SEQ ID NO: 30856 - DNA, 1053 bp, Vibrio parahaemolyticus; identical to SEQ ID NO: 1473
  CDS (1)..(1053)

SEQ ID NO: 30857 - protein, 350 aa, Vibrio parahaemolyticus; identical to SEQ ID NO: 1474

SEQ ID NO: 30858 - DNA, 1074 bp, Vibrio parahaemolyticus; identical to SEQ ID NO: 1475
  CDS (1)..(1074)

SEQ ID NO: 30859 - protein, 357 aa, Vibrio parahaemolyticus; identical to SEQ ID NO: 1476

SEQ ID NO: 30860 - DNA, 1083 bp, Pseudomonas syringae; identical to SEQ ID NO: 1477
  CDS (1)..(1083)

SEQ ID NO: 30861 - protein, 360 aa, Pseudomonas syringae; identical to SEQ ID NO: 1478

SEQ ID NO: 30862 - DNA, 1077 bp, Pseudomonas syringae; identical to SEQ ID NO: 1479
  CDS (1)..(1077)

SEQ ID NO: 30863 - protein, 358 aa, Pseudomonas syringae; identical to SEQ ID NO: 1480

SEQ ID NO: 30864 - DNA, 1062 bp, Pseudomonas putida; identical to SEQ ID NO: 1481
  CDS (1)..(1062)

SEQ ID NO: 30865 - protein, 353 aa, Pseudomonas putida; identical to SEQ ID NO: 1482

SEQ ID NO: 30866 - DNA, 1113 bp, Pseudomonas putida; identical to SEQ ID NO: 1483
  CDS (1)..(1113)

SEQ ID NO: 30867 - protein, 370 aa, Pseudomonas putida; identical to SEQ ID NO: 1484

SEQ ID NO: 30868 - DNA, 1086 bp, Bradyrhizobium japonicum; identical to SEQ ID NO: 1485
  CDS (1)..(1086)

SEQ ID NO: 30869 - protein, 361 aa, Bradyrhizobium japonicum; identical to SEQ ID NO: 1486

SEQ ID NO: 30870 - DNA, 1077 bp, Yersinia pestis; identical to SEQ ID NO: 1489
  CDS (1)..(1077)

SEQ ID NO: 30871 - protein, 358 aa, Yersinia pestis; identical to SEQ ID NO: 1490

SEQ ID NO: 30872 - DNA, 1038 bp, Wigglesworthia glossinidia brevipalpis; identical to SEQ ID NO: 1491
  CDS (1)..(1038)

SEQ ID NO: 30873 - protein, 345 aa, Wigglesworthia glossinidia brevipalpis; identical to SEQ ID NO: 1492

SEQ ID NO: 30874 - DNA, 1071 bp, Vibrio vulnificus; identical to SEQ ID NO: 1739
  CDS (1)..(1071)

SEQ ID NO: 30875 - protein, 356 aa, Vibrio vulnificus; identical to SEQ ID NO: 1740

SEQ ID NO: 30876 - DNA, 1053 bp, Vibrio vulnificus; identical to SEQ ID NO: 1495
  CDS (1)..(1053)

SEQ ID NO: 30877 - protein, 350 aa, Vibrio vulnificus; identical to SEQ ID NO: 1496

SEQ ID NO: 30878 - DNA, 1071 bp, Vibrio vulnificus; identical to SEQ ID NO: 1497
  CDS (1)..(1071)

SEQ ID NO: 30879 - protein, 356 aa, Vibrio vulnificus; identical to SEQ ID NO: 1498

SEQ ID NO: 30880 - DNA, 1062 bp, Synechococcus elongatus; identical to SEQ ID NO: 1499
  CDS (1)..(1062)

SEQ ID NO: 30881 - protein, 353 aa, Synechococcus elongatus; identical to SEQ ID NO: 1500

SEQ ID NO: 30882 - DNA, 1032 bp, Streptococcus mutans; identical to SEQ ID NO: 1501
  CDS (1)..(1032)

SEQ ID NO: 30883 - protein, 343 aa, Streptococcus mutans; identical to SEQ ID NO: 1502

SEQ ID NO: 30884 - DNA, 1035 bp, Streptococcus mutans; identical to SEQ ID NO: 1503
  CDS (1)..(1035)

SEQ ID NO: 30885 - protein, 344 aa, Streptococcus mutans; identical to SEQ ID NO: 1504

SEQ ID NO: 30886 - DNA, 1008 bp, Streptococcus agalactiae; identical to SEQ ID NO: 1505
  CDS (1)..(1008)

SEQ ID NO: 30887 - protein, 335 aa, Streptococcus agalactiae; identical to SEQ ID NO: 1506

SEQ ID NO: 30888 - DNA, 1065 bp, Shewanella oneidensis; identical to SEQ ID NO: 1507
  CDS (1)..(1065)

SEQ ID NO: 30889 - protein, 354 aa, Shewanella oneidensis; identical to SEQ ID NO: 1508

SEQ ID NO: 30890 - DNA, 1092 bp, Shewanella oneidensis; identical to SEQ ID NO: 1509
  CDS (1)..(1092)

SEQ ID NO: 30891 - protein, 363 aa, Shewanella oneidensis; identical to SEQ ID NO: 1510

SEQ ID NO: 30892 - DNA, 1059 bp, Shewanella oneidensis; identical to SEQ ID NO: 1511
  CDS (1)..(1059)

SEQ ID NO: 30893 - protein, 352 aa, Shewanella oneidensis; identical to SEQ ID NO: 1512

SEQ ID NO: 30894 - DNA, 1053 bp, Escherichia coli O6; identical to SEQ ID NO: 1513
  CDS (1)..(1053)

SEQ ID NO: 30895 - protein, 350 aa, Escherichia coli O6; identical to SEQ ID NO: 1514

SEQ ID NO: 30896 - DNA, 1170 bp, Corynebacterium efficiens; identical to SEQ ID NO: 1515
  CDS (1)..(1170)

SEQ ID NO: 30897 - protein, 389 aa, Corynebacterium efficiens; identical to SEQ ID NO: 1516

SEQ ID NO: 30898 - DNA, 1134 bp, Bifidobacterium longum; identical to SEQ ID NO: 1517
  CDS (1)..(1134)

SEQ ID NO: 30899 - protein, 377 aa, Bifidobacterium longum; identical to SEQ ID NO: 1518

SEQ ID NO: 30900 - DNA, 1233 bp, Bifidobacterium longum; identical to SEQ ID NO: 1519
  CDS (1)..(1233)

SEQ ID NO: 30901 - protein, 410 aa, Bifidobacterium longum; identical to SEQ ID NO: 1520

SEQ ID NO: 30902 - DNA, 1221 bp, Phytophthora infestans; identical to SEQ ID NO: 1521
  CDS (20)..(1153)

SEQ ID NO: 30903 - protein, 377 aa, Phytophthora infestans; identical to SEQ ID NO: 1522

SEQ ID NO: 30904 - DNA, 1062 bp, Chlorobium tepidum; identical to SEQ ID NO: 1523
  CDS (1)..(1062)

SEQ ID NO: 30905 - protein, 353 aa, Chlorobium tepidum; identical to SEQ ID NO: 1524

SEQ ID NO: 30906 - DNA, 1074 bp, Xanthomonas campestris; identical to SEQ ID NO: 1525
  CDS (1)..(1074)

SEQ ID NO: 30907 - protein, 357 aa, Xanthomonas campestris; identical to SEQ ID NO: 1526

SEQ ID NO: 30908 - DNA, 1074 bp, Xanthomonas axonopodis; identical to SEQ ID NO: 1527
  CDS (1)..(1074)

SEQ ID NO: 30909 - protein, 357 aa, Xanthomonas axonopodis; identical to SEQ ID NO: 1528

SEQ ID NO: 30910 - DNA, 1080 bp, Ralstonia solanacearum; identical to SEQ ID NO: 1529
  CDS (1)..(1080)

SEQ ID NO: 30911 - protein, 359 aa, Ralstonia solanacearum; identical to SEQ ID NO: 1530

SEQ ID NO: 30912 - DNA, 1179 bp, Ralstonia solanacearum; identical to SEQ ID NO: 1531
  CDS (1)..(1179)

SEQ ID NO: 30913 - protein, 392 aa, Ralstonia solanacearum; identical to SEQ ID NO: 1532

SEQ ID NO: 30914 - DNA, 1065 bp, Synechococcus sp; identical to SEQ ID NO: 1533
  CDS (1)..(1065)

SEQ ID NO: 30915 - protein, 354 aa, Synechococcus sp; identical to SEQ ID NO: 1534

SEQ ID NO: 30916 - DNA, 1035 bp, Escherichia coli; identical to SEQ ID NO: 1535
  CDS (1)..(1035)

SEQ ID NO: 30917 - protein, 344 aa, Escherichia coli; identical to SEQ ID NO: 1536

SEQ ID NO: 30918 - DNA, 1200 bp, Stigmatella aurantiaca; identical to SEQ ID NO: 1537
  CDS (62)..(1147)

SEQ ID NO: 30919 - protein, 361 aa, Stigmatella aurantiaca; identical to SEQ ID NO: 1538

SEQ ID NO: 30920 - DNA, 1092 bp, Rhizobium loti; identical to SEQ ID NO: 1539
  CDS (1)..(1092)

SEQ ID NO: 30921 - protein, 363 aa, Rhizobium loti; identical to SEQ ID NO: 1540

SEQ ID NO: 30922 - DNA, 1083 bp, Amycolatopsis mediterranei; identical to SEQ ID NO: 1541
  CDS (1)..(1083)

SEQ ID NO: 30923 - protein, 360 aa, Amycolatopsis mediterranei; identical to SEQ ID NO: 1542

SEQ ID NO: 30924 - DNA, 1053 bp, Pasteurella multocida; identical to SEQ ID NO: 1543
  CDS (1)..(1053)

SEQ ID NO: 30925 - protein, 350 aa, Pasteurella multocida; identical to SEQ ID NO: 1544

SEQ ID NO: 30926 - DNA, 1086 bp, Pasteurella multocida; identical to SEQ ID NO: 1545
  CDS (1)..(1086)

SEQ ID NO: 30927 - protein, 361 aa, Pasteurella multocida; identical to SEQ ID NO: 1546

SEQ ID NO: 30928 - DNA, 1089 bp, Emericella nidulans; identical to SEQ ID NO: 1549
  CDS (1)..(1089)

SEQ ID NO: 30929 - protein, 362 aa, Emericella nidulans; identical to SEQ ID NO: 1550

SEQ ID NO: 30930 - DNA, 1239 bp, Vibrio cholerae; identical to SEQ ID NO: 1551
  CDS (114)..(1175)

SEQ ID NO: 30931 - protein, 353 aa, Vibrio cholerae; identical to SEQ ID NO: 1552

SEQ ID NO: 30932 - DNA, 1113 bp, Candida albicans; identical to SEQ ID NO: 1797
  CDS (1)..(1113)

SEQ ID NO: 30933 - protein, 370 aa, Candida albicans; identical to SEQ ID NO: 1554

SEQ ID NO: 30934 - DNA, 1047 bp, Buchnera aphidicola; identical to SEQ ID NO: 1557
  CDS (1)..(1047)

SEQ ID NO: 30935 - protein, 348 aa, Buchnera aphidicola; identical to SEQ ID NO: 1558

SEQ ID NO: 30936 - DNA, 1047 bp, Erwinia herbicola; identical to SEQ ID NO: 1559
  CDS (1)..(1047)

SEQ ID NO: 30937 - protein, 348 aa, Erwinia herbicola; identical to SEQ ID NO: 1560

SEQ ID NO: 30938 - DNA, 23 bp, Artificial sequence
  (1)..(23): primer
atgcaaaaagacgcgctgaataa

SEQ ID NO: 30939 - DNA, 21 bp, Artificial sequence
  (1)..(21): primer
ttaagccacgcgagccgtcag

SEQ ID NO: 30940 - protein, 296 aa, Artificial sequence; identical to SEQ ID NO: 2896
  Variant (5)..(35): xaa in position 5 to 35 is any amino acid
  Variant (37)..(37): xaa in position 37 is any amino acid
  Variant (39)..(40): xaa in position 39 to 40 is any amino acid
  Variant (42)..(42): xaa in position 42 is any amino acid
  Variant (45)..(47): xaa in position 45 to 47 is any amino acid
  Variant (49)..(50): xaa in position 49 to 50 is any amino acid
  Variant (52)..(55): xaa in position 52 to 55 is any amino acid
  Variant (57)..(66): xaa in position 57 to 66 is any amino acid
  Variant (68)..(71): xaa in position 68 to 71 is any amino acid
  Variant (73)..(108): xaa in position 73 to 108 is any amino acid
  Variant (112)..(117): xaa in position 112 to 117 is any amino acid
  Variant (120)..(122): xaa in position 120 to 122 is any amino acid
  Variant (124)..(131): xaa in position 124 to 131 is any amino acid
  Variant (134)..(136): xaa in position 134 to 136 is any amino acid
  Variant (138)..(170): xaa in position 138 to 170 is any amino acid
  Variant (173)..(179): xaa in position 173 to 179 is any amino acid
  Variant (182)..(191): xaa in position 182 to 191 is any amino acid
  Variant (193)..(222): xaa in position 193 to 222 is any amino acid
  Variant (224)..(225): xaa in position 224 to 225 is any amino acid
  Variant (227)..(227): xaa in position 227 is any amino acid
  Variant (229)..(260): xaa in position 229 to 260 is any amino acid
  Variant (262)..(262): xaa in position 262 is any amino acid
  Variant (264)..(268): xaa in position 264 to 268 is any amino acid
  Variant (270)..(288): xaa in position 270 to 288 is any amino acid
  Variant (290)..(290): xaa in position 290 is any amino acid
  Variant (292)..(292): xaa in position 292 is any amino acid
  Variant (295)..(295): xaa in position 295 is any amino acid

SEQ ID NO: 30941 - protein, 352 aa, Artificial sequence; identical to SEQ ID NO: 2895
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (43)..(43): xaa in position 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(150): xaa in position 148 to 150 is any amino acid
  Variant (152)..(152): xaa in position 152 is any amino acid
  Variant (163)..(163): xaa in position 163 is any amino acid
  Variant (167)..(167): xaa in position 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 30942 - protein, 26 aa, Artificial sequence
  Variant (1)..(1): xaa in position 1 is Asp or Asn
  Variant (2)..(2): xaa in position 2 is any amino acid
  Variant (4)..(4): xaa in position 4 is any amino acid
  Variant (5)..(5): xaa in position 5 is Leu, Val, Ile, Phe, Ala or Met
  Variant (6)..(6): xaa in position 6 is Val, Ile, Leu or Ala
  Variant (7)..(7): xaa in position 7 is Val or Ile
  Variant (8)..(8): xaa in position 8 is Val, Ile, Cys or Thr
  Variant (13)..(13): xaa in position 13 is Ile, Val, Ser or Leu
  Variant (14)..(14): xaa in position 14 is His or Asp
  Variant (15)..(15): xaa in position 15 is Asp or Asn
  Variant (16)..(18): xaa in position 16 to 18 is any amino acid
  Variant (19)..(19): xaa in position 19 is Ala, Val or Gly
  Variant (20)..(20): xaa in position 20 is any amino acid
  Variant (21)..(21): xaa in position 21 is Glu, Asp, Ala or Gln
  Variant (23)..(23): xaa in position 23 is Ala, Gly, Ser or Cys
  Variant (24)..(25): xaa in position 24 to 25 is any amino acid
  Variant (26)..(26): xaa in position 26 is Leu, Ile or Phe
XXRXXXXXGPCSXXXXXXXXXYXXXX

SEQ ID NO: 30943 - protein, 40 aa, Artificial sequence; identical to SEQ ID NO: 2890
  Variant (1)..(1): xaa in position 1 is Ile, Val, Leu or Met
  Variant (2)..(2): xaa in position 2 is Val, Ile or Leu
  Variant (5)..(5): xaa in position 5 is Val, Ala or Thr
  Variant (7)..(7): xaa in position 7 is Phe, Leu, Thr or Val
  Variant (8)..(8): xaa in position 8 is Glu, Ala or Gln
  Variant (13)..(14): xaa in position 13 to 14 is any amino acid
  Variant (15)..(15): xaa in position 15 is any or no amino acid
  Variant (17)..(17): xaa in position 17 is Trp or Tyr
  Variant (18)..(18): xaa in position 18 is Lys or Arg
  Variant (20)..(20): xaa in position 20 is Leu, Phe, Tyr or Met
  Variant (21)..(21): xaa in position 21 is Ile, Val, Ala or Leu
  Variant (22)..(22): xaa in position 22 is any amino acid
  Variant (23)..(23): xaa in position 23 is Asp, Glu or Gln
  Variant (25)..(25): xaa in position 25 is any amino acid
  Variant (26)..(26): xaa in position 26 is Leu, Met, Ile, Val, Ala or Thr
  Variant (27)..(27): xaa in position 27 is Asp, Asn or Ser
  Variant (28)..(31): xaa in position 28 to 31 is any amino acid
  Variant (32)..(32): xaa in position 32 is Ile, Val, Leu or Met
  Variant (33)..(34): xaa in position 33 to 34 is any amino acid
  Variant (36)..(36): xaa in position 36 is Leu, Ile, Met or Val
  Variant (37)..(38): xaa in position 37 to 38 is any amino acid
  Variant (39)..(39): xaa in position 39 is Ala, Ser, Gly, Val or Thr

SEQ ID NO: 30944 - protein, 58 aa, Artificial sequence; identical to SEQ ID NO: 2891
  Variant (1)..(1): xaa in position 1 is Tyr, Phe or Leu
  Variant (2)..(3): xaa in position 2 to 3 is any amino acid
  Variant (4)..(4): xaa in position 4 is Asp or Glu
  Variant (5)..(6): xaa in position 5 to 6 is any amino acid
  Variant (7)..(7): xaa in position 7 is Ser, Ala, Thr or Cys
  Variant (8)..(8): xaa in position 8 is Trp, Leu, Phe, Tyr or Val
  Variant (9)..(9): xaa in position 9 is any amino acid
  Variant (10)..(10): xaa in position 10 is Ala or Ser
  Variant (11)..(11): xaa in position 11 is Ile or Val
  Variant (15)..(15): xaa in position 15 is Thr, Ser or Asn
  Variant (16)..(16): xaa in position 16 is Thr, Val, Ala or Ser
  Variant (17)..(17): xaa in position 17 is Glu or Ala
  Variant (18)..(18): xaa in position 18 is Ser, Asp or Asn
  Variant (20)..(20): xaa in position 20 is any amino acid
  Variant (23)..(23): xaa in position 23 is Glu, Gln, Phe or Met
  Variant (24)..(24): xaa in position 24 is Leu, Met, Val or Ile
  Variant (25)..(25): xaa in position 25 is Ala, Ser, Thr, Cys or Val
  Variant (27)..(27): xaa in position 27 is Gly or Ala
  Variant (28)..(28): xaa in position 28 is Leu, Ile, Met or Val
  Variant (29)..(30): xaa in position 29 to 30 is any amino acid
  Variant (31)..(31): xaa in position 31 is Pro or Ala
  Variant (32)..(32): xaa in position 32 is Val, Ile or Thr
  Variant (34)..(34): xaa in position 34 is Phe, Met, Tyr or Ile
  Variant (37)..(37): xaa in position 37 is any amino acid
  Variant (38)..(38): xaa in position 38 is Thr or Arg
  Variant (39)..(39): xaa in position 39 is any amino acid
  Variant (41)..(41): xaa in position 41 is any amino acid
  Variant (42)..(42): xaa in position 42 is Leu, Ile, Val, Ala, Thr or Phe
  Variant (43)..(44): xaa in position 43 to 44 is any amino acid
  Variant (45)..(45): xaa in position 45 is Ala or Met
  Variant (46)..(46): xaa in position 46 is any amino acid
  Variant (47)..(47): xaa in position 47 is Asp, Asn or Glu
  Variant (48)..(48): xaa in position 48 is Ala or Gly
  Variant (49)..(50): xaa in position 49 to 50 is any amino acid
  Variant (51)..(51): xaa in position 51 is Ala or Ser
  Variant (52)..(52): xaa in position 52 is Ala, Ser, Val or Thr
  Variant (53)..(55): xaa in position 53 to 55 is any amino acid
  Variant (56)..(56): xaa in position 56 is His or Gln
  Variant (57)..(57): xaa in position 57 is any amino acid
  Variant (58)..(58): xaa in position 58 is Phe, Tyr, His or Val

SEQ ID NO: 30945 - protein, 25 aa, Artificial sequence
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
XXGNXXXXXXXRGXXXXXXXXXXNX

SEQ ID NO: 30946 - protein, 52 aa, Artificial sequence; identical to SEQ ID NO: 2893
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is any amino acid
  Variant (6)..(6): xaa in position 6 is Ser, Asn or Ala
  Variant (8)..(8): xaa in position 8 is Ala, Gly or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(23): xaa in position 21 to 23 is any amino acid
  Variant (24)..(24): xaa in position 24 is Val, Ile, Leu, Thr or Ala
  Variant (25)..(26): xaa in position 25 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(34): xaa in position 32 to 34 is any amino acid
  Variant (35)..(37): xaa in position 35 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid

SEQ ID NO: 30947 - protein, 19 aa, Artificial sequence
  Variant (1)..(1): xaa in position 1 is Tyr, Phe, Lys or Arg
  Variant (3)..(3): xaa in position 3 is any amino acid
  Variant (5)..(5): xaa in position 5 is Ile or Val
  Variant (8)..(8): xaa in position 8 is any amino acid
  Variant (10)..(10): xaa in position 10 is Ile, Leu or Val
  Variant (11)..(11): xaa in position 11 is any amino acid
  Variant (12)..(12): xaa in position 12 is Trp, Ile, Phe or Leu
  Variant (13)..(14): xaa in position 13 to 14 is any amino acid
  Variant (15)..(15): xaa in position 15 is Thr or Ser
  Variant (16)..(18): xaa in position 16 to 18 is any amino acid
  Variant (19)..(19): xaa in position 19 is Leu, Ile, Val or Phe
XGXSXTDXCXXXXXXXXXX

SEQ ID NO: 30948 - DNA, 1575 bp, Escherichia coli K12; identical to SEQ ID NO: 10324
  CDS (244)..(1575)

SEQ ID NO: 30949 - protein, 443 aa, Escherichia coli K12; identical to SEQ ID NO: 10325

SEQ ID NO: 30950 - DNA, 1326 bp, Yersinia pestis; identical to SEQ ID NO: 10326
  CDS (1)..(1326)

SEQ ID NO: 30951 - protein, 441 aa, Yersinia pestis; identical to SEQ ID NO: 10327

SEQ ID NO: 30952 - DNA, 1332 bp, Salmonella enterica subsp. enterica serovar Typhi; identical to SEQ ID NO: 10328
  CDS (1)..(1332)

SEQ ID NO: 30953 - protein, 443 aa, Salmonella enterica subsp. enterica serovar Typhi; identical to SEQ ID NO: 10329

SEQ ID NO: 30954 - DNA, 1311 bp, Neisseria meningitidis; identical to SEQ ID NO: 10330
  CDS (1)..(1311)

SEQ ID NO: 30955 - protein, 436 aa, Neisseria meningitidis; identical to SEQ ID NO: 10331

SEQ ID NO: 30956 - DNA, 1863 bp, Arabidopsis thaliana (mouse-ear cress); identical to SEQ ID NO: 10332
  CDS (1)..(1863)

SEQ ID NO: 30957 - protein, 620 aa, Arabidopsis thaliana (mouse-ear cress); identical to SEQ ID NO: 10333

SEQ ID NO: 30958 - DNA, 1371 bp, Vibrio cholerae; identical to SEQ ID NO: 10334
  CDS (1)..(1371)

SEQ ID NO: 30959 - protein, 456 aa, Vibrio cholerae; identical to SEQ ID NO: 10335

SEQ ID NO: 30960 - DNA, 1299 bp, Pseudomonas aeruginosa; identical to SEQ ID NO: 10336
  CDS (1)..(1299)

SEQ ID NO: 30961 - protein, 432 aa, Pseudomonas aeruginosa; identical to SEQ ID NO: 10337

SEQ ID NO: 30962 - DNA, 1259 bp, Pseudomonas aeruginosa; identical to SEQ ID NO: 10338
  CDS (45)..(1238)

SEQ ID NO: 30963 - protein, 397 aa, Pseudomonas aeruginosa; identical to SEQ ID NO: 10339

SEQ ID NO: 30964 - DNA, 1716 bp, Arabidopsis thaliana (mouse-ear cress); identical to SEQ ID NO: 10340
  CDS (1)..(1716)

SEQ ID NO: 30965 - protein, 571 aa, Arabidopsis thaliana (mouse-ear cress); identical to SEQ ID NO: 10341

SEQ ID NO: 30966 - DNA, 1326 bp, Erwinia carotovora; identical to SEQ ID NO: 10342
  CDS (1)..(1326)

SEQ ID NO: 30967 - protein, 441 aa, Erwinia carotovora; identical to SEQ ID NO: 10343

SEQ ID NO: 30968 - DNA, 1356 bp, Acinetobacter sp; identical to SEQ ID NO: 10344
  CDS (1)..(1356)

SEQ ID NO: 30969 - protein, 451 aa, Acinetobacter sp; identical to SEQ ID NO: 10345

SEQ ID NO: 30970 - DNA, 1326 bp, Photobacterium profundum; identical to SEQ ID NO: 10346
  CDS (1)..(1326)

SEQ ID NO: 30971 - protein, 441 aa, Photobacterium profundum; identical to SEQ ID NO: 10347

SEQ ID NO: 30972 - DNA, 1872 bp, Oryza sativa; identical to SEQ ID NO: 10348
  CDS (1)..(1731)

SEQ ID NO: 30973 - protein, 576 aa, Oryza sativa; identical to SEQ ID NO: 10349

SEQ ID NO: 30974 - DNA, 1308 bp, Chromobacterium violaceum; identical to SEQ ID NO: 10350
  CDS (1)..(1308)

SEQ ID NO: 30975 - protein, 435 aa, Chromobacterium violaceum; identical to SEQ ID NO: 10351

SEQ ID NO: 30976 - DNA, 1404 bp, Bordetella parapertussis; identical to SEQ ID NO: 10352
  CDS (1)..(1404)

SEQ ID NO: 30977 - protein, 467 aa, Bordetella parapertussis; identical to SEQ ID NO: 10353

SEQ ID NO: 30978 - DNA, 1335 bp, Nitrosomonas europaea; identical to SEQ ID NO: 10354
  CDS (1)..(1335)

SEQ ID NO: 30979 - protein, 444 aa, Nitrosomonas europaea; identical to SEQ ID NO: 10355

SEQ ID NO: 30980 - DNA, 2075 bp, Arabidopsis thaliana; identical to SEQ ID NO: 10356
  CDS (120)..(1949)

SEQ ID NO: 30981 - protein, 609 aa, Arabidopsis thaliana; identical to SEQ ID NO: 10357

SEQ ID NO: 30982 - DNA, 1728 bp, Oryza sativa; identical to SEQ ID NO: 10358
  CDS (1)..(1728)

SEQ ID NO: 30983 - protein, 575 aa, Oryza sativa; identical to SEQ ID NO: 10359

SEQ ID NO: 30984 - DNA, 1329 bp, Buchnera aphidicola; identical to SEQ ID NO: 10360
  CDS (1)..(1329)

SEQ ID NO: 30985 - protein, 442 aa, Buchnera aphidicola; identical to SEQ ID NO: 10361

SEQ ID NO: 30986 - DNA, 1314 bp, Haemophilus ducreyi; identical to SEQ ID NO: 10362
  CDS (1)..(1314)

SEQ ID NO: 30987 - protein, 437 aa, Haemophilus ducreyi; identical to SEQ ID NO: 10363

SEQ ID NO: 30988 - DNA, 1323 bp, Pasteurella multocida; identical to SEQ ID NO: 10364
  CDS (1)..(1323)

SEQ ID NO: 30989 - protein, 440 aa, Pasteurella multocida; identical to SEQ ID NO: 10365

SEQ ID NO: 30990 - DNA, 1347 bp, Photorhabdus luminescens; identical to SEQ ID NO: 10366
  CDS (1)..(1347)

SEQ ID NO: 30991 - protein, 448 aa, Photorhabdus luminescens; identical to SEQ ID NO: 10367

SEQ ID NO: 30992 - DNA, 1299 bp, Pseudomonas putida; identical to SEQ ID NO: 10368
  CDS (1)..(1299)

SEQ ID NO: 30993 - protein, 432 aa, Pseudomonas putida; identical to SEQ ID NO: 10369

SEQ ID NO: 30994 - DNA, 1299 bp, Pseudomonas syringae; identical to SEQ ID NO: 10370
  CDS (1)..(1299)

SEQ ID NO: 30995 - protein, 432 aa, Pseudomonas syringae; identical to SEQ ID NO: 10371

SEQ ID NO: 30996 - DNA, 1356 bp, Ralstonia solanacearum; identical to SEQ ID NO: 10372
  CDS (1)..(1356)

SEQ ID NO: 30997 - protein, 451 aa, Ralstonia solanacearum; identical to SEQ ID NO: 10373

SEQ ID NO: 30998 - DNA, 1338 bp, Shewanella oneidensis; identical to SEQ ID NO: 10374
  CDS (1)..(1338)

SEQ ID NO: 30999 - protein, 445 aa, Shewanella oneidensis; identical to SEQ ID NO: 10375

SEQ ID NO: 31000 - DNA, 1338 bp, Vibrio parahaemolyticus; identical to SEQ ID NO: 10376
  CDS (1)..(1338)

SEQ ID NO: 31001 - protein, 445 aa, Vibrio parahaemolyticus; identical to SEQ ID NO: 10377

SEQ ID NO: 31002 - DNA, 25 bp, Artificial sequence
  (1)..(25): primer
atggtaaaggaacgtaaaaccgagt

SEQ ID NO: 31003 - DNA, 24 bp, Artificial sequence
  (1)..(24): primer
ttaccctaaatccgccatcaacac

SEQ ID NO: 31004 - protein, 528 aa, Artificial sequence; identical to SEQ ID NO: 13504
  Variant (2)..(3): xaa in position 2 to 3 is any amino acid
  Variant (6)..(8): xaa in position 6 to 8 is any amino acid
  Variant (11)..(13): xaa in position 11 to 13 is any amino acid
  Variant (16)..(17): xaa in position 16 to 17 is any amino acid
  Variant (21)..(24): xaa in position 21 to 24 is any amino acid
  Variant (26)..(42): xaa in position 26 to 42 is any amino acid
  Variant (44)..(45): xaa in position 44 to 45 is any amino acid
  Variant (49)..(49): xaa in position 49 is any amino acid
  Variant (52)..(54): xaa in position 52 to 54 is any amino acid
  Variant (56)..(56): xaa in position 56 is any amino acid
  Variant (58)..(58): xaa in position 58 is any amino acid
  Variant (60)..(60): xaa in position 60 is any amino acid
  Variant (62)..(62): xaa in position 62 is any amino acid
  Variant (65)..(67): xaa in position 65 to 67 is any amino acid
  Variant (69)..(76): xaa in position 69 to 76 is any amino acid
  Variant (78)..(81): xaa in position 78 to 81 is any amino acid
  Variant (83)..(83): xaa in position 83 is any amino acid
  Variant (86)..(88): xaa in position 86 to 88 is any amino acid
  Variant (90)..(94): xaa in position 90 to 94 is any amino acid
  Variant (96)..(96): xaa in position 96 is any amino acid
  Variant (98)..(102): xaa in position 98 to 102 is any amino acid
  Variant (104)..(104): xaa in position 104 is any amino acid
  Variant (106)..(106): xaa in position 106 is any amino acid
  Variant (109)..(114): xaa in position 109 to 114 is any amino acid
  Variant (115)..(123): xaa in position 115 to 123 is any or no amino acid
  Variant (125)..(131): xaa in position 125 to 131 is any amino acid
  Variant (133)..(133): xaa in position 133 is any amino acid
  Variant (138)..(139): xaa in position 138 to 139 is any amino acid
  Variant (141)..(141): xaa in position 141 is any amino acid
  Variant (143)..(143): xaa in position 143 is any amino acid
  Variant (146)..(147): xaa in position 146 to 147 is any amino acid
  Variant (149)..(149): xaa in position 149 is any amino acid
  Variant (151)..(154): xaa in position 151 to 154 is any amino acid
  Variant (156)..(157): xaa in position 156 to 157 is any amino acid
  Variant (159)..(159): xaa in position 159 is any amino acid
  Variant (162)..(164): xaa in position 162 to 164 is any amino acid
  Variant (166)..(168): xaa in position 166 to 168 is any amino acid
  Variant (170)..(173): xaa in position 170 to 173 is any amino acid
  Variant (177)..(178): xaa in position 177 to 178 is any amino acid
  Variant (180)..(182): xaa in position 180 to 182 is any amino acid
  Variant (184)..(184): xaa in position 184 is any amino acid
  Variant (188)..(188): xaa in position 188 is any amino acid
  Variant (192)..(193): xaa in position 192 to 193 is any amino acid
  Variant (195)..(196): xaa in position 195 to 196 is any amino acid
  Variant (199)..(200): xaa in position 199 to 200 is any amino acid
  Variant (202)..(203): xaa in position 202 to 203 is any amino acid
  Variant (205)..(205): xaa in position 205 is any amino acid
  Variant (207)..(207): xaa in position 207 is any amino acid
  Variant (209)..(209): xaa in position 209 is any amino acid
  Variant (211)..(216): xaa in position 211 to 216 is any amino acid
  Variant (218)..(222): xaa in position 218 to 222 is any amino acid
  Variant (224)..(228): xaa in position 224 to 228 is any amino acid
  Variant (230)..(248): xaa in position 230 to 248 is any amino acid
  Variant (249)..(330): xaa in position 249 to 330 is any or no amino acid
  Variant (332)..(333): xaa in position 332 to 333 is any amino acid
  Variant (335)..(336): xaa in position 335 to 336 is any amino acid
  Variant (339)..(340): xaa in position 339 to 340 is any amino acid
  Variant (343)..(343): xaa in position 343 is any amino acid
  Variant (345)..(345): xaa in position 345 is any amino acid
  Variant (347)..(352): xaa in position 347 to 352 is any amino acid
  Variant (355)..(355): xaa in position 355 is any amino acid
  Variant (358)..(358): xaa in position 358 is any amino acid
  Variant (362)..(364): xaa in position 362 to 364 is any amino acid
  Variant (366)..(366): xaa in position 366 is any amino acid
  Variant (369)..(376): xaa in position 369 to 376 is any amino acid
  Variant (378)..(379): xaa in position 378 to 379 is any amino acid
  Variant (381)..(381): xaa in position 381 is any amino acid
  Variant (383)..(385): xaa in position 383 to 385 is any amino acid
  Variant (387)..(388): xaa in position 387 to 388 is any amino acid
  Variant (390)..(392): xaa in position 390 to 392 is any amino acid
  Variant (395)..(395): xaa in position 395 is any amino acid
  Variant (399)..(400): xaa in position 399 to 400 is any amino acid
  Variant (402)..(402): xaa in position 402 is any amino acid
  Variant (405)..(405): xaa in position 405 is any amino acid
  Variant (407)..(407): xaa in position 407 is any amino acid
  Variant (410)..(410): xaa in position 410 is any amino acid
  Variant (413)..(417): xaa in position 413 to 417 is any amino acid
  Variant (419)..(421): xaa in position 419 to 421 is any amino acid
  Variant (423)..(423): xaa in position 423 is any amino acid
  Variant (425)..(427): xaa in position 425 to 427 is any amino acid
  Variant (429)..(429): xaa in position 429 is any amino acid
  Variant (434)..(434): xaa in position 434 is any amino acid
  Variant (436)..(442): xaa in position 436 to 442 is any amino acid
  Variant (443)..(446): xaa in position 443 to 446 is any or no amino acid
  Variant (448)..(448): xaa in position 448 is any amino acid
  Variant (451)..(451): xaa in position 451 is any amino acid
  Variant (454)..(454): xaa in position 454 is any amino acid
  Variant (456)..(457): xaa in position 456 to 457 is any amino acid
  Variant (459)..(462): xaa in position 459 to 462 is any amino acid
  Variant (464)..(465): xaa in position 464 to 465 is any amino acid
  Variant (468)..(473): xaa in position 468 to 473 is any amino acid
  Variant (475)..(477): xaa in position 475 to 477 is any amino acid
  Variant (479)..(481): xaa in position 479 to 481 is any amino acid
  Variant (484)..(484): xaa in position 484 is any amino acid
  Variant (488)..(491): xaa in position 488 to 491 is any amino acid
  Variant (494)..(496): xaa in position 494 to 496 is any amino acid
  Variant (499)..(505): xaa in position 499 to 505 is any amino acid
  Variant (508)..(513): xaa in position 508 to 513 is any amino acid
  Variant (516)..(518): xaa in position 516 to 518 is any amino acid
  Variant (520)..(520): xaa in position 520 is any amino acid
  Variant (522)..(527): xaa in position 522 to 527 is any amino acid

SEQ ID NO: 31005 - protein, 108 aa, Artificial sequence; identical to SEQ ID NO: 13500
  Variant (1)..(1): xaa in position 1 is Val or Ile
  Variant (2)..(3): xaa in position 2 to 3 is any amino acid
  Variant (4)..(4): xaa in position 4 is Phe or Leu
  Variant (6)..(6): xaa in position 6 is any amino acid
  Variant (7)..(7): xaa in position 7 is Ser, Ala or Val
  Variant (8)..(8): xaa in position 8 is any amino acid
  Variant (10)..(10): xaa in position 10 is Tyr or His
  Variant (11)..(11): xaa in position 11 is Ile, Val or Leu
  Variant (12)..(14): xaa in position 12 to 14 is any amino acid
  Variant (15)..(15): xaa in position 15 is Arg, His or Ser
  Variant (16)..(17): xaa in position 16 to 17 is any amino acid
  Variant (18)..(18): xaa in position 18 is Thr, Lys or Val
  Variant (19)..(19): xaa in position 19 is any amino acid
  Variant (21)..(21): xaa in position 21 is Ile, Leu, Val or Ala
  Variant (22)..(24): xaa in position 22 to 24 is any amino acid
  Variant (25)..(25): xaa in position 25 is Gly, Ala, Ser or Asp
  Variant (26)..(26): xaa in position 26 is Glu, Asp, Arg or Asn
  Variant (27)..(27): xaa in position 27 is any amino acid
  Variant (28)..(28): xaa in position 28 is Ile, Val or Leu
  Variant (29)..(38): xaa in position 29 to 38 is any amino acid
  Variant (39)..(42): xaa in position 39 to 42 is any or no amino acid
  Variant (44)..(44): xaa in position 44 is Ile, Leu, Val or Phe
  Variant (45)..(45): xaa in position 45 is any amino acid
  Variant (46)..(46): xaa in position 46 is Leu or Phe
  Variant (47)..(47): xaa in position 47 is Leu or Met
  Variant (48)..(49): xaa in position 48 to 49 is any amino acid
  Variant (50)..(50): xaa in position 50 is Leu or Met
  Variant (52)..(52): xaa in position 52 is Ile, Val, Leu, Met or Ala
  Variant (53)..(54): xaa in position 53 to 54 is any amino acid
  Variant (55)..(55): xaa in position 55 is Val or Ile
  Variant (56)..(56): xaa in position 56 is Leu, Val or Ile
  Variant (57)..(57): xaa in position 57 is Val or Ile
  Variant (58)..(58): xaa in position 58 is any amino acid
  Variant (60)..(62): xaa in position 60 to 62 is any amino acid
  Variant (63)..(63): xaa in position 63 is Gln or Phe
  Variant (64)..(64): xaa in position 64 is Ile, Val or Leu
  Variant (65)..(67): xaa in position 65 to 67 is any amino acid
  Variant (68)..(68): xaa in position 68 is Leu or Ala
  Variant (69)..(75): xaa in position 69 to 75 is any amino acid
  Variant (76)..(76): xaa in position 76 is any or no amino acid
  Variant (77)..(77): xaa in position 77 is Tyr, Phe or Ile
  Variant (78)..(81): xaa in position 78 to 81 is any amino acid
  Variant (82)..(82): xaa in position 82 is Arg or Ala
  Variant (83)..(83): xaa in position 83 is Val, Ile or Pro
  Variant (85)..(85): xaa in position 85 is Asp or Thr
  Variant (86)..(88): xaa in position 86 to 88 is any amino acid
  Variant (89)..(89): xaa in position 89 is Leu or Met
  Variant (90)..(91): xaa in position 90 to 91 is any amino acid
  Variant (92)..(92): xaa in position 92 is Val, Ala or Ile
  Variant (93)..(94): xaa in position 93 to 94 is any amino acid
  Variant (95)..(95): xaa in position 95 is Ala, Ser, Val or Phe
  Variant (96)..(96): xaa in position 96 is Ala, Val or Ser
  Variant (98)..(102): xaa in position 98 to 102 is any amino acid
  Variant (103)..(103): xaa in position 103 is Ile, Phe or Val
  Variant (104)..(104): xaa in position 104 is any amino acid
  Variant (105)..(105): xaa in position 105 is Ala or Ser
  Variant (106)..(106): xaa in position 106 is any amino acid
  Variant (107)..(107): xaa in position 107 is Leu or Phe
  Variant (108)..(108): xaa in position 108 is Ser or Cys

SEQ ID NO: 31006 - protein, 79 aa, Artificial sequence; identical to SEQ ID NO: 13501
  Variant (1)..(1): xaa in position 1 is Val or Leu
  Variant (2)..(2): xaa in position 2 is any amino acid
  Variant (3)..(3): xaa in position 3 is Ser, Thr or Gly
  Variant (4)..(4): xaa in position 4 is Gly or Ser
  Variant (6)..(8): xaa in position 6 to 8 is any amino acid
  Variant (9)..(9): xaa in position 9 is Ala or Ser
  Variant (10)..(10): xaa in position 10 is Gln, Arg or Lys
  Variant (11)..(11): xaa in position 11 is Pro or Arg
  Variant (12)..(12): xaa in position 12 is any amino acid
  Variant (14)..(14): xaa in position 14 is Val or Ile
  Variant (15)..(16): xaa in position 15 to 16 is any amino acid
  Variant (18)..(18): xaa in position 18 is Val, Ile or Thr
  Variant (20)..(22): xaa in position 20 to 22 is any amino acid
  Variant (23)..(23): xaa in position 23 is Thr, Ser or Ala
  Variant (25)..(25): xaa in position 25 is any amino acid
  Variant (26)..(26): xaa in position 26 is Val or Ile
  Variant (27)..(27): xaa in position 27 is Arg or Lys
  Variant (28)..(28): xaa in position 28 is Arg, Lys or Ala
  Variant (29)..(29): xaa in position 29 is Ile, Val or Thr
  Variant (30)..(30): xaa in position 30 is Asp or Asn
  Variant (31)..(33): xaa in position 31 to 33 is any amino acid
  Variant (34)..(34): xaa in position 34 is Ile, Leu or Val
  Variant (35)..(37): xaa in position 35 to 37 is any amino acid
  Variant (38)..(38): xaa in position 38 is Leu or Ile
  Variant (39)..(42): xaa in position 39 to 42 is any amino acid
  Variant (43)..(43): xaa in position 43 is Ile, Val or Leu
  Variant (45)..(45): xaa in position 45 is Leu, Val or Trp
  Variant (46)..(46): xaa in position 46 is Leu, Ile, Val or Met
  Variant (47)..(47): xaa in position 47 is any amino acid
  Variant (48)..(48): xaa in position 48 is Pro or Asn
  Variant (49)..(49): xaa in position 49 is any amino acid
  Variant (50)..(50): xaa in position 50 is Gly or Ala
  Variant (51)..(51): xaa in position 51 is any amino acid
  Variant (53)..(53): xaa in position 53 is any amino acid
  Variant (54)..(54): xaa in position 54 is Thr or Ser
  Variant (56)..(57): xaa in position 56 to 57 is any amino acid
  Variant (58)..(58): xaa in position 58 is Phe or Leu
  Variant (59)..(59): xaa in position 59 is Asn or Tyr
  Variant (60)..(60): xaa in position 60 is Leu or Cys
  Variant (61)..(61): xaa in position 61 is any amino acid
  Variant (62)..(62): xaa in position 62 is any or no amino acid
  Variant (63)..(63): xaa in position 63 is Glu, Tyr or Leu
  Variant (64)..(64): xaa in position 64 is Glu, Asp, Asn or Gln
  Variant (65)..(65): xaa in position 65 is any amino acid
  Variant (67)..(69): xaa in position 67 to 69 is any amino acid
  Variant (70)..(70): xaa in position 70 is Ala or Ser
  Variant (71)..(72): xaa in position 71 to 72 is any amino acid
  Variant (73)..(73): xaa in position 73 is Leu or Ile
  Variant (74)..(74): xaa in position 74 is any amino acid
  Variant (75)..(75): xaa in position 75 is Ala or Val
  Variant (76)..(76): xaa in position 76 is Asp or Glu
  Variant (78)..(78): xaa in position 78 is Leu or Met
  Variant (79)..(79): xaa in position 79 is Ile, Leu or Val

SEQ ID NO: 31007 - protein, 103 aa, Artificial sequence; identical to SEQ ID NO: 13502
  Variant (1)..(1): xaa in position 1 is Leu or Ile
  Variant (2)..(6): xaa in position 2 to 6 is any amino acid
  Variant (7)..(7): xaa in position 7 is Ala or Val
  Variant (8)..(10): xaa in position 8 to 10 is any amino acid
  Variant (12)..(12): xaa in position 12 is Val or Ile
  Variant (13)..(13): xaa in position 13 is any amino acid
  Variant (15)..(15): xaa in position 15 is any amino acid
  Variant (16)..(16): xaa in position 16 is His or Gln
  Variant (17)..(17): xaa in position 17 is Leu or Ile
  Variant (18)..(18): xaa in position 18 is Ile, Val or Leu
  Variant (19)..(23): xaa in position 19 to 23 is any amino acid
  Variant (25)..(25): xaa in position 25 is Ala, Ser or Val
  Variant (26)..(26): xaa in position 26 is Leu, Ile or Val
  Variant (27)..(27): xaa in position 27 is Leu or Ile
  Variant (28)..(28): xaa in position 28 is any amino acid
  Variant (30)..(30): xaa in position 30 is Leu, His or Ile
  Variant (32)..(34): xaa in position 32 to 34 is any amino acid
  Variant (36)..(36): xaa in position 36 is any amino acid
  Variant (38)..(38): xaa in position 38 is Thr or Ser
  Variant (39)..(39): xaa in position 39 is any amino acid
  Variant (40)..(40): xaa in position 40 is Ile, Val, Leu or Met
  Variant (41)..(47): xaa in position 41 to 47 is any amino acid
  Variant (48)..(49): xaa in position 48 to 49 is any or no amino acid
  Variant (51)..(51): xaa in position 51 is any amino acid
  Variant (53)..(55): xaa in position 53 to 55 is any amino acid
  Variant (57)..(57): xaa in position 57 is Ile, Val or Leu
  Variant (58)..(59): xaa in position 58 to 59 is any amino acid
  Variant (60)..(60): xaa in position 60 is Ile or Leu
  Variant (61)..(62): xaa in position 61 to 62 is any amino acid
  Variant (63)..(63): xaa in position 63 is Leu or Ile
  Variant (64)..(64): xaa in position 64 is Ile or Leu
  Variant (65)..(65): xaa in position 65 is any amino acid
  Variant (69)..(70): xaa in position 69 to 70 is any amino acid
  Variant (72)..(72): xaa in position 72 is any amino acid
  Variant (74)..(74): xaa in position 74 is Val or Leu
  Variant (75)..(75): xaa in position 75 is any amino acid
  Variant (77)..(77): xaa in position 77 is any amino acid
  Variant (78)..(78): xaa in position 78 is Arg or Asp
  Variant (79)..(80): xaa in position 79 to 80 is any amino acid
  Variant (81)..(81): xaa in position 81 is Leu or Ile
  Variant (82)..(82): xaa in position 82 is Glu or Leu
  Variant (83)..(84): xaa in position 83 to 84 is any amino acid
  Variant (85)..(85): xaa in position 85 is Ile, Leu or Val
  Variant (86)..(87): xaa in position 86 to 87 is any amino acid
  Variant (88)..(88): xaa in position 88 is Phe or Tyr
  Variant (89)..(89): xaa in position 89 is any amino acid
  Variant (90)..(91): xaa in position 90 to 91 is Ile, Val or Leu
  Variant (92)..(92): xaa in position 92 is any amino acid
  Variant (93)..(93): xaa in position 93 is Arg, His or Lys
  Variant (94)..(94): xaa in position 94 is Asp or Glu
  Variant (95)..(95): xaa in position 95 is Gly or Asn
  Variant (96)..(98): xaa in position 96 to 98 is any amino acid
  Variant (99)..(99): xaa in position 99 is Ala or Gly
  Variant (101)..(101): xaa in position 101 is Ala, Ser or Val
  Variant (103)..(103): xaa in position 103 is Leu or Met

SEQ ID NO: 31008 - protein, 76 aa, Artificial sequence; identical to SEQ ID NO: 13503
  Variant (1)..(1): xaa in position 1 is Gly, Ala or Cys
  Variant (3)..(3): xaa in position 3 is Met, Leu, Val, Ile or Phe
  Variant (5)..(5): xaa in position 5 is Cys or Ala
  Variant (6)..(6): xaa in position 6 is Val, Leu or Ile
  Variant (7)..(7): xaa in position 7 is any amino acid
  Variant (8)..(8): xaa in position 8 is Val or Ile
  Variant (9)..(12): xaa in position 9 to 12 is any amino acid
  Variant (13)..(13): xaa in position 13 is Arg or Gln
  Variant (14)..(17): xaa in position 14 to 17 is any amino acid
  Variant (19)..(20): xaa in position 19 to 20 is any amino acid
  Variant (21)..(22): xaa in position 21 to 22 is Leu or Ile
  Variant (23)..(28): xaa in position 23 to 28 is any amino acid
  Variant (29)..(29): xaa in position 29 is Ala or Ser
  Variant (30)..(32): xaa in position 30 to 32 is any amino acid
  Variant (33)..(33): xaa in position 33 is Gly, Asn or Arg
  Variant (34)..(36): xaa in position 34 to 36 is any amino acid
  Variant (37)..(37): xaa in position 37 is Leu, Ile or Val
  Variant (39)..(39): xaa in position 39 is Val, Ala or Leu
  Variant (41)..(41): xaa in position 41 is Thr or Ser
  Variant (43)..(43): xaa in position 43 is any amino acid
  Variant (44)..(44): xaa in position 44 is Thr or Ser
  Variant (45)..(46): xaa in position 45 to 46 is any amino acid
  Variant (49)..(49): xaa in position 49 is any amino acid
  Variant (50)..(50): xaa in position 50 is any or no amino acid
  Variant (51)..(51): xaa in position 51 is Arg, Gln or His
  Variant (54)..(60): xaa in position 54 to 60 is any amino acid
  Variant (61)..(61): xaa in position 61 is Leu or Ile
  Variant (63)..(64): xaa in position 63 to 64 is any amino acid
  Variant (65)..(65): xaa in position 65 is Lys or Arg
  Variant (66)..(68): xaa in position 66 to 68 is any amino acid
  Variant (69)..(69): xaa in position 69 is Tyr or Ile
  Variant (70)..(72): xaa in position 70 to 72 is any amino acid
  Variant (73)..(73): xaa in position 73 is any or no amino acid
  Variant (75)..(75): xaa in position 75 is any amino acid
  Variant (76)..(76): xaa in position 76 is Ser or Ala

SEQ ID NO: 31009 - DNA, 2374 bp, Escherichia coli K12; identical to SEQ ID NO: 1805
  CDS (86)..(2281)

SEQ ID NO: 31010 - protein, 731 aa, Escherichia coli K12; identical to SEQ ID NO: 1806

SEQ ID NO: 31011 - DNA, 2961 bp, Hafnia alvei; identical to SEQ ID NO: 1807
  CDS (185)..(2404)

SEQ ID NO: 31012 - protein, 739 aa, Hafnia alvei; identical to SEQ ID NO: 1808

SEQ ID NO: 31013 - DNA, 4341 bp, Escherichia coli; identical to SEQ ID NO: 1809
  CDS (660)..(2858)

SEQ ID NO: 31014 - protein, 732 aa, Escherichia coli; identical to SEQ ID NO: 1810

SEQ ID NO: 31015 - DNA, 1850 bp, Bacillus subtilis; identical to SEQ ID NO: 1811
  CDS (312)..(1784)

SEQ ID NO: 31016 - protein, 490 aa, Bacillus subtilis; identical to SEQ ID NO: 1812

SEQ ID NO: 31017 - DNA, 3091 bp, Lactobacillus sp; identical to SEQ ID NO: 1813
  CDS (572)..(2767)

SEQ ID NO: 31018 - protein, 731 aa, Lactobacillus sp; identical to SEQ ID NO: 1814

SEQ ID NO: 31019 - DNA, 1449 bp, Bacillus halodurans; identical to SEQ ID NO: 1815
  CDS (1)..(1449)

SEQ ID NO: 31020 - protein, 482 aa, Bacillus halodurans; identical to SEQ ID NO: 1816

SEQ ID NO: 31021 - DNA, 2196 bp, Sinorhizobium meliloti; identical to SEQ ID NO: 1817
  CDS (1)..(2196)

SEQ ID NO: 31022 - protein, 731 aa, Sinorhizobium meliloti; identical to SEQ ID NO: 1818

SEQ ID NO: 31023 - DNA, 1380 bp, Listeria innocua; identical to SEQ ID NO: 1819
  CDS (1)..(1380)

SEQ ID NO: 31024 - protein, 459 aa, Listeria innocua; identical to SEQ ID NO: 1820

SEQ ID NO: 31025 - DNA, 2307 bp, Yersinia pestis; identical to SEQ ID NO: 1821
  CDS (1)..(2307)

SEQ ID NO: 31026 - protein, 768 aa, Yersinia pestis; identical to SEQ ID NO: 1822

SEQ ID NO: 31027 - DNA, 2145 bp, Salmonella enterica subsp. enterica serovar Typhi; identical to SEQ ID NO: 1823
  CDS (1)..(2145)

SEQ ID NO: 31028 - protein, 714 aa, Salmonella enterica subsp. enterica serovar Typhi; identical to SEQ ID NO: 1824

SEQ ID NO: 31029 - DNA, 1467 bp, Nostoc sp. PCC 7120; identical to SEQ ID NO: 1825
  CDS (1)..(1467)

SEQ ID NO: 31030 - protein, 488 aa, Nostoc sp. PCC 7120; identical to SEQ ID NO: 1826

SEQ ID NO: 31031 - DNA, 2163 bp, Yersinia pestis; identical to SEQ ID NO: 1827
  CDS (1)..(2163)

SEQ ID NO: 31032 - protein, 720 aa, Yersinia pestis; identical to SEQ ID NO: 1828

SEQ ID NO: 31033 - DNA, 2271 bp, Salmonella enterica subsp. enterica serovar Typhi; identical to SEQ ID NO: 1829
  CDS (1)..(2271)

SEQ ID NO: 31034 - protein, 756 aa, Salmonella enterica subsp. enterica serovar Typhi; identical to SEQ ID NO: 1830

SEQ ID NO: 31035 - DNA, 2148 bp, Escherichia coli; identical to SEQ ID NO: 1831
  CDS (1)..(2148)

SEQ ID NO: 31036 - protein, 715 aa, Escherichia coli; identical to SEQ ID NO: 1832

SEQ ID NO: 31037 - DNA, 2835 bp, Escherichia coli; identical to SEQ ID NO: 1833
  CDS (571)..(2712)

SEQ ID NO: 31038 - protein, 713 aa, Escherichia coli; identical to SEQ ID NO: 1834

SEQ ID NO: 31039 - DNA, 1446 bp, Clostridium acetobutylicum; identical to SEQ ID NO: 1835
  CDS (1)..(1446)

SEQ ID NO: 31040 - protein, 481 aa, Clostridium acetobutylicum; identical to SEQ ID NO: 1836

SEQ ID NO: 31041 - DNA, 1464 bp, Clostridium acetobutylicum; identical to SEQ ID NO: 1837
  CDS (1)..(1464)

SEQ ID NO: 31042 - protein, 487 aa, Clostridium acetobutylicum; identical to SEQ ID NO: 1838

SEQ ID NO: 31043 - DNA, 2256 bp, Pseudomonas aeruginosa; identical to SEQ ID NO: 1839
  CDS (1)..(2256)

SEQ ID NO: 31044 - protein, 751 aa, Pseudomonas aeruginosa; identical to SEQ ID NO: 1840

SEQ ID NO: 31045 - DNA, 2853 bp, Mycobacterium leprae; identical to SEQ ID NO: 1841
  CDS (1)..(2853)

SEQ ID NO: 31046 - protein, 950 aa, Mycobacterium leprae; identical to SEQ ID NO: 1842

SEQ ID NO: 31047 - DNA, 2202 bp, Vibrio cholerae; identical to SEQ ID NO: 1843
  CDS (1)..(2202)

SEQ ID NO: 31048 - protein, 733 aa, Vibrio cholerae; identical to SEQ ID NO: 1844

SEQ ID NO: 31049 - DNA, 2163 bp, Vibrio cholerae; identical to SEQ ID NO: 1845
  CDS (1)..(2163)

SEQ ID NO: 31050 - protein, 720 aa, Vibrio cholerae; identical to SEQ ID NO: 1846

SEQ ID NO: 31051 - DNA, 2163 bp, Haemophilus influenzae; identical to SEQ ID NO: 1847
  CDS (1)..(2163)

SEQ ID NO: 31052 - protein, 720 aa, Haemophilus influenzae; identical to SEQ ID NO: 1848

SEQ ID NO: 31053 - DNA, 2844 bp, Mycobacterium tuberculosis; identical to SEQ ID NO: 1849
  CDS (1)..(2844)

SEQ ID NO: 31054 - protein, 947 aa, Mycobacterium tuberculosis; identical to SEQ ID NO: 1850

SEQ ID NO: 31055 - DNA, 1476 bp, Streptococcus pneumoniae; identical to SEQ ID NO: 1851
  CDS (1)..(1476)

SEQ ID NO: 31056 - protein, 491 aa, Streptococcus pneumoniae; identical to SEQ ID NO: 1852

SEQ ID NO: 31057 - DNA, 1476 bp, Bacillus halodurans; identical to SEQ ID NO: 1853
  CDS (1)..(1476)

SEQ ID NO: 31058 - protein, 491 aa, Bacillus halodurans; identical to SEQ ID NO: 1854

SEQ ID NO: 31059 - DNA, 2349 bp, Sinorhizobium meliloti; identical to SEQ ID NO: 1855
  CDS (1)..(2349)

SEQ ID NO: 31060 - protein, 782 aa, Sinorhizobium meliloti; identical to SEQ ID NO: 1856

SEQ ID NO: 31061 - DNA, 1476 bp, Streptococcus pneumoniae; identical to SEQ ID NO: 1857
  CDS (1)..(1476)

SEQ ID NO: 31062 - protein, 491 aa, Streptococcus pneumoniae; identical to SEQ ID NO: 1858

SEQ ID NO: 31063 - DNA, 2271 bp, Escherichia coli; identical to SEQ ID NO: 1859
  CDS (1)..(2271)

SEQ ID NO: 31064 - protein, 756 aa, Escherichia coli; identical to SEQ ID NO: 1860

SEQ ID NO: 31065 - DNA, 1443 bp, Bacillus subtilis; identical to SEQ ID NO: 1861
  CDS (1)..(1443)

SEQ ID NO: 31066 - protein, 480 aa, Bacillus subtilis; identical to SEQ ID NO: 1862

SEQ ID NO: 31067 - DNA, 1452 bp, Synechocystis sp; identical to SEQ ID NO: 1863
  CDS (1)..(1452)

SEQ ID NO: 31068 - protein, 483 aa, Synechocystis sp; identical to SEQ ID NO: 1864

SEQ ID NO: 31069 - DNA, 2307 bp, Yersinia pseudotuberculosis IP 32953; identical to SEQ ID NO: 1865
  CDS (1)..(2307)

SEQ ID NO: 31070 - protein, 768 aa, Yersinia pseudotuberculosis IP 32953; identical to SEQ ID NO: 1866

SEQ ID NO: 31071 - DNA, 1467 bp, Symbiobacterium thermophilum; identical to SEQ ID NO: 1867
  CDS (1)..(1467)

SEQ ID NO: 31072 - protein, 488 aa, Symbiobacterium thermophilum; identical to SEQ ID NO: 1868

SEQ ID NO: 31073 - DNA, 1410 bp, Symbiobacterium thermophilum; identical to SEQ ID NO: 1869
  CDS (1)..(1410)

SEQ ID NO: 31074 - protein, 469 aa, Symbiobacterium thermophilum; identical to SEQ ID NO: 1870

SEQ ID NO: 31075 - DNA, 2154 bp, Erwinia carotovora; identical to SEQ ID NO: 1871
  CDS (1)..(2154)

SEQ ID NO: 31076 - protein, 717 aa, Erwinia carotovora; identical to SEQ ID NO: 1872

SEQ ID NO: 31077 - DNA, 2790 bp, Acinetobacter sp; identical to SEQ ID NO: 1873
  CDS (1)..(2790)

SEQ ID NO: 31078 - protein, 929 aa, Acinetobacter sp; identical to SEQ ID NO: 1874

SEQ ID NO: 31079 - DNA, 1482 bp, Bacillus thuringiensis; identical to SEQ ID NO: 1875
  CDS (1)..(1482)

SEQ ID NO: 31080 - protein, 493 aa, Bacillus thuringiensis; identical to SEQ ID NO: 1876

SEQ ID NO: 31081 - DNA, 1422 bp, Bacillus thuringiensis; identical to SEQ ID NO: 1877
  CDS (1)..(1422)

SEQ ID NO: 31082 - protein, 473 aa, Bacillus thuringiensis; identical to SEQ ID NO: 1878

SEQ ID NO: 31083 - DNA, 2358 bp, Rhodopseudomonas palustris; identical to SEQ ID NO: 1879
  CDS (1)..(2358)

SEQ ID NO: 31084 - protein, 785 aa, Rhodopseudomonas palustris; identical to SEQ ID NO: 1880

SEQ ID NO: 31085 - DNA, 2837 bp, Shigella boydii; identical to SEQ ID NO: 1881
  CDS (165)..(2435)

SEQ ID NO: 31086 - protein, 756 aa, Shigella boydii; identical to SEQ ID NO: 1882

SEQ ID NO: 31087 - DNA, 1380 bp, Listeria monocytogenes; identical to SEQ ID NO: 1883
  CDS (1)..(1380)

SEQ ID NO: 31088 - protein, 459 aa, Listeria monocytogenes; identical to SEQ ID NO: 1884

SEQ ID NO: 31089 - DNA, 1482 bp, Bacillus cereus; identical to SEQ ID NO: 1885
  CDS (1)..(1482)

SEQ ID NO: 31090 - protein, 493 aa, Bacillus cereus; identical to SEQ ID NO: 1886

SEQ ID NO: 31091 - DNA, 1422 bp, Bacillus cereus; identical to SEQ ID NO: 1887
  CDS (1)..(1422)

SEQ ID NO: 31092 - protein, 473 aa, Bacillus cereus; identical to SEQ ID NO: 1888

SEQ ID NO: 31093 - DNA, 1458 bp, Mycobacterium paratuberculosis; identical to SEQ ID NO: 1889
  CDS (1)..(1458)

SEQ ID NO: 31094 - protein, 485 aa, Mycobacterium paratuberculosis; identical to SEQ ID NO: 1890

SEQ ID NO: 31095 - DNA, 2853 bp, Mycobacterium paratuberculosis; identical to SEQ ID NO: 1891
  CDS (1)..(2853)

SEQ ID NO: 31096 - protein, 950 aa, Mycobacterium paratuberculosis; identical to SEQ ID NO: 1892

SEQ ID NO: 31097 - DNA, 2100 bp, Lactobacillus johnsonii; identical to SEQ ID NO: 1893
  CDS (1)..(2100)

SEQ ID NO: 31098 - protein, 699 aa, Lactobacillus johnsonii; identical to SEQ ID NO: 1894

SEQ ID NO: 31099 - DNA, 3625 bp, Vibrio parahaemolyticus; identical to SEQ ID NO: 1895
  CDS (1451)..(3625)

SEQ ID NO: 31100 - protein, 724 aa, Vibrio parahaemolyticus; identical to SEQ ID NO: 1896

SEQ ID NO: 31101 - DNA, 2142 bp, Shigella flexneri; identical to SEQ ID NO: 1897
  CDS (1)..(2142)

SEQ ID NO: 31102 - protein, 713 aa, Shigella flexneri; identical to SEQ ID NO: 1898

SEQ ID NO: 31103 - DNA, 2181 bp, Vibrio vulnificus; identical to SEQ ID NO: 1899
  CDS (1)..(2181)

SEQ ID NO: 31104 - protein, 726 aa, Vibrio vulnificus; identical to SEQ ID NO: 1900

SEQ ID NO: 31105 - DNA, 2307 bp, Photorhabdus luminescens; identical to SEQ ID NO: 1901
  CDS (1)..(2307)

SEQ ID NO: 31106 - protein, 768 aa, Photorhabdus luminescens; identical to SEQ ID NO: 1902

SEQ ID NO: 31107 - DNA, 1404 bp, Gloeobacter violaceus; identical to SEQ ID NO: 1903
  CDS (1)..(1404)

SEQ ID NO: 31108 - protein, 467 aa, Gloeobacter violaceus; identical to SEQ ID NO: 1904

SEQ ID NO: 31109 - DNA, 2259 bp, Chromobacterium violaceum; identical to SEQ ID NO: 1905
  CDS (1)..(2259)

SEQ ID NO: 31110 - protein, 752 aa, Chromobacterium violaceum; identical to SEQ ID NO: 1906

SEQ ID NO: 31111 - DNA, 1251 bp, Chromobacterium violaceum; identical to SEQ ID NO: 1907
  CDS (1)..(1251)

SEQ ID NO: 31112 - protein, 416 aa, Chromobacterium violaceum; identical to SEQ ID NO: 1908

SEQ ID NO: 31113 - DNA, 2352 bp, Fusobacterium nucleatum subsp; identical to SEQ ID NO: 1909
  CDS (1)..(2352)

SEQ ID NO: 31114 - protein, 783 aa, Fusobacterium nucleatum subsp; identical to SEQ ID NO: 1910

SEQ ID NO: 31115 - DNA, 2196 bp, Shigella flexneri; identical to SEQ ID NO: 1911
  CDS (1)..(2196)

SEQ ID NO: 31116 - protein, 731 aa, Shigella flexneri; identical to SEQ ID NO: 1912

SEQ ID NO: 31117 - DNA, 2271 bp, Bordetella pertussis; identical to SEQ ID NO: 1913
  CDS (1)..(2271)

SEQ ID NO: 31118 - protein, 756 aa, Bordetella pertussis; identical to SEQ ID NO: 1914

SEQ ID NO: 31119 - DNA, 2271 bp, Bordetella parapertussis; identical to SEQ ID NO: 1915
  CDS (1)..(2271)

SEQ ID NO: 31120 - protein, 756 aa, Bordetella parapertussis; identical to SEQ ID NO: 1916

SEQ ID NO: 31121 - DNA, 1422 bp, Bacillus cereus; identical to SEQ ID NO: 1917
  CDS (1)..(1422)

SEQ ID NO: 31122 - protein, 473 aa, Bacillus cereus; identical to SEQ ID NO: 1918

SEQ ID NO: 31123 - DNA, 1422 bp, Bacillus anthracis; identical to SEQ ID NO: 1919
  CDS (1)..(1422)

SEQ ID NO: 31124 - protein, 473 aa, Bacillus anthracis; identical to SEQ ID NO: 1920

SEQ ID NO: 31125 - DNA, 2271 bp, Shigella flexneri; identical to SEQ ID NO: 1921
  CDS (1)..(2271)

SEQ ID NO: 31126 - protein, 756 aa, Shigella flexneri; identical to SEQ ID NO: 1922

SEQ ID NO: 31127 - DNA, 2136 bp, Shigella flexneri; identical to SEQ ID NO: 1923
  CDS (1)..(2136)

SEQ ID NO: 31128 - protein, 711 aa, Shigella flexneri; identical to SEQ ID NO: 1924

SEQ ID NO: 31129 - DNA, 2127 bp, Escherichia coli; identical to SEQ ID NO: 1925
  CDS (1)..(2127)

SEQ ID NO: 31130 - protein, 708 aa, Escherichia coli; identical to SEQ ID NO: 1926

SEQ ID NO: 31131 - DNA, 1563 bp, Oryza sativa; identical to SEQ ID NO: 1927
  CDS (1)..(1563)

SEQ ID NO: 31132 - protein, 520 aa, Oryza sativa; identical to SEQ ID NO: 1928

SEQ ID NO: 31133 - DNA, 2181 bp, Vibrio parahaemolyticus; identical to SEQ ID NO: 1929
  CDS (1)..(2181)

SEQ ID NO: 31134 - protein, 726 aa, Vibrio parahaemolyticus; identical to SEQ ID NO: 1930

SEQ ID NO: 31135 - DNA, 4026 bp, Vibrio parahaemolyticus; identical to SEQ ID NO: 1931
  CDS (1779)..(3914)

SEQ ID NO: 31136 - protein, 711 aa, Vibrio parahaemolyticus; identical to SEQ ID NO: 1932

SEQ ID NO: 31137 - DNA, 1461 bp, Clostridium tetani; identical to SEQ ID NO: 1933
  CDS (1)..(1461)

SEQ ID NO: 31138 - protein, 486 aa, Clostridium tetani; identical to SEQ ID NO: 1934

SEQ ID NO: 31139 - DNA, 1416 bp, Clostridium tetani; identical to SEQ ID NO: 1935
  CDS (1)..(1416)

SEQ ID NO: 31140 - protein, 471 aa, Clostridium tetani; identical to SEQ ID NO: 1936

SEQ ID NO: 31141 - DNA, 2766 bp, Bradyrhizobium japonicum; identical to SEQ ID NO: 1937
  CDS (1)..(2766)

SEQ ID NO: 31142 - protein, 921 aa, Bradyrhizobium japonicum; identical to SEQ ID NO: 1938

SEQ ID NO: 31143 - DNA, 2517 bp, Bradyrhizobium japonicum; identical to SEQ ID NO: 1939
  CDS (1)..(2517)

SEQ ID NO: 31144 - protein, 838 aa, Bradyrhizobium japonicum; identical to SEQ ID NO: 1940

SEQ ID NO: 31145 - DNA, 2181 bp, Vibrio vulnificus; identical to SEQ ID NO: 1941
  CDS (1)..(2181)

SEQ ID NO: 31146 - protein, 726 aa, Vibrio vulnificus; identical to SEQ ID NO: 1942

SEQ ID NO: 31147 - DNA, 2109 bp, Vibrio vulnificus; identical to SEQ ID NO: 1943
  CDS (1)..(2109)

SEQ ID NO: 31148 - protein, 702 aa, Vibrio vulnificus; identical to SEQ ID NO: 1944

SEQ ID NO: 31149 - DNA, 2163 bp, Shewanella oneidensis; identical to SEQ ID NO: 1945
  CDS (1)..(2163)

SEQ ID NO: 31150 - protein, 720 aa, Shewanella oneidensis; identical to SEQ ID NO: 1946

SEQ ID NO: 31151 - DNA, 1419 bp, Oceanobacillus iheyensis; identical to SEQ ID NO: 1947
  CDS (1)..(1419)

SEQ ID NO: 31152 - protein, 472 aa, Oceanobacillus iheyensis; identical to SEQ ID NO: 1948

SEQ ID NO: 31153 - DNA, 2154 bp, Escherichia coli O6; identical to SEQ ID NO: 1949
  CDS (1)..(2154)

SEQ ID NO: 31154 - protein, 717 aa, Escherichia coli O6; identical to SEQ ID NO: 1950

SEQ ID NO: 31155 - DNA, 2271 bp, Escherichia coli O6; identical to SEQ ID NO: 1951
  CDS (1)..(2271)

SEQ ID NO: 31156 - protein, 756 aa, Escherichia coli O6; identical to SEQ ID NO: 1952

SEQ ID NO: 31157 - DNA, 2370 bp, Escherichia coli O6; identical to SEQ ID NO: 1953
  CDS (1)..(2370)

SEQ ID NO: 31158 - protein, 789 aa, Escherichia coli O6; identical to SEQ ID NO: 1954

SEQ ID NO: 31159 - DNA, 2136 bp, Escherichia coli O6; identical to SEQ ID NO: 1955
  CDS (1)..(2136)

SEQ ID NO: 31160 - protein, 711 aa, Escherichia coli O6; identical to SEQ ID NO: 1956

SEQ ID NO: 31161 - DNA, 2208 bp, Escherichia coli O6; identical to SEQ ID NO: 1957
  CDS (1)..(2208)

SEQ ID NO: 31162 - protein, 735 aa, Escherichia coli O6; identical to SEQ ID NO: 1958

SEQ ID NO: 31163 - DNA, 2142 bp, Escherichia coli O6; identical to SEQ ID NO: 1959
  CDS (1)..(2142)

SEQ ID NO: 31164 - protein, 713 aa, Escherichia coli O6; identical to SEQ ID NO: 1960

SEQ ID NO: 31165 - DNA, 1488 bp, Thermoanaerobacter tengcongensis; identical to SEQ ID NO: 1961
  CDS (1)..(1488)

SEQ ID NO: 31166 - protein, 495 aa, Thermoanaerobacter tengcongensis; identical to SEQ ID NO: 1962

SEQ ID NO: 31167 - DNA, 1419 bp, Thermoanaerobacter tengcongensis; identical to SEQ ID NO: 1963
  CDS (1)..(1419)

SEQ ID NO: 31168 - protein, 472 aa, Thermoanaerobacter tengcongensis; identical to SEQ ID NO: 1964

SEQ ID NO: 31169 - DNA, 2352 bp, Fusobacterium nucleatum; identical to SEQ ID NO: 1965
  CDS (1)..(2352)

SEQ ID NO: 31170 - protein, 783 aa, Fusobacterium nucleatum; identical to SEQ ID NO: 1966

SEQ ID NO: 31171 - DNA, 1431 bp, Clostridium perfringens; identical to SEQ ID NO: 1967
  CDS (1)..(1431)

SEQ ID NO: 31172 - protein, 476 aa, Clostridium perfringens; identical to SEQ ID NO: 1968

SEQ ID NO: 31173 - DNA, 1455 bp, Clostridium perfringens; identical to SEQ ID NO: 1969
  CDS (1)..(1455)

SEQ ID NO: 31174 - protein, 484 aa, Clostridium perfringens; identical to SEQ ID NO: 1970

SEQ ID NO: 31175 - DNA, 2280 bp, Ralstonia solanacearum; identical to SEQ ID NO: 1971
  CDS (1)..(2280)

SEQ ID NO: 31176 - protein, 759 aa, Ralstonia solanacearum; identical to SEQ ID NO: 1972

SEQ ID NO: 31177 - DNA, 2271 bp, Salmonella typhimurium; identical to SEQ ID NO: 1973
  CDS (1)..(2271)

SEQ ID NO: 31178 - protein, 756 aa, Salmonella typhimurium; identical to SEQ ID NO: 1974

SEQ ID NO: 31179 - DNA, 2136 bp, Salmonella typhimurium; identical to SEQ ID NO: 1975
  CDS (1)..(2136)

SEQ ID NO: 31180 - protein, 711 aa, Salmonella typhimurium; identical to SEQ ID NO: 1976

SEQ ID NO: 31181 - DNA, 2199 bp, Salmonella typhimurium; identical to SEQ ID NO: 1977
  CDS (1)..(2199)

SEQ ID NO: 31182 - protein, 732 aa, Salmonella typhimurium; identical to SEQ ID NO: 1978

SEQ ID NO: 31183 - DNA, 2142 bp, Salmonella typhimurium; identical to SEQ ID NO: 1979
  CDS (1)..(2142)

SEQ ID NO: 31184 - protein, 713 aa, Salmonella typhimurium; identical to SEQ ID NO: 1980

SEQ ID NO: 31185 - DNA, 2136 bp, Vibrio vulnificus; identical to SEQ ID NO: 1981
  CDS (1)..(2136)

SEQ ID NO: 31186 - protein, 711 aa, Vibrio vulnificus; identical to SEQ ID NO: 1982

SEQ ID NO: 31187 - DNA, 2163 bp, Pasteurella multocida; identical to SEQ ID NO: 1983
  CDS (1)..(2163)

SEQ ID NO: 31188 - protein, 720 aa, Pasteurella multocida; identical to SEQ ID NO: 1984

SEQ ID NO: 31189 - DNA, 2139 bp, Moritella japonica; identical to SEQ ID NO: 1985
  CDS (1)..(2139)

SEQ ID NO: 31190 - protein, 712 aa, Moritella japonica; identical to SEQ ID NO: 1986

SEQ ID NO: 31191 - DNA, 1479 bp, Streptomyces coelicolor; identical to SEQ ID NO: 1987
  CDS (1)..(1479)

SEQ ID NO: 31192 - protein, 492 aa, Streptomyces coelicolor; identical to SEQ ID NO: 1988

SEQ ID NO: 31193 - DNA, 2130 bp, Eikenella corrodens; identical to SEQ ID NO: 1989
  CDS (1)..(2130)

SEQ ID NO: 31194 - protein, 709 aa, Eikenella corrodens; identical to SEQ ID NO: 1990

SEQ ID NO: 31195 - DNA, 2271 bp, Escherichia coli; identical to SEQ ID NO: 1859
  CDS (4)..(2271)

SEQ ID NO: 31196 - protein, 755 aa, Escherichia coli; identical to SEQ ID NO: 1992

SEQ ID NO: 31197 - DNA, 2196 bp, Lactobacillus sp; identical to SEQ ID NO: 1993
  CDS (1)..(2196)

SEQ ID NO: 31198 - protein, 731 aa, Lactobacillus sp; identical to SEQ ID NO: 1814

SEQ ID NO: 31199 - DNA, 1482 bp, Bacillus anthracis; identical to SEQ ID NO: 1995
  CDS (1)..(1482)

SEQ ID NO: 31200 - protein, 493 aa, Bacillus anthracis; identical to SEQ ID NO: 1996

SEQ ID NO: 31201 - DNA, 1383 bp, Bacillus cereus; identical to SEQ ID NO: 1997
  CDS (1)..(1383)

SEQ ID NO: 31202 - protein, 460 aa, Bacillus cereus; identical to SEQ ID NO: 1998

SEQ ID NO: 31203 - DNA, 20 bp, Artificial sequence
  (1)..(20): primer
atggggcagggttttccacc

SEQ ID NO: 31204 - DNA, 25 bp, Artificial sequence
  (1)..(25): primer
ttacttcaacacataaccgtacaac

SEQ ID NO: 31205 - protein, 642 aa, Artificial sequence; identical to SEQ ID NO: 2902
  Variant (2)..(5): xaa in position 2 to 5 is any amino acid
  Variant (7)..(58): xaa in position 7 to 58 is any amino acid
  Variant (60)..(61): xaa in position 60 to 61 is any amino acid
  Variant (63)..(66): xaa in position 63 to 66 is any amino acid
  Variant (68)..(71): xaa in position 68 to 71 is any amino acid
  Variant (73)..(76): xaa in position 73 to 76 is any amino acid
  Variant (78)..(90): xaa in position 78 to 90 is any amino acid
  Variant (92)..(92): xaa in position 92 is any amino acid
  Variant (94)..(113): xaa in position 94 to 113 is any amino acid
  Variant (116)..(116): xaa in position 116 is any amino acid
  Variant (120)..(131): xaa in position 120 to 131 is any amino acid
  Variant (133)..(188): xaa in position 133 to 188 is any amino acid
  Variant (191)..(191): xaa in position 191 is any amino acid
  Variant (193)..(215): xaa in position 193 to 215 is any amino acid
  Variant (217)..(217): xaa in position 217 is any amino acid
  Variant (219)..(224): xaa in position 219 to 224 is any amino acid
  Variant (226)..(290): xaa in position 226 to 290 is any amino acid
  Variant (292)..(292): xaa in position 292 is any amino acid
  Variant (295)..(300): xaa in position 295 to 300 is any amino acid
  Variant (302)..(302): xaa in position 302 is any amino acid
  Variant (304)..(305): xaa in position 304 to 305 is any amino acid
  Variant (307)..(333): xaa in position 307 to 333 is any amino acid
  Variant (337)..(337): xaa in position 337 is any amino acid
  Variant (339)..(341): xaa in position 339 to 341 is any amino acid
  Variant (343)..(355): xaa in position 343 to 355 is any amino acid
  Variant (357)..(370): xaa in position 357 to 370 is any amino acid
  Variant (372)..(457): xaa in position 372 to 457 is any amino acid
  Variant (460)..(460): xaa in position 460 is any amino acid
  Variant (462)..(494): xaa in position 462 to 494 is any amino acid
  Variant (496)..(497): xaa in position 496 to 497 is any amino acid
  Variant (499)..(505): xaa in position 499 to 505 is any amino acid
  Variant (507)..(520): xaa in position 507 to 520 is any amino acid
  Variant (522)..(524): xaa in position 522 to 524 is any amino acid
  Variant (526)..(620): xaa in position 526 to 620 is any amino acid
  Variant (622)..(624): xaa in position 622 to 624 is any amino acid
  Variant (626)..(630): xaa in position 626 to 630 is any amino acid
  Variant (635)..(640): xaa in position 635 to 640 is any amino acid

SEQ ID NO: 31206 - protein, 101 aa, Artificial sequence; identical to SEQ ID NO: 1322
  Variant (2)..(23): xaa in position 2 to 23 is any amino acid
  Variant (24)..(30): xaa in position 24 to 30 is any or no amino acid
  Variant (32)..(32): xaa in position 32 is any amino acid
  Variant (37)..(39): xaa in position 37 to 39 is any amino acid
  Variant (41)..(55): xaa in position 41 to 55 is any amino acid
  Variant (56)..(57): xaa in position 56 to 57 is any or no amino acid
  Variant (59)..(62): xaa in position 59 to 62 is any amino acid
  Variant (64)..(64): xaa in position 64 is any amino acid
  Variant (67)..(70): xaa in position 67 to 70 is any amino acid
  Variant (72)..(72): xaa in position 72 is any amino acid
  Variant (75)..(77): xaa in position 75 to 77 is any amino acid
  Variant (79)..(85): xaa in position 79 to 85 is any amino acid
  Variant (87)..(90): xaa in position 87 to 90 is any amino acid
  Variant (92)..(93): xaa in position 92 to 93 is any amino acid
  Variant (97)..(97): xaa in position 97 is any amino acid
  Variant (100)..(100): xaa in position 100 is any amino acid

SEQ ID NO: 31207 - protein, 76 aa, Artificial sequence; identical to SEQ ID NO: 2897
  Variant (1)..(1): xaa in position 1 is Leu, Met or Val
  Variant (2)..(2): xaa in position 2 is Gly or Asp
  Variant (3)..(3): xaa in position 3 is Asp, Ser, Asn, Gln or Gly
  Variant (4)..(4): xaa in position 4 is Leu or Arg
  Variant (5)..(6): xaa in position 5 to 6 is any amino acid
  Variant (7)..(7): xaa in position 7 is His or Pro
  Variant (8)..(8): xaa in position 8 is any amino acid
  Variant (9)..(9): xaa in position 9 is Gly, Ser, Glu or Asp
  Variant (10)..(13): xaa in position 10 to 13 is any amino acid
  Variant (14)..(14): xaa in position 14 is Ala or Ser
  Variant (15)..(15): xaa in position 15 is Gln, Glu or Met
  Variant (16)..(18): xaa in position 16 to 18 is any amino acid
  Variant (19)..(19): xaa in position 19 is Ala or Ser
  Variant (20)..(21): xaa in position 20 to 21 is any amino acid
  Variant (22)..(22): xaa in position 22 is Phe, Tyr, Trp or Val
  Variant (23)..(23): xaa in position 23 is any amino acid
  Variant (24)..(24): xaa in position 24 is Ala, Ser or Val
  Variant (25)..(27): xaa in position 25 to 27 is any amino acid
  Variant (28)..(28): xaa in position 28 is Tyr, Phe or Trp
  Variant (29)..(30): xaa in position 29 to 30 is any amino acid
  Variant (31)..(31): xaa in position 31 is Val, Thr, Leu or Ile
  Variant (32)..(32): xaa in position 32 is any amino acid
  Variant (34)..(34): xaa in position 34 is Thr or Ser
  Variant (35)..(35): xaa in position 35 is Ser or Thr
  Variant (36)..(36): xaa in position 36 is any amino acid
  Variant (37)..(37): xaa in position 37 is Ser, Ala or Gly
  Variant (38)..(38): xaa in position 38 is Asn, Ile, Val or Ser
  Variant (39)..(51): xaa in position 39 to 51 is any amino acid
  Variant (52)..(52): xaa in position 52 is Val, Ile, Leu or Ala
  Variant (53)..(53): xaa in position 53 is Leu, Ile, Val or Met
  Variant (54)..(55): xaa in position 54 to 55 is any amino acid
  Variant (57)..(57): xaa in position 57 is Asn or Asp
  Variant (58)..(58): xaa in position 58 is any amino acid
  Variant (60)..(60): xaa in position 60 is Lys, Gln or Arg
  Variant (61)..(61): xaa in position 61 is Ser or Ala
  Variant (62)..(65): xaa in position 62 to 65 is any amino acid
  Variant (66)..(66): xaa in position 66 is any or no amino acid
  Variant (67)..(67): xaa in position 67 is Leu, Ile, Met or Val
  Variant (68)..(73): xaa in position 68 to 73 is any amino acid
  Variant (74)..(74): xaa in position 74 is Pro or Ala
  Variant (75)..(75): xaa in position 75 is any amino acid
  Variant (76)..(76): xaa in position 76 is Tyr, Phe or Trp

SEQ ID NO: 31208 - protein, 39 aa, Artificial sequence; identical to SEQ ID NO: 2898
  Variant (1)..(1): xaa in position 1 is Val, Ile, Leu, Phe or Thr
  Variant (2)..(2): xaa in position 2 is Ile, Val, Leu, Phe or Ala
  Variant (3)..(5): xaa in position 3 to 5 is any amino acid
  Variant (6)..(6): xaa in position 6 is Thr, Asn or Ser
  Variant (7)..(7): xaa in position 7 is Tyr, Phe or Pro
  Variant (8)..(8): xaa in position 8 is Asp, Tyr, Phe or His
  Variant (10)..(12): xaa in position 10 to 12 is any amino acid
  Variant (13)..(13): xaa in position 13 is Asn, Asp or Ser
  Variant (14)..(25): xaa in position 14 to 25 is any amino acid
  Variant (26)..(29): xaa in position 26 to 29 is any or no amino acid
  Variant (30)..(30): xaa in position 30 is Ile, Val, Leu or Phe
  Variant (31)..(31): xaa in position 31 is any amino acid
  Variant (32)..(32): xaa in position 32 is Phe, Val, Trp or Ile
  Variant (34)..(34): xaa in position 34 is Glu, Ser or Cys
  Variant (36)..(36): xaa in position 36 is Trp or His
  Variant (37)..(37): xaa in position 37 is any amino acid
  Variant (38)..(38): xaa in position 38 is Ala, Gly, Pro or Val
  Variant (39)..(39): xaa in position 39 is Tyr, His or Phe

SEQ ID NO: 31209 - protein, 84 aa, Artificial sequence; identical to SEQ ID NO: 2899
  Variant (1)..(1): xaa in position 1 is Ser or Leu
  Variant (2)..(2): xaa in position 2 is any amino acid
  Variant (5)..(7): xaa in position 5 to 7 is any amino acid
  Variant (8)..(8): xaa in position 8 is Ala, Gly or Ser
  Variant (9)..(9): xaa in position 9 is Leu, Phe, Met or Ile
  Variant (10)..(10): xaa in position 10 is Ser, Thr, Arg or Glu
  Variant (11)..(11): xaa in position 11 is Gln or Met
  Variant (12)..(12): xaa in position 12 is any amino acid
  Variant (13)..(13): xaa in position 13 is Ser or Ala
  Variant (14)..(14): xaa in position 14 is any amino acid
  Variant (15)..(15): xaa in position 15 is Ile, Leu, Met, Val or Phe
  Variant (16)..(16): xaa in position 16 is His, Asn, Leu or Ile
  Variant (17)..(25): xaa in position 17 to 25 is any amino acid
  Variant (26)..(33): xaa in position 26 to 33 is any or no amino acid
  Variant (34)..(34): xaa in position 34 is Phe, Val, Leu, Met or Ile
  Variant (35)..(42): xaa in position 35 to 42 is any amino acid
  Variant (43)..(43): xaa in position 43 is Ser or Thr
  Variant (44)..(44): xaa in position 44 is Thr or Ser
  Variant (46)..(47): xaa in position 46 to 47 is any amino acid
  Variant (48)..(48): xaa in position 48 is Tyr, Gln or Val
  Variant (49)..(49): xaa in position 49 is any amino acid
  Variant (50)..(50): xaa in position 50 is Leu, Ile, Phe or Met
  Variant (51)..(51): xaa in position 51 is any amino acid
  Variant (52)..(52): xaa in position 52 is Ala or Ser
  Variant (53)..(53): xaa in position 53 is Ser, Ala or Thr
  Variant (54)..(54): xaa in position 54 is any amino acid
  Variant (55)..(55): xaa in position 55 is Asp or Glu
  Variant (56)..(63): xaa in position 56 to 63 is any amino acid
  Variant (64)..(65): xaa in position 64 to 65 is any or no amino acid
  Variant (66)..(66): xaa in position 66 is Gly, Ala, Lys or Asn
  Variant (67)..(73): xaa in position 67 to 73 is any amino acid
  Variant (74)..(74): xaa in position 74 is Ile, Val, Leu, Tyr or Phe
  Variant (75)..(80): xaa in position 75 to 80 is any amino acid
  Variant (81)..(81): xaa in position 81 is Arg or Lys
  Variant (82)..(83): xaa in position 82 to 83 is any amino acid
  Variant (84)..(84): xaa in position 84 is Ile, Leu, Val, Met, Phe, Ala or Thr

SEQ ID NO: 31210 - protein, 31 aa, Artificial sequence; identical to SEQ ID NO: 2900
  Variant (1)..(1): xaa in position 1 is Val, Ile, Leu, Cys or Arg
  Variant (2)..(5): xaa in position 2 to 5 is any amino acid
  Variant (6)..(9): xaa in position 6 to 9 is any or no amino acid
  Variant (10)..(10): xaa in position 10 is Gly, Thr, Asp or Asn
  Variant (11)..(11): xaa in position 11 is any amino acid
  Variant (12)..(12): xaa in position 12 is Ile, Val or Thr
  Variant (13)..(13): xaa in position 13 is any amino acid
  Variant (14)..(14): xaa in position 14 is Ala, Gly, Thr or Leu
  Variant (15)..(16): xaa in position 15 to 16 is any amino acid
  Variant (17)..(17): xaa in position 17 is Val, Ile, Ala, Leu or Phe
  Variant (18)..(19): xaa in position 18 to 19 is any amino acid
  Variant (24)..(24): xaa in position 24 is Ile, Val or Phe
  Variant (25)..(26): xaa in position 25 to 26 is any amino acid
  Variant (27)..(27): xaa in position 27 is Val, Leu, Ile, Phe or Met
  Variant (28)..(29): xaa in position 28 to 29 is any amino acid
  Variant (31)..(31): xaa in position 31 is Glu or Gln

SEQ ID NO: 31211 - DNA, 990 bp, Escherichia coli
  CDS (1)..(990)
atgcatattacatacgatctgccggttgctattgatgacattattgaagcgaaacaacgactggctgggcgaatttataaaacaggcatgcctcgctccaactattttagtgaacgttgcaaaggtgaaatattcctgaagtttgaaaatatgcagcgtacgggttcatttaaaattcgtggcgcatttaataaattaagttcactgactgatgcggaaaaacgcaaaggcgtggtggcctgttctgcgggcaaccatgcgcaaggggtttcgctctcctgcgcgatgctgggtatcgacggtaaagtggtgatgccaaaaggcgcgccgaaatccaaagtagcggcaacgtgcgactactccgcagaagtcgttctgcatggtgataacttcaacgacactatcgctaaagtgagcgaaattgtcgaaatggaaggccgtatttttatcccaccttacgatgatccgaaagtgattgctggtcagggaacgattggcctggaaattatggaagatctctatgatgtcgataacgtgattgtgccaattggtggtggcggtttaattgctggtattgcggtggcaattaaatctattaacccgaccattcgtgttattggcgtacagtctgaaaacgttcacggcatggcggcttctttccactccggagaaataaccacgcaccgaactaccggcaccctggcggatggttgtgatgtctcccgcccgggtaatttaacttacgaaatcgttcgtgaattagtcgatgacatcgtgctggtcagcgaagacgaaatcagaaacagtatgattgccttaattcagcgcaataaagtcgtcaccgaaggcgcaggcgctctggcatgtgctgcattattaagcggtaaattagaccaatatattcaaaacagaaaaaccgtcagtattatttccggcggcaatatcgatctttctcgcgtctctcaaatcaccggtttcgttgacgcttaa

SEQ ID NO: 31212 - protein, 329 aa, Escherichia coli
MHITYDLPVAIDDIIEAKQRLAGRIYKTGMPRSNYFSERCKGEIFLKFENMQRTGSFKIRGAFNKLSSLTDAEKRKGVVACSAGNHAQGVSLSCAMLGIDGKVVMPKGAPKSKVAATCDYSAEVVLHGDNFNDTIAKVSEIVEMEGRIFIPPYDDPKVIAGQGTIGLEIMEDLYDVDNVIVPIGGGGLIAGIAVAIKSINPTIRVIGVQSENVHGMAASFHSGEITTHRTTGTLADGCDVSRPGNLTYEIVRELVDDIVLVSEDEIRNSMIALIQRNKVVTEGAGALACAALLSGKLDQYIQNRKTVSIISGGNIDLSRVSQITGFVDA

SEQ ID NO: 31213 - DNA, 978 bp, Xenopus tropicalis
  CDS (1)..(978)
atggatttcacagagcaagctccttttcatattgtcacccctctgaaagagagccatgctttatccaaattggctgggaccacagttctcatgaagctggaaaatgttcagcccgcagggtcattcaagatacgtgggattggacactattgtcagaagcttgcgaagaaaggctgcacgaggtttgtctgttcctcagggggtaatgctgggcttgcagcagcttatgcttgcagaagattggccctgccagccaccattgttgttccacagaccactggagcagatattgtacagaagctgcaggatctgggagctgacgttgtggtgactggaaaggtctgggacgatgctgatgcacatgctcaccagctgactgaaactcctggcagtgtgtatatctctccgtttaaccatcctctcgtctgggaaggccatgccagccttgtgtgtgaactaaaggcttctttgggttctcagaagccaggtgcacttgtggtttctgtagggggtggcgggctccttgcggggctggctgaagggatgaagaaggtgggctggtctgatattcccataattgcaatggagactaaaggtgcccactgtttgaatgcagcgcttgaagcaggcaaacccatcagccttccagacattaccagtgttgccaagtgtcttggcgcaaagacagtatgtgacagagcctatgagtgtacaagggagcacaaagttatctccattactgttgatgacagagaagccattcgagctgtggaaatgtttttggatgatgagctaatgtttgtggaacctgcatgtggagctgcccttgctgctgtctattcaggacatatccaacgcctgcagcaggagggaagcttgaagacaccccttgaccccatagtgatggtagtgtgtggcggcagtgggatcagcatttctcagcttcaacactttaaatcccaactgaatataaactga

SEQ ID NO: 31214 - protein, 325 aa, Xenopus tropicalis
MDFTEQAPFHIVTPLKESHALSKLAGTTVLMKLENVQPAGSFKIRGIGHYCQKLAKKGCTRFVCSSGGNAGLAAAYACRRLALPATIVVPQTTGADIVQKLQDLGADVVVTGKVWDDADAHAHQLTETPGSVYISPFNHPLVWEGHASLVCELKASLGSQKPGALVVSVGGGGLLAGLAEGMKKVGWSDIPIIAMETKGAHCLNAALEAGKPISLPDITSVAKCLGAKTVCDRAYECTREHKVISITVDDREAIRAVEMFLDDELMFVEPACGAALAAVYSGHIQRLQQEGSLKTPLDPIVMVVCGGSGISISQLQHFKSQLNIN

SEQ ID NO: 31215 - DNA, 1773 bp, Cryptococcus neoformans var. neoformans JEC21
  CDS (1)..(1773)
atggcgcccacacccatccccgtccccgccgcccgcccggccgccagccacctctccaagtcgccgccgacgaccaacgagtacacctccaccgcgcccatccccgccctcccgccgcagcacacggacgagggcgtcccctcccacctctaccaaggcctgcccgcccatctcctgatcgacgatgcccagggacaaaaggtccccgactatctcaggatgatcctgatgtccaaggtctacgccgcgcccctcaacctcaaggaaacccctctcacatatgcagccaacctctccgcccggctcggcaacgagatctggatcaagcgggaggacctccagcccgtgttctcattcaagatccgcggcgcctacaacatgatggccagtctgtccgacgaagaaaagaaaaagggcgtcatcacgtgctccgccggcaaccacgcccagggcgtcgccctctccggccacgcactcaacatccccgccatcgtcgtcatgcccgtctccaccccgtccatcaagtggcgcaacgtccagcgtctcggcgccaccgtcctcctccacggccgcgactttgacgaggccaaggccgagtgtctccgcctcgaaaaggaaaagggcctgacctttgtgcccccgtacgataacccctacgtcgtcgccggccagggaactgtcgccatggaaatctgccgccaagtcacagatgccgaccagatcgatggcatattcgcttccgtcggcggaggcggccttgcggccggtatcgcggcgtacatgaagcgagtcgccaagcccagtgtcggaatctacggtgtcgagaccgttgacggtgatgccatggaccgctcactcaaggccggcaagagggtcctcctcgatgaagtcggcccgtttgcagacggtaccgcggtaaggcttgtcggcgaagaaccttttcgcgtatgcaaaaactttttggacgacgtcgtgcttgtcaacaatgacgagatttgcgccgccatcaaggatgtctttgaagaaacccgatctgtccccgaaccgtccggtgccctcgcactcgcaggcctgaaagcccacattatccgaaacaacctccaaggcgccggtaaacgctttgtcgccgtcatctccggcggtaacatgaactttggccgactccgattcgtcgctgagcgagcggatgtcggcgaacgacgagaagtgctgatgagtgtccgagtgcccgaaaagcctggcagctttttgaaattccactccctcctcggttcacgcgcagtcaccgagttctcctaccgccactccaacaattccaccggctacatcatctgctccttcctcctctcctcctcatcctcttcgtcctccgggccctcacccgaagcgcgcgcaaacgagattcacgagatggtcgaatcgtttaaacagcatgggatcgaagccgtcgatttgagcgaggatgagtttgcaaagagtcatgtgaggcatctggtcggtggacgcagtgccgtggagcacgaaaggatctttaggtttgagttcccggaaagacctggggcacttggaaactttttaaaaggtatgaaggtcgaatggaatatctccatgttccattacagaaaccacggtgccgacgtcggcaaagtcctcatcggcgtccaagtcccgtcccaggacaaccccgcatttgacgagtttttggaaaagctgggatatccatatgtcgaagagacccataatgaggtttacaccatgttcctcaggtcgtaa

SEQ ID NO: 31216 - protein, 590 aa, Cryptococcus neoformans var. neoformans JEC21
MAPTPIPVPAARPAASHLSKSPPTTNEYTSTAPIPALPPQHTDEGVPSHLYQGLPAHLLIDDAQGQKVPDYLRMILMSKVYAAPLNLKETPLTYAANLSARLGNEIWIKREDLQPVFSFKIRGAYNMMASLSDEEKKKGVITCSAGNHAQGVALSGHALNIPAIVVMPVSTPSIKWRNVQRLGATVLLHGRDFDEAKAECLRLEKEKGLTFVPPYDNPYVVAGQGTVAMEICRQVTDADQIDGIFASVGGGGLAAGIAAYMKRVAKPSVGIYGVETVDGDAMDRSLKAGKRVLLDEVGPFADGTAVRLVGEEPFRVCKNFLDDVVLVNNDEICAAIKDVFEETRSVPEPSGALALAGLKAHIIRNNLQGAGKRFVAVISGGNMNFGRLRFVAERADVGERREVLMSVRVPEKPGSFLKFHSLLGSRAVTEFSYRHSNNSTGYIICSFLLSSSSSSSSGPSPEARANEIHEMVESFKQHGIEAVDLSEDEFAKSHVRHLVGGRSAVEHERIFRFEFPERPGALGNFLKGMKVEWNISMFHYRNHGADVGKVLIGVQVPSQDNPAFDEFLEKLGYPYVEETHNEVYTMFLRS

SEQ ID NO: 31217 - DNA, 996 bp, Cryptococcus neoformans var. neoformans JEC21
  CDS (1)..(996)
atggctgccgtcaactacacaatcgaagatccaaacactgtgccatggatcaagacccccctcgtgcgctcagctgcactttcaaagcttgccggctgtgaaatcttactcaagctggaaaatatccagccgagtgggtcgttcaaatctagagggataggtaatctggtccttcagtctgtcaactcagctccaccagacactccgcttcacttctactcttcatcaggaggcaatgctggtctcgcttgcgttaacgcagcatctactctgggctatccttcctctgttatcgtgcctctcagcaccaaaccttttatgattgataagcttcgtaccgctggcgctacagaagtgatccagactggccaaacatggtttgaggcagataagcaccttcaggaagagatacttgcaagagatccgaacggcatctacctcccgccctttgatcactccgacatctggcaaggagcagctactatggtcgacgagattgtgcaagaattaacacacgtcccagatgcgatagtgtgctcagtaggaggaggaggactaatgattggtgtttgtaaaggactggagagactggataaggaaaagaaagcgaaagttgtggcggtcgaaactttaggggcagagtcactacacaagtcggtaaaggcgggacagttgatcactttgccgggtatcgcatcacttgctacttcactaggtgcgacgaccgtcgctgccaaagcactagagtatgctctacagcctcaggttcgtagtacggtagtatcagataaggaagctttagaagcctgtatccggtttcttgatgacgaaagaatcttggttgagccagcctgcggcgcgactttggcaatggtgtattcaggaaagctcaaagatgtgctgaaactcgacgccaaaagcaaagtggtgctcgtggtttgtgggggatcaaatatctcattagaattgatagaaggctataaaaagatgttttga

SEQ ID NO: 31218 - protein, 331 aa, Cryptococcus neoformans var. neoformans JEC21
MAAVNYTIEDPNTVPWIKTPLVRSAALSKLAGCEILLKLENIQPSGSFKSRGIGNLVLQSVNSAPPDTPLHFYSSSGGNAGLACVNAASTLGYPSSVIVPLSTKPFMIDKLRTAGATEVIQTGQTWFEADKHLQEEILARDPNGIYLPPFDHSDIWQGAATMVDEIVQELTHVPDAIVCSVGGGGLMIGVCKGLERLDKEKKAKVVAVETLGAESLHKSVKAGQLITLPGIASLATSLGATTVAAKALEYALQPQVRSTVVSDKEALEACIRFLDDERILVEPACGATLAMVYSGKLKDVLKLDAKSKVVLVVCGGSNISLELIEGYKKMF

SEQ ID NO: 31219 - DNA, 1146 bp, Thermococcus kodakaraensis
  CDS (1)..(1146)
atgaagcttaaatgtccaatatgtggaaaaacttacgatgagcccgtccagaggtgcgagtgcggtgaaccagttgagtttgaagccttcaatgcagagccttaccttggaaagaccgtctgggagagattctgggacttctggccaatagaaccagcaatggatctctcgctcggcgagggggatactcccctcgtgaagtccaaacttggaaaagagctcggggtaaagctctacctgaagaatgagaccgcaaacccgacctggagcttcaaggacaggggaacgtttctggcggtgagctacgcggtcaaagcgggatacaaggccattggaacggtttccactggcaacatggcggccagtgtagctgcttacgccgcgagggctggcctaaaggccaaaattctcgtctcagagagcgcgagcgaggagaagctcaaaactgtgagcgtttacggtgcggacgtgataagggttaggggagattacggaaggctctacttcgagagcctggagctgggtgagaagcttgggatatacttcatcaattccgacaacccattccgcgtcgagggctacaaggggattgccttcgagatggcggaggagcttactcctgactacgtcttaatccccacgagctcaggcggtctgttcaggggaattgccaagggcttcatcgagctgaaggagagcgggctcatcgaaaaactcccaacgctgatagcagtccaggctgaaggctgttcgccgatatgcagggcctttaacgaagggaacgagagaataaagcgcttcgaaaacccaaacacgatagcgaaggccatagcaaatccgtacccgccgagcggaaacgccgtccttaagttgctccgcgacttaggctggaagtgcaccaccgtgagcgacgaagaaatcctcgaagcgcagagagagcttgcaaaggaaggcctcttcgtccagccagcgagcgcaacggggattgctgttctcaaaaagctcgtcgagagtgaaaaaatcgatgaaggggcaaaagttgtgtctattctcacggggtcaggattaaaagtgctcgcacatatgccctccggcaaaatagtaaattgtccgctggaaggactggagaactgtgtgtcattttag

SEQ ID NO: 31220 - protein, 381 aa, Thermococcus kodakaraensis
MKLKCPICGKTYDEPVQRCECGEPVEFEAFNAEPYLGKTVWERFWDFWPIEPAMDLSLGEGDTPLVKSKLGKELGVKLYLKNETANPTWSFKDRGTFLAVSYAVKAGYKAIGTVSTGNMAASVAAYAARAGLKAKILVSESASEEKLKTVSVYGADVIRVRGDYGRLYFESLELGEKLGIYFINSDNPFRVEGYKGIAFEMAEELTPDYVLIPTSSGGLFRGIAKGFIELKESGLIEKLPTLIAVQAEGCSPICRAFNEGNERIKRFENPNTIAKAIANPYPPSGNAVLKLLRDLGWKCTTVSDEEILEAQRELAKEGLFVQPASATGIAVLKKLVESEKIDEGAKVVSILTGSGLKVLAHMPSGKIVNCPLEGLENCVSF

SEQ ID NO: 31221 - DNA, 1269 bp, Staphylococcus aureus subsp. aureus COL
  CDS (1)..(1269)
atgacagtcaaaacaacagtttctacgaaagatatcgatgaggcatttttaagacttaaagatattgtcaaagaaacacctttacaattagaccattacttatctcaaaagtatgattgtaaagtctatttaaaacgagaagatttacaatgggtacgttcttttaaattaagaggtgcttacaacgctatttctgttttatcagatgaagctaaaagtaaaggtattacatgtgcaagtgcaggtaatcatgctcaaggtgttgcctatacagctaaaaaacttaatttaaacgctgttatctttatgccagtcactacacctttacaaaaggtaaatcaagtaaagttctttggaaatagtaacgttgaagttgtactcactggtgatacatttgatcactgtttagctgaagctttaacttatacaagtgaacatcaaatgaactttatagatccattcaataatgttcatacaatttctggacaaggtacgcttgctaaagaaatgctagaacaagcaaagtctgacaatgttaactttgattatctatttgccgcaattggtggtggcggtttaatttcaggtattagtacttactttaaaacctattcacctaccacgaaaattataggtgttgaaccttcaggtgcaagtagtatgtatgaatctgttgtggtaaataatcaggtagtcacattgcctaatatcgataaatttgtggacggtgcatctgtagctagagttggcgatattacatttgaaattgcaaaagaaaatgtagatgattacgttcaagtagatgaaggtgcagtttgttctacgattttagatatgtattcaaaacaagcaattgtagcagaacctgctggcgcattaagtgtaagtgcgcttgaaaactataaagatcatattaaaggtaaaacagtggtttgtgtcattagtggtggtaataatgatattaatcgaatgaaagaaattgaagaacgttcattactatacgaagaaatgaagcattactttatcttaaatttccctcaacgtccaggtgcattgagagaatttgtaaatgacgtattaggacctcaagacgatattactaaatttgaatacttaaaaaaatcttctcaaaatacaggtactgtcattattggtattcaacttaaagatcatgatgatttaatacaactcaaacaacgtgtaaatcatttcgatccttccaatatttatattaatgaaaataagatgttatattcattgttaatttaa

SEQ ID NO: 31222 - protein, 422 aa, Staphylococcus aureus subsp. aureus COL
MTVKTTVSTKDIDEAFLRLKDIVKETPLQLDHYLSQKYDCKVYLKREDLQWVRSFKLRGAYNAISVLSDEAKSKGITCASAGNHAQGVAYTAKKLNLNAVIFMPVTTPLQKVNQVKFFGNSNVEVVLTGDTFDHCLAEALTYTSEHQMNFIDPFNNVHTISGQGTLAKEMLEQAKSDNVNFDYLFAAIGGGGLISGISTYFKTYSPTTKIIGVEPSGASSMYESVVVNNQVVTLPNIDKFVDGASVARVGDITFEIAKENVDDYVQVDEGAVCSTILDMYSKQAIVAEPAGALSVSALENYKDHIKGKTVVCVISGGNNDINRMKEIEERSLLYEEMKHYFILNFPQRPGALREFVNDVLGPQDDITKFEYLKKSSQNTGTVIIGIQLKDHDDLIQLKQRVNHFDPSNIYINENKMLYSLLI

SEQ ID NO: 31223 - DNA, 1104 bp, Staphylococcus epidermidis RP62A
  CDS (40)..(1104)
tatcaagaaagtttatcctgtagagggagtttaataattatgaaaagatggcaaggattagttaaagaatttaaagaatatttaccagtcaatcaatctacaccagcactaacactcaatgaaggacatacaccacttatttattgtgaaaatctttctcaaaaattagatattgaattatatgttaaatatgaaggagcaaatccgactggctcatttaaagatcgtggtatggttatggctgtaacaaaggcaaaagaacaagggaaaaaagttgttatttgtgcttcaactggtaatacttcagcatcagcagctgcttatgctgcaagagctggtttaaaagcaattgtcgtaattcctgaaggtaaaatagcattaggtaaattatcacaagcagttatgtatggtgcagaaattgtttctatagaaggaaacttcgatgaagcactagaaattgtaaaagagattgctgaagaaaatgatgaaattgaattagttaattctgttaatccatttaggattgaaggacaaaagacgggtgcctttgaaattgttgaacagttagatggtcaagcccctgacattttagcaataccagtgggaaatgcaggtaatataactgcttattggcaaggatttgttgaatatcataataaaaagaatacacaattaccacaaatgtttggcttccaagcagaaggagcatctccaattgttcaaaataaaataatcaaaaatccagaaacaatagctacagctatccgaatagggaatcctgctagttggcaaaaagctgttaatgcactagatgaatcaaatggtttaattgatagtgtgatagatgaagaaattttagaagcttatcagttaatgacaacaaatgaaggtgtttttagtgaaccagcgagtaatgcttcaattgcaggtctaatcaaacttcatcgctctggtaagttacctaaaggtaaaaagatagttgcaatattaactgggaatggacttaaagatcctgacacagctatttctctcttagataatcctattcaacctttacctaataataaagaaagtataattagatacatcaaaggggcaatctag

SEQ ID NO: 31224 - protein, 354 aa, Staphylococcus epidermidis RP62A
MKRWQGLVKEFKEYLPVNQSTPALTLNEGHTPLIYCENLSQKLDIELYVKYEGANPTGSFKDRGMVMAVTKAKEQGKKVVICASTGNTSASAAAYAARAGLKAIVVIPEGKIALGKLSQAVMYGAEIVSIEGNFDEALEIVKEIAEENDEIELVNSVNPFRIEGQKTGAFEIVEQLDGQAPDILAIPVGNAGNITAYWQGFVEYHNKKNTQLPQMFGFQAEGASPIVQNKIIKNPETIATAIRIGNPASWQKAVNALDESNGLIDSVIDEEILEAYQLMTTNEGVFSEPASNASIAGLIKLHRSGKLPKGKKIVAILTGNGLKDPDTAISLLDNPIQPLPNNKESIIRYIKGAI

SEQ ID NO: 31225 - DNA, 1269 bp, Staphylococcus epidermidis RP62A
  CDS (1)..(1269)
atgacagtaagaactaaagtttcgacaaaagatatagatgaagcatatttacgtctaaaaaatatagtaaaagaaactcccttacaattcgaccattacttatctcaaaaatataattgtaatgtttatttaaaaagagaagatttacagtgggtacgatcctttaaattaagaggagcttataatgctatttcagtattatccaatgaagaaaaaaataaaggtattacttgcgcaagtgctggaaatcatgctcaaggtgttgcttatactgccaaaaaactcaatttaaaagctgttattttcatgccagtaactacaccacgacaaaaaatcaatcaagtcaaattcttcggggatagtaacgtagaaatagtattaattggcgatacatttgatcactgcttagcacaagctttaaactatacgaagcaacataaaatgaattttattgacccatttaataatgtatatactattgcaggacaaggcactttagctaaggaaatattaaatcaagctgaaaaagaggataaaacatttgattatgtatttgctgctataggtggtggcggtcttatttcaggagtgagcacatattttaaagcacattccccccatactaaaattattggtgttgaaccaaccggtgccagtagtatgtatcaatcagtcgttatcaaccatagtatagttactttagaaaatattgataagtttgttgatggagcttcagtagcaagagttggtgatattacctttgatattgcgaaagataaagtggatgattatgttcaagttgacgaaggagctgtttgctccacaattctggatatgtactctaaacaagcgattgttgctgaaccagctggtgctttaagtgtaagtgccttagaacaatataaaaagcagattgaaaataaaactattgtatgcatagtaagtggaggcaacaatgatattaatcgaatgaaagaaattgaggagcgttcccttctatttgaagaaatgaaacattactttattttaaatttcccacaaagacctggtgctttaagagaatttgtcaatgatgtcctcggacctcaagacgatattacaaaatttgaatatttaaagaaaacatcacaaaacactggaactgttattataggtatacagctgaaacatcatgatgatctcattcagttaaaagatcgcgtatgtcaatttgatccttctaatatttatatcaatgaaaataaaatgttatattcattacttatttaa

SEQ ID NO: 31226 - protein, 422 aa, Staphylococcus epidermidis RP62A
MTVRTKVSTKDIDEAYLRLKNIVKETPLQFDHYLSQKYNCNVYLKREDLQWVRSFKLRGAYNAISVLSNEEKNKGITCASAGNHAQGVAYTAKKLNLKAVIFMPVTTPRQKINQVKFFGDSNVEIVLIGDTFDHCLAQALNYTKQHKMNFIDPFNNVYTIAGQGTLAKEILNQAEKEDKTFDYVFAAIGGGGLISGVSTYFKAHSPHTKIIGVEPTGASSMYQSVVINHSIVTLENIDKFVDGASVARVGDITFDIAKDKVDDYVQVDEGAVCSTILDMYSKQAIVAEPAGALSVSALEQYKKQIENKTIVCIVSGGNNDINRMKEIEERSLLFEEMKHYFILNFPQRPGALREFVNDVLGPQDDITKFEYLKKTSQNTGTVIIGIQLKHHDDLIQLKDRVCQFDPSNIYINENKMLYSLLI

SEQ ID NO: 31227 - DNA, 1227 bp, Gluconobacter oxydans 621H
  CDS (1)..(1227)
atgtctgacgtcctgacgtccaccacccctgtcgtgaccatcgcggacatcgagagcgcccatgagcgcatcgcgtccacggtggtccgcacgccgaccatcgcctgcccggccctttcccggctgacaggcgcggagattacgctcaagctcgaaaaccttcaggcgatcggctccttcaaggagcgcggagcggccaacaagatggccctcctgacgccggaagagcgggcgcgcggcgtcattaccgtctcggcaggcaaccacgcacagggtgtggcccgtcaggccagtcttcttggtattgatgcgaccatcgtcatgccgcgcttcacgccggccaccaaggtcgcggcaacgcaggcctggggcgcgaatgtcgtgctcgcaggggacgatttcgcacaggccagcgagaccgctgccgagctccagaagcaggacggccgcgttctcgtccacccgttcaatgatccggccgtcatcgccggtcagggcactgcggcgctggagcttctggaagatgctccggacatcgatacggtcgtcgtgcccgtgggcggcggtggcctgatcggtgggtttgcgaccgtcatggcggcgctgcgtccggatgtcgaggtcattggggtacaggtcgaggcctatgcctcgctgtcaaactacccgcaggaagacggcccgactcagggcggctcaaccatcgcggaaggtatcgccgtcacaaggctcggcgatcactgcctgaacgcctttcgcaacaagatctcgaagatcctcgttgtcagcgagcttcaggtcgaaagctccatcacgacgctggctgaaaaggccaagcaggtctgtgaaggtgcgggcgccacgggccttgctgcagttctggcctatccggagctgttcaagggacgccgcgttgccctgcccctgtctggcggcaacatcaacgcccgtatccttgccaacacaatcctgcgctcccttctccgggacggacggatcctgcggctgatcttccagatccccgaccgtccaggcatgctggcggatatttcggcccgcatcggcaattatggcggaaacatcatcgaagtctcccatcaccgcctgttcgcctccccgtccgttcagacggccgaactgctggtgatggtggaagcccgcgacaccgaacatgcccaccagatcgagaccgatctggcacggcattacatcgtccggcgcgactga

SEQ ID NO: 31228 - protein, 408 aa, Gluconobacter oxydans 621H
MSDVLTSTTPVVTIADIESAHERIASTVVRTPTIACPALSRLTGAEITLKLENLQAIGSFKERGAANKMALLTPEERARGVITVSAGNHAQGVARQASLLGIDATIVMPRFTPATKVAATQAWGANVVLAGDDFAQASETAAELQKQDGRVLVHPFNDPAVIAGQGTAALELLEDAPDIDTVVVPVGGGGLIGGFATVMAALRPDVEVIGVQVEAYASLSNYPQEDGPTQGGSTIAEGIAVTRLGDHCLNAFRNKISKILVVSELQVESSITTLAEKAKQVCEGAGATGLAAVLAYPELFKGRRVALPLSGGNINARILANTILRSLLRDGRILRLIFQIPDRPGMLADISARIGNYGGNIIEVSHHRLFASPSVQTAELLVMVEARDTEHAHQIETDLARHYIVRRD

SEQ ID NO: 31229 - DNA, 1071 bp, Xanthomonas oryzae pv. oryzae KACC10331
  CDS (1)..(1071)
atgaatcggtccttcattgtgcagcaacgcggcgctttgtcatcgatccagcccgcgcggcggcagtgcgtgcgacccgtgaagagggagcgatacgttaatcttgcaggcatgatcgagacggtccctcttgcccattccgacgttctgcaagccgctgcgcggatcgcgccgcactgcgcgccgacaccattgctgacatcgcacagcctggatgcgctcagcggtgcacggttgttcttcaaggccgaacatctgcaacgcagcggggccttcaagttccgcggggcgtgcaatgccgtgtggtcgctgccggacgagcggactgcacatggggtagtgacgcattcatccggcaaccacggcgcggcgctggcgctggccgcacgcacgcgtggcatgggttgccatgtggtggtgcccgaaggcgcggtggcggccaagctggccaatatttcccggcatggcgccaccttgtggcgctgcgcaccgaccatcgcagcgcgtgaacagctatgcgccgaggtgcaggccagcagcggtgccacgctggtgcacccgtataccgatgtcgcggtcatcgccggccaggggacggccacgctggagctgctgcatcaaagcggtggcctggacgtgctggtggcgccggtcggcggtggcgggttggcggccggtgccgcgctggcgctgcgctgcgcacccggctgcgagctggtgctggccgagccggccggcgcagccgataccgcgcgttcgttggcggcaggccagcggctggtcgattttgtgccggacactgtgtgcgatggtctgcgcggcaccttgggcgcgcccaatttcgcgctgctgcagcacgccggcgcgcaggtgatcacagtcgacgatgccgcggtcgtccaggcgatgcggctgatctggcagttgctcaaacaagtggtcgagccgtcttcggtgatcaccctggccgcggtgctggccgagccggcacggtttgccgggcgccgggtgggcttgatcctgtctggtggcaatgtcgatctggatgccttgccatgggccgcggcgtga

SEQ ID NO: 31230 - protein, 356 aa, Xanthomonas oryzae pv. oryzae KACC10331
MNRSFIVQQRGALSSIQPARRQCVRPVKRERYVNLAGMIETVPLAHSDVLQAAARIAPHCAPTPLLTSHSLDALSGARLFFKAEHLQRSGAFKFRGACNAVWSLPDERTAHGVVTHSSGNHGAALALAARTRGMGCHVVVPEGAVAAKLANISRHGATLWRCAPTIAAREQLCAEVQASSGATLVHPYTDVAVIAGQGTATLELLHQSGGLDVLVAPVGGGGLAAGAALALRCAPGCELVLAEPAGAADTARSLAAGQRLVDFVPDTVCDGLRGTLGAPNFALLQHAGAQVITVDDAAVVQAMRLIWQLLKQVVEPSSVITLAAVLAEPARFAGRRVGLILSGGNVDLDALPWAAA

SEQ ID NO: 31231 - DNA, 897 bp, Xanthomonas oryzae pv. oryzae KACC10331
  CDS (1)..(897)
atgcctgattccggccgcccttccgcttccgcacaggagccagaggtaggcgacgtggccgtcagcgtggccgacgtgctggcggcacaggcacgcctgcgcaagtacctgtcgcccacgccgctgcattacgccgaacgcttcggtgtgtggctgaagcttgagaatttgcagcgcaccggctcctacaaggtgcgcggcgcattgaatgcattgctggccgggctggagcgcggcgatgagcgtccggtgatctgtgcctcggccggcaatcatgcgcaaggcgtggcgtggtcggcgtatcggctgggtgtgcaggccatcacggtgatgccctacggcgcgccgcagaccaagatcgccggtgtcgcgcattggggcgccaccgtgcgccagcatggcaacagctacgacgaagcattcgcgtttgcgcgcgagctggccgaccagaacggttatcgctttttgtctgccttcgacgacccggatgtgattgccggccagggcacggtcggcatcgaactggctgcgcatgcgccggacgtggtgatcgtgccgattggcggcggcggggctggcgtctggggtagcgctggcgttgaaatcgcaaggcgtgcgtgtggtcggcgcgcaggtggaaggcgtcgattcgatggcgcgcgccgtgcgcggcgacctgcgcgaaattaccccggttgcaacgctggccgacggcgtgaaggtcaagattccgggctttctcacgcgccgcctgtgctcgagcctgctcgacgatgtggtgatcgtgcgcgaggccgaattacgcgaaacattggtgcgtctggcgctggaagaacacgtgatcgccgaaggcgccggcgcgctggcgctggccgccggacgccgcgtttccggtaa

SEQ ID NO: 31232 - protein, 298 aa, Xanthomonas oryzae pv. oryzae KACC10331
MPDSGRPSASAQEPEVGDVAVSVADVLAAQARLRKYLSPTPLHYAERFGVWLKLENLQRTGSYKVRGALNALLAGLERGDERPVICASAGNHAQGVAWSAYRLGVQAITVMPYGAPQTKIAGVAHWGATVRQHGNSYDEAFAFARELADQNGYRFLSAFDDPDVIAGQGTVGIELAAHAPDVVIVPIGGGGAGVWGSAGVEIARRACGRRAGGRRRFDGARRARRPARNYPGCNAGRRREGQDSGLSHAPPVLEPARRCGDRARGRITRNIGASGAGRTRDRRRRRRAGAGRRTPRFR

SEQ ID NO: 31233 - DNA, 1131 bp, Vibrio fischeri ES114
  CDS (1)..(1131)
atgaaatacctctgtatggcgtgtaataaagaatacgcaccgaaacctgaactcattaaatgtgaatgtggctccgccctatgggttaaacctcaaacgtcatttagtaaaaaagatctcatagaaaatgaattcacacctagacgctattctagtgctttcccagtaaaaaaagacgatatcaatatcactttcaatgaagccatcacacctctttgccaagctgaaatatcaggaactccaatactggttaaactcgattcgctacaaccaacaggctcatttaaagaccgaggtgcctctcttgtaatcaattaccttaacaaccatggaataacaagcattgcagaagactcaagcggtaatggaggaagtgcttatgccggttatgccgctaaaggaaacatgcaatgcaacatatttgtgcctgctggaacatccaaaggaaagacaacacaaacccgattatacggcgctaactgtattgaagtagaaggaacaagagaagatgttgctctagctgcaatagagagcagcgtcactcatggaagtcattatgttgggcataactggcatcccctatttatcgaaggcgtcaaatccatcgcttatgaaatatgggaacagtgtggatataaagcccctgataattttgttgttcccgcaggaaatggaagtttactcgctggagcatatatcggtttctctgaattattaaaaggcggagaaataagcaaactccctcgcctttttggtattcaaagtgaaagcattcagccgtttgtacaaacctttaacaataaagaaatcaacattacttcagaagataccattgctgagggtattaagattaagcgttcatcacgaatgaatgagatcgttcaatttgtaaaagaaacgaatgggaattttattagtgttaatgaacaacaaatccaatcagcattaaaagagatgggagcacaaggatactttatcgaaccaacatcagcgacggcatttgcaggaatcgctcagcttataaaaacgcaagaaatcaaacctgacgagcttaccgttggagtcgtaaccggaaatggactcaaagcaacaaactcaattgaacatttaatcaatgatatgagaggttaa

SEQ ID NO: 31234 - protein, 376 aa, Vibrio fischeri ES114
MKYLCMACNKEYAPKPELIKCECGSALWVKPQTSFSKKDLIENEFTPRRYSSAFPVKKDDINITFNEAITPLCQAEISGTPILVKLDSLQPTGSFKDRGASLVINYLNNHGITSIAEDSSGNGGSAYAGYAAKGNMQCNIFVPAGTSKGKTTQTRLYGANCIEVEGTREDVALAAIESSVTHGSHYVGHNWHPLFIEGVKSIAYEIWEQCGYKAPDNFVVPAGNGSLLAGAYIGFSELLKGGEISKLPRLFGIQSESIQPFVQTFNNKEINITSEDTIAEGIKIKRSSRMNEIVQFVKETNGNFISVNEQQIQSALKEMGAQGYFIEPTSATAFAGIAQLIKTQEIKPDELTVGVVTGNGLKATNSIEHLINDMRG

SEQ ID NO: 31235 - DNA, 1527 bp, Neisseria gonorrhoeae FA 1090
  CDS (1)..(1527)
atgaacacgccccttccttattccgattacctcatccgcatcctgacggcatctgtctatgatgtagcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcacgcacaaggcgtggcgttgtccgcacagcgtttgggctgccgtgccgttatcgtcatgccggagactacgccgaaaattaaagtggatgcggttaaaagccgtggcggcgaggtggttttgcggggtgtttcatacaacgatgcctacgattatgcgatggagctggcggaacaggaagggctgacctatatcgcgccgtttgacgatcccgatgtgattgcgggacaggggacggtggggatggaaattgtcagccagcatcccgatccaatccgcgccgtattcgtaccgatagggggcggcggtttggcggcgggcgtggcggcatttatcaaacaggttcgtcccgaaattaaagttatcggcgtacagaccaacgattcctgctgtatgaagcagtcggtcgaagcaggcgaaatcgtccatttgaaagatgtcgggctgttttcagacggtacggcggtcaaagtcgtcggaaacggaaccttccgcctctgcaaagaacttttggatgaaatcattacagtcgataccgatgcggtttgcggcgcggtcaaggatattttcgatgacacgcgcagcattaccgagccggccggcgcgttggcgttggcgggtctgaaagcctatattgcccgagaaggtgcggaaaaccaaaccctgattgccgttaccagcggtgcgaatatgaattttcaccgtttgcgccacgtttcggaacggagcgaattgggcgagggcaacgaaggtatttttgccgttaccatccccgaagaacgcggcagcttccttaagtttgtcaatatattgggaaataggaatattaccgagttcaactaccgctacggcggcgatgaaaaagcgcatatctttgtcggacttcaagcggcaggcccgcaggatttggcggttatcggcagccggttggatgaggcgggattgcccaatgtcgatttgaccaataatgagattgccaaaatccatatccgctatatggtcggagggcggacggacaaagtagggcacgagcgtctggtcagttttgagtttccggagcgtccgggcgcgttggcgcgctttttgaaccatatgcagggcggttggaacattacgctcttccattaccgcaaccacggtgcggattacgggcggattttggtcggtatcgacgtgccgccgcacgatgccgccgcatttgacggtttcttggaaagtctgggatacagctatcacgaggaaacgcaaaatgccgcgtacaagctgtttcttgcctga

SEQ ID NO: 31236 - protein, 508 aa, Neisseria gonorrhoeae FA 1090
MNTPLPYSDYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSRGGEVVLRGVSYNDAYDYAMELAEQEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNGTFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGGDEKAHIFVGLQAAGPQDLAVIGSRLDEAGLPNVDLTNNEIAKIHIRYMVGGRTDKVGHERLVSFEFPERPGALARFLNHMQGGWNITLFHYRNHGADYGRILVGIDVPPHDAAAFDGFLESLGYSYHEETQNAAYKLFLA

SEQ ID NO: 31237 - DNA, 1302 bp, Mesorhizobium loti MAFF303099
  CDS (1)..(1302): transl_table=11
atgacaggggggccgcgcagacatgcggcacaaggtggctttccgatgaacagtttttcctcccgcgtcgccaccgctgcggcggcgatccgccagatctttccggaaacgccgctgcaggaaaacgactatctgtcgaagaagaccggcgcgcgggtgctgctgaagcgggaggacctgtcgccggtgcgctcctacaagatccgtggcgccttcaacttcttccgcaaggcgctcggcgagggcaaccaggcagagctgttcgtctgtgcgtccgccggcaaccatgcccagggttttgccttcgtctgccgccatttcggcaaaaagggcgtggtgttcatgccggtgacaacgccgcagcagaagatcgacaagaccaggctgttcggcggtgatttcgtcgagatcaggctggtcggcgactttttcgacgactgctatcgcgccgccttcgaattcaccgaaaggtcgggtgcccacatggtgccgcccttcgaccacaaggacattatcgagggccaggcgacggtcgcctatgagatcgcggcccagatggcgggtgcgcgcatgcctgacatcgtcatgctgccggtcggcggtggcgggctcgccgccggcgtcacgcactatttcgccgatcagggccgcgaggcgcgttttgtcttctgcgagccggccggcgcgccgagcctgcacgacagcctcgcggccggaaaacggctgaagctcgccaaggtcgacaacttcgtcgacggcgcggcggtggccgaaatcggccgcgaacccttgcggtttctcaaggaattcgctgctgacaccgtgcggctgatcccggaaaaccggctctgcgccaccatgatcgagatgctcaatgtcgaaggcgtcgtgctcgagccggccggcgcattggccatcgacgcattgaaggatttttccaggaaggagatccgtggcaagaccattgtcgccgtggtctcaggcggcaatttcgatttcgagcggctgccggatgtcaaggaacgggcgctgcgcttcgaaggcctgaagaaatatttcatcatccgcttcccgcagcggccgggcgcgctgcgcgacttcctcgaaatgctgggacccgacgacgacattgcccgcttcgagtatctgaagaagtccgcgcgcaatttcggctcggtgctgatcggcatcgaaaccaaggaccgtcgcaatttcgacctgctcaaggcaaatttcgaggccgagggcgtccagtatcaggacatcaccgacaacgagacattggcgggcttcatcatatga

SEQ ID NO: 31238 - protein, 433 aa, Mesorhizobium loti MAFF303099
MTGGPRRHAAQGGFPMNSFSSRVATAAAAIRQIFPETPLQENDYLSKKTGARVLLKREDLSPVRSYKIRGAFNFFRKALGEGNQAELFVCASAGNHAQGFAFVCRHFGKKGVVFMPVTTPQQKIDKTRLFGGDFVEIRLVGDFFDDCYRAAFEFTERSGAHMVPPFDHKDIIEGQATVAYEIAAQMAGARMPDIVMLPVGGGGLAAGVTHYFADQGREARFVFCEPAGAPSLHDSLAAGKRLKLAKVDNFVDGAAVAEIGREPLRFLKEFAADTVRLIPENRLCATMIEMLNVEGVVLEPAGALAIDALKDFSRKEIRGKTIVAVVSGGNFDFERLPDVKERALRFEGLKKYFIIRFPQRPGALRDFLEMLGPDDDIARFEYLKKSARNFGSVLIGIETKDRRNFDLLKANFEAEGVQYQDITDNETLAGFII

SEQ ID NO: 31239 - DNA, 942 bp, Mesorhizobium loti MAFF303099
  CDS (1)..(942): transl_table=11
atggcgcagggcaataccgtcacacgcgaacgcattgccgcgatggaaccgcgcatccggccctatatcaggcacacgccggtgctgcacgtcgacatgaccgacttcgaccggccaccgctggctctcgacctcaaactcgaatgcctgcagcattccggctcgttcaaggcgcgcggcgccttcaccaatcttctggaaaggccggttcccaaggccggcgttgtcgccgcatcgggcggcaaccatggcgccgccgtagcctatgccgccatgcggctcggccacaaggcgaccatcttcgttcccgaagtgagcccacaggccaagctggaccgcattcgttcctatggcgccgacctggtcgtcggaggcgcccgctatgccgaggcgctgggcgccagcgaacgtttcgcgcaggaaactggcgccttgcagatccatgccttcaaccaggaggaaacgctggtcggccagggcacgctcgggctcgaaatcgagaacgacttgcctcagatcgacacgctgctggtcgccgtcggcggtggcggcctgatcggcggcatcgccgcctggtatgccggccgcatccgcatcatcgccatcgagcccgaaggcgcgccgacgctttatcgcgccttcgaggccggccatcccgtcgacgcaccggcggaaggcatcgccgccgattcgctggcgccgaagcgcgtcggcgagatgatgttcccgatcgcggaagccttcgtcgagcgctccatcctggtcagtgacgacgacatcatcgccgcgcagaaggcgttgtggaaccgggtgcgcatcatctccgaaccgggcggggctgcggccttcgccgcgatcctgtccggccgctacacgccggcacccggcgaacgcgtcgccgtgctggtctgtggcgccaacgcaaaccccgccaatttctga

SEQ ID NO: 31240 - protein, 313 aa, Mesorhizobium loti MAFF303099
MAQGNTVTRERIAAMEPRIRPYIRHTPVLHVDMTDFDRPPLALDLKLECLQHSGSFKARGAFTNLLERPVPKAGVVAASGGNHGAAVAYAAMRLGHKATIFVPEVSPQAKLDRIRSYGADLVVGGARYAEALGASERFAQETGALQIHAFNQEETLVGQGTLGLEIENDLPQIDTLLVAVGGGGLIGGIAAWYAGRIRIIAIEPEGAPTLYRAFEAGHPVDAPAEGIAADSLAPKRVGEMMFPIAEAFVERSILVSDDDIIAAQKALWNRVRIISEPGGAAAFAAILSGRYTPAPGERVAVLVCGANANPANF

SEQ ID NO: 31241 - DNA, 984 bp, Mesorhizobium loti MAFF303099
  CDS (1)..(984): transl_table=11
atgaccgccaccacccctcccggcatcgccgacatccgtgccgccgccgcccgcctctccggcctgatcgtcgaaacgccattgatcgaatcggccgagctgaacaagcgcttcggcggccgtatcctgttcaagccggagacgttgcagcgcaccggctcgttcaagttccgcggcgcctacaacaagctgtcgtcgctgagcgaggaagagcgcagccgtggcgtcgtcgccttctcctccggcaatcatgcgcaaggggttgccgcttcggccgccatgttcggcgtcaaggcggtcatcgccatgccggcggacgcgccggcgatgaagatcggcaatgtccgcaagatgggcgcggaggtggtgccgttcgaccgctttcgcgatgaccgcatgaccgtggttcgcccctatatcgacaagggcatggtgctggtgccgcccttcgacgatccggccatcattgccgggcaaggcacgatcggccttgaactgatgcggcagggcagggcgctcggcgtcagcctcgacaccgtcgtcatcccctgcgggggcggcggcctgtcgagcggcatttcggtggcggtcaaggatgcctcgccgggcacggcggtctgggcggtagagcccgagcatttcgacgacacgcgccgctcgctcgccgcaggcgcgcgggtttcgaacgagcccggccacagctcgatctgcgacgcgatcctgaccgccgagccgggcgccatcaccttcgaaatcaaccgcaggaacctcactggggccattgccgtctccgacaaggcgaccgcacaggcgatgcgcgatgccatggcctatctgaagctggtggtcgagccgggcggctgcgtggcgctggcggcgctgtcgtcgggcgagatcgaactgtccggcaaatgcgtcgccgtggtgctgtccggcggcaatgtcgatttcggcacctatgccgggatcatggcggccgcctga

SEQ ID NO: 31242 - protein, 327 aa, Mesorhizobium loti MAFF303099
MTATTPPGIADIRAAAARLSGLIVETPLIESAELNKRFGGRILFKPETLQRTGSFKFRGAYNKLSSLSEEERSRGVVAFSSGNHAQGVAASAAMFGVKAVIAMPADAPAMKIGNVRKMGAEVVPFDRFRDDRMTVVRPYIDKGMVLVPPFDDPAIIAGQGTIGLELMRQGRALGVSLDTVVIPCGGGGLSSGISVAVKDASPGTAVWAVEPEHFDDTRRSLAAGARVSNEPGHSSICDAILTAEPGAITFEINRRNLTGAIAVSDKATAQAMRDAMAYLKLVVEPGGCVALAALSSGEIELSGKCVAVVLSGGNVDFGTYAGIMAAA

SEQ ID NO: 31243 - DNA, 1059 bp, Mesorhizobium loti MAFF303099
  CDS (1)..(1059): transl_table=11
gtgtggcgacgagacgccgcgccccgaatttgggcagctgatgacgcttcctctgccgcgcgattgatgatcatgacgaccgtctcccttaacgatatccgcgccgcgcgtgagcgtattgccagcaaggtcgagtacacgccgactgttttatcctcgagcctttcggaacgtctcggtgtccccgtccatctcaagctcgagcatcgccagactaccggcagcttcaagctccgcggcgccacgaatgccgtctcttcgctgagcgcggaagaaaaggcaggcggtgtggtcgcggcctcgaccggcaaccatggccgggcgctggcacatgctgcgaagctcgaaggcatgcgcgcggtgatctgcatgtcgcggctggtgccccagaacaagctcgacgaaatccgccggctcggcgccgaggtccacatcgtcggcaacagccaggacgatgcccagcaggaggttgagcggctggtggcgcagcaggggctggtgatgctgccgcctttcgacaatcccgccatcatcgccgggcaaggcacgctcgggctggagatgatcgagcaggtcccggatgccgctctggtgcttgtgcaactctccggcggtggcctggcttccggcgtcgccacagccgtcaagggcatcaggcccgggacagaagtcatcggcgtttcgatggcgcggggtgctgcgatgaaggcgagcctcgatgccggccggcctgtcctggtggaggaactgccgacgttggcggactcgctgggtggcggcatcggcctcgacaacaggctgaccttcgccatgtgccgcgacctgctcgacgaaatcatcttgctcagcgaggacgagatcgccgcaggtatctgccatgcctatgcgcaggagcgcgagatcgtcgagggcgccggcgcggtcggcatcgcagcgcttctcgccggcaaggtcaaggcgaaagggccgatggtcgtacttctctccggccgcaacatcgacatgaatgcgcaccgccggatcatctgcggcgaggcaatcggggagcgcgccgcatga

SEQ ID NO: 31244 - protein, 352 aa, Mesorhizobium loti MAFF303099
MWRRDAAPRIWAADDASSAARLMIMTTVSLNDIRAARERIASKVEYTPTVLSSSLSERLGVPVHLKLEHRQTTGSFKLRGATNAVSSLSAEEKAGGVVAASTGNHGRALAHAAKLEGMRAVICMSRLVPQNKLDEIRRLGAEVHIVGNSQDDAQQEVERLVAQQGLVMLPPFDNPAIIAGQGTLGLEMIEQVPDAALVLVQLSGGGLASGVATAVKGIRPGTEVIGVSMARGAAMKASLDAGRPVLVEELPTLADSLGGGIGLDNRLTFAMCRDLLDEIILLSEDEIAAGICHAYAQEREIVEGAGAVGIAALLAGKVKAKGPMVVLLSGRNIDMNAHRRIICGEAIGERAA

SEQ ID NO: 31245 - DNA, 1005 bp, Mesorhizobium loti MAFF303099
  CDS (1)..(1005): transl_table=11
atgatggcagaccttctcgtcccctcgctggcccatctcaaacaggcctatgccgtcacctccagggcgacgcagatcacgccgctgctggaatcgaccgcactcgccagggagaccggtgctgcccgtgtcttcatcaagccggaatcgctgcaatgggccggatcgttcaagatccgcggcgcctattggcggttgaagcggctgtcggccgacgaagcgaggaaaggagtcgtcgcctactcctccggcaatttcgcgcaaggcctggcggcagccggccaagcgctcggcattcccgtcaccatcgtcatgccgatcgacgcacccgccgccaagcgtgacgcgacggcgggctatggcgcgcgtgtcgtgttgaccgaccatggcgagcgcgcgcgagaagaggttgccgctgccaaggcgcgcgagatcgccgagacggaagggctggccctgctgcatcccttcgacgatccggagatcgtcgccggccaggctggcgccgggctcgaagcgctcgaccagcttgaggccaaggacgccagcgccgacctgttgttctgctcggtcggcggcggcgggctgatcggcggcgtttcgctcgccttccactatctgtcgccggcgacggagatcatcggcgtcgagccggaaggcttcaatggcatgggctcgtcgctggcgcatggcagcatcgagaccatgccgatcgggccgaaatcgatttgcgacgggctgatgtcgcggcggccgggcgatgcgccgttcgcggcggtcaagaccgctggcgttcgcggaatcaccgtcgatgatcaatcggtgcggcgtgccatgcggatcgccttcgagcggatgaagctggtgctggagccgtccggggctgcgtcgctggcagcattgctcggtggcaaggtggatgtgactgataaaaccgtccttgttgtggctaccggcggcaatgtctcgctcgccgattttatggcgcatatgaaccatgcttga

SEQ ID NO: 31246 - protein, 334 aa, Mesorhizobium loti MAFF303099
MMADLLVPSLAHLKQAYAVTSRATQITPLLESTALARETGAARVFIKPESLQWAGSFKIRGAYWRLKRLSADEARKGVVAYSSGNFAQGLAAAGQALGIPVTIVMPIDAPAAKRDATAGYGARVVLTDHGERAREEVAAAKAREIAETEGLALLHPFDDPEIVAGQAGAGLEALDQLEAKDASADLLFCSVGGGGLIGGVSLAFHYLSPATEIIGVEPEGFNGMGSSLAHGSIETMPIGPKSICDGLMSRRPGDAPFAAVKTAGVRGITVDDQSVRRAMRIAFERMKLVLEPSGAASLAALLGGKVDVTDKTVLVVATGGNVSLADFMAHMNHA

SEQ ID NO: 31247 - DNA, 1221 bp, Thermoplasma volcanium GSS1
  CDS (1)..(1221): transl_table=11
atggaaaacctcgaaataccttcatttgatgagataatagaggcacagagatacctcgaaggcaaagtcaacaggactcctctcataagatcgactactatcggaaaagaatatggagcagatatttatttcaaacttgaaaattttcagaagacaggttcttttaagtcgaggggtgctatatttaggttttcaaagctatctgaagatgaaaaaaggcatggtgtaataactgccagtgcaggaaaccatgcacaaggggtagcctacgcagctatgataaacggcatagatgccaagatagttatgccagaatacacgataccgcaaaaagtaaacgcagttataagctacggggcccacgtcattttaaaaggatccgattatgatgaagcgcataggtacgcggacgagattgcaaaacaggagggtaggatcttcatagaggcattcaacgaccgttgggttatttcagggcaaggcacaataggcctggagataatggaggatttgccagatgttgatataatactcgttccggtaggtggcggcggcctcatctccggaatagcactggcagcaaagcatgcaagcaacaaggtcaaagtaataggaatagaatcagagctgtccgattctatgaaagcatcactccgggaaggaaagatagtggcacatactagcggagtcagcatatgcgacggcatctccgtcaagtatccaggagtcctcacatttgacatagcaagaaagtacgttgatgacatagtaacagtaactgaagaatatgtttctaaggctatctacaaactcttcgagagaaacaagatcgtagccgagccttcaggggcagtaggtctcgccgccataatggagggcaaggtagatgttaagggaaagaaggtcgctatagttgtttccggaggaaacataaacccgctgctcatgtcaaagataatatataaagaattggaaaaccttggccaacttgtacgcatagagtgtactataccagatcggcctgggaacctttacaggatagctatggctatagcagaaaacggcggtaatatataccatgccgaagtagataaccttaggaaggagacgccgccaggattccagtcagttacatttacggtaaatgtcagaggccaagatcacttggatcgtataataggaagcttgagggagatgggctatttatttaggataacatga

SEQ ID NO: 31248 - protein, 406 aa, Thermoplasma volcanium GSS1
MENLEIPSFDEIIEAQRYLEGKVNRTPLIRSTTIGKEYGADIYFKLENFQKTGSFKSRGAIFRFSKLSEDEKRHGVITASAGNHAQGVAYAAMINGIDAKIVMPEYTIPQKVNAVISYGAHVILKGSDYDEAHRYADEIAKQEGRIFIEAFNDRWVISGQGTIGLEIMEDLPDVDIILVPVGGGGLISGIALAAKHASNKVKVIGIESELSDSMKASLREGKIVAHTSGVSICDGISVKYPGVLTFDIARKYVDDIVTVTEEYVSKAIYKLFERNKIVAEPSGAVGLAAIMEGKVDVKGKKVAIVVSGGNINPLLMSKIIYKELENLGQLVRIECTIPDRPGNLYRIAMAIAENGGNIYHAEVDNLRKETPPGFQSVTFTVNVRGQDHLDRIIGSLREMGYLFRIT

SEQ ID NO: 31249 - DNA, 1320 bp, Pyrococcus abyssi GE5
  CDS (1)..(1320): transl_table=11
atgaagtgccctaaatgtgggcgagagtacaaagcagaaattccaccattctgtatttgtggtgaggagttagaaataacttacgactactcctctgttgatacgaggaaatggaagaatagacggcctggagtgtggcgatataaggagttattgcctaaggtaaagaagatagtaagtttgcaagaaggtggaaccccactaataaaggcaagaataagcgagcaacttaacgtagatgtttttattaaagacgagaccagaaacccaacgggatcttttagggacagacttgcaacggttgcaatttcatatggtttaccttatgcaaagaacggtttcatagtggcaagcgacgggaatgctgctgcttcggtagcagcgtattctgctagggccgagaaggaatgcttcgttgtcattccaaggaaggtagataagggaaagctaattcaaatgatagcctttggggcgaggataataaggtacggtgaaagcgttgatgatgctatagaatacgctaaagagcttgcaaagctaaacggattatacaatgtaactcctgaagagaatatagtagggctagagggccaaaagaccatagcatttgagctttgggaagaaattaacccaacccatgttatagtgccaactggaagtggaagttacctttactccatctacaaaggatttaaggagttaattgagattggagcccttgaagagatgcccaagctaatagcagttcaaacagatagatgcaatccaatagcttccgaaatattaggaattaaaggtgagtgcaaggaaactaaagctcttggtctttacgtaagggaacctcttatgaaacccaaagttatcagggccataagggaaagcagtggaacggctgttctagttagtgaagaagagatagagaaaggcgagaggttacttgcgaatgaaggaatttttgccgaattatcgtcggcggtagtcatgccagccttaattaagctcgtaaatgacggattcattgagaaaggggatagggtagttctagttgtaactggttctggattaaagacaggagaaggaggaagagagaaatttgggattggcggaactaagcttgaaattttgaagatactcaaggatggagaaaaatatgcctatgagatatggcaagccttaggaaaacccgttaagtatcaagccattcaccagcacataaaagagcttcaagagctaggactaattgaagaggcatatagaaggggaaagagaatttattataagcttactgaaaaagggattaggttagttgacaacctttaa

SEQ ID NO: 31250 - protein, 439 aa, Pyrococcus abyssi GE5
MKCPKCGREYKAEIPPFCICGEELEITYDYSSVDTRKWKNRRPGVWRYKELLPKVKKIVSLQEGGTPLIKARISEQLNVDVFIKDETRNPTGSFRDRLATVAISYGLPYAKNGFIVASDGNAAASVAAYSARAEKECFVVIPRKVDKGKLIQMIAFGARIIRYGESVDDAIEYAKELAKLNGLYNVTPEENIVGLEGQKTIAFELWEEINPTHVIVPTGSGSYLYSIYKGFKELIEIGALEEMPKLIAVQTDRCNPIASEILGIKGECKETKALGLYVREPLMKPKVIRAIRESSGTAVLVSEEEIEKGERLLANEGIFAELSSAVVMPALIKLVNDGFIEKGDRVVLVVTGSGLKTGEGGREKFGIGGTKLEILKILKDGEKYAYEIWQALGKPVKYQAIHQHIKELQELGLIEEAYRRGKRIYYKLTEKGIRLVDNL

SEQ ID NO: 31251 - DNA, 1185 bp, Pyrococcus abyssi GE5
  CDS (1)..(1185): transl_table=11
atggtattgagatgtataaggtgtggaagggagtatcccgaggatgagataaggtacaggtgtgagtgtggaggattgctggaagttgttgtagatcttgataaggtagatacaaaaatatttgatgggaataacattacgctgtggaagtacgagagctggctacctgtgaagaagattgtttctctaaatgagggaggaacccccctgtacagattaaataacttagaaaagattctcggagtgaaggagctgtatgccaagaacgagggtgcaaatccaactggttcgtttaaggatagaggaatgacggttggagtttcaaaggctcttgaactcggaatgaagagagttgcgtgtgcctcaactggaaacacctctgcatctttggctgcatatgcggctaaggctggaatagaggcatacgtccttgtgcctagtggaaagatagcacttggaaaacttgctcaagcgataatatatggggcaaaggttattccaataaagggaaatttcgatgatgcacttcgcgtggtaattgaagcaagcgaggaacttgggatatacatgttaaactcgataaatccatttagattagaaggacagaaaactatagcctatgaaatctatgatcaactacagaaggttccagataatgtagtcttgccagtgggaaacgctggaaatatctcggcgatatggaagggattcaaggagctgtatgaggctggagtcatagataagttacccagaatgataggtatacaagcagagggagcctcacctttagctaaagcatggaaagagaaaaggaaattcaagccagaaaagaatccggaaacccttgcaacggcaataaggattgggaatcctgcaaactgggagaaggcatggagagctgttgaagaatcaggaggtatgtttgagattgttagcgatgaagaaatattgaaggcccagaggatactcgcctcaaaggaaggtctcttcgttgaacccgcttcagcggcttctcttgccgggttaattaagctgttaaatgaggagaaggttgatagagatgaaagcttcgttttggtaacaaccggtcatggacttaaggatcccgacattgttcttaggaatttcaagttgcccgaacctatagaaccgacattagatgcatttaggagggtgattgaatga

SEQ ID NO: 31252 - protein, 394 aa, Pyrococcus abyssi GE5
MVLRCIRCGREYPEDEIRYRCECGGLLEVVVDLDKVDTKIFDGNNITLWKYESWLPVKKIVSLNEGGTPLYRLNNLEKILGVKELYAKNEGANPTGSFKDRGMTVGVSKALELGMKRVACASTGNTSASLAAYAAKAGIEAYVLVPSGKIALGKLAQAIIYGAKVIPIKGNFDDALRVVIEASEELGIYMLNSINPFRLEGQKTIAYEIYDQLQKVPDNVVLPVGNAGNISAIWKGFKELYEAGVIDKLPRMIGIQAEGASPLAKAWKEKRKFKPEKNPETLATAIRIGNPANWEKAWRAVEESGGMFEIVSDEEILKAQRILASKEGLFVEPASAASLAGLIKLLNEEKVDRDESFVLVTTGHGLKDPDIVLRNFKLPEPIEPTLDAFRRVIE

SEQ ID NO: 31253 - DNA, 1185 bp, Pyrococcus horikoshii OT3
  CDS (1)..(1185): transl_table=11
atggtattgagatgtgtagtttgcggaagagaataccctgaggacgaagttaggtataggtgtgattgcggaggattgctggaggtagttattgaccttgataaggttgatacctccattttcaacggtagggatataaagttatggaagtatgagagctggcttcccgtaaaaaagagggtaagcctagaggagggtggaactcccctttataggttgtcaaacctcgaaaatgagctaaaagtgaaggagctttatgcaaaaaatgaaggagcaaatccaactggttcctttaaggatcgtggaatgaccgtcggagtttcaaaggctctcgaactgggaatggataaggttatatgtgcatccacgggcaatacttcagcatcactagcagcttacgctgcaaaggcaggaataaaagcgtacgttctaatacccagcggaaagatagcattaggaaaacttgctcaggcgataatccatggagccaaggtaatcccaatcaagggaaacttcgacgatgcccttaggatagttgttgaggcaagtagagagcttgggatatacatgttgaactcgataaatccatttaggcttgaaggacagaagacaatagcatatgagatatacgatcaactagggaaagttccagacaacattatcctcccagttggaaacgctgggaacatttccgcgatatggaaggggttcaaggaaatgtatgaggctggagttatagatgagcttcccaggatgattggaattcaagctgaaggtgcctctcctttagtgaaagcttggaaggagaagaaaaagtttcaacctgaagagaacccagagactgttgcctctgcaataagaatagggaatccagcaaactggataaaggcatggaaagctgttgaagagtctggaggattgtttgaaagcgtgagtgatgaagagatactaagggcccaaaggctcctagcatctagagagggattattcgttgagcctgcctctgcagcatctttggctggcttgattaagctacttgaaagtggtgaaataagcagaaatgagagttacatcttaataacaactggacatgggttgaaggatccgaacatcgttataaagaactttcagatcccagaacctatagaaccaacattagaagcttttaaggaggtaattaaatga

SEQ ID NO: 31254 - protein, 394 aa, Pyrococcus horikoshii OT3
MVLRCVVCGREYPEDEVRYRCDCGGLLEVVIDLDKVDTSIFNGRDIKLWKYESWLPVKKRVSLEEGGTPLYRLSNLENELKVKELYAKNEGANPTGSFKDRGMTVGVSKALELGMDKVICASTGNTSASLAAYAAKAGIKAYVLIPSGKIALGKLAQAIIHGAKVIPIKGNFDDALRIVVEASRELGIYMLNSINPFRLEGQKTIAYEIYDQLGKVPDNIILPVGNAGNISAIWKGFKEMYEAGVIDELPRMIGIQAEGASPLVKAWKEKKKFQPEENPETVASAIRIGNPANWIKAWKAVEESGGLFESVSDEEILRAQRLLASREGLFVEPASAASLAGLIKLLESGEISRNESYILITTGHGLKDPNIVIKNFQIPEPIEPTLEAFKEVIK

SEQ ID NO: 31255 - DNA, 1323 bp, Pyrococcus horikoshii OT3
  CDS (1)..(1323): transl_table=11
atgaagtgcccaagatgtggtagggaatacatatcttcaatcccacctttttgtatctgtggggaagagctcgagataacttatgattattcctctgtagacgtgagaaaatggaaaagaagaaatcctggggtatggagatataaagagcttctgccagaagttaagaagatcataaccctacaagagggaggaacaccactaataaaggctaggataagcgagaaaatcaacgttgatgtttatataaaagatgaaaccagaaatccaaccggctcctttagggataggttagccacagttgcaatctcctatggtttaccttacgcatcaaatggatttatagttgcgagtgatggaaatgcagctgcttcagtcgctgcttactcggcaagagctgaaaaggagtgcttcgtagttgttcccaggaaagttgataaaggaaagctaattcaaatgatagcctttggagcgaggataatacgctatggtgacagcgttgatgaagcaatagaatatgcaagagagctttcaaaacttaacggcttatacaatgtcacacccgaggataatataatcggacttgagggtcagaagacgatagcattcgaactttgggaggaaattaatccaacgcatgtaatagtcccgacgggaagcgggagttacatatactcgatatacaaggggttcaaggaactcatcaaaattggagtgctagagaagatgccaagattaattgccgttcaaacggagagatgcaatcctatagccgctgaaattttgggattaaaaaaagaatgtaaagaaactaaagctctcggattatatgtgaagaacccggtaatgaagtctagagttataagggctataaaggaaagtggaggaacagcagttgttgtaaatgaaaacgacataattaccggggaaaagttgctagccaatgaagggatatttgcggagctttcctcggccgttgtaatgcccgccctattaagcctagttgaaaagggaataattgaaaaaggagataaagtagttttggttgttaccggttcaggactcaaaattggtgaagggggaagagagaaattctccattggtggaactaagcttgagattcttaaaatcctcgaggaaagagagatgtacgcctatgaaatttggcaagcactaggaaaacccctaaagtatcaagccgttcatcagcatataaaggaattacaagagttaggcctcataaaggaggcatatagaaaggggaagaggatatattacaagctgactgagagaggtagaaggcttattgaaaatcttgagtag

SEQ ID NO: 31256 - protein, 440 aa, Pyrococcus horikoshii OT3
MKCPRCGREYISSIPPFCICGEELEITYDYSSVDVRKWKRRNPGVWRYKELLPEVKKIITLQEGGTPLIKARISEKINVDVYIKDETRNPTGSFRDRLATVAISYGLPYASNGFIVASDGNAAASVAAYSARAEKECFVVVPRKVDKGKLIQMIAFGARIIRYGDSVDEAIEYARELSKLNGLYNVTPEDNIIGLEGQKTIAFELWEEINPTHVIVPTGSGSYIYSIYKGFKELIKIGVLEKMPRLIAVQTERCNPIAAEILGLKKECKETKALGLYVKNPVMKSRVIRAIKESGGTAVVVNENDIITGEKLLANEGIFAELSSAVVMPALLSLVEKGIIEKGDKVVLVVTGSGLKIGEGGREKFSIGGTKLEILKILEEREMYAYEIWQALGKPLKYQAVHQHIKELQELGLIKEAYRKGKRIYYKLTERGRRLIENLE

SEQ ID NO: 31257 - DNA, 1050 bp, Aeropyrum pernix K1
  CDS (1)..(1050): transl_table=11
gtgagaggacctcttttcaagctgggcagggcgctggagaagggcagtgtggagggagtggtcgccgcctcagccgggaaccatgcccagggtgttgcgtacgccgctagcttctacgggctcaagagcgttatagtcatgcccgagctggccccgccagccaaggttaaggctaccaggtcgtacggggctgaggtagtgctgcacggccgggttgtggacgaggcgtttaagctcgccgagaagatagcggaggagaggggatacatgcttgtccaccccttcgacgatcccgagataatggctggaaacgggactatagcgtgggaggcctacgagcaggggggtaagttcgacacggtgatagtgcctgtaggcgggggcggtttgatctctggtgtagtctcggttgtgcggaagctgatgcccggcgtcaaggtcataggtgttgaggcggaggctgcgcccaagttcgtagagagcttcaaggaggggaagccgatagaggttgaagtcacccatagcctggccgacgggcttgtgaccaagaagccgggtaggctcacctaccccatagtgaagcatcttgtcgacaaggttgtggctgtggacgagcatgagatagcgagcgccatgtacctcctcctcgagaggtctaagattctggctgagggtgccggagccgcgggcgtggcagcccttcttgccagggtggtgaagcccaagggtaagacccttgtaatagttagcggggggaacgcggaccttacaagcatagagaaggttatactggttggcctcgccagggagggtaggatagctaggataacgggtgtgatacccgacatcccgggccagctatacaaggttctggaggtgatagcggagaagaggtgcaatgttgtagacattatacatgacaggctccaccccaggataagccctggtatggcgagggttacaatcgtgctcgaagtgccagagcgcatgctcctcttcgagcttctagaggacctcagagacatgggttacaagttcgtcatagactga

SEQ ID NO: 31258 - protein, 349 aa, Aeropyrum pernix K1
MRGPLFKLGRALEKGSVEGVVAASAGNHAQGVAYAASFYGLKSVIVMPELAPPAKVKATRSYGAEVVLHGRVVDEAFKLAEKIAEERGYMLVHPFDDPEIMAGNGTIAWEAYEQGGKFDTVIVPVGGGGLISGVVSVVRKLMPGVKVIGVEAEAAPKFVESFKEGKPIEVEVTHSLADGLVTKKPGRLTYPIVKHLVDKVVAVDEHEIASAMYLLLERSKILAEGAGAAGVAALLARVVKPKGKTLVIVSGGNADLTSIEKVILVGLAREGRIARITGVIPDIPGQLYKVLEVIAEKRCNVVDIIHDRLHPRISPGMARVTIVLEVPERMLLFELLEDLRDMGYKFVID

SEQ ID NO: 31259 - DNA, 1182 bp, Aeropyrum pernix K1
  CDS (1)..(1182): transl_table=11
gtggcctgcggctccaaatatccgtcctcccctcgtctattcacctgccctaagtgcggggggcttctggagcccttctacattgacggaggatcgcccaggggcaggggggtgtggaggtatagggacctcctgccgaggccacgcaggatcgtgaccatgggggagggttctacgccgctggtcaagctggagaacctttctagggctatgggggttgaagtctatgggaaactcgagttcctaaaccctactggcagctttaaggataggggtatgactgttggtgtcagcatcgcctcgtccttcagctaccgacttgtagtagcggcaagcacgggtaacactgcggctagcatggcagcatacgctaggagagcagggcttaatccggttatactgattccgaaggggggtatagcctcgggcaagctctcccagatagccgcccttggggcttgggttcttgaggttgagggcagcttcgacgatgctctcgacgctgccagggccgctgcggagaaggggctcgcgtactcactcaacagcataaacccctacaggcttgaggggcagaagaccattgccttcgagattctagaggatgtggacagagtggaccatgtggtggtgcctgtgggtaatgcgggtaacatatctgcaatatggaaagggttcaaagaggccggcctcctaggccttcccagcatgaggcctaggatggtgggggtccaggctgagggcgcctcccccctgtacagggcttgggttgagaagatggactctgtggagagggttagaaacccgagcaccatagcctcggccataaggataggcaatccagtcaacgctgcgaaagccctggcagcggttagggagtcggacggtttaataatatctgtcagcgacgccgagatcctaaaggcggcggccacgctcgctgagaacgaggggatgctggtagagcctgccagtgcagccagccttgcaggcctcataaagctgaggaaccagggcatcatagcttctggctcaagcgtggtgctgatactcacaggccacggtcttaaggatcctagggccctagagtttatagcaagtagtgcgggtgtaaggagagcatatgccagcaccgccgaggaggctctactcaagctggaagagattgctgttggcggttag

SEQ ID NO: 31260 - protein, 393 aa, Aeropyrum pernix K1
MACGSKYPSSPRLFTCPKCGGLLEPFYIDGGSPRGRGVWRYRDLLPRPRRIVTMGEGSTPLVKLENLSRAMGVEVYGKLEFLNPTGSFKDRGMTVGVSIASSFSYRLVVAASTGNTAASMAAYARRAGLNPVILIPKGGIASGKLSQIAALGAWVLEVEGSFDDALDAARAAAEKGLAYSLNSINPYRLEGQKTIAFEILEDVDRVDHVVVPVGNAGNISAIWKGFKEAGLLGLPSMRPRMVGVQAEGASPLYRAWVEKMDSVERVRNPSTIASAIRIGNPVNAAKALAAVRESDGLIISVSDAEILKAAATLAENEGMLVEPASAASLAGLIKLRNQGIIASGSSVVLILTGHGLKDPRALEFIASSAGVRRAYASTAEEALLKLEEIAVGG

SEQ ID NO: 31261 - DNA, 1041 bp, Arabidopsis thaliana
  CDS (1)..(1041)
atggaagcaaatagagagaagtatgctgctgatatattgtccataaaagaagctcatgaccgtattaagccgtatatacatagaactccggtgttaacatctgaatcgttgaattcaatctccggaagaagcttgttctttaagtgtgagtgccttcagaaaggtattgaatgtcgatcgttttacttttctgtttattgtggaaaaagtggagctttcaaattccgtggagcttgcaatgctgttttgtctcttgatgctgaacaagcagccaaaggagttgtaacacacagcagtggaaaccatgctgctgcattgtctttggctgcaaagattcagggaataccggcatatattgttgtaccaaaaggtgctccaaagtgcaaagttgataatgtgatcaggtatggtggtaaggttatatggagtgaagcaacaatgtcttctagagaggaaatagcttcaaaagttttgcaggaaacaggttcagttctgatccatccatataatgatggacgcattataagtggtcagggtacaattgcattggaactgctggagcaaatccaagagattgatgctatagttgtgccgataagcgggggtggtttgatatctggtgtggcgcttgctgccaaatctattaagcctagtatccggattatagccgctgaaccaaaaggagctgatgatgcggctcagtctaaggtcgctggtaaaatcatcactttacctgtgactaatactatagctgatggccttcgagcttctcttggagatttaacctggccggtggtgagggacttggtagatgatgttgtcaccttggaagagtgtgaaataatcgaagccatgaaaatgtgctatgagatactgaaggtctctgtggaaccaagtggagctattggccttgcagcagttttatcaaacagtttccgcaacaatccttcttgtcgtgattgcaaaaacataggaattgtactctcaggaggtaatgttgatttgggctctctatgggattcatttaagagttcaaaataa

SEQ ID NO: 31262 - protein, 346 aa, Arabidopsis thaliana
MEANREKYAADILSIKEAHDRIKPYIHRTPVLTSESLNSISGRSLFFKCECLQKGIECRSFYFSVYCGKSGAFKFRGACNAVLSLDAEQAAKGVVTHSSGNHAAALSLAAKIQGIPAYIVVPKGAPKCKVDNVIRYGGKVIWSEATMSSREEIASKVLQETGSVLIHPYNDGRIISGQGTIALELLEQIQEIDAIVVPISGGGLISGVALAAKSIKPSIRIIAAEPKGADDAAQSKVAGKIITLPVTNTIADGLRASLGDLTWPVVRDLVDDVVTLEECEIIEAMKMCYEILKVSVEPSGAIGLAAVLSNSFRNNPSCRDCKNIGIVLSGGNVDLGSLWDSFKSSK

SEQ ID NO: 31263 - DNA, 1059 bp, Aquifex aeolicus VF5
  CDS (1)..(1059): transl_table=11
atgaatcggtggcaaggaataattaaacagtataaaaagtacctccccgttgacgaaaacacacccatcgtaaccctctacgaaggtaacactcctctcatagaggcggacaacctcgcaagggcgataggttttaaaggaaagatttatctgaagtacgaaggactaaatccgactggttcttttaaagatagggggatgacccttgccatttcgaaagcagtggaagcgggtaaaagagcggtgatatgtgcatccacgggaaacacctccgcttccgccgcggcttacgctgcaagggctggactcagggcttacgttctgctacccaagggtgctgtcgccataggaaagctctctcaggctatgatttacggggctaaagtcctcgccattcaaggaacttttgacgatgccctgaacatagtgagaaaaataggtgaaaattttcccgtggaaattgtgaactcggtcaacccctatagaatagaggggcaaaagacagccgcttttgagatatgcgataccttgggagaggctccagattatcactttatcccagtcgggaacgcaggaaacataaccgcctactggaagggctttaagatttattacgaggaggggaaaataacgaaactccctaggatgatgggctggcaagcggaaggtgctgctcctatagtgaagggctacccgattaaaaatccccagaccatagctacggctataaagataggaaatccctacagctggaagtctgccctgaaagccgctcaggagagtggtgggaaaatagatgcggtaagtgacagcgaaatcctttatgcttacaaactcatcgcctcaacggaaggtgttttctgcgagcctgcttctgccgcgagcgtggcagggttgataaaactcgtaagggaaggcttttttaaaggcggagaagtggtaacgtgtacacttaccggaaacggtttaaaggaccccgataccgctataaaagtttgtgaagaacctataacagtacctccggattttgacgaggtagtaaaggttctaggtttttaa

SEQ ID NO: 31264 - protein, 352 aa, Aquifex aeolicus VF5
MNRWQGIIKQYKKYLPVDENTPIVTLYEGNTPLIEADNLARAIGFKGKIYLKYEGLNPTGSFKDRGMTLAISKAVEAGKRAVICASTGNTSASAAAYAARAGLRAYVLLPKGAVAIGKLSQAMIYGAKVLAIQGTFDDALNIVRKIGENFPVEIVNSVNPYRIEGQKTAAFEICDTLGEAPDYHFIPVGNAGNITAYWKGFKIYYEEGKITKLPRMMGWQAEGAAPIVKGYPIKNPQTIATAIKIGNPYSWKSALKAAQESGGKIDAVSDSEILYAYKLIASTEGVFCEPASAASVAGLIKLVREGFFKGGEVVTCTLTGNGLKDPDTAIKVCEEPITVPPDFDEVVKVLGF

SEQ ID NO: 31265 - DNA, 1002 bp, Rickettsia prowazekii str. Madrid E
  CDS (1)..(1002): transl_table=11
atgaatttattactacaacctcctcaaaatgtagcaatagcacataatagaataaaacaatatataaatttaactccgatcattcactctgaaagcttaaatgcgatgctaggtcatgagattttttttaaggttgaatcattacaaaaaacaggagcatttaaaattagaggcgtattaaataatttgttaaaattaaaagagcaagaaaaattacctgataaaatagtttgttatagtagcggtaaccatggcattggtcttgcttattcaagtaaattatttggtattaaaacaagaatttatttaccgttaaatacttcaaaagtaaaacagcaagcagctctttattacggaggtgaagttatatacacgaatactcggcaagaagcagaatcaagagcaaaggcagatgaagaacaaggattctactatatgcacccttctgatagtgattctataatagcaggagccggtacgttatgctatgaagcattacagcaattaggttttagtcctgatgcaatttttgcttcttgcggcggtggaggtttaatttccggctcatatcttgctaaagaattaatatcacctacaagcttattaataggttcagaaccagttgcggctaatgatgcttatttatcgattaaaaataataatatatatagatttaatgactcaccaattaccattgcagatggtcttaaaactttaagtgtatcagctcgcacatttgaatatttgaaaaaacttgatcatttttatttagcagaagaatatgaaatatattactggacagcgtggcttactcatttacttaaagtaatatgtgagccatcaagtagtataaatatggcttcagtagtaagttggttaaaaacacaaaccaaaacacagaaactattagtattaatctcaggcggcaatatcgaccctactctttataatgagttatggaaaaatgattatctaactgttccaccaagcattagtaactaa

SEQ ID NO: 31266 - protein, 333 aa, Rickettsia prowazekii str. Madrid E
MNLLLQPPQNVAIAHNRIKQYINLTPIIHSESLNAMLGHEIFFKVESLQKTGAFKIRGVLNNLLKLKEQEKLPDKIVCYSSGNHGIGLAYSSKLFGIKTRIYLPLNTSKVKQQAALYYGGEVIYTNTRQEAESRAKADEEQGFYYMHPSDSDSIIAGAGTLCYEALQQLGFSPDAIFASCGGGGLISGSYLAKELISPTSLLIGSEPVAANDAYLSIKNNNIYRFNDSPITIADGLKTLSVSARTFEYLKKLDHFYLAEEYEIYYWTAWLTHLLKVICEPSSSINMASVVSWLKTQTKTQKLLVLISGGNIDPTLYNELWKNDYLTVPPSISN

SEQ ID NO: 31267 - DNA, 1206 bp, Thermotoga maritima MSB8
  CDS (1)..(1206): transl_table=11
gtgatcacactcgaggatataaaagaagcccaaagaacattgaagaatgtggtgcacaggacagctcttgcttacagctctgttctgagcgaggtaaccggtggagagatctacctgaagatggaaaatctccagaagaccggttcgttcaaaataaggggagcgtacaacaaaatagctcacctgagcgaagaagaaagaaagagaggagtcgttgccgcgtccgctggaaaccacgcgcagggagtggcacttgctgctcaaatcttcggtattcccgctaccattgtgatgccgaggtacgcccctctttctaaaatcaccaaaacgaggaatcttggagctcaggtgattcttgaggggaacattttcgacgaggcctacgaggcggctctcagaatacaggagaaaacaggtgcggtttttgtgcatcccttcaatgatcctcatgtcatcgccgggcagggaactatagggctggaaataatggaagatcttccggatgtggaagtggtggtggtgcccgttggtggaggtggtttgatttcgggagtatccgttgcgatcaaatcgatgaatcctgaggttaaagtaataggcgttcaaacggagaacatgccttccatgatcgcttcactgagaaggggcagggcagagcgggtcgaaggtaaacccacacttgccgatggaatagccgtgaaaaagcccggtgacctgaccttcgagctggtgaagaagtatgtcgatgagatggtcgcggtgaacgaagaagaaatagcggatgctatccttttccttcttgagcaggcaaaggtggttgctgaaggtgcaggagcggtgggtgtagccgctgttttgaacaaactggatgtgaagggaaagaaggtagcgatcgtgataagcggtggtaacatagatgtgaacatgatagacagaatcataaacaaagggctcgtgaagagcggaaggaaggtgttcatagaaacgttcgtgatggacagacccggtgccctgaaagagcttctcgggatagtggcggaactcggcgcaaacgttctttccgtttttcacaatcgctccgcaaaggaagttcccattggttttgccaaaatagagctcgagcttgaaacggtcgatgaaaaacacgtcgaagagatagagagggtgttgatcgcaaagggatacgaggtgaggatagtcgggtga

SEQ ID NO: 31268 - protein, 401 aa, Thermotoga maritima MSB8
MITLEDIKEAQRTLKNVVHRTALAYSSVLSEVTGGEIYLKMENLQKTGSFKIRGAYNKIAHLSEEERKRGVVAASAGNHAQGVALAAQIFGIPATIVMPRYAPLSKITKTRNLGAQVILEGNIFDEAYEAALRIQEKTGAVFVHPFNDPHVIAGQGTIGLEIMEDLPDVEVVVVPVGGGGLISGVSVAIKSMNPEVKVIGVQTENMPSMIASLRRGRAERVEGKPTLADGIAVKKPGDLTFELVKKYVDEMVAVNEEEIADAILFLLEQAKVVAEGAGAVGVAAVLNKLDVKGKKVAIVISGGNIDVNMIDRIINKGLVKSGRKVFIETFVMDRPGALKELLGIVAELGANVLSVFHNRSAKEVPIGFAKIELELETVDEKHVEEIERVLIAKGYEVRIVG

SEQ ID NO: 31269 - DNA, 1515 bp, Pseudomonas aeruginosa PAO1
  CDS (1)..(1515): transl_table=11
atgctcgaacaatacgtcaagaagatcctcacctcgcgcgtctacgacgtcgcggtggaaacgcccctgcaacccgcccgccagttgtccgaacgcctcggcaaccaggtcctgctcaagcgcgaggacctgcagccggtgttttccttcaagatccgcggcgcctacaacaaggtcgcgcagctcaccgaggaggagaaggcccgcggggtgatcgccgcctcggccggcaaccacgcccagggcctggccctggcggccaagcggcaggggatcagggcggtcatcgtgatgcccaagaccacccccgagatcaaggtccaggcggtgcgcgcccacggcgccaaggcggtgctgcacggcgacgccttccccgaggcgctggcccacgcgctgaagctggtcgacgagaagggctacaccttcgtccatccctacgacgatccggacaccatcgccggccagggcaccgtggccatggagattctccgccagcagcccggccgcctcgatgcgatcttcgtcccggtgggcggtggcggactggtcgccggcatcgccgcctacgtcaagtacctgcgtccggagatcaaggtgatcggcgtcgagccggacgagtcgaactgcctgcaggcggccatggccgccggcgagcgggtggtgctgggccaggtcgggctgttcgccgacggcgtggcggtggcgcagatcggccagcacaccttcgacatctgcaaggaccacgtcgacgaagtgatcaccgtcagcactgacgagatctgtgcggcgatcaaggacatctacgacgacacccgctcgatcaccgagccggccggcgcgctggcggtggccgggatcaagaagtacgtcgagcgcgagcgcgccgaggggcagaccctggtggcgatcgactccggcgccaacgtcaacttcgatcgcctgcggcatgtcgccgaacgcgccgaactgggcgagcgccgcgaagcgatcatcgcggtgaccattcccgagcggccgggcagcttcaaggccttctgcgaggcggtcggcaagcgccagatcaccgagttcaactatcgctaccacagcggcagcgaggcgcacatcttcgtcggcgtgcagacccacccggagaacgacccgcgcgaggcgctggtggcctatctgcgcgagaagggcttcccggtcctcgacctgaccgacaacgaactggccaagctgcacatccgccacatggttggcggccatgcggtgaaagtcagcgacgagatggtgttccgcttcgaattccccgagcggcccggcgcgctgttcaacttcctcaccaagctcggcgggcgctggaacatctcgatgttccactaccgtaaccatggtgcggccgacggccgggtggtggccgggttgcaggtgccggaagacgagcgccacctgatcccgcagaccctggaggcgatcggctatccgtactgggacgagaccgccaacccggcctaccagctgttcctcggctga

SEQ ID NO: 31270 - protein, 504 aa, Pseudomonas aeruginosa PAO1
MLEQYVKKILTSRVYDVAVETPLQPARQLSERLGNQVLLKREDLQPVFSFKIRGAYNKVAQLTEEEKARGVIAASAGNHAQGLALAAKRQGIRAVIVMPKTTPEIKVQAVRAHGAKAVLHGDAFPEALAHALKLVDEKGYTFVHPYDDPDTIAGQGTVAMEILRQQPGRLDAIFVPVGGGGLVAGIAAYVKYLRPEIKVIGVEPDESNCLQAAMAAGERVVLGQVGLFADGVAVAQIGQHTFDICKDHVDEVITVSTDEICAAIKDIYDDTRSITEPAGALAVAGIKKYVERERAEGQTLVAIDSGANVNFDRLRHVAERAELGERREAIIAVTIPERPGSFKAFCEAVGKRQITEFNYRYHSGSEAHIFVGVQTHPENDPREALVAYLREKGFPVLDLTDNELAKLHIRHMVGGHAVKVSDEMVFRFEFPERPGALFNFLTKLGGRWNISMFHYRNHGAADGRVVAGLQVPEDERHLIPQTLEAIGYPYWDETANPAYQLFLG

SEQ ID NO: 31271 - DNA, 963 bp, Pseudomonas aeruginosa PAO1
  CDS (1)..(963): transl_table=11
atgcctttttctctcgccgccctccaacaggccgccgccatcgtccaccagagcctgccgccgacgccgcagatacgctggccgctgctatgcgaggcactgggttgcgaagtgtggatgaagcacgagaaccacctgccggtgggggccttcaaactgcgcggcggcctggtgtatttccaccacctggcgcaccagggcgagcggccggccgccgtgatcagcgcgacccgcggcaaccacggccagtcggtggccttctcggcgagccgctacggcatccagccgatcatcgtcgtgccgcacggcaacagccgcgagaagaacgcggcgatgcgcagccttggcgcggagctgattgagcacggcgaggacttccaggcctcccgcgaatacgccgccgagcgcgcccggcgcgaaggcctgcacctgattccggcgttccatccctggctggtggccggggtcgccagctacagcctggagttgttcgccgcgctggccgaccttgacgaagtctacgtgccgatcggtatgggttcgggcatctgcggtctgatcgccgcgcgcgacgcgctgggcctgaagacccgcatcgtcggcgtggtgtccgcccatgcgccggcctacgccctgtcgttcgaggccggcacggcgatcagccacccggtcgacacccgcctggccgacggcatggcgtgcagtacgccggacccgagcgcgctggaaatgatcctggccggcgccgatcgcctggtgcgggtcagcgacagggagatcggcgcggccatgcgcctgtgcttcaccagcacccacaacgtcgccgagggcgccggggtggcggcgctggccgccgcctggcaggagcgcgagcgcctgaaggggctgaaggtaggcctgatcctcagcggagcgaacgtcgaccgcgaggtattcgccgagcaactggccgccggcgactga

SEQ ID NO: 31272 - protein, 320 aa, Pseudomonas aeruginosa PAO1
MPFSLAALQQAAAIVHQSLPPTPQIRWPLLCEALGCEVWMKHENHLPVGAFKLRGGLVYFHHLAHQGERPAAVISATRGNHGQSVAFSASRYGIQPIIVVPHGNSREKNAAMRSLGAELIEHGEDFQASREYAAERARREGLHLIPAFHPWLVAGVASYSLELFAALADLDEVYVPIGMGSGICGLIAARDALGLKTRIVGVVSAHAPAYALSFEAGTAISHPVDTRLADGMACSTPDPSALEMILAGADRLVRVSDREIGAAMRLCFTSTHNVAEGAGVAALAAAWQERERLKGLKVGLILSGANVDREVFAEQLAAGD

SEQ ID NO: 31273 - DNA, 1548 bp, Pseudomonas aeruginosa PAO1
  CDS (1)..(1548): transl_table=11
atgagcgcctcgaccctcagcgcaagcaaacccctgctggccggctacgtggaaagcatcctggccgcgccggtgtacgacgtcgccgtggaaacccccttgcaggtcgcgccgcagttgtcccagcgcctgggcaaccgggtgctgctcaagcgcgaggacctgcagccggtgttctccttcaagatccgcggcgcctacacccgtgtcgcgcgcctgagcgacgagcagaaggcccgcggggtgatcaccgcctccgccggcaaccatgcccagggcctggccctggcggcgcagcgcctgggcgtgcgggcggtgatcgtgatgccgcgcaccactcccgaactcaaggtcaagggcgtgctggcacgcggcggcgaggcgttgctgcacggcgacgccttccccgatgcgctggcccatgccctgcaactggccgagcgcgaaggcatgaccttcgtcccaccctacgacgatccggacgtgatcgccggacagggcacggtggcgatggagatcctccgccagcacagcggccgcctcgacgcgatcttcgtgccggtcggcggcggcagcctgatcgccgggatcgccgcctacgtcaagcacctgcgtccggatattcgcgtgatcggcgtcgagccggaggattccaactgcctgcaggcggcgctggccgccggcgaacgggtggtgctgggccaggtcgggctgttcgccgacggggtggcggtggcgcagatcggcgcttgcaacttcgaggtctgcaaggaccatgtcgacgaggtgatcaccgtcggcagcgacgaaatctgcgcggcgatcaaggacatctacgacgacacccgttcgatcaccgagccggccggcgccctggccgtagcggggatcaagaagtacgtggcccgcgaacgcaccgaggggcagaccctggtggccatcgactccggtgccaacatcaacttcgaccgcctgcgccacgttgccgagcgcgccgaactgggcgaacagcgcgaagcgatcatcgccgtcaccgtggccgagcggccgggcagcttcaaggccttctgcgcggcgctgggccggcgccagatcaccgagttcaactaccgctaccacagcgaccgccaggcccacctgttcgtcggcgtgcagacccatccgctcaccgacagccgcgccgacctgctcgccggcctgcgcgagcagggcttcccggtactcgacctgaccgacaacgagatggccaagctgcacatccgccacatggtcggcggccacggtaccgaggtgcgccgcgagcggctgttccgcttcgagtttcccgaacgccccggggccttgctgaacttcctcgacaagctcggctcgcgctggaacatcagcctgttccactaccgcaaccacggcgccgccgacggtcgggtgctggccggattgcaggtgccggacgaggagcgcggcgagctggaggcggcgttgcaagccatcggctatccgtactgggaggaaacccacaacccggcctaccggctgttcgccggttga

SEQ ID NO: 31274 - protein, 515 aa, Pseudomonas aeruginosa PAO1
MSASTLSASKPLLAGYVESILAAPVYDVAVETPLQVAPQLSQRLGNRVLLKREDLQPVFSFKIRGAYTRVARLSDEQKARGVITASAGNHAQGLALAAQRLGVRAVIVMPRTTPELKVKGVLARGGEALLHGDAFPDALAHALQLAEREGMTFVPPYDDPDVIAGQGTVAMEILRQHSGRLDAIFVPVGGGSLIAGIAAYVKHLRPDIRVIGVEPEDSNCLQAALAAGERVVLGQVGLFADGVAVAQIGACNFEVCKDHVDEVITVGSDEICAAIKDIYDDTRSITEPAGALAVAGIKKYVARERTEGQTLVAIDSGANINFDRLRHVAERAELGEQREAIIAVTVAERPGSFKAFCAALGRRQITEFNYRYHSDRQAHLFVGVQTHPLTDSRADLLAGLREQGFPVLDLTDNEMAKLHIRHMVGGHGTEVRRERLFRFEFPERPGALLNFLDKLGSRWNISLFHYRNHGAADGRVLAGLQVPDEERGELEAALQAIGYPYWEETHNPAYRLFAG

SEQ ID NO: 31275 - DNA, 1527 bp, Neisseria meningitidis MC58
  CDS (1)..(1527): transl_table=11
atgaacacgccccttccttattccgattacctcatccgcatcctgacggcatctgtctatgatgtggcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcatgctcaaggcgtggcattgtccgcacagcgtttgggctgccgtgccgttatcgttatgccggagactacgccgaaaatcaaagtggatgcggttaaaagccatggcggcgaggtggttttgcggggcgtttcatacaacgatgcctacgattatgcgatggagttggcggaaaaagaagggttaacctatatcgcgccgtttgatgatcctgatgtgattgcgggacaggggacggtggggatggaaattgtcagccagcatcccgatccaatccgcgccgtattcgtaccgataggcggtggcggtttggcggcgggcgtggcggcatttatcaagcaggtccgtcccgaaatcaaagttatcggcgttcagaccaacgattcctgctgtatgaagcagtcggtcgaagcgggtgaaatcgtccatttgaaagatgtcgggctgttttcagacggcactgcggtcaaagtcgtcggaaacgaaaccttccgcctctgcaaagaacttttggatgaaatcattacagtcgataccgatgcggtttgcggcgcggtcaaggatattttcgatgacacgcgcagcattaccgagccggcgggcgcgttggcgttggcgggtctgaaagcctatatcgcccgagaaggcgcggaaaaccaaaccctgattgccgttaccagcggtgcgaatatgaattttcaccgtttgcgccacgtttcggaacggagcgaattgggcgagggcaacgaaggtatttttgccgttaccatccctgaagaacgcggcagcttccttaagtttgtcaatatattgggaaataggaatattaccgagttcaactaccgctacggagacgatgaaaaagcgcatatctttgtcggacttcaagcggcaggcccgcaggatttggcggttatcggcagccggttggatgaggcgggattgcccaatgtcgatttgaccaacaatgagattgccaaaatccatatccgctatatggtcggagggcggacggacaaagtagaaaacgagcgtttggtcagttttgagtttccggagcgtccgggggcattggcacgctttttgaaccatatgcagggagggtggaatattacgcttttccattaccgcaaccacggtgcggattacgggcggattttggtcggtatcgatgtgccgccgcacgatgccgccgcatttgacggtttcttggaaagtctgggatacagctatcacgaggaaacgcaaaatgccgcgtacaagctgtttcttgcctga

SEQ ID NO: 31276 - protein, 508 aa, Neisseria meningitidis MC58
MNTPLPYSDYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSHGGEVVLRGVSYNDAYDYAMELAEKEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNETFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGDDEKAHIFVGLQAAGPQDLAVIGSRLDEAGLPNVDLTNNEIAKIHIRYMVGGRTDKVENERLVSFEFPERPGALARFLNHMQGGWNITLFHYRNHGADYGRILVGIDVPPHDAAAFDGFLESLGYSYHEETQNAAYKLFLA

SEQ ID NO: 31277 - DNA, 1221 bp, Methanothermobacter thermautotrophicus str. Delta H
  CDS (1)..(1221): transl_table=11
atggatggtgaatctgtgataaggtgcatatcatgtggtcgagagtatgacctggaggagatcatatacacctgcagggagtgcgggtcggtacttgaagttgaatgtgacgtggaggtctcaagggacgtcttcaggggcagaaggcagaacatgtggaggtacagggagttcatgcctgttgacccctcaaggatagtcagcctcgatgaggggggaacaccctttgtcaggtgtgacaccataggatctgaacttggtattgagctctatgtgaaggtggagggctccaaccccacagggagcttcaaggacagggggatgagcgtggggatcacaaaggcccttgaacttggcgttgatactgtggggtgcgcctcaaccggtaacacctcagcctcccttgcagcctacgcagccagggctgggctgggctgcgtcgttctactcccatcaggtaaggtcgccctcggtaaacttgcccaggctatgttccatggcgccagggtcctctcggtgaggggaaactttgacgaggcccttgaggctgtcacggaacttgcactgatgggtgaactctacctcctcaactccgtgaaccccttcaggcttgagggtcagaagtcaataggctttgagatagtggatgacctcggctgggagtcccctgaccgcatcatactgcctgtggggaatgcaggtaatatctcagccatctggaagggtatatcagagttttacagggctggattcatagatgagaggccgatgatgaccggtatacaggccgagggcgcttcaccggtggtagaagccttcaggaagggcagaaccgagattgaaccggtcagggatcctgaaacggttgcaacggccataaggataggggcccctgttagctatctcaaggccctccgggccatatatgagtcagatggttatgctgaatccgtgaccgatgaggagatactctctgcccagaaactccttgcaaggagggagggtataggtgttgagcccgcatcagcggcgtccatagcgggtctcatcaaactcgttgatgagggtgttgttgacaggggtgaacgtgtggtctgtgttgtcactggtcatgtactcaaggaccctgacaccgccataaaggcatcaacggaaccagttgaggtagaacctgatataaaccagttaagatccattataaggggtacggggtcctcctag

SEQ ID NO: 31278 - protein, 406 aa, Methanothermobacter thermautotrophicus str. Delta H
MDGESVIRCISCGREYDLEEIIYTCRECGSVLEVECDVEVSRDVFRGRRQNMWRYREFMPVDPSRIVSLDEGGTPFVRCDTIGSELGIELYVKVEGSNPTGSFKDRGMSVGITKALELGVDTVGCASTGNTSASLAAYAARAGLGCVVLLPSGKVALGKLAQAMFHGARVLSVRGNFDEALEAVTELALMGELYLLNSVNPFRLEGQKSIGFEIVDDLGWESPDRIILPVGNAGNISAIWKGISEFYRAGFIDERPMMTGIQAEGASPVVEAFRKGRTEIEPVRDPETVATAIRIGAPVSYLKALRAIYESDGYAESVTDEEILSAQKLLARREGIGVEPASAASIAGLIKLVDEGVVDRGERVVCVVTGHVLKDPDTAIKASTEPVEVEPDINQLRSIIRGTGSS

SEQ ID NO: 31279 - DNA, 1488 bp, Halobacterium salinarum NRC-1
  CDS (1)..(1488): transl_table=11
atgctttctcggtgtcctgtgctgcgtagaccgatccctcacggcacgatcgaccacctgattcgcagtcgcgactgcggaactggcacacgcgtgccccgtctaaccaagcccccactcgcagtttcactttcactccgcttcgatcggttttatgttcgtgggcgtcctaccgatagttgtcacacgctccgttctcgcgttcttcggcgctcaccaccaacggttaaacccggaccacgcataccagcgagtatgctctcgctgtccgacattcgggacgcccgcgagcgcgtctccgaaaccgcccgccacacaccgcttgagtactcgcatacgttctccgatctcaccggcgcggacgtccgcccgaagctggagtgtttccagcgcaccggctcgttcaagatccgtggcgcgaccaaccgcatccgcacgctctccgccgaccagcaggacgccggcgtggtcactgcgtcggccggcaaccacgcccagggcgtcgcgctcgcggcctcccggtcgggcgtcgactcgaaggtggtgatgccggagtccgcgcccatctcgaagatcaaggccaccaagagctacggcgccgaagtcgtcctccacggcgccgactacgacgacgcacaggcccacgcccacgaactcgaagccgccgaaggccgcacgtacgtccacgccttcgacgacgagtacatcatggccggccagggcaccctgggcctcgaaatcgccgcggactgtccgacggttgacaccgtcgttgtccccatcggtggcggtggcctcatctccggcgtcgccaccgcgctcaagggggaactcgacgacgtgcgcgtcatcggcgtgcaggccgagggggcctcgacggtcgcgcggtccctcgacaagggccagccacaggccgtcgatcacgtcgacaccatcgccgacggtatcgccgtccgacaggtcggggcgcagacgttccccgtcatccaggagcacgtcgacgaggtcgtcaccgtctccgacgacgagatcgccaccgcgctcgtgttgctgctggagcgcgggaaaaccctcgttgagggtgccggcgccaccgcgctcgcggccgtcctggaggacaaattcgagtacgcggacggcgaaaccatcgtgcccgcgctctgcggtggcaacatcgacctcaacctcctcaccacggtgatcgttcgcgggctcgtcgaccagggccgctacgtcaagatccgcaccgtgctcaaggacagcccgggcagcctcaacgacctgctggcgaccgccgccgaggagcgcgcgaacatctacgccatccagcacgaccgcaccaaccgcgacatcgcgatgaacgccaccgaggtcgaactcgacctcgaaacgcgaggccccgaacacgtcgaccggctgctcacccggatccaggacgagggcttcgacgtcacggtgctcaacggcccccagatcgtcagcgagtga

SEQ ID NO: 31280 - protein, 495 aa, Halobacterium salinarum NRC-1
MLSRCPVLRRPIPHGTIDHLIRSRDCGTGTRVPRLTKPPLAVSLSLRFDRFYVRGRPTDSCHTLRSRVLRRSPPTVKPGPRIPASMLSLSDIRDARERVSETARHTPLEYSHTFSDLTGADVRPKLECFQRTGSFKIRGATNRIRTLSADQQDAGVVTASAGNHAQGVALAASRSGVDSKVVMPESAPISKIKATKSYGAEVVLHGADYDDAQAHAHELEAAEGRTYVHAFDDEYIMAGQGTLGLEIAADCPTVDTVVVPIGGGGLISGVATALKGELDDVRVIGVQAEGASTVARSLDKGQPQAVDHVDTIADGIAVRQVGAQTFPVIQEHVDEVVTVSDDEIATALVLLLERGKTLVEGAGATALAAVLEDKFEYADGETIVPALCGGNIDLNLLTTVIVRGLVDQGRYVKIRTVLKDSPGSLNDLLATAAEERANIYAIQHDRTNRDIAMNATEVELDLETRGPEHVDRLLTRIQDEGFDVTVLNGPQIVSE

SEQ ID NO: 31281 - DNA, 1527 bp, Neisseria meningitidis Z2491
  CDS (1)..(1527): transl_table=11
atgaacacgccccttccttattccaattacctcatccgcatcctgacggcatctgtctatgatgtggcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcacgcacaaggcgtggcattgtccgcacagcgtttgggttgccgtgccgttatcgtcatgccggagactacgccgaaaatcaaagtggatgcggtcaaaagccgtggcggcgaggtggttttgcgcggtgtttcatacaacgatgcttacgattatgcgatggagctggcggaacaggaagggctgacctatatcgcaccgtttgacgatcctgatgtgattgcaggacaagggacggtagggatggaaattgtcagccagcatcccgatccaatccgcgccgtattcgtaccgataggcggtggcggtttggcggcgggcgtggcggcatttatcaagcaggtccgtcccgaaatcaaagttatcggcgttcagaccaacgattcctgctgtatgaagcagtcggtcgaagcgggtgaaatcgtccatttgaaagatgtcgggctgttttcagacggcacggcggtcaaagtcgtcggaaacgaaaccttccgtctctgcaaagaacttttggatgaaatcattacagtcgataccgatgcggtttgcggcgcggtcaaggatattttcgatgacacgcgcagcattaccgagccggcgggcgcgttggcgttggcgggtctgaaagcctatatcgcccgagaaggcgcggaaaaccaaaccctgattgccgttaccagcggtgcgaatatgaattttcaccgtttgcgccacgtttcggaacggagcgaattgggcgagggcaacgaaggtatttttgccgttaccatccctgaagaacgcggcagcttccttaagtttgtcaatatattgggaaataggaatattaccgagttcaactaccgctacggggacgatgaaaaagcgcatatctttgtcggacttcaagcggcaggcccgcaggatttggcggttatcggcagccggttggatgaggcgggattgcccaatgtcgacctgaccgatgatgagattgccaaaatccatatccgctatatggtcggagggcggacggacaaagtagaaaacgagcgtctggtcagttttgagtttccggagcgtccgggggcgttggcgcgttttttgaaccatatgcagggcggttggaacattacgctcttccattaccgcaaccacggtgcggattacgggcggattttggtcggtatcgatgtgccgcctcacgatgccgccgcatttgacggtttcttggaaagtctgggatacagctatcacgaggaaacgcaaaatgccgcgtacaagctgtttcttgcctga

SEQ ID NO: 31282 - protein, 508 aa, Neisseria meningitidis Z2491
MNTPLPYSNYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSRGGEVVLRGVSYNDAYDYAMELAEQEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNETFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGDDEKAHIFVGLQAAGPQDLAVIGSRLDEAGLPNVDLTDDEIAKIHIRYMVGGRTDKVENERLVSFEFPERPGALARFLNHMQGGWNITLFHYRNHGADYGRILVGIDVPPHDAAAFDGFLESLGYSYHEETQNAAYKLFLA

SEQ ID NO: 31283 - DNA, 1707 bp, Deinococcus radiodurans R1
  CDS (1)..(1707): transl_table=11
ttgccccccggcctattctcggcacaagacagcggcgctccgacgcctgacgcgggccgcttcctgggccagccctcctcccccgctgctggcgggggctgcgacttttgcccgtatgttctcctttctttgccgaggtttttcatgtcagacccccgccctgcccccgcccccgctcccttgcccggtacgctggacgggatggacgtgctgcggctcgcgctgaccagtcaggtctacggcgcggccaccgagacgccgctgagccccgccccgcgcctgagcgagcgcagcggcaaccgcgtgctgctcaagcgcgaggaccagcagcccattttctccttcaaattgcgcggcgcctataacaagatgagccagctcagcgccgaggaacgcgcccggggcgtgatttgcgcttcggcaggcaaccacgcacagggagtggcgtttgccggggagaagctcgggattcccgccgtcatcgtgatgcccgcgaccacgcccgacatcaaggtgcaggcgtgccgggcacggggggccgaggtgatcttgcacggcgactcgttcagcgacgccgaaaccttcgcactggcgctgcaacaggagcgcggcctgaccttcgtgcatccctacgacgacccgctggtgctggcggggcagggcaccatcgcgctcgaactgctgcggcaggtggaagaggacgactacgcggtgttcgtgccggtgggcggcggcggcctgatcgcgggggtggcgagcattctgaaagccctcaagcccggcgtgcgggtcatcggcgtggagcccgacgacagcgacgcgatgtaccagagcctgcaagcgggcgaacgggtgcggctcgacaccgtgggcattttcgtggacggggtggcggtcaagcaggtgggggcctacaccttcgacctgacccggcgttacgtggacgactgggtgcgggtgaacaccgacgaggtgtgcgccgccatcaaggacgtgttcgacgacacccgcgccgtgctggaacccgctggggcgctgagcgtggccgggctgaagaaatacgcggcgacccacggcctgcatgaccggacgctggtggcgctcacctgcggggcgaacatcaacttcgaccgcctgcgccacgtggccgagcgcaccgagataggcgagcagcgtgaggcgattctggccgtcacgattcccgagcggcccggcgcctttctggaatttatcgagctgatcggctcgcgggccatcaccgaattcaactaccgctacgctccgcgcgaagacgcccggatttttgtcggcgtgcagctcgggcagccgggcgagcgccaggaactgctgacgctgctgcgtgggcgcggctacgcggtgcttgacctcaccgaagacgaactcgccaaggtccacgtccgccacatggtcggtggccgcgcccccgaggcggtgaacgagcgggtctacgccttcaccttccccgagcggcccggcgccctgcacgactttttgacgcagctccagggcgagtggaacatcagcctctttcactaccgcaaccacggctcggcgcacgggcgggtgctggcgggcgtgcaggtgcctgacgcggcgctcacccgcttcggtgactttctcgctggcctcggctacccggcgcacgacgtgacgagcaatccggcgtaccggctgttcctgacctga

SEQ ID NO: 31284 - protein, 568 aa, Deinococcus radiodurans R1
MPPGLFSAQDSGAPTPDAGRFLGQPSSPAAGGGCDFCPYVLLSLPRFFMSDPRPAPAPAPLPGTLDGMDVLRLALTSQVYGAATETPLSPAPRLSERSGNRVLLKREDQQPIFSFKLRGAYNKMSQLSAEERARGVICASAGNHAQGVAFAGEKLGIPAVIVMPATTPDIKVQACRARGAEVILHGDSFSDAETFALALQQERGLTFVHPYDDPLVLAGQGTIALELLRQVEEDDYAVFVPVGGGGLIAGVASILKALKPGVRVIGVEPDDSDAMYQSLQAGERVRLDTVGIFVDGVAVKQVGAYTFDLTRRYVDDWVRVNTDEVCAAIKDVFDDTRAVLEPAGALSVAGLKKYAATHGLHDRTLVALTCGANINFDRLRHVAERTEIGEQREAILAVTIPERPGAFLEFIELIGSRAITEFNYRYAPREDARIFVGVQLGQPGERQELLTLLRGRGYAVLDLTEDELAKVHVRHMVGGRAPEAVNERVYAFTFPERPGALHDFLTQLQGEWNISLFHYRNHGSAHGRVLAGVQVPDAALTRFGDFLAGLGYPAHDVTSNPAYRLFLT

SEQ ID NO: 31285 - DNA, 1143 bp, Xylella fastidiosa 9a5c
  CDS (1)..(1143): transl_table=11
gtgcaatactgccgctggattttcttagcaggcacgagtcagcatggcatgccatcaggatgtgtgcagatcatcaggacgtatagctctatggatatacctgatgtaggtcacaccgttgtcaagcaacccaatgcaagtaacgtcaacaccgtgagtgtggccgatgtgttggctgcacaagcccgcttacgtcgttatctaatgcctaccccaattcactatgccgagcgtttcggagtgatgctgaagttggaaaatctgcaacgcaccggatcctataaagtgcgtggcgcgctgaacgcaatgttagttgcgctggaacgcggcgataaccgcccagtcatttgcgcatcagccggtaaccacgcccaaggcgtagcttggtcagcttaccggctgggtatacaagcaatcactgtcatgcctcacggtgctccggtcacgaaggttgcaggtgtctcacattggggggcgacggtacgccaacacggccaaagctatgacgaggcctatgcgttcgcatgtgagttggctgagcaaaacgattaccactttctatcagcattcgatgatccggatgtgattgccggtcagggaactgttggcatagagatcaccgcgcatgaaccggatgtagtcatcgtgccgatcggcggcggcggccttgcttcaggcattgctttggtgctgcgctcgcagggagtacgtgtcattggcgctcaggtcgagggcgtggatgcgatggcgcgtgcaatccgtggcgacacacgcgagatcgctccagtttcgaccttagctgacggggtgaaagtcaagattcctggtttcattacccgccgtctgtgtgccaacttgttagacgatgtagtgatcgtgcgtgaggctgaactgcgcgaaacattggtgcgtttagtattggaagaacacctgatcgccgaaggggcaggcgcactggcattggccgctggccgccgcgttgcaggtaagcgcaagtgtgcagtggtctccggaggtaatattgacgctgcagtactggccaaactgttgtccgaagtaagaccacggccaccccgcaaaccacgtaggcgtagtgcagatcgccccaacaattgcggcaatttaccgctcccttttaactga

SEQ ID NO: 31286 - protein, 380 aa, Xylella fastidiosa 9a5c
MQYCRWIFLAGTSQHGMPSGCVQIIRTYSSMDIPDVGHTVVKQPNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPVTKVAGVSHWGATVRQHGQSYDEAYAFACELAEQNDYHFLSAFDDPDVIAGQGTVGIEITAHEPDVVIVPIGGGGLASGIALVLRSQGVRVIGAQVEGVDAMARAIRGDTREIAPVSTLADGVKVKIPGFITRRLCANLLDDVVIVREAELRETLVRLVLEEHLIAEGAGALALAAGRRVAGKRKCAVVSGGNIDAAVLAKLLSEVRPRPPRKPRRRSADRPNNCGNLPLPFN

SEQ ID NO: 31287 - DNA, 1218 bp, Sulfolobus solfataricus P2
  CDS (1)..(1218): transl_table=11
atgaattacttagaatattttgatagaattagactagcaaaagagaaaatagaaaaatatgtgcatattactccaatagattattctacaacgttttccagaattataaacgcaaaagtttatcttaagttggaaaatctacagaaaactggatcattcaaagttagaggtgcctttaataagttattatctttaaaggaggaagaaaaaaagaatggcgttattgcagtttcagcaggtaatcatgctcaaggagttgcttatgcagcctccacgttaaatatcaaatcgactatagtgatgccagaaacagctccagcttccaagtatttagctacaaaatcctatggggcagaagtagttctttatggtaagtacttgcatgagagtatgaagaaagcggaagaattgattcaaaatactggtttaatatttgttcatccttatagtgatttagatgtgataacgggtcaaggtaccataggattagaattgtatgatatcgaaccagattacgtaattattccaatagggggtggaggattgatttctggtataagtatagctttaaagtatagattcccaaacgtcaagataataggcgttcagtcttcttcttctccttcaatgaaggtttctaaggatcttgggaggcttgtagaaatagagcctagttattccatagctgatggcatattggttaagtctccttctgaattaacctttagtataattaatgagttagtagatgatatagtattagtggatgatgaagaaatagctgaggcaatagttttactacttgaaagaagtaaaacgctagcagaaggagcaggagctgcagcattagcgtcactaatttcagggaaggttaaagtaaatggaatagacaaaaaagtaatttcattagtaagtgggggaaatattgacttatcattattgtctactctaacagagaagtttttatatagacaaaaaagggtagtcaaagtgagggtaatagttccagataagccaggacagttaaataaagtattaagctatgtagttaagatcagaggtaatataatagatattgttcatgataggcacagtagtgatgtattgcctggatacactaaaatatatataactttcgagcttcagtcttcagaggctattaccttacttctgacaaatctggcaaacgagggaatagacgtgaaaattgtagaatag

SEQ ID NO: 31288 - protein, 405 aa, Sulfolobus solfataricus P2
MNYLEYFDRIRLAKEKIEKYVHITPIDYSTTFSRIINAKVYLKLENLQKTGSFKVRGAFNKLLSLKEEEKKNGVIAVSAGNHAQGVAYAASTLNIKSTIVMPETAPASKYLATKSYGAEVVLYGKYLHESMKKAEELIQNTGLIFVHPYSDLDVITGQGTIGLELYDIEPDYVIIPIGGGGLISGISIALKYRFPNVKIIGVQSSSSPSMKVSKDLGRLVEIEPSYSIADGILVKSPSELTFSIINELVDDIVLVDDEEIAEAIVLLLERSKTLAEGAGAAALASLISGKVKVNGIDKKVISLVSGGNIDLSLLSTLTEKFLYRQKRVVKVRVIVPDKPGQLNKVLSYVVKIRGNIIDIVHDRHSSDVLPGYTKIYITFELQSSEAITLLLTNLANEGIDVKIVE

SEQ ID NO: 31289 - DNA, 1038 bp, Sulfolobus solfataricus P2
  CDS (1)..(1038): transl_table=11
gtgattagtagtatggtaaaagaggtttgtatgaaatgcagaaaggaaagggaaagtatatacgagattaagtgtaacaaatgcggaggaccattcgagatcctgatagattttgaatttgataagaattctgagagaggttttccctatagtgaaaagattttcccttacatcaaacatttcatatccctaggagagggaagaactccattaattaaaaaggggaacatatggtttaaactcgacttcttaaatccatcaggatcatacaaggatagaggagcagtgactctggtctcttatcttgcggaaaaaggtgtaaaacaaattagtgaagactcttctggaaatgcaggatcagcaatagctgcgtattctgcagctgctggtattgaggcatacattttcgttcctgaaacggcaaaaggaggaaaacttaagcaaatagaatcctacggtgctcacgttgttagagtaagggggagtagagaagatgtagcaaaagctgcagagaattctggttactattacgcatcacatgttttacaacctcaatttagagatgggattagaactctggcatatgaaattgtaaaggatttagattggaaaattcctaattatgttttcattccagtatcagcaggaactttacttttaggtgtttataaggggttcaagcacttgctagattctggtgtcatatcggaaatgcctaaaatcgtagcagtccaaacagagcaagttatgccactttgtgctaaattcaaaaagatttcttacacaccaccagacaaggttacctccattgcagacgctttagtatcaactagaccatttctactagattatatggtaaaggcttctagtgaatgcatagttgtaagcgataatgaaatagtagaagcttggaaagaattggctaaaatgggactgctggtagaatatagttctgctactgtatttgctgcttataagaaatacagtgttaacgatgcagtattagttttaaccggtagcggattaaaggtattatga

SEQ ID NO: 31290 - protein, 345 aa, Sulfolobus solfataricus P2
MISSMVKEVCMKCRKERESIYEIKCNKCGGPFEILIDFEFDKNSERGFPYSEKIFPYIKHFISLGEGRTPLIKKGNIWFKLDFLNPSGSYKDRGAVTLVSYLAEKGVKQISEDSSGNAGSAIAAYSAAAGIEAYIFVPETAKGGKLKQIESYGAHVVRVRGSREDVAKAAENSGYYYASHVLQPQFRDGIRTLAYEIVKDLDWKIPNYVFIPVSAGTLLLGVYKGFKHLLDSGVISEMPKIVAVQTEQVMPLCAKFKKISYTPPDKVTSIADALVSTRPFLLDYMVKASSECIVVSDNEIVEAWKELAKMGLLVEYSSATVFAAYKKYSVNDAVLVLTGSGLKVL

SEQ ID NO: 31291 - DNA, 1191 bp, Sulfolobus solfataricus P2
  CDS (1)..(1191): transl_table=11
atgaagtgcttgaattgtggatatgaaacggaaatagatcaaagtcagatattatgtccaagatgtggaggactattagaaattatactagaaccaccaaaggacttctctttcagtaaattgagaggaagaggagtttggagatataaagaattaatagcaggcagatacaaaaatattgtaagcataaatgagggaaataccccactaattagatcctcaaatataaatgataatctttattttaaatttgaagggcttaatccaactggtagttttaaggatagaggaatgacagtggcagttagttctgcggtaagcttgaattacaaaactgtaatagccgcatccactggaaatactgcagcttctgcagctgcttatgctgcaagagctggtataaagagctttatcgtcttacctaaaggtaaggtagcattaggtaaattagctcaatcaatactttatggctcagttattttagaagttgatggaagttttgacgttgctatggatgcagtaatgagattatataaggatttaaaagtagtatatccattaaattcctttaatccatggagattagaaggacaaaagacaatcgcatttgagatagcagaagaactaggagttcctgacaacgtgatagtcccggtaggcaatgcaggcaatatctacgccatatggaaaggatttaatgagctagttaaaactggagttattaatactattcctagaatgattggaatccaagctgagggcgcatcaccaatagttaccgcaataataaaaggaaaagattctccagatttcatagaaaatccagatactgtagcaacagcaataaggatagggaaaccagttaattggcaaaaagcgatgaaagcaataagggaatctaatggaaccgcaatagctgtatctgattccgagatattagacgcacagaagaccctagctagaaaagagggcataggagctgagcctgcttcagcagctgccttagctggttatattaaggcaataaatgaaaaggtggtagataaagatgaaaaaacagttttaatcctaacaggacattcgttaaaggatcccgatagtatgacaaaagctgaggctaaaagaatattagttaatcctttacatatggaaaaaattatcctaggtgagataaatggctctaatagttaa

SEQ ID NO: 31292 - protein, 396 aa, Sulfolobus solfataricus P2
MKCLNCGYETEIDQSQILCPRCGGLLEIILEPPKDFSFSKLRGRGVWRYKELIAGRYKNIVSINEGNTPLIRSSNINDNLYFKFEGLNPTGSFKDRGMTVAVSSAVSLNYKTVIAASTGNTAASAAAYAARAGIKSFIVLPKGKVALGKLAQSILYGSVILEVDGSFDVAMDAVMRLYKDLKVVYPLNSFNPWRLEGQKTIAFEIAEELGVPDNVIVPVGNAGNIYAIWKGFNELVKTGVINTIPRMIGIQAEGASPIVTAIIKGKDSPDFIENPDTVATAIRIGKPVNWQKAMKAIRESNGTAIAVSDSEILDAQKTLARKEGIGAEPASAAALAGYIKAINEKVVDKDEKTVLILTGHSLKDPDSMTKAEAKRILVNPLHMEKIILGEINGSNS

SEQ ID NO: 31293 - DNA, 1251 bp, Streptococcus pneumoniae TIGR4
  CDS (1)..(1251): transl_table=11
atgttaagttcaaaagatataatcaaggctcacaaggtcttgaacggtgtggttgtgaatactccactggattacgatcattatttatcggagaagtatggtgctaagatttatttgaaaaaagaaaatgcccagcgtgttcgctcctttaaaattcgtggtgcctattatgccatttcccagctcagcaaggaagaacgtgaacgtggggtagtctgcgcttctgcgggaaatcatgcgcagggagtagcctatacttgtaatgaaatgaaaattcctgctactatctttatgcccattactacgccacaacaaaagattggtcaggttcgcttttttggtggggattttgtaactattaaactagttggagatacctttgatgcctcagccaaagcagctcaagaatttacagtctctgaaaatcgtacctttattgatccttttgatgatgctcatgttcaagcaggtcaaggaacagttgcttatgagattttagaagaagctcgaaaagaatcgattgattttgatgctgtcttggttcctgttggtggtggcggtctcattgccggggtttctacctatatcaaggaaacaagtccagagattgaggttatcggagtagaggcgaatggagcgcgttccatgaaagctgcctttgaggctggaggtccagtaaaactcaaggaaattgataaatttgctgatgggattgctgtgcaaaaggtaggtcagttgacctatgaagcaactcgtcaacatattaaaactttggtaggtgtcgatgagggattgatttctgaaaccttgattgacctttactctaagcaagggatagtcgcagaacctgctggagcggctagtatcgcctctttagaggttttagctgaatatattaaggggaaaaccatttgttgtatcatttctggaggaaataatgatatcaaccgtatgccagaaatggaagagcgtgccttgatttatgatggtatcaaacattactttgtggtcaatttcccacaacgtccaggagctttgcgtgagtttgtaaatgatatcctggggccaaatgatgatatcacacgttttgagtatatcaaacgagctagcaagggaacaggcccagtattaattgggatcgctttagcagataagcatgattatgcaggtttgattcgtagaatggaaggttttgatccagcttatattaacttaaatggtaatgaaacgctttataatatgcttgtctga

SEQ ID NO: 31294 - protein, 416 aa, Streptococcus pneumoniae TIGR4
MLSSKDIIKAHKVLNGVVVNTPLDYDHYLSEKYGAKIYLKKENAQRVRSFKIRGAYYAISQLSKEERERGVVCASAGNHAQGVAYTCNEMKIPATIFMPITTPQQKIGQVRFFGGDFVTIKLVGDTFDASAKAAQEFTVSENRTFIDPFDDAHVQAGQGTVAYEILEEARKESIDFDAVLVPVGGGGLIAGVSTYIKETSPEIEVIGVEANGARSMKAAFEAGGPVKLKEIDKFADGIAVQKVGQLTYEATRQHIKTLVGVDEGLISETLIDLYSKQGIVAEPAGAASIASLEVLAEYIKGKTICCIISGGNNDINRMPEMEERALIYDGIKHYFVVNFPQRPGALREFVNDILGPNDDITRFEYIKRASKGTGPVLIGIALADKHDYAGLIRRMEGFDPAYINLNGNETLYNMLV

SEQ ID NO: 31295 - DNA, 1314 bp, Agrobacterium tumefaciens str. C58
  CDS (1)..(1314): transl_table=11
ttgtctccgacgccttcctatggcatagcgggtgccattatgaatttcaatggattgactatcgtggacaagcagcttgtggaagcagcgcggcgggaagtgcgggagatattcccggaaacgccgctgcagttgaatgaacatctcagccgtcgctatggcgcatcgatttggctgaagcgtgaggatctgtccccggttcgttcctacaagattagaggcgcattcaattttctccgcaaggcggtggccaaggctggcaaggacaaggttttcgtctgcgcgtccgccggcaaccacgcccagggctttgctttcgcctgccgccatttcggcgttcacggcgtcgttttcatgccggtgacgacaccgcagcagaagatcgaaaaaacccgcatctttggcggagagttcatcaagatccgtctggtgggcgatatcttcgaccagtgttacgccgctgcgcgtcagcatgtgcaggaccatgacggctacatggttccgccctttgaccatgaggatattatcgaaggccaggcgacggtcgccgccgagatcatggaccagctgcccgaaggcaccaaacctgacatcgtcgtgatgcctgtcggtggtggcggtctttcggccggcctgaccgggtttctggccggcacggtgaagaaggagaacttcgtgttctgcgagccggaaggcgcgcccagcctgaaaaagagcctggaacgtggcgaaccggtgacgctgaacaaggtcgacaattttgtcgatggtgccgccgttgcccgcatcggcgacctgaacttcaaggcgctgaaggattttccggccgagcaggtgatgctcatcccggaaaatgcgatctgcgtgacgatcatcgagatgctgaacctagaaggcgtggtgctggagcctgcgggcgccctgtccatcgccgcgctggaaaggctcggccgcgagaggctggaaggcaagacggtcatcgccgtggtctccggcggtaatttcgatttcgagcgcctgccggacgtcaaggaacgcgccatgcgttacaccggcgtgaagaagtacttcatcctgcgcctgccgcagcgccccggcgcgctgcgcgatttcctcaatctgctcggtccggacgacgatatcgcccgtttcgaatatctgaagaaatccgcccgcaatttcggctcgatcctgatcggcatcgagaccaatgcgcaggaaaacttcgccgggttgctggagcgcttcgaggcagccggtctcggctatgaggatattaccgaaaacgacatcttgtcgaacctgatcatctga

SEQ ID NO: 31296 - protein, 437 aa, Agrobacterium tumefaciens str. C58
MSPTPSYGIAGAIMNFNGLTIVDKQLVEAARREVREIFPETPLQLNEHLSRRYGASIWLKREDLSPVRSYKIRGAFNFLRKAVAKAGKDKVFVCASAGNHAQGFAFACRHFGVHGVVFMPVTTPQQKIEKTRIFGGEFIKIRLVGDIFDQCYAAARQHVQDHDGYMVPPFDHEDIIEGQATVAAEIMDQLPEGTKPDIVVMPVGGGGLSAGLTGFLAGTVKKENFVFCEPEGAPSLKKSLERGEPVTLNKVDNFVDGAAVARIGDLNFKALKDFPAEQVMLIPENAICVTIIEMLNLEGVVLEPAGALSIAALERLGRERLEGKTVIAVVSGGNFDFERLPDVKERAMRYTGVKKYFILRLPQRPGALRDFLNLLGPDDDIARFEYLKKSARNFGSILIGIETNAQENFAGLLERFEAAGLGYEDITENDILSNLII

SEQ ID NO: 31297 - DNA, 915 bp, Agrobacterium tumefaciens str. C58
  CDS (1)..(915): transl_table=11
gtggagcgcacgccgctggttcgctcggagtttctctccgaacgctgcggtcatcctgttcatctcaaacttgaaacccttcagcctatcggcgccttcaaactgcgcggcgcgatgaacgcgatcctctcgcttgacgatgcggtgcgacggcgtggcctagtcaccgcctcgacgggcaaccatggtcgggccgttgcttacgccgccgccaaactcggcattcccgccacgatctgcatgtcggcgctggtgccggcaaacaaggttgaggcgatccgcatgcttggcgcggaaatccggattgtcggcagatcacaggatgatgcgcaggaggaagtggagcgcctgacaaaaaaccgaggcctgaccgcgatcccacctttcgatcatgctgacgtcgtggccggccagggcactatcggcctcgaggtcgttgaagacatgcctgaactggcgacaattctcgttcctctatcgggcggtggccttgcgggcggtatcgccgttgcggtgaaggcgctgaagccaagggcgcgggttatcggcatttccatggaacgaggtgcggccatgcatgcgtcagtgaaagccggccgccccgtctcggtttgcgaggaagaaacgctggcggattcgcttggcggcgggattggactggcaaaccgcgtgacctttgcactttgcaagacacttctcgatgagatcgtgctggtctccgaagatgaaatcgcgaccggcatctgccatgcatcccgcgaggaagacctgagagtggaaggcgcgggcgccgttggcttcgcagcaatcctcgccggcaagatcgcggtgagcggccctgccgccatcatcgtatcgggcgggaatatcgatccggcggtccacaagacgatcatcgacgggggagtcgcatga

SEQ ID NO: 31298 - protein, 304 aa, Agrobacterium tumefaciens str. C58
MERTPLVRSEFLSERCGHPVHLKLETLQPIGAFKLRGAMNAILSLDDAVRRRGLVTASTGNHGRAVAYAAAKLGIPATICMSALVPANKVEAIRMLGAEIRIVGRSQDDAQEEVERLTKNRGLTAIPPFDHADVVAGQGTIGLEVVEDMPELATILVPLSGGGLAGGIAVAVKALKPRARVIGISMERGAAMHASVKAGRPVSVCEEETLADSLGGGIGLANRVTFALCKTLLDEIVLVSEDEIATGICHASREEDLRVEGAGAVGFAAILAGKIAVSGPAAIIVSGGNIDPAVHKTIIDGGVA

SEQ ID NO: 31299 - DNA, 1215 bp, Sulfolobus tokodaii str. 7
  CDS (1)..(1215): transl_table=11
atgtcttatacaaaatattttgatgaaatagtaaaaattcaagatagaattaaacaatatattcatgagacgcctattgattactcaaaaaccttttctgatatgattggagctcaaatatatttaaagcttgaaaatttgcagaaaacaggttcttttaaggtaagaggagctttttcaaaattgacaagcctagccgaagaagaaaggaaaaaaggtgttatagcggtttccgcgggtaatcatgctcaaggtgttgcatatgctgcaaaagttttaggaattaaagcaactatagtaatgccagaaactgctccaatctcaaaatatcaagctacaaagtcatacggtgctcaagttattttgtatgggaaatttcttcatgagagtatgaaaaaagctgaggagattataagagaagaaggaagtattcttgttcatccttacggagatcttgatgtaattttgggtcaaggtacattaggactagaacttttgccatataatccagatattgttgttgttcctataggagggggaggactaatatcaggaatatctatagcattaaaagcaaaaaatccaaaaaccaaaataataggtgtacaatcttcagcttctccttcattaaaggtctcaaaagatcttcataggctagtagagattgagccctctttttcgatagcagatggaattctagtaaaatctccctctgaaataacgtttagcataatagatgaattagtggatgatattgttcttgttgatgatgaagaaatagcaaatgctatagtatatttattagaaagaaataaaacattagtagaaggagcagctgctgcttcattagcagcacttttatctggaaagattaaagttgcttataatcataaagctattccggttctaagtgggggcaatatagatctttcaatgttatccagaattatagataagatgcttttcaagaataaacgaatagtcaaagtgaaggtaatagtaccagataaacctggatatcttaataaagtattaagtagagtagcacaaataagagggaacgttatcgatgtagttcatgatagaacaagcagtgatgttaaacctggttatactaaaatttatgtaatgtttgaagtacctagtggtgatgctctttcagatttcatgtacaacttagctttagatggtattgaggctaaattagtagaatag

SEQ ID NO: 31300 - protein, 404 aa, Sulfolobus tokodaii str. 7
MSYTKYFDEIVKIQDRIKQYIHETPIDYSKTFSDMIGAQIYLKLENLQKTGSFKVRGAFSKLTSLAEEERKKGVIAVSAGNHAQGVAYAAKVLGIKATIVMPETAPISKYQATKSYGAQVILYGKFLHESMKKAEEIIREEGSILVHPYGDLDVILGQGTLGLELLPYNPDIVVVPIGGGGLISGISIALKAKNPKTKIIGVQSSASPSLKVSKDLHRLVEIEPSFSIADGILVKSPSEITFSIIDELVDDIVLVDDEEIANAIVYLLERNKTLVEGAAAASLAALLSGKIKVAYNHKAIPVLSGGNIDLSMLSRIIDKMLFKNKRIVKVKVIVPDKPGYLNKVLSRVAQIRGNVIDVVHDRTSSDVKPGYTKIYVMFEVPSGDALSDFMYNLALDGIEAKLVE

SEQ ID NO: 31301 - DNA, 1188 bp, Sulfolobus tokodaii str. 7
  CDS (1)..(1188): transl_table=11
atgcaaggctatctaaaatgcttagactgtggatcagaatatcctatccaacaagatattataacttgtcctaaatgtggaggattattagagataattgttgaacctaagaaagacttctcattcagtaaactaaaagggaaaggagtttggagatatagagaattaatagctggagaatacaaacatatagttagtttaaatgaaggaaataccccactaattgcttcttctactaataaaaatctatattttaagtttgaaggagccaaccctactggaagttttaaagatagaggaatgacagtagctataagttccgctaaatcattaaactataaagttgtagtagctgcatctactggaaatactgcagcttcagccgctgcatatgcaagtagagctggtttaagaagttacattgtattacctaaaggaaaagttgctttaggaaaattggctcaatctatactttatgggactactatacttgaagttgatggcagttttgatgttgctatgaatagtgtaatgaaattatatagagaactaaaaatagtttatccgcttaactcttttaatccatggagacttgaaggacaaaaaactattgcttttgaaatagttgaggatattggagtacctgataatgtgatagtacccgtaggtaatgccggaaacatttatgctatatggaagggatttgtagagttaatgaatattggggttaccgataaagtacctagaatgattgggatacaagctgaaggagcagcgccaatagctaaggctctagaaaaaggattagataaaccggaatttatagattcacctgaaactgtagcctctgctataagaataggtaaaccagtgaactggaaaaaagcaattaaggctataaaatcatctaatggatttgcaacttatgtttctgactctgagatcttagaggcgcaaaaagaattagctaggagagagggaataggtgcagaacctgcatcagctgcttcctatgctggttatttaaagcttgtaaattctggcaaaattgataaaagcgaaaaaactgttttaattttaactgggcatgcgctaaaggacccagatgcgatgataaaagctgaatcacgaagaattttagttaacccagaacatataaatgaaataatcttgagtgatctaaaatga

SEQ ID NO: 31302 - protein, 395 aa, Sulfolobus tokodaii str. 7
MQGYLKCLDCGSEYPIQQDIITCPKCGGLLEIIVEPKKDFSFSKLKGKGVWRYRELIAGEYKHIVSLNEGNTPLIASSTNKNLYFKFEGANPTGSFKDRGMTVAISSAKSLNYKVVVAASTGNTAASAAAYASRAGLRSYIVLPKGKVALGKLAQSILYGTTILEVDGSFDVAMNSVMKLYRELKIVYPLNSFNPWRLEGQKTIAFEIVEDIGVPDNVIVPVGNAGNIYAIWKGFVELMNIGVTDKVPRMIGIQAEGAAPIAKALEKGLDKPEFIDSPETVASAIRIGKPVNWKKAIKAIKSSNGFATYVSDSEILEAQKELARREGIGAEPASAASYAGYLKLVNSGKIDKSEKTVLILTGHALKDPDAMIKAESRRILVNPEHINEIILSDLK

SEQ ID NO: 31303 - DNA, 1248 bp, Sinorhizobium meliloti 1021
  CDS (1)..(1248): transl_table=11
atgaagcaggatgttgaaaaagcggcagcggcgatgcgcgagatctttccgccgacgccgcttcagctcaacgagcacctgagcgcgcgctgtggggcgaccgtcttcctgaagcgcgaggacctttcgccggtgcgctcctacaagatccgcggcgccttcaatttcttccgcaagtcgctcggctccggagcggccgggaagaccttcgtttgcgcttccgcgggcaatcacgctcagggctttgctttcgtctgccgccacttcggcgttcccggagtcgtcttcatgcccgtgacgacgccccagcagaagatcgacaaaacgcgcatgttcggggccgagttcatcacgatccgcctcgtcggcgatattttcgatcaatgctacaaggcggcgcgcgagcatgtggaagcgatcggcggcgtcatggtgcctcccttcgaccatgacgatatcatcgaaggccaggccacggttgcagcggagatagccgaacaattgccggccggccccgttgccgatctcgtcgtcctgcccgtcggcggcggcggcttggccgcgggcgtgaccgggtatttgggcgacagcctctcggccgaccgttttctgttctgtgaaccggagggggcgccgagcttcaggcgcagcctggaactcggcggcgtcgtcacgctcgaccaggtggacaatttcgtcgatggcgcggcggtcgcacggatcggcgacctgaactttgctgcgctccggagattttcgccggaacaggtgatgctgctgcctgagaatgcgatctgcctgacgatcaccgaaatgctgaatgtcgagggcgtggttctcgaacccgccggcgcgcttgcaatcaccgcactggaagcgcttggccgcgatagtctcgaaggcaagatcgtcgtagcggtcgtttccggaggcaatttcgacttcgagcgcctgccggacgtgaaggagcgggccatgcgccatgcggggctcaagaaatacttcatcctgcgcatggcgcagcgtccgggcgcgcttcgcgatttcctcggtctcctgggagaggaggacgacatcgcccggttcgaatacctgaaaaagtctgctcgaaacttcggctccgtgctcatcggtatcgaaacgaaacacgcggagaatttccccgttctcaaacagcgtttcgatgcggcgggtctccgctaccaggacatcaccgagaacgagatgctggccaacttcgtcatttga

SEQ ID NO: 31304 - protein, 415 aa, Sinorhizobium meliloti 1021
MKQDVEKAAAAMREIFPPTPLQLNEHLSARCGATVFLKREDLSPVRSYKIRGAFNFFRKSLGSGAAGKTFVCASAGNHAQGFAFVCRHFGVPGVVFMPVTTPQQKIDKTRMFGAEFITIRLVGDIFDQCYKAAREHVEAIGGVMVPPFDHDDIIEGQATVAAEIAEQLPAGPVADLVVLPVGGGGLAAGVTGYLGDSLSADRFLFCEPEGAPSFRRSLELGGVVTLDQVDNFVDGAAVARIGDLNFAALRRFSPEQVMLLPENAICLTITEMLNVEGVVLEPAGALAITALEALGRDSLEGKIVVAVVSGGNFDFERLPDVKERAMRHAGLKKYFILRMAQRPGALRDFLGLLGEEDDIARFEYLKKSARNFGSVLIGIETKHAENFPVLKQRFDAAGLRYQDITENEMLANFVI

SEQ ID NO: 31305 - DNA, 978 bp, Caulobacter crescentus CB15
  CDS (1)..(978): transl_table=11
atgaccgtctcgctcgccgacatccaagccgccgccgtacgcctgaagggctcggccgtcgagacgccgctgatcgagagccccgccttgaacgacaggctgggcgggcggatcttcctcaagcccgagaccttgcaacgtgccggcgccttcaagtttcgcggcgcctacaaccgtctttctcagctcagcgatgaggaaaaggcgcgcggcgtcgtggccttctcgtccggcaatcacgcccaaggggtggcgctggcggccaggctgctgggcgtgccggcgctgattgtgatgccctccgattcgcccagcgtgaaggtcgaaggcacgcgcgggtttggcgcggacatccgcttctacgaccgcttcaccgaggaccgcgtcgccatcgccgaccagatcgcggccgagcgcggctgcgtggtcgtgccctcgtatgacgacccgcacatcatcgccggccagggcacggtgggtctggagatcgtcgcccaggccgccgcgcaaggcgcgacgctggaccgcctgatctgctgcgtcggcggcggcggtctgatcgccggaacctcgacggcggtgaaggccctctcgccggccaccgagatctggggcgtggagcccgccggcttcgacgagacgcggcgctcgctggaaagcggccggcgcgagaccatcgacaaggacgcccgctcgatctgcgacgccctgctgaccccgatccccggcgacctgacctggccgatcaaccagaaaaacctctcaggcgtggtcgcggtgaccgacgccgaggtggccgaggcgatgcgctatgcgttctcgaccttgaaactggtggtggagcccggcggctgcgtggccctgacggcggcgctgacaggcaaggtcgacgtcgccggcaagaccgtggcgatcgtgctgtcgggcggcaatgtcgatccggggttgttcgcgcaggtcttgggcggtcaaatctga

SEQ ID NO: 31306 - protein, 325 aa, Caulobacter crescentus CB15
MTVSLADIQAAAVRLKGSAVETPLIESPALNDRLGGRIFLKPETLQRAGAFKFRGAYNRLSQLSDEEKARGVVAFSSGNHAQGVALAARLLGVPALIVMPSDSPSVKVEGTRGFGADIRFYDRFTEDRVAIADQIAAERGCVVVPSYDDPHIIAGQGTVGLEIVAQAAAQGATLDRLICCVGGGGLIAGTSTAVKALSPATEIWGVEPAGFDETRRSLESGRRETIDKDARSICDALLTPIPGDLTWPINQKNLSGVVAVTDAEVAEAMRYAFSTLKLVVEPGGCVALTAALTGKVDVAGKTVAIVLSGGNVDPGLFAQVLGGQI

SEQ ID NO: 31307 - DNA, 1203 bp, Caulobacter crescentus CB15
  CDS (1)..(1203): transl_table=11
atgaccctcgacctcgccgctatccaggccgccgccggccgtctccagggccagatcgagcgcacgccgtgccgccactccaagaccctctcgaagatcaccggcgccgaggtgtgggtgaagttcgagaacctgcagttcaccgccgcctacaaggagcgcggcgcgctcaacaagctgatgctcctctcggagaccgagaagcagcgcggcgtcatcgccgccagcgccggcaaccacgcccagggcttggcctatcacggcgcgcgcctcggcgtgccggtcaccatcgtcatgcccaagaccacgcctttcgtgaaggtgcagcacacccgcgacttcggcgcgaccgtggtcatcgagggcgagacctatgacgacgccaacgcccatgcccgcaagctgcgcgacgagcagggcctgaccttcgtccacccgttcgacgactacgacatcatggccggacagggcaccatcgccctggaaatgctggaagacgcgcccgatctggagatcctgcccgtgccgatcggcggcggcggcctgatcagcggcgtggcgacggcggccaaggcgctgaagccggatatccgcatcatcggctgcgagccggccatgtatccgtccttcaccgccaagatgcgcggtgtcgccgcccactgcggcggccagaccatcgccgaaggggtcgcggtcaagcaggtcggcgagctgacctatggcgtcgttcgcccgttgctggacgacgtgctgctgctggaagagccctatctggagcaggccgtctcgctctattgcaatgtcgagaagaccatcgccgagggcgcgggcgcagcctcgctggccgctttgctggcctatcccgaacgcttccggggcaagaagtgcggcctgatcctgtgcggcggcaatatcgacacccgcctcttggcctcggtgctgacccgcgaactggtgcgcgcccagcgcctggccagcttgcgaatcatcggcgacgaccgtccgggcctgttgtcgaccgtcgcctcggtcatcggcgccatgggcgccaacatcatcgaagtgaatcacaaccgcctggccctggacgtgccggccaagggcgcggagttcgacatcaccatcgaaacccgcgacgcccagcacacccaggaggtcatggaggccctgcgcgagagcggctacccgccgcgggtggtttga

SEQ ID NO: 31308 - protein, 400 aa, Caulobacter crescentus CB15
MTLDLAAIQAAAGRLQGQIERTPCRHSKTLSKITGAEVWVKFENLQFTAAYKERGALNKLMLLSETEKQRGVIAASAGNHAQGLAYHGARLGVPVTIVMPKTTPFVKVQHTRDFGATVVIEGETYDDANAHARKLRDEQGLTFVHPFDDYDIMAGQGTIALEMLEDAPDLEILPVPIGGGGLISGVATAAKALKPDIRIIGCEPAMYPSFTAKMRGVAAHCGGQTIAEGVAVKQVGELTYGVVRPLLDDVLLLEEPYLEQAVSLYCNVEKTIAEGAGAASLAALLAYPERFRGKKCGLILCGGNIDTRLLASVLTRELVRAQRLASLRIIGDDRPGLLSTVASVIGAMGANIIEVNHNRLALDVPAKGAEFDITIETRDAQHTQEVMEALRESGYPPRVV

SEQ ID NO: 31309 - DNA, 972 bp, Sinorhizobium meliloti 1021
  CDS (1)..(972)
atgcgcaattaccccaccattcaggacatccgtgaagcccgggaacggctgaaaccgcacgtcaggcacacgccgctcttgcgtgcggagaaaatcgagaaggccgctggctgtcagctttatctcaaacccgaaaccctgcagatcactggcgccttcaagatccgcggcgccctgaacaaggctctctcgctctcgagagaagagatcgcaaacggcattatcgcgacgtcgtcgggcaaccatgcccaggggctttcttacgcggccaagatgctcggcgtaaaagtgatattggtacttccggtcaccacacccaaaatcaagattgaaaatacaaaagccctgggtgcggaagtcattctttttgatggtgataatgctgctagatggaaaaaggtctacgaaatcgctgaaggaaacaagtatgcggttattcacggcttcgaggaccccgttgtaatggctggccagggaacgatcgggtgcgagatactcgaagacctggacgatgtagatacggtcatcgttcccttaggcggcggaggcctgatctcgggaatcgctaccgccataaaagaaacgaaaccatcggtgcgcgttatcggggcagagcctgccttgacaccgaagtattttcacagccgggtaaacaaggagcgcacatcgcttcccttgaagaacaccattgcggatggcttgaggataagcgttccgggtcaaaacccgtatccgattatcgaaaagtatgtggacgagattgttcttgttgaagacgagcacatcatcgccgggatgcgtgctcttgccaaggatgcgaaattgatcgctgaaccagccgcctcgattggcgtcggagcactgttggcgggcatcatagacgtcaagctggatgaaaaagtctgtgcggtgttgtctggcgggaactgggatctacgcgaccttgccgcgatatacaatgtagcggggtaa

SEQ ID NO: 31310 - protein, 323 aa, Sinorhizobium meliloti 1021
MRNYPTIQDIREARERLKPHVRHTPLLRAEKIEKAAGCQLYLKPETLQITGAFKIRGALNKALSLSREEIANGIIATSSGNHAQGLSYAAKMLGVKVILVLPVTTPKIKIENTKALGAEVILFDGDNAARWKKVYEIAEGNKYAVIHGFEDPVVMAGQGTIGCEILEDLDDVDTVIVPLGGGGLISGIATAIKETKPSVRVIGAEPALTPKYFHSRVNKERTSLPLKNTIADGLRISVPGQNPYPIIEKYVDEIVLVEDEHIIAGMRALAKDAKLIAEPAASIGVGALLAGIIDVKLDEKVCAVLSGGNWDLRDLAAIYNVAG

SEQ ID NO: 31311 - DNA, 1005 bp, Sinorhizobium meliloti 1021
  CDS (1)..(1005): transl_table=11
gtgagcgtttctctccccgtgacgatcgacgacatcgaggtggcggcacggcgcatttccggccgtgtacttacgacgccgctggcaatgtcgggctcgttgagcgagctctgcggcgtgccggtcggcttaaagctcgagcaccaccagacgaccggtagcttcaagctgcgcggcgcgaccaatgcagtgctttcgctttctgccggcgaccgggcgctcggcgtaatcgcggcctcgaccggcaatcatggccgggcacttgcccatgcggcaaaggcggaaggctcggtcgctacgatctgcatgtcgcacctggtgcccgtgaacaaggtctccgaaatcagacgcctcggcgccaatgtgcggattgtcggcaattcccaggacgaggcgcaggaagaagtcgaaaggctcgttgcggaaaatggtctcgtgatggtgccgcccttcgaccatcgggcgatcgtcgccgggcaggggacgctcggactcgaggtcgtggcgcagatgccggacgttgccatggtgcttgtaccggtgtcgggtggtggactggcagccggagtggcggcagcggtcaaggcgcgcagaccggcgacgcgtgtcataggcctgacgatggagcgcggtgcggcgatgaaggcgagcttcgccgccggcggacccgcgctcgtcgatgaacaaccgagccttgcggactcgctcggcggcggcatcggcctcgacaatcgcgtcacattccgcatgtgccgggagctcctcgacgacataatcctcctgacggaagccgagatcgccgccggcatgcgccacgcctatgccgaggagcgcgagatcgtcgaaggggcgggggccgtcggcatttcggcgcttctcgccggcaagatcaaggacatcgacggccccatcgcggttattatctcggggcgcaacgtcgacatggacctgcacctgcgcgtgatgaacggcgaaacggacccattccgcgaggaggcggcatga

SEQ ID NO: 31312 - protein, 334 aa, Sinorhizobium meliloti 1021
MSVSLPVTIDDIEVAARRISGRVLTTPLAMSGSLSELCGVPVGLKLEHHQTTGSFKLRGATNAVLSLSAGDRALGVIAASTGNHGRALAHAAKAEGSVATICMSHLVPVNKVSEIRRLGANVRIVGNSQDEAQEEVERLVAENGLVMVPPFDHRAIVAGQGTLGLEVVAQMPDVAMVLVPVSGGGLAAGVAAAVKARRPATRVIGLTMERGAAMKASFAAGGPALVDEQPSLADSLGGGIGLDNRVTFRMCRELLDDIILLTEAEIAAGMRHAYAEEREIVEGAGAVGISALLAGKIKDIDGPIAVIISGRNVDMDLHLRVMNGETDPFREEAA

SEQ ID NO: 31313 - DNA, 1527 bp, Synechocystis sp. PCC 6803
  CDS (1)..(1527): transl_table=11
atgaccaccgattacctcgaaagaattcttaaagcccgggtttacgatgtggcgatcgaaactccgttggatttggcggccaatttatcgaagcggctgggtaaccgggtttactttaagcgggaagacctacagccggtcttttcctttaagttacggggggcctataacaaaatggcccagttatcaccggaattattggcaaaaggagtaattgcagcttcggcgggtaaccatgcccagggagtggccctaggagcttccaagttgggtaccagggcgattattgttatgcccgaaaccactcctcaggtgaaagtggaggcggtcaaagctcggggcggtgtggtggtgctctatggcgaaacctatgacgatgcctatggccatgcccgacagttggagcaggaaaaagggctaacttttatccatccttttaatgatcccgacgtgattgctggccaaggcaccattggcatggaaattctacgtcagtatcaacagcccattgatgccatttttgtggcgatcggtggcggtgggctgattgcgggggtagcggcctacgttaaacgcctctatccagaaattaaaattatcggcgtggaaccaacggatgccgatgctatgcgccaatctttggcggcgggaaaacgggtcaagctaaaccaagtgggactgtttgcggatggtgtggcggtgcgggaagtgggggatttaacttttcccctctgtcagcaatatgtggatgatattttgctggtggatacggacgacacctgtgcggccatcaaagattgctttgaagatacccgctcaattttggagccggcgggagcgttggccattgcgggactgaaacaatatgtccaaaagcaaggctgtcgagaccaaaccctagtggcgatcgcctgtggggcgaatatgaactttgaccgattgagatttgtggcggaacgggccgagtatggggaacagcgagaggccatttttgcagtgaccattcccgaacaaaggggcagtttaagaaaattttgtgaagggttagggaaacataacattaccgaatttagttaccgcattgcggaggggcccgatgctcatatttttgtcggcattcaggtgcaaaaccgcagtgatgcgtcccaactggccgccagctttaaccgccaaggttttaaaaccctcgatttaaccgatgacgaactgacgaagctccatttgcgccatatggtggggggccgtcccccccaggtgacccaattggaaaatcaacgggaattactctaccgatttgaatttcctgagcggccaggggcattgatgaaatttttgggctgtatggatccagcctggaatattagtttgttccattaccgtaaccacggggccgactacggcagaattgtcgtcggcatgcaggttcccttggcagaaatggaacagtggcaacagtttttagccaatttaggctatcgctattgggacgagagtgataatccggtttatcgtctctttcttcgctaa

SEQ ID NO: 31314 - protein, 508 aa, Synechocystis sp. PCC 6803
MTTDYLERILKARVYDVAIETPLDLAANLSKRLGNRVYFKREDLQPVFSFKLRGAYNKMAQLSPELLAKGVIAASAGNHAQGVALGASKLGTRAIIVMPETTPQVKVEAVKARGGVVVLYGETYDDAYGHARQLEQEKGLTFIHPFNDPDVIAGQGTIGMEILRQYQQPIDAIFVAIGGGGLIAGVAAYVKRLYPEIKIIGVEPTDADAMRQSLAAGKRVKLNQVGLFADGVAVREVGDLTFPLCQQYVDDILLVDTDDTCAAIKDCFEDTRSILEPAGALAIAGLKQYVQKQGCRDQTLVAIACGANMNFDRLRFVAERAEYGEQREAIFAVTIPEQRGSLRKFCEGLGKHNITEFSYRIAEGPDAHIFVGIQVQNRSDASQLAASFNRQGFKTLDLTDDELTKLHLRHMVGGRPPQVTQLENQRELLYRFEFPERPGALMKFLGCMDPAWNISLFHYRNHGADYGRIVVGMQVPLAEMEQWQQFLANLGYRYWDESDNPVYRLFLR

SEQ ID NO: 31315 - DNA, 1269 bp, Listeria monocytogenes EGD-e
  CDS (1)..(1269): transl_table=11
atggaattagttgacttattagtaacagaagaagatgtcgaaaaggcctatgaagtcttaaagtcggtcgtcaaacatacgccactagaatatgatttttatctttcggaaaaatatcattgcaatgtctatctgaaacgcgaagatttgcaaagagtgcgttcttttaaattacgtggtgctttttatgctatttctagattatcagcggaacaattggaaaaaggagtggtgtgcgcaagtgctggaaatcatgcgcaaggagttgcatatacgtgcaaacgaatgacagttccagctacgatttttatgccaacgactaccccgcaacaaaaagtatcacaagtaaaattttttggtggtagtaatgtcgaagtggttttagttggcgatacgtttgatgcttctgcaactgccgcgaaagaatttgctgcagcacatggccaaacttttatcccaccgtttgatgatcctgatattattgcaggccaaggctcgcttgctgtggagatggtcaaagatttaaataaagcacacgagcaagcagattatgtttttgctggaattgggggtggtggcttgattagcggtgttgcaacgtatctcaaagcgaagagcccgattacaaaaatcatcggggtagaacctgatggcgcgccttcaatgacagcagctttaaaacaaaatcaagtcgtaacactagataaaatcgataaatttgtcgatggtgctgcggtaaaagaagttggtagcttaacgttccaacatgccaaagtgttagtcgatgaagtgacaactgtttctgaaggtgctgtttgttctacgattttggatatgtatacgaagcaagcgattgttgcagaacctgctggagcactttccgttgctgcacttgaaacctaccgcgaggaaattaaagacaagacggttgtttgtattgtaagtggcggaaacaatgatattaaccggatgcaagaaattgaagaacgttccctcctacatgaaggattaaagcattattttatcgtcaatttctcgcagcgtcctggggctttgaaagaatttgttaacgatgtgctcggtccacatgacgatatcaccaaattcgaatatacgaaaaaagtgaatcgaggtaatggacctgtaattatcggtgttttgttgcaagataaaaatgattatgaaggattgcttgaccgggttgctgcttttgacccgagctatattccgattaatgataatcaaaccctatacactttgcttgtataa

SEQ ID NO: 31316 - protein, 422 aa, Listeria monocytogenes EGD-e
MELVDLLVTEEDVEKAYEVLKSVVKHTPLEYDFYLSEKYHCNVYLKREDLQRVRSFKLRGAFYAISRLSAEQLEKGVVCASAGNHAQGVAYTCKRMTVPATIFMPTTTPQQKVSQVKFFGGSNVEVVLVGDTFDASATAAKEFAAAHGQTFIPPFDDPDIIAGQGSLAVEMVKDLNKAHEQADYVFAGIGGGGLISGVATYLKAKSPITKIIGVEPDGAPSMTAALKQNQVVTLDKIDKFVDGAAVKEVGSLTFQHAKVLVDEVTTVSEGAVCSTILDMYTKQAIVAEPAGALSVAALETYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLDRVAAFDPSYIPINDNQTLYTLLV

SEQ ID NO: 31317 - DNA, 1269 bp, Listeria innocua Clip11262
  CDS (1)..(1269): transl_table=11
atggagttagttgatttattagtgacagaagaagatgtcgaaaaagcctatgatgtattaaaaccagttgtcaagcataccccgcttgaatacgatttttacctatcagaaaaatatcattgcaatgtatatttgaaacgtgaagatttacagcgggtgcgttcttttaaattacgtggtgctttttatgccatttctcgactgtcagcagaacagttagaaaaaggagttgcctgtgcaagcgctggaaatcatgcccaaggagtcgcctatacttgtaaacgtatgacggttccggcaacgattttcatgccaactactaccccacaacaaaaagtatcgcaagtgaaatttttcggtggaagtaatgtggaggttgttttagttggtgacacgtttgatgcatctgctactgccgcaaaagaattcgcagcagaacatggtcagacatttatcccgccgtttgatgatccagatattatcgcaggccaaggatcgctcgcggttgaaatggtaaaagatttaaataaagcacatgagcaagcggattatgtttttgcaggtattggtggcggcggcttaattagcggtgtggcatcttatctaaaagcgaaaagtccaatcacaaaaattatcggtgtagaaccagctggcgcgccttcgatgacagaagcattaaaacaaaatcaagttgtgactctagataaaatcgataaatttgttgacggggctgcagtgaaagaagttggaagtttaacatttcagcatgcaaaagtcttagttgatgaagtgacaaccgtttctgaaggagcagtttgttcaacaattttagatatgtatacgaagcaagcgattgtcgccgaaccagctggtgctctttccgttgctgctctcgaaacttatcgtgaggaaatcaaagataaaacagtagtctgtatcgttagtggcggaaataacgatattaatcgaatgcaagaaattgaagagcgttccctacttcatgaaggattaaaacattatttcatcgtcaacttctctcaacgccctggtgctctaaaagagtttgtaaatgatgttcttggaccgcatgatgatattactaaattcgaatatacgaaaaaagtaaatcgaggcaatggacctgttatcatcggtgtacttttacaagataagaatgattatgaaggcttgcttgaccgggttgctgcttttgatccgagttatataccgattaatgataaccaaacactttacacattacttgtttaa

SEQ ID NO: 31318 - protein, 422 aa, Listeria innocua Clip11262
MELVDLLVTEEDVEKAYDVLKPVVKHTPLEYDFYLSEKYHCNVYLKREDLQRVRSFKLRGAFYAISRLSAEQLEKGVACASAGNHAQGVAYTCKRMTVPATIFMPTTTPQQKVSQVKFFGGSNVEVVLVGDTFDASATAAKEFAAEHGQTFIPPFDDPDIIAGQGSLAVEMVKDLNKAHEQADYVFAGIGGGGLISGVASYLKAKSPITKIIGVEPAGAPSMTEALKQNQVVTLDKIDKFVDGAAVKEVGSLTFQHAKVLVDEVTTVSEGAVCSTILDMYTKQAIVAEPAGALSVAALETYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLDRVAAFDPSYIPINDNQTLYTLLV

SEQ ID NO: 31319 - DNA, 1056 bp, Listeria innocua Clip11262
  CDS (1)..(1056): transl_table=11
atgtataaaggtttactagaaaaatataaagaatatctaccagtaactgaaaaaacgccaatgatctcacttgcggaaggaaacacaccacttatcccattaccaaatttatcaaaagaacttggagtaactttatatggaaaatatgaagggttaaatccaactggttcttttaaagaccgcggaatggttatggctgtggctaaagcgaaagaagaaggtgcggaagcggttatttgtgcatcgactgggaatacttcagcagcggcggcggcatatgcaacacgtgccggattaaaagcatatattgttatcccagaaggtaaagttgctctaggaaaattagcgcaagcagtcatgtatggcgctgatattatctcgattcaaggtaattttgatgaagctttaaaatctgttcgtgaacttgctgaaacagaagcagtaacgcttgtaaactcagtaaatccttatcgtttagaaggccaaaaaacggctgcattcgaaatctgtgagcaattaggttctgctccagatgttcttgcaattccagtcggtaacgccggaaatatttctgcatactggaaaggttttaaagagtggaatgaggcaaacgcttctggacttccacggatgcatggatttgaagcagaaggagcggctgcaattgtccaagggaaaccgattgataacccggaaacaattgcaacagcgattcgtatcggaaatccagctagttgggagcttgcagaagcagctcgcgacgaatctggcggatacatccattctgtaacagatgatgaaattgttaatgcttataaaaaaatcgcagcgcaagatggagtcttcatcgagccaggttctgctgcatcattagctggagttattcaacatgtggcgaatggaacaattaaacaaggggaaaaagtcgtttgtgtctttactggaaatggcttaaaagacccagatacagcaatgagtgtacatgaaattccgatttcccatgtagatgatattgaagcaatgcgtacacatttacgttcaggagtgaaagcttaa

SEQ ID NO: 31320 - protein, 351 aa, Listeria innocua Clip11262
MYKGLLEKYKEYLPVTEKTPMISLAEGNTPLIPLPNLSKELGVTLYGKYEGLNPTGSFKDRGMVMAVAKAKEEGAEAVICASTGNTSAAAAAYATRAGLKAYIVIPEGKVALGKLAQAVMYGADIISIQGNFDEALKSVRELAETEAVTLVNSVNPYRLEGQKTAAFEICEQLGSAPDVLAIPVGNAGNISAYWKGFKEWNEANASGLPRMHGFEAEGAAAIVQGKPIDNPETIATAIRIGNPASWELAEAARDESGGYIHSVTDDEIVNAYKKIAAQDGVFIEPGSAASLAGVIQHVANGTIKQGEKVVCVFTGNGLKDPDTAMSVHEIPISHVDDIEAMRTHLRSGVKA

SEQ ID NO: 31321 - DNA, 954 bp, Caenorhabditis elegans
  CDS (1)..(954)
atgactacaaaaataacaatggaagaaatgagagcagcttatcaaagaactgctccatttcttcataaaacacttgttataacaagtgaaaatattgatgaaaaagttggaaatggaacacatgttctattcaaatgtgaacatttacaaaaaactggaagtttcaaagccagaggagcactgaattctgctattttggcaaaagagaaaaatgcaaaaggaatgattgcccattcgtctggaaatcacgggcaagctctagcgtgggctgctcaaaaaatcggacttccttgtacaattgtcgttccaaaaaatgctccaatttctaaaattgaaggaatgagagaatacaatgcgaatattgttttctgtgagccaactgttactagtcgagaatctgtatgtgctgatttgactgaaaaacttgagtattattgtgtagaaccttataattgtgtttcaatgatcaacggacattcatcagttgcatttgaaatcctggaacaggttggcaatgagattgattccatttttttatctgttggaggtggtggtttagcttcatctgttgcttttctgataggcaacttgaggccagacatcgaagtataccttgtgcaaccagcacagaaagaactttcgaactttctggaaaatggaattaagtgtccggttgacacattggatacaattgctgatggagttcgtgtagcaagagttggaccgctttgtgaaccaatactcaaacagtattgtgcacaaaaagttatcagtgtgaaggaagacgagatcaaagaaggattgaaactcatatggacaagaatgaagcaacgaattgaaccaactgcagcacttgcatttgcaggagttctctaccacaaaccggctcacatcaaacgtccactagtcatcctatgcggaggaaatgttgatactaattatgtgatcaattaa

SEQ ID NO: 31322 - protein, 317 aa, Caenorhabditis elegans
MTTKITMEEMRAAYQRTAPFLHKTLVITSENIDEKVGNGTHVLFKCEHLQKTGSFKARGALNSAILAKEKNAKGMIAHSSGNHGQALAWAAQKIGLPCTIVVPKNAPISKIEGMREYNANIVFCEPTVTSRESVCADLTEKLEYYCVEPYNCVSMINGHSSVAFEILEQVGNEIDSIFLSVGGGGLASSVAFLIGNLRPDIEVYLVQPAQKELSNFLENGIKCPVDTLDTIADGVRVARVGPLCEPILKQYCAQKVISVKEDEIKEGLKLIWTRMKQRIEPTAALAFAGVLYHKPAHIKRPLVILCGGNVDTNYVIN

SEQ ID NO: 31323 - DNA, 1347 bp, Caenorhabditis elegans
  CDS (1)..(1347)
atgcttcaaagcacgttgcttcgaaagtcgattttctattctctagctcaccgccgccacgtggcatccgtgcctctgaaggatgtcttttgtgacccggaaaacccgaaaatcctgcaattcggcgatatttcgatggctcatcatcggattcagaatggaatcgttcgtaccgattgccggaaatccagatgtttgtcgaaattgttcgatatgaacatctatctgaagatggaggtcaatcaggacactggaagcttcaaggagcgcggagcccgatatgctctacagaatttgccggaggagaagaagaaagccggggtttacgcggcttctgctggaaatcatgcgctggcactttctcttcatgggaaacagttgggtgtagaggtgaacgtggtgatgcccaagattgctccattgatgaaaatcaatcgatgccaggacctgggagccaacattctggttcagggcgaagacatcgccgagagccgagaaatcgctcttcggatggctcacgatagcaacggaacctatatcaacggctacgatcattatgacattctcgccggcgccggcaccactggaatcgagattctggagcaaatccagatgcctgacgcgattttggtgccggttggtggtggtgggctggttgcaggtgtcgccacagctgtcaaggctttgtctccaactaccgaagtgatcggtgttgttagtgagacttgtcaggctattgtgaaatctctccaagcaggacaccctgtgtacacgccgactcgtccaacactagctgacggattagcagtacccaatgcaggagtgaatgcttttgcgtcgatgatcggaaaagtggatcgagtgattagtgtgcctgaaaacgacatcgctgtggcaattctccgcctaatcgagaatgagaaggtggtctgcgaaggcgccggagcaatcggaatcggagcaattctatcgggaaagctgaatcatttgaagggaaaaacagtcgtatcaattctctctggtggaaatatcgatagtacatcgctgggtagatgcattgagagaggtctcgcgtatgatcatcgtgtaattcgtctgtcggttatcattcctgataagcctggtggtctgtcgaaattgactggcctggtgggcgaactgagtggaaatgttcgggatttgtatttggaacgtgcattcatgagaaacgacatgtcgagtcaacgtgtcaagatggtgattgaggtgcgcggagaggagcacgaaatgcagttgaagcagaagttccaggaagtatacgacccgtcaaactgccaattcaagaacaatcgcctgccaagactttga

SEQ ID NO: 31324 - protein, 448 aa, Caenorhabditis elegans
MLQSTLLRKSIFYSLAHRRHVASVPLKDVFCDPENPKILQFGDISMAHHRIQNGIVRTDCRKSRCLSKLFDMNIYLKMEVNQDTGSFKERGARYALQNLPEEKKKAGVYAASAGNHALALSLHGKQLGVEVNVVMPKIAPLMKINRCQDLGANILVQGEDIAESREIALRMAHDSNGTYINGYDHYDILAGAGTTGIEILEQIQMPDAILVPVGGGGLVAGVATAVKALSPTTEVIGVVSETCQAIVKSLQAGHPVYTPTRPTLADGLAVPNAGVNAFASMIGKVDRVISVPENDIAVAILRLIENEKVVCEGAGAIGIGAILSGKLNHLKGKTVVSILSGGNIDSTSLGRCIERGLAYDHRVIRLSVIIPDKPGGLSKLTGLVGELSGNVRDLYLERAFMRNDMSSQRVKMVIEVRGEEHEMQLKQKFQEVYDPSNCQFKNNRLPRL

SEQ ID NO: 31325 - DNA, 1539 bp, Caenorhabditis elegans
  CDS (1)..(1539)
atggttgctccatctcgaaagaagtcgattattcatcatcatgatcactctcatgaatcaacacctcaaaaaactcaccatcatcgagtgaagcaggctgaacgtaaacggacagcaagcatcagtaaagaagatggaatggaatataacaaaagagttcgaaagcttcataaggcattcttaacccatggagccgagtccccacatgttgatgataaacagacttctggaagtaacagtgatactgaagctccacttttcgatccggattgtgatccagagaacccaaagaaattgaaattttctgatatttcaagtgctgcatttaacattaaaaatggagttcaaacaacaccatgtgtgcgatctcttcaactgtcatccaagtgtgaaatggacctttatttcaaaaaagaatatctgcaagtgacaggatcattcaaagaacgaggagcaagatacgctctttcaaaaatggctgagcaattcaaaaaagcaggagtgatcgctgcgagcgcaggaaatcatgctctagctctcagttatcatggacaacaaatggggattccagtgacagtggtcatgcctgttattgctccacttatgaaaattcaattctgcagaagcttgggagcaacagttattctcaagggagagagtattgcagtggccaaggactttgcacttcgtcacgctaaagagaatcacttaaagtacattaatggttatgatgcaattgatattcttgctggacaaggaacaattggacttgaaattcttgatcaagttccagatgttgatacaattcttgtaccagttggaggtggtggattaattgctggaatcgcaacagctgttaagacattgaagccggatgttcatatttatgtaagctcatttctcataattgcaaattttaaagtaaccggaattgaatcagaaacctgcccatcgttcactgaagcatatgaagctggccatataataacttcccaggccaaagcgtcacttgctgatggtctcgccgttcccacagtcggcggaaattctttggagacagcaaaaggcttggttgataaggttatcacagtgaaagaagaaagcattgcgctgagtattttaagacttttggaagttgaaaaggctgttgttgaaggaggaggagctgttggattagcagctattttggaaggaaaagtaccagaattgaaaggaaagaaagttgtttcaattctttccggtggaaatattgatacaacagtacttggaagatcaattgaaagaggattagctgtagatggaagacttgttcgtttagaagttgtcgtatcagatagaccaggaggtattgctgaactaacaactacaattgctcatcttggagcatcaatcaaagatattttccacgaaagagcatggatctcaacggatgtattccacgttaaagttaaggttgtggcagaaactcgtggaaaagagcacgtggaggagattgagactgcattgaagaaaatttatgataatgttatacttcattga

SEQ ID NO: 31326 - protein, 512 aa, Caenorhabditis elegans
MVAPSRKKSIIHHHDHSHESTPQKTHHHRVKQAERKRTASISKEDGMEYNKRVRKLHKAFLTHGAESPHVDDKQTSGSNSDTEAPLFDPDCDPENPKKLKFSDISSAAFNIKNGVQTTPCVRSLQLSSKCEMDLYFKKEYLQVTGSFKERGARYALSKMAEQFKKAGVIAASAGNHALALSYHGQQMGIPVTVVMPVIAPLMKIQFCRSLGATVILKGESIAVAKDFALRHAKENHLKYINGYDAIDILAGQGTIGLEILDQVPDVDTILVPVGGGGLIAGIATAVKTLKPDVHIYVSSFLIIANFKVTGIESETCPSFTEAYEAGHIITSQAKASLADGLAVPTVGGNSLETAKGLVDKVITVKEESIALSILRLLEVEKAVVEGGGAVGLAAILEGKVPELKGKKVVSILSGGNIDTTVLGRSIERGLAVDGRLVRLEVVVSDRPGGIAELTTTIAHLGASIKDIFHERAWISTDVFHVKVKVVAETRGKEHVEEIETALKKIYDNVILH

SEQ ID NO: 31327 - DNA, 1005 bp, Ralstonia solanacearum GMI1000
  CDS (1)..(1005): transl_table=11
atgccgtcgatcgccaatgccgcttcgctcaatcgtgccgctgaactgcgccgtctgcgcgcggctgccgccgttgtcaatgccgtgatcccgccgacgccgcagtactgctggccgctgttgtcgcaggcgctgggggctgccgtgtgggtcaagcacgagaaccatacggaagtgggcgccttcaaggtgcgcggcgggctgaactatctgcacgccttgcgtcgtcgcgatccggaactgcgcggcgtgatcgcggcgacacgcggcaaccatgggcagtcgatcgccctggcggcgcgcaagcaaggcatgtcggccaccatcgtggtgccccacggcaacagcgtggaaaagaacgccgccatgcgcgcgctcggcgccgaactggtcgaagccggcgaagacttccaggcgagccgcgaagccgcggcaaggcaggccgccgagcgcggcctgcacctggtgccggccttccacgaagacctggtggccggggtggccagctattggctggagtttttcgaggaggccgcgccgctggacgtggtctacgtgccgatcggcatgggctcgggcatctgcgcggcggcggcggcgcgcgatgcgttccggctgtcgacgcgcatcatcggcgtggtgtcggcgcatgcgcgatgctatgactactcgttcaattgcggcgcgccgatttccgcgccggtatcgacgcaactggccgacggcctggcatgccggacgccggatgcgacggcgctggaggtgatccgcgcgggcgtcgacgaaatcgtcacggtgacggacgacgaagtcgccgaggccatccgcctgtacttctccaccacgcacaacattgcggagggtgccgccgccgcggccctggcggcggcctggcagcagcgcgaccagttggccggcctgcgcgtcggcctgccgctgaccggcggcaacatcgaccgcgccacgctggcgcgggtgctggccggtcagccgatcggcgcttaa

SEQ ID NO: 31328 - protein, 334 aa, Ralstonia solanacearum GMI1000
MPSIANAASLNRAAELRRLRAAAAVVNAVIPPTPQYCWPLLSQALGAAVWVKHENHTEVGAFKVRGGLNYLHALRRRDPELRGVIAATRGNHGQSIALAARKQGMSATIVVPHGNSVEKNAAMRALGAELVEAGEDFQASREAAARQAAERGLHLVPAFHEDLVAGVASYWLEFFEEAAPLDVVYVPIGMGSGICAAAAARDAFRLSTRIIGVVSAHARCYDYSFNCGAPISAPVSTQLADGLACRTPDATALEVIRAGVDEIVTVTDDEVAEAIRLYFSTTHNIAEGAAAAALAAAWQQRDQLAGLRVGLPLTGGNIDRATLARVLAGQPIGA

SEQ ID NO: 31329 - DNA, 972 bp, Ralstonia solanacearum GMI1000
  CDS (1)..(972): transl_table=11
atgaccacgctgcccatcacctacgacgatgtcgtcgccgcccacgcccgcctgcagggccaggtccaccggacgcccgtcctcacgtcgaccacggcgaatgcgctgaccggcgccgagctgttcttcaagtgcgagaacttccagcgcatgggcgccttcaagttccgcggcgcgtacaacgcgctgtcgcagttcacacccgagcagcgcaaggccggcgtcatcaccttctcgtcgggcaatcatgcgcaggcgatcgcgctgtcggcgcggctgctgggcatgcgcgcggtgatcgtgatgcccaaggacgcgccgacgatcaaggtcgaggccacgcgcggctacggcggcgaggtggtcttctacgaccgctataccgaagaccgcgaagccatcggccgccggctggccgagcagcacggcctgacactgatcccgccctacgatcatccgcacgtgatggccgggcagggcacggccgccaaggaactgatcgaagagaccggaccgctcgacctgctgctcgtctgcctgggcggcggcggtctgctgtcgggctgcgccacggcggcgcgcgcgctgagcccggcctgccggatcatcggcgtggagcccgaggccggcaacgacggccagcagagcctgcgcaagggcgagatcgtccacatcgacacgcccgccaccatcgccgacggggcgcagacgcagcacctgggccactacacttttgcggtgatccgtgcgctggtcgacgacatcgcgacggtgagcgatgccgatctggtcgacaccatgcgcttcttcgccggccgcatgaagatcgtggtggagccgaccggctgcctggccgcggcggccgccctgcggcagcgggtggaggtgcgcggcaagcgcgtcggcgtgatcatttcgggcggcaatgtggacctgcagcactttgcccggctcgtgcaggcggacgcatga

SEQ ID NO: 31330 - protein, 323 aa, Ralstonia solanacearum GMI1000
MTTLPITYDDVVAAHARLQGQVHRTPVLTSTTANALTGAELFFKCENFQRMGAFKFRGAYNALSQFTPEQRKAGVITFSSGNHAQAIALSARLLGMRAVIVMPKDAPTIKVEATRGYGGEVVFYDRYTEDREAIGRRLAEQHGLTLIPPYDHPHVMAGQGTAAKELIEETGPLDLLLVCLGGGGLLSGCATAARALSPACRIIGVEPEAGNDGQQSLRKGEIVHIDTPATIADGAQTQHLGHYTFAVIRALVDDIATVSDADLVDTMRFFAGRMKIVVEPTGCLAAAAALRQRVEVRGKRVGVIISGGNVDLQHFARLVQADA

SEQ ID NO: 31331 - DNA, 975 bp, Agrobacterium tumefaciens str. C58
  CDS (1)..(975): transl_table=11
atgacagatatttcgatgatcgaggcggcgcgtgagcgcatcggcaaccatgcggtgcgaacaccgctgctcacctcgccttttctggacgagatcgccgggcgaaagctgttcgttaaggcggaatgcctgcaaaggacgggatccttcaagtttcgcggcggctggtcggcggtatccggcctgccggcggatgtgcgcgccaagggtgtgatcgctttttcctccggcaaccatgcgcagggcgtggcgctcgcggcccgcctgcatggcattcccgccgtcatcatcatgccttcggatgcgccgaagatcaaaatcgacaatacccgcgcctatggcgccgaggtggtgctttacgaccgggcgaatgaagaccgtgacgccattggcaaccggttgtcgagcgagcgcggtttgaccctgatcaggccttacgatgaaccgctggtgattgcggggcaggggaccgctgggctggaaatcgctgagcaaggcgccgaactcggtatcggtgctgccgaggttctggtgccttgcggtggcggcggcctcacctccggcatctctcttgcactcgatgcgaaagcgcgaaattataaggtcaggacggcagaaccggagcgtttcgatgacgtggcgcgctcccttgcggcgggcaagatcgagcggaatgcgacgacatcgggttcgatctgtgatgcaatcgtcacgccgcagcctggcaatatcacctttcccatcatggcagggctttgcgggaaaggtatcgccgtcagcgaggaggaagcgctgcgggccatggttctcgccttcaaccggctgaaggtcgttatcgagccgggtggtgctgttgcgcttgccgcagcgctttttcatggcaaggaactggaaagcgaaaccgtgattgcggttgcctccggcggcaatgtcgatcccgggatcatggccgacgctctgtcacgcttcggttga

SEQ ID NO: 31332 - protein, 324 aa, Agrobacterium tumefaciens str. C58
MTDISMIEAARERIGNHAVRTPLLTSPFLDEIAGRKLFVKAECLQRTGSFKFRGGWSAVSGLPADVRAKGVIAFSSGNHAQGVALAARLHGIPAVIIMPSDAPKIKIDNTRAYGAEVVLYDRANEDRDAIGNRLSSERGLTLIRPYDEPLVIAGQGTAGLEIAEQGAELGIGAAEVLVPCGGGGLTSGISLALDAKARNYKVRTAEPERFDDVARSLAAGKIERNATTSGSICDAIVTPQPGNITFPIMAGLCGKGIAVSEEEALRAMVLAFNRLKVVIEPGGAVALAAALFHGKELESETVIAVASGGNVDPGIMADALSRFG

SEQ ID NO: 31333 - DNA, 1011 bp, Agrobacterium tumefaciens str. C58
  CDS (1)..(1011): transl_table=11
atgaagagcgaaaacctgtccatatccgccgataaaaaccagcttccggtctcgctggccgcgatagagcgggcggcaacgcggctttcgggacaggtggagcgcacgccgctggttcgctcggagtttctctccgaacgctgcggtcatcctgttcatctcaaacttgaaacccttcagcctatcggcgccttcaaactgcgcggcgcgatgaacgcgatcctctcgcttgacgatgcggtgcgacggcgtggcctagtcaccgcctcgacgggcaaccatggtcgggccgttgcttacgccgccgccaaactcggcattcccgccacgatctgcatgtcggcgctggtgccggcaaacaaggttgaggcgatccgcatgcttggcgcggaaatccggattgtcggcagatcacaggatgatgcgcaggaggaagtggagcgcctgacaaaaaaccgaggcctgaccgcgatcccacctttcgatcatgctgacgtcgtggccggccagggcactatcggcctcgaggtcgttgaagacatgcctgaactggcgacaattctcgttcctctatcgggcggtggccttgcgggcggtatcgccgttgcggtgaaggcgctgaagccaagggcgcgggttatcggcatttccatggaacgaggtgcggccatgcatgcgtcagtgaaagccggccgccccgtctcggtttgcgaggaagaaacgctggcggattcgcttggcggcgggattggactggcaaaccgcgtgacctttgcactttgcaagacacttctcgatgagatcgtgctggtctccgaagatgaaatcgcgaccggcatctgccatgcatcccgcgaggaagacctgagagtggaaggcgcgggcgccgttggcttcgcagcaatcctcgccggcaagatcgcggtgagcggccctgccgccatcatcgtatcgggcgggaatatcgatccggcggtccacaagacgatcatcgacgggggagtcgcatga

SEQ ID NO: 31334 - protein, 336 aa, Agrobacterium tumefaciens str. C58
MKSENLSISADKNQLPVSLAAIERAATRLSGQVERTPLVRSEFLSERCGHPVHLKLETLQPIGAFKLRGAMNAILSLDDAVRRRGLVTASTGNHGRAVAYAAAKLGIPATICMSALVPANKVEAIRMLGAEIRIVGRSQDDAQEEVERLTKNRGLTAIPPFDHADVVAGQGTIGLEVVEDMPELATILVPLSGGGLAGGIAVAVKALKPRARVIGISMERGAAMHASVKAGRPVSVCEEETLADSLGGGIGLANRVTFALCKTLLDEIVLVSEDEIATGICHASREEDLRVEGAGAVGFAAILAGKIAVSGPAAIIVSGGNIDPAVHKTIIDGGVA

SEQ ID NO: 31335 - DNA, 1212 bp, Pyrobaculum aerophilum str. IM2
  CDS (1)..(1212): transl_table=11
atgatcctcctggaggaggctgcgtcggtaataagagaaaaacagcgggaatcaaaaatccataggacgccgactttgaggtcagagtctctgactagaataacaggcggggaggtgttcctcaagttggaatcgcttcaaaagacaggcagtttcaagatcaggggggcatattttgccatgtataaatacataaaggagggttatagggagtttataaccgcctcgtcgggtaatcacgcgcagggagttgcctatgcggcacaattacacggagtaaaggccactgttgtaatgcctgaaactacgccttggctcaaggttaaaaagacccaggattacggcgccaacgttatattatacggcgagagttattacgaggcggagaaaaaagccatggaattagtacgcggaggagttaagttcctccacgcgtataacgactggtacgtcatctcgggacaagccactttaggccttgagattgtagaggatgtcggtgacgtagacgtagtagttgtgccaataggcggcggggggcttatctccggcgttgcatatgccgtgaagaagagaaggcctggggcaaaggtaataggggttcaagccagcggagcgccggcggtgtacttgtctttaaaagaggggcggcccattgtgattgagaaagtagacactattgccgacggtatcgctattaaaagccccggcgacattacgttgaaattaatacaagagtacgtagacgacgtggtgttagtagacgacaatgaaattgtagatgccatttacctcctccttgaaaggacaagagtagtggctgagggcgctggggctgttgcagtggccgcgttaatgtcggggaaaattaacgtaagtggtaaaaaagtagtggcggttgtctccggcggtaatatagacgcgcctatttttatgcgcgttctcatgaaggcaatggcgagacagaggcgggtgattaaattagtcggcgaagtgcctgacaagcctggaactcttgcgaaggcctcttctttcctggcctcacacaatgtgaatatcctagaggttttccacgagcgctacgacccggaacaacggcctaattatgtaagactcatatttgtagtggaaattccaggcacgttagacgtatcaaagctcttagacgaactggaaaaaaacggcttctttttcagagtcgcctcgcagtaa

SEQ ID NO: 31336 - protein, 403 aa, Pyrobaculum aerophilum str. IM2
MILLEEAASVIREKQRESKIHRTPTLRSESLTRITGGEVFLKLESLQKTGSFKIRGAYFAMYKYIKEGYREFITASSGNHAQGVAYAAQLHGVKATVVMPETTPWLKVKKTQDYGANVILYGESYYEAEKKAMELVRGGVKFLHAYNDWYVISGQATLGLEIVEDVGDVDVVVVPIGGGGLISGVAYAVKKRRPGAKVIGVQASGAPAVYLSLKEGRPIVIEKVDTIADGIAIKSPGDITLKLIQEYVDDVVLVDDNEIVDAIYLLLERTRVVAEGAGAVAVAALMSGKINVSGKKVVAVVSGGNIDAPIFMRVLMKAMARQRRVIKLVGEVPDKPGTLAKASSFLASHNVNILEVFHERYDPEQRPNYVRLIFVVEIPGTLDVSKLLDELEKNGFFFRVASQ

SEQ ID NO: 31337 - DNA, 1047 bp, Pyrobaculum aerophilum str. IM2
  CDS (1)..(1047): transl_table=11
ttgcttgaagtggaagttcgtaataaagtctgggccccaaagggcaacgggatctggcgttattcaacaatgttgcctcttaaaagcgggatatccctgggagaggggaggacccccctggtgaaatccaatctggcggagaatctgtatgtaaaatttgaaggggctaacccaactggaagttttaaagaccggggaatggccctcggcgtgactgtggccaaggagagcggcgccaataaagtcgtcgtggcgtctactggcaacacggcggcctctgcggcggcttacgccgctagggctgggcttaggtgttatgtagttttgcccaagggcaatgtggccagggggaagttaatacaagcggcgttacacggcgctgagcttgttatgataaacggcctatttgataaggcgcttgactacgtggttaactacgggacaaaatacgcatatcctctaaacagctttaacccgtggaggctggaggggcagaagaccgtggcctttgagatatacgaagagctggggtgtccggactacgtaatagtgccagtgggaaacgcggggaatatctcggctatatggaaggggtttagggaactcgccgagctggggctttgtaataaactgccgaaaatggtgggcgtccaggcggagggcgcggcgccgcttgtcgaggcctgggcccgcggcgtggaggagccgctttttgtagacgagcctaacacagtggcgacggcaattaaaatcggcaggcctataaactggcccaaggcgctgagggccgtgaaggagtcaggaggctttttcgtaaaagtgtctgacggggagatattaaaggcgcagaggctcttggcaactcgcgacggcataggggcggagcccgcgggcgccgcgtcaatagccgcggcgattaaattaaatatagggggagtagccgtggccgtggtaaccggccatgcgctgaaagaccccgacgttatagaaataacagcgaaggaggtgagaaatgcagacgagctgatagagcttttggaaaaatga

SEQ ID NO: 31338 - protein, 348 aa, Pyrobaculum aerophilum str. IM2
MLEVEVRNKVWAPKGNGIWRYSTMLPLKSGISLGEGRTPLVKSNLAENLYVKFEGANPTGSFKDRGMALGVTVAKESGANKVVVASTGNTAASAAAYAARAGLRCYVVLPKGNVARGKLIQAALHGAELVMINGLFDKALDYVVNYGTKYAYPLNSFNPWRLEGQKTVAFEIYEELGCPDYVIVPVGNAGNISAIWKGFRELAELGLCNKLPKMVGVQAEGAAPLVEAWARGVEEPLFVDEPNTVATAIKIGRPINWPKALRAVKESGGFFVKVSDGEILKAQRLLATRDGIGAEPAGAASIAAAIKLNIGGVAVAVVTGHALKDPDVIEITAKEVRNADELIELLEK

SEQ ID NO: 31339 - DNA, 1209 bp, Clostridium perfringens str. 13
  CDS (1)..(1209): transl_table=11
gtgattattttgtatttagaaaaaattattaaagcaaaaaaaaatatagaagatgtagttataaaaacacctttaatatatagcgaggtcttttcaaggaaatctggaaaccaagtgtatatgaaatgtgaaaatttacaattaacaggtgcttacaaaataagaggtgctttaaataaaataagatctttatcagatgaagaaaaatcaaaaggtgttgtttgttcttctgccggaaatcatgctcaaggcgtagcttttgcagcatcacaagctaatgttaaatcaactatagtaatgccaaagactactcctctactaaaaatccaatcaacaaaggatttaggagggaatgttgttttatcaggttatgtttatgatgatgcttttaatgaggctaaaagaattgaacaagaacaaggagccttatttatacatccatttaatgatattgatgtaatttgtggacaaggtacagtagccttagaaatatttgaagatttaaatgatgtagatattattctctgccctataggtggcggtggcttaataagtggagttaccctagctgctaaggctttaaaccctaatgttaaagtaattggagtacaggctgaaggtgcaaatgcaatggttaaaagttttaaggcaggagaaataattgctttagacgctgttgatactattgctgatggaattgcagtaaaaagacctggtgatttaacatttaaatttataaaagaatatgttgatgatataataactgtatcagatcatgaaattgttgaagcattctttacattaagtgaaaaacataaacttttagcagaagcttcaggagcagtctcattagcagcttctgctaaattaaattgtaaagataaaaatatagtatcagtaataagtggtggtaatatagatatggttactataacttcattaataaacagcgcattagtagctaaaggaagactttttggatttagtttagaagttcctcataaaccaggacaaatattgaagattgctaaagttcttgctgatactaatgctaatatagtaaaacttgaacatgatcattttaaagcaagggatgctcttaaaaatatggttatagaagtaactttagagacaaatggacactctcacatagaggaaataaaaaaagctttaacagatcaaaattatgtaataaaacaaatttattaa

SEQ ID NO: 31340 - protein, 402 aa, Clostridium perfringens str. 13
MIILYLEKIIKAKKNIEDVVIKTPLIYSEVFSRKSGNQVYMKCENLQLTGAYKIRGALNKIRSLSDEEKSKGVVCSSAGNHAQGVAFAASQANVKSTIVMPKTTPLLKIQSTKDLGGNVVLSGYVYDDAFNEAKRIEQEQGALFIHPFNDIDVICGQGTVALEIFEDLNDVDIILCPIGGGGLISGVTLAAKALNPNVKVIGVQAEGANAMVKSFKAGEIIALDAVDTIADGIAVKRPGDLTFKFIKEYVDDIITVSDHEIVEAFFTLSEKHKLLAEASGAVSLAASAKLNCKDKNIVSVISGGNIDMVTITSLINSALVAKGRLFGFSLEVPHKPGQILKIAKVLADTNANIVKLEHDHFKARDALKNMVIEVTLETNGHSHIEEIKKALTDQNYVIKQIY

SEQ ID NO: 31341 - DNA, 1185 bp, Pyrococcus furiosus DSM 3638
  CDS (1)..(1185): transl_table=11
atggtgctgaaatgtgtagtctgtgggagagagtatcctgaagacgaagttaggtataggtgtgagtgtggaggtctattagaggttgttatcgatctagataaagttgatacttccatttttaacggtaaggagataaagctgtggaaatatgaaagctggctacccgtaaagaagagagttagtctggaagaaggtggaactcccctatataggttattaaatcttgaaagtgatcttggagtaaaagagctctatgcaaaaaacgagggtgcgaatccaacaggttcatttaaagaccgcggaatgacggttggagtctcgaaggctcttgagctaggaatggataaagtcatatgtgcatctacgggaaatacttcagcatcacttgctgcttatgctgcaaaagcaggaataaaagcatatgtcctaatcccaagtgggaagatagcgttaggaaagcttgctcaagcaataatctatggggctagggttgtaccaatcaaggggaactttgacgatgctctaagagtagtcgtggagacaagcaaagaacttgggatatacatgttaaattcaataaacccattcaggctcgaaggacaaaagacaatagcgtatgagatatatgaccaacttggaaaagttccagacaacgttattctcccagttggaaatgcaggaaacatttctgcaatatggaaggggtttaaggagatgtatgaggctggcgtaatagatgaacttcccaggatgataggaattcaagcagaaggagcatccccattagcgaaggcttggaaagagaaaagaaaattccaacccgaagagagtccagaaaccattgcatcggccataagaataggaaaccccgcaaattggataaaggcatggagggctgttgaagaatctgggggactatttgagagcgtaagtgatgaggaaatactaagagctcagaaacttctagcgtctagggaaggactatttgttgaacctgcttctgcagcatctttagctggcttaattaagctccttgaaagtggtgaaataagcaggaatgagagttacgttttaatcacaactggacatgggctaaaagatccaaatatcgtcataaagaacttccaagttccagaacctatagacccaactttagaagcttttaaggaggtgattgaatga

SEQ ID NO: 31342 - protein, 394 aa, Pyrococcus furiosus DSM 3638
MVLKCVVCGREYPEDEVRYRCECGGLLEVVIDLDKVDTSIFNGKEIKLWKYESWLPVKKRVSLEEGGTPLYRLLNLESDLGVKELYAKNEGANPTGSFKDRGMTVGVSKALELGMDKVICASTGNTSASLAAYAAKAGIKAYVLIPSGKIALGKLAQAIIYGARVVPIKGNFDDALRVVVETSKELGIYMLNSINPFRLEGQKTIAYEIYDQLGKVPDNVILPVGNAGNISAIWKGFKEMYEAGVIDELPRMIGIQAEGASPLAKAWKEKRKFQPEESPETIASAIRIGNPANWIKAWRAVEESGGLFESVSDEEILRAQKLLASREGLFVEPASAASLAGLIKLLESGEISRNESYVLITTGHGLKDPNIVIKNFQVPEPIDPTLEAFKEVIE

SEQ ID NO: 31343 - DNA, 1152 bp, Pyrococcus furiosus DSM 3638
  CDS (1)..(1152): transl_table=11
atgcttaggtgcacttcatgtggaagaatgtattcatttgacagcccatatcaaaggtgcgaatgtggagagcctttggaacttgagcttttcaatgggatgtataaaaagaaaggaaagagggtatgggaaaggttttctgagttctttcctctcgaactagatccagagttaagcttgggagaaggagatactccattaacaagagcaaagaagctttcgaaagaacttggaattgagctatatttaaaaaacgagactataaatcccacgtggagttttaaagataggggaacctacctgggaattcatagggcgatacaacttgactttagaaggattgggacggtatcaacgggaaatatggcggcaagtgttgccgcatatggagctcattctgagctcgaagtttacattttggtttcctcaacaataccagaggaaaagattaaggccttagctccctatggagcaaagattgtaaaggttcatggggactatggggaactctattatagggccctagaaatagggcagaaaaagggaatatatttcataaactcggatgatccctttagagttgaagggtataagagcataagcttcgagataagtgaggagataactccagactacgtaatagtccctacgtcatctggaggcctatttagaggtattgtgaaggggtttctggaagccaagaatagtggactaatagaaaagctccctagattttttgtggtacaggctgagggctgttctccaatatgtaaagcattcaacgctggaaaagaaaagatagagagatttgaaaatccccatacaatcgcccatgcaatagaaaatccatatcctccaagtggaaatgcagtcctaagattgctgaagaaattgaatggcatttgtaccacggttacagatgaagagattctagaggcccagaaaatcctgggaagagaaggaatttttgttcaactcgcatctgcaacaggaatagccgcagtaaaaaagctaaggcgaaaaggaattatcaaagaaggagcaattgtagttagcattcttacgggctctggattaaagacattgaggtacattaagcaaccaaaagtcgaggaatgctctttacaaagattagaagagtgcattggataa

SEQ ID NO: 31344 - protein, 383 aa, Pyrococcus furiosus DSM 3638
MLRCTSCGRMYSFDSPYQRCECGEPLELELFNGMYKKKGKRVWERFSEFFPLELDPELSLGEGDTPLTRAKKLSKELGIELYLKNETINPTWSFKDRGTYLGIHRAIQLDFRRIGTVSTGNMAASVAAYGAHSELEVYILVSSTIPEEKIKALAPYGAKIVKVHGDYGELYYRALEIGQKKGIYFINSDDPFRVEGYKSISFEISEEITPDYVIVPTSSGGLFRGIVKGFLEAKNSGLIEKLPRFFVVQAEGCSPICKAFNAGKEKIERFENPHTIAHAIENPYPPSGNAVLRLLKKLNGICTTVTDEEILEAQKILGREGIFVQLASATGIAAVKKLRRKGIIKEGAIVVSILTGSGLKTLRYIKQPKVEECSLQRLEECIG

SEQ ID NO: 31345 - DNA, 1338 bp, Pyrococcus furiosus DSM 3638
  CDS (1)..(1338): transl_table=11
atgaaatgtccgaaatgcgggagagagtggactacttttattccccccttttgtacttgtggggctgaacttgaaattagctatgactactctaaagtagatgttagaaagtggaagaacagactttcttctgtatggaaatatcgagagcttcttccccctgtaaagagaatgattacactgcgagagggtggaactccgttaataaaggcaagaatttcagaaaaaattgggatagatgtgtatattaaggatgaaactagaaatcccacaggttcatttagggatagactagctacagttgccatttcttatggtttaccttatgcatccaacggatttattgtagctagtgatggaaatgctgcagtttcagttgcagcttatgctgcaagagctgaaaaggaagcgtttgtagtaatcccaaggaaagttgacagggggaagttaatacagatgatggcctttggggccaaaatcattagatttggggaaagtgttgacgaggcaatagagtatgcaagggaaatagcaaagctcaatggcctttataacgtcacgccagaagataatattattggacttgaaggtcaaaaaacaatagcctttgaactttgggaagagctaaatcccacccacgtagtagttccaactggtagtggaagttatatttattcaatttacaagggatttaaggagttaatggaaatcggggttcttgaggaaattcctaatttgatagccgttcaaactgataaatgcaatcctatagcatctgaagttctgggaacaaagaagaaatgcacagaaacaaaagctctcggcttgtacgttaaaaatccagttatgaaaaacaaggcagttaaagctataaaagaaagcaaaggtactgcagtaattgtaaatgaggaagaaatcatgagaggagaaaaattacttgcaagtgagggcatttatgcagaattatcctcagccgtagtcatgccggctttgctaaagcttaaagaaaatgggtttatagaaaaaggagacaaagttgtactagtagttacaggttctggtttaaaaactggagaaggtggaaaagagaaattttcaattggaccaactaaaattgagatacttaggctgttgaaagaaagagaaatgtatgcatatgagatctggagcttacttgggaaacctctaaagtaccaagcagtccatcagcacattaaggagttacttgaattgggattagttgaacaggcatatagaaagggaaagagggtatattacaagataactgaaaaaggattgagaattctacaaaacttcgaagacctagagaacatttaa

SEQ ID NO: 31346 - protein, 445 aa, Pyrococcus furiosus DSM 3638
MKCPKCGREWTTFIPPFCTCGAELEISYDYSKVDVRKWKNRLSSVWKYRELLPPVKRMITLREGGTPLIKARISEKIGIDVYIKDETRNPTGSFRDRLATVAISYGLPYASNGFIVASDGNAAVSVAAYAARAEKEAFVVIPRKVDRGKLIQMMAFGAKIIRFGESVDEAIEYAREIAKLNGLYNVTPEDNIIGLEGQKTIAFELWEELNPTHVVVPTGSGSYIYSIYKGFKELMEIGVLEEIPNLIAVQTDKCNPIASEVLGTKKKCTETKALGLYVKNPVMKNKAVKAIKESKGTAVIVNEEEIMRGEKLLASEGIYAELSSAVVMPALLKLKENGFIEKGDKVVLVVTGSGLKTGEGGKEKFSIGPTKIEILRLLKEREMYAYEIWSLLGKPLKYQAVHQHIKELLELGLVEQAYRKGKRVYYKITEKGLRILQNFEDLENI

SEQ ID NO: 31347 - DNA, 1803 bp, Schizosaccharomyces pombe
  CDS (1)..(1803)
atgactggaacgagtttttacacttcggtactcagattgggacgattggctcaacagggcctaaaattccaatctgtaaaacatattcgtccatcatgtttttcatcttttggattacaagctaaacgttggaactctactcaacaaaatgatagttctattgattgtttagaacctaagctgcaaggaattattgaagacaatatttctccctcgacggcacaaaaagaaatatcagacatcaagtttaatattccaaaggaaatgcttcttccagatggaactcctgattatttacgtttgactctcacgtctaacgtgtatgaagttatcaaggagactcctcttacaaagggtgttgtcatttctgaaagtaccggtgttccagtctacttaaaacgtgaagatctcactcctgtgttttcatttaaaattcgaggggctcataataaaatggcttctcttgataagcagtcattgaaaaatggagtcattgcttgttccgctggcaatcacgcccagggtgttgcttactccgctaggactcttggtgtaaaagctaccattgttatgcctcagaatactcctgaaatcaaatggaggaacgttaagagattgggcgctaatgttctcttacatggagctaattttgacattgctaaagcagaatgtgcacgtttggctaaagagcaaaatctcgaagttattcatccctttgacgatccttatgtaattgctggacaaggaaccattggacttgaaattcttcatcaaatagatcttcgcaagctggatgctatttactgcgctgttggcggtggtggtttaattgctggaatagctacttacgttaagcgtattgctccccatgttaaggtcattggtgtcgagacatttgacgctgatgctttaaaaaagtctttgaaggacaaaaagcgggtaacccttaaggaagttggcttattcgctgatggaactgctgtgaaacttgttggagaggaaaccttccgtcttgtctccaagaatattgacgatgtagttcttgttgacaaagatgagatttgtgcagccattaaggatgtttttttggatacccgttcagtggtcgaaccatcaggagctatggctgttgctggtatgaagcgttatgtcgctaaacacaagcctaaaaatcccaatgctgctcaggtttgcatcttaagtggtgccaatatggactttgatcgccttagatttattgctgagcgtgctgatcttggtttgaacaaggaagtattcttgagtgtcactattcctgagcgccctggttcatttgaagccctacacaacattattactccacgtagtattaccgaattttcttatcgttacgataatgatgactatgctaacatttacacatcgtttgtggtaaaggaccgtgcaactgaattgcctttgattcttcaacaaatctctgagcaaaatatggttgcagaagatatcagcgataatgaacttgctaaaactcatgcccgttatcttattggaggaaaatcatctgtttcaaaagagcgtttgtaccgattggatttccctgaacgccctggagctttatgtaagtttttgaggagtataaaggaagtttgcagcatttcccttttccattatcgtaattgtggtggagatatagctagtgtgcttgctggccttagagtttttgatggccaagtggaaaaacttcattcagttttggaagagattggatacaactgggtggacgaaacaaataatcccgtttacttgcgctatcttcgtaaatag

SEQ ID NO: 31348 - protein, 600 aa, Schizosaccharomyces pombe
MTGTSFYTSVLRLGRLAQQGLKFQSVKHIRPSCFSSFGLQAKRWNSTQQNDSSIDCLEPKLQGIIEDNISPSTAQKEISDIKFNIPKEMLLPDGTPDYLRLTLTSNVYEVIKETPLTKGVVISESTGVPVYLKREDLTPVFSFKIRGAHNKMASLDKQSLKNGVIACSAGNHAQGVAYSARTLGVKATIVMPQNTPEIKWRNVKRLGANVLLHGANFDIAKAECARLAKEQNLEVIHPFDDPYVIAGQGTIGLEILHQIDLRKLDAIYCAVGGGGLIAGIATYVKRIAPHVKVIGVETFDADALKKSLKDKKRVTLKEVGLFADGTAVKLVGEETFRLVSKNIDDVVLVDKDEICAAIKDVFLDTRSVVEPSGAMAVAGMKRYVAKHKPKNPNAAQVCILSGANMDFDRLRFIAERADLGLNKEVFLSVTIPERPGSFEALHNIITPRSITEFSYRYDNDDYANIYTSFVVKDRATELPLILQQISEQNMVAEDISDNELAKTHARYLIGGKSSVSKERLYRLDFPERPGALCKFLRSIKEVCSISLFHYRNCGGDIASVLAGLRVFDGQVEKLHSVLEEIGYNWVDETNNPVYLRYLRK

SEQ ID NO: 31349 - DNA, 933 bp, Corynebacterium glutamicum ATCC 13032
  CDS (1)..(933): transl_table=11
atgctcaccctcaacgatgtcatcaccgcccaacaacgaaccgcccctcatgttcgacgaacgccacttttcgaagcagaccccatcgacggcacacaaatctggatcaaagcagagttcctccaaaagtgcggcgtgttcaaaacgcgtggagcattcaaccgccagctcgcagcttcggaaaacggactactcgacccaacggttggcatcgtcgcggcatcaggcggaaacgcaggactcgcaaatgcttttgccgcagcatccttaagcgttcccgccacggtattggtgcccgaaactgccccacaagtaaaagttgatcgcctcaagcaatacggtgcaaccgtgcaacaaatcggatctgaatatgcggaagcatttgaggcagctcaaacctttgagtcggaaactggtgctctgttttgccacgcctacgaccagcccgacatcgcagctggagcaggcgtcattgggctagaaattgtcgaagatcttcccgacgttgacaccatcgtggttgctgtcggtggcggtggactctatgcaggaatcgcagccgtcgtagcagcccacgacatcaaagtggtggccgttgaaccctccaaaattccaaccctgcacaactcactcattgccggccaaccagtcgatgtgaacgtttctggtatcgcggcagattctttgggggctcgccaaattggacgagaagcctttgacatcgcaactgcccatcccccaataggcgtcctagtggacgatgaagcaatcatcgcagctcgacgccacctctgggacaactaccgcatccctgccgagcatggcgctgccgcagcactcgcctctcttaccagtggagcatacaaacctgcagcagatgaaaaagtggcagtcattgtgtgcggagcgaacactgacctcacaacactgtga

SEQ ID NO: 31350 - protein, 310 aa, Corynebacterium glutamicum ATCC 13032
MLTLNDVITAQQRTAPHVRRTPLFEADPIDGTQIWIKAEFLQKCGVFKTRGAFNRQLAASENGLLDPTVGIVAASGGNAGLANAFAAASLSVPATVLVPETAPQVKVDRLKQYGATVQQIGSEYAEAFEAAQTFESETGALFCHAYDQPDIAAGAGVIGLEIVEDLPDVDTIVVAVGGGGLYAGIAAVVAAHDIKVVAVEPSKIPTLHNSLIAGQPVDVNVSGIAADSLGARQIGREAFDIATAHPPIGVLVDDEAIIAARRHLWDNYRIPAEHGAAAALASLTSGAYKPAADEKVAVIVCGANTDLTTL

SEQ ID NO: 31351 - DNA, 1215 bp, Fusobacterium nucleatum subsp. nucleatum ATCC 25586
  CDS (1)..(1215): transl_table=11
atggctaagttagaagcttttataaaagcaaaagaaaaattatcaaaagtacttttagaaacacagttaatttacagtcctatattctcaaaagaatctggaaacaaagtattcatcaagcctgagaacttacaaaaaacaggttcatttaagataagaggagcatacaataaaatttctaatctaacagatgctgaaaagaaaagaggtgtaattgcctcatctgctggaaatcacgctcaaggtgttgcttatggtgctaaggaatctggtataaaggcagttattgtaatgcctaaatctactcctcttataaaagttgaatctacaaaacaatatggagcagaagttattttacatggtgatgtttatgatgatgcctttaaaaaagcaaaagaattagaagaaaaagaaggttatgtgtttgtccatccttttaatgatgaagatgttttagatgggcaaggaacaatagccctagaaattttagaagaacttcctgaaactgatattatacttgttcctattggtggtggtggtttaatttcaggtatagcttgtgctgcaaaaatattaaaacctgaaataaaaattattggtgttgaaccagaaggagctgcttctgcttatgaagctataaaggaaaataaagttgttgaacttaaagaagctaatacaatagctgatggaaccgctgtaaagaaaattggagacctaaactttgaatatattaaaaaatatgttgatgaaattataacagtatctgattatgaattgatggaagcatttttattattagtagaaaaacataaaattattgcagaaaattctggtatattatcaatagctgctacaaaaaaacttaaggaaaaaaataaaaaagttgtatctgtcataagtggtggtaatatagatgtcttaatgatttcatctatgattaataaaggacttatcagaagagatagaatctttaattttacagttagcattcctgataaaccaggtgaattagcaaaagttgtagatttaatcgctgaacagggggctaatgtgataaaacttgaacataatcaatttaaaaatctatcaagatttaaggacattgaattacaaattactgttgaaactaatggaagtgaacatgtccaaaatttaactcaagcttttgaagaaaaaggttatgaaatagtaagaatcaaatctaaaataaattaa

SEQ ID NO: 31352 - protein, 404 aa, Fusobacterium nucleatum subsp. nucleatum ATCC 25586
MAKLEAFIKAKEKLSKVLLETQLIYSPIFSKESGNKVFIKPENLQKTGSFKIRGAYNKISNLTDAEKKRGVIASSAGNHAQGVAYGAKESGIKAVIVMPKSTPLIKVESTKQYGAEVILHGDVYDDAFKKAKELEEKEGYVFVHPFNDEDVLDGQGTIALEILEELPETDIILVPIGGGGLISGIACAAKILKPEIKIIGVEPEGAASAYEAIKENKVVELKEANTIADGTAVKKIGDLNFEYIKKYVDEIITVSDYELMEAFLLLVEKHKIIAENSGILSIAATKKLKEKNKKVVSVISGGNIDVLMISSMINKGLIRRDRIFNFTVSIPDKPGELAKVVDLIAEQGANVIKLEHNQFKNLSRFKDIELQITVETNGSEHVQNLTQAFEEKGYEIVRIKSKIN

SEQ ID NO: 31353 - DNA, 1212 bp, Methanopyrus kandleri AV19
  CDS (1)..(1212): transl_table=11
ttgcattacgtcctggagtgtgttgaatgcggttcggagttcgatgatgactcactggtacggtgccccgagtgcggaggactcctggaggtggcactgcgctacgacgaaatcgaggtgagtcggtcgacgttcgagggtcgtcgcctcggcgtatgggccttccgggagctcctaccagtgaacacggacgatcccgtcacgatgtccgagggcggtacgggcttacacccgtgtccgagactgggcgaggagctcggtgttagggagctgttcgtgaagaacgagggcgagaaccccacgggctccttcaaggatcggggaatgaccgtgggagttaccaaggccgtggagctcggtgcggaggtcgtcgcatgtgcctcgacgggcaacacatcggcctcgttggccgcctacgccgcccgcgcgggccttacgtgtgccgtcctccttccggccggtaaggtggccctaggcaaactcgctcaagccctcttccacggtgcccgcgtgattccagtgaacggcaacttcgacgacgccttggatgtcgtgaagaagctggccgatgagggcatcgtgtacattctaaactccgtgaacccgttccgcctctccggtcagcgtaccatcgcgtacgagatctgcttgcagttggactgggaggtccccgacgcggtcgtcgtgccggtcggtaacgcgggtaacatcagcgcgatctggcaggggttcctcgatctctacaggctgggaatcatcgacgagctcccgaggatgtacggagtacaggcggagggtgctcgaccgatcgtcgaggcgattcggcggggcaaggaggacatcgaaccggatcccgagcccgaaaccgtcgccaccgcgatccgcatcggtaacccagtgaacgccatcaaggctctccgtgccatccggtgttcgggcggctgggccgtagaggtctccgacgaggaaatactctcggcgcagcgtgagctcgcaacgcgggaggggatcttcgtggagccggcgagtgccgcctcgatagcgggactcaggaagttcgtggaggagggtgagatcgacgccgacgagcgggtggtctgcgtgaccaccggacacggtttgaaggatccggagacggtcatggaagtgtgtgagctgcctgaacccgtggaaccggatcccgagaccatacagcgtttaatcgccgagtga

SEQ ID NO: 31354 - protein, 403 aa, Methanopyrus kandleri AV19
MHYVLECVECGSEFDDDSLVRCPECGGLLEVALRYDEIEVSRSTFEGRRLGVWAFRELLPVNTDDPVTMSEGGTGLHPCPRLGEELGVRELFVKNEGENPTGSFKDRGMTVGVTKAVELGAEVVACASTGNTSASLAAYAARAGLTCAVLLPAGKVALGKLAQALFHGARVIPVNGNFDDALDVVKKLADEGIVYILNSVNPFRLSGQRTIAYEICLQLDWEVPDAVVVPVGNAGNISAIWQGFLDLYRLGIIDELPRMYGVQAEGARPIVEAIRRGKEDIEPDPEPETVATAIRIGNPVNAIKALRAIRCSGGWAVEVSDEEILSAQRELATREGIFVEPASAASIAGLRKFVEEGEIDADERVVCVTTGHGLKDPETVMEVCELPEPVEPDPETIQRLIAE

SEQ ID NO: 31355 - DNA, 1056 bp, Thermoanaerobacter tengcongensis MB4
  CDS (1)..(1056): transl_table=11
atggcgtacgaaggaattataaaagcttatagagagtttttgcctcctataagagatgaaaatattgtcacgttaaaagagggcaacacacctttaattgaagcttttaacctccaaagaaaatatttgccgggtataagggtgtatctaaaatacgaagggctaaatcccacaggttcttttaaggacagggggatgacggtagcggtatctcaagcaaagcaagaagggtctaatgccgtcgtatgcgcctcaacaggcaacacttctgcttctgcagcagcctatgcagcaaaagcaggccttaaaagtgtggtattaattcctggcggtaaaattgctctggggaaactcgcacaggcaattgcttatggggcagaggttattgcggtagatggcaattttgatgacgctttaaggcttgtgagagaaatttcgcagaaattcccgattactttggtaaattctataaacccctatcgcctggaaggccaaaaaacggcagcttttgaaatatgtgatgctttgggagaagtaccagactatgtctctcttcctgtgggcaatgcaggaaatataactgcttactggatgggatttaaagaatactaccggaaggggaagataaaaaagcttcccaaaatgcttggctttcaggcggcaggagcggctcctattgtggaaggaagagtaatagaaaatcccgagacgattgccacggctataagaattggcaaccctgccagctggcagaaggcagtggctgcaagagatgagtcgggggggataattgacaaagttacggatgaggaaatactggaggcttattcaattttggcaaaaacagaggggatttttgcagagccagcctctgcagcctccatagcgggtgtgataaagaagtacaaagaaggattttttaaagaaggagattctgtggtgtgtatccttacggggaatggtttaaaagaccctgatactgctgttaaactagggggagaggtaaagagaatacagccaaatctaaaggaattggaggaagttttgtatggatag

SEQ ID NO: 31356 - protein, 351 aa, Thermoanaerobacter tengcongensis MB4
MAYEGIIKAYREFLPPIRDENIVTLKEGNTPLIEAFNLQRKYLPGIRVYLKYEGLNPTGSFKDRGMTVAVSQAKQEGSNAVVCASTGNTSASAAAYAAKAGLKSVVLIPGGKIALGKLAQAIAYGAEVIAVDGNFDDALRLVREISQKFPITLVNSINPYRLEGQKTAAFEICDALGEVPDYVSLPVGNAGNITAYWMGFKEYYRKGKIKKLPKMLGFQAAGAAPIVEGRVIENPETIATAIRIGNPASWQKAVAARDESGGIIDKVTDEEILEAYSILAKTEGIFAEPASAASIAGVIKKYKEGFFKEGDSVVCILTGNGLKDPDTAVKLGGEVKRIQPNLKELEEVLYG

SEQ ID NO: 31357 - DNA, 1230 bp, Streptomyces coelicolor A3(2)
  CDS (1)..(1230)
atgagctacagcacagcgtcctgcgtcgctcccgtcaccctcgacgacgtgcgcggagcccagaagatgctctcgggcgtggcgcgggtgacggccatggagggcagcaggcacctctcccagctggtcggctcgccggtgcacctcaagtgcgagaacctccagcggacgggctcgttcaagctgcgcggcgcctacgtgcggatcgccgggctgctccccgagcagcgggccgcgggcgtggtcgcggcgagcgcgggcaaccacgcgcagggcgtcgcgctggcctcgtcgctgctcggtgtgcgctcgacggtgttcatgccgcagggggcgccgctgcccaagatcagcgcgacccgggactacggcgccgaggtgcggctgcacggccaggtggtggacgagacgctggccgccgcgcaggagtacgcggagcggaccggcgcggtcttcatccaccccttcgaccaccccgacgtcatcgcgggccagggcacggtcgggctggagatcctggagcagtgccccgaggtgcggaccgtcgtcgtcggcatcggcgggggcggactggcggccgggatcgcggtcgcggtgaaggcgctgcggccggacgtgcggatcgtcggcgtgcaggcggagggcgcggccgcctacccgccctcgctggccgccggacgcccggtcgccgtgcagaacccggcgacgatggccgacgggatcaaggtggggcggcccggcgacgtgccgttcgggatcgtcggcgaactggtggacgaggtccgcacggtctccgaggacgcgctgtcgaccgcgctgctgctgtgtctggagcgggccaagctggtcgtggagccggccggagcgagcccggtggcggcgctgctgagcgagccggacgccttcgagggaccggtcgtcgcggtcctgtccggcggcaacgtggacccggtgctgatgcagggtgtgctgcggcacggcatggccgcgcagggccgctacctggcggtccggctgcggctgacggaccggcccggcgccctggccacgctgctcggggtgttgtcagtggtcgacgctaacgtcctcgatgtgagccacgtccgaacccatccgcggctcgggctcacggaggcggaggtcgagctgcacctggagacgaagggcccggagcactgcaccgaggtcggccgcgtgctgcgggaagcgggatacacggtcatcgcctga

SEQ ID NO: 31358 - protein, 409 aa, Streptomyces coelicolor A3(2)
MSYSTASCVAPVTLDDVRGAQKMLSGVARVTAMEGSRHLSQLVGSPVHLKCENLQRTGSFKLRGAYVRIAGLLPEQRAAGVVAASAGNHAQGVALASSLLGVRSTVFMPQGAPLPKISATRDYGAEVRLHGQVVDETLAAAQEYAERTGAVFIHPFDHPDVIAGQGTVGLEILEQCPEVRTVVVGIGGGGLAAGIAVAVKALRPDVRIVGVQAEGAAAYPPSLAAGRPVAVQNPATMADGIKVGRPGDVPFGIVGELVDEVRTVSEDALSTALLLCLERAKLVVEPAGASPVAALLSEPDAFEGPVVAVLSGGNVDPVLMQGVLRHGMAAQGRYLAVRLRLTDRPGALATLLGVLSVVDANVLDVSHVRTHPRLGLTEAEVELHLETKGPEHCTEVGRVLREAGYTVIA

SEQ ID NO: 31359 - DNA, 1218 bp, Methanosarcina mazei Go1
  CDS (1)..(1218): transl_table=11
atgtatcatctaaaatgtatcgagtgcggtgcagagtattcaaaagatgaagtaatctatacatgcagcaaatgcgatgggctgcttgatgttatttatgattattcctcaattaaactcgacatggaaaaattaaagaccgaatgtccttcggtctggaaatatgcagaacttctccccatagaaagagaacctgtgaccatacatgaaggcgggaccccactttacagatgcgatcgccttgccgaaaagatagggattaaagaactctatgtaaaacatgaaggaatgaacccgactggctcatttaaagatagagggatgactgttggggttacaaaagcacttgaactcggaatgagtaccgtcgcctgtgcatcaaccgggaacacgtcggcagcccttgcaatctatggggcaaaagcaggaatacctgtggttgtgcttcttccggctggaaaagttgcccttggaaaggtagcccaggcacttatgcacggggcaaaagtcctcagcatccgcggaaactttgatgatgcactcgctcttgtgcgcactctctgctcccaggaaaagatctacctcttaaactcgatcaacccttacaggctggaaggccagaagaccatcggcttcgagattgcagaccagctcggcttcaaagttcctgacaggattgtcctgcccgtaggaaatgcaggcaatatcactgctatctacaagggtttcagggagttcaagctccttggcatcacggactccctcccgaagatgacgggaattcaggcagcaggctcctgccccatagtaaaagccattaaaaacggggctccggaaatcactcccgaagagaacccggagacggttgcaacggcaatcaggataggaaaccctgtgaacgcaacaaaagccctgaacgctataagggaatccggcggtactgcggagtccgtaactgatgaagaaatccttgcagcccagaaagaccttgcaaggcttgagggtataggagtcgaacctgcaagtgcagcctcggtagctggtcttaagaaactcgttgacatgggagtcataggcagggacgaaacagtagtctgcattaccacaggccacctccttaaagacccccagaccgttattgacatctgtgaggaacctactgtcgttgatgcaaacatcgagtccatccgggaagcgattttcgggaagggaaaataa

SEQ ID NO: 31360 - protein, 405 aa, Methanosarcina mazei Go1
MYHLKCIECGAEYSKDEVIYTCSKCDGLLDVIYDYSSIKLDMEKLKTECPSVWKYAELLPIEREPVTIHEGGTPLYRCDRLAEKIGIKELYVKHEGMNPTGSFKDRGMTVGVTKALELGMSTVACASTGNTSAALAIYGAKAGIPVVVLLPAGKVALGKVAQALMHGAKVLSIRGNFDDALALVRTLCSQEKIYLLNSINPYRLEGQKTIGFEIADQLGFKVPDRIVLPVGNAGNITAIYKGFREFKLLGITDSLPKMTGIQAAGSCPIVKAIKNGAPEITPEENPETVATAIRIGNPVNATKALNAIRESGGTAESVTDEEILAAQKDLARLEGIGVEPASAASVAGLKKLVDMGVIGRDETVVCITTGHLLKDPQTVIDICEEPTVVDANIESIREAIFGKGK

SEQ ID NO: 31361 - DNA, 960 bp, Xanthomonas campestris pv. campestris str. ATCC 33913
  CDS (1)..(960): transl_table=11
atgatcgaaacgcttcttcctgcctattccgacgtcctgcaggcggctgcacgcattgccccgcacaccgcaccgaccccgttgctgcgctcgcacacgctggacacgctcagcggtgcgcagctgatgttcaaggccgagcacctgcagcgcagcggtgcgttcaaattccgcggcgcctgcaatgcggtctgggcgttgccggccgagaccgccgcacatggcgtggtgacgcactcttccggcaaccatggcgcggcgctggcactggccgcgcgcacccgcggcatcggctgccatgtggtggtgcccgaaggcgcggtggctgccaagctggccaatatttcccggcatggcgccaccttgtggcgctgcgcgccgaccatcgctgcgcgcgagcagctatgcgccgaggtccaggccagcagcggtgcgaccctggttcacccgtataccgatccggcggtgattgccggccagggcaccgcaacgctggagctgttgcacgacagcggcggcctggatgtgctggtggcgcccgtgggcggcggcgggctggcggccggggcggccctggcgctgcaggcttcgcccggttgcgcgctggtgctggccgagccggcgggtgcagccgacaccgcgcggtcgctggcggcagggcagcggctggtggacttcgttcccgacaccgtgtgcgacgggctgcgcggcaccctgggggcgcccaacttcgcgctgctgcaggccgccggagcgcaggtcatcaccgttgacgatgccgccgtggtgcaggccatgcgcctgctctggcaggtcttgaaacaggtggtggaaccgtcgtcggccatcgcgctggcggccgtgctggccgacccggcgcgctttgccgggaagcgggtgggcgtcatcttgtctggcggcaacgtcgacctggacgccttgccgtgggccgccgcgtga

SEQ ID NO: 31362 - protein, 319 aa, Xanthomonas campestris pv. campestris str. ATCC 33913
MIETLLPAYSDVLQAAARIAPHTAPTPLLRSHTLDTLSGAQLMFKAEHLQRSGAFKFRGACNAVWALPAETAAHGVVTHSSGNHGAALALAARTRGIGCHVVVPEGAVAAKLANISRHGATLWRCAPTIAAREQLCAEVQASSGATLVHPYTDPAVIAGQGTATLELLHDSGGLDVLVAPVGGGGLAAGAALALQASPGCALVLAEPAGAADTARSLAAGQRLVDFVPDTVCDGLRGTLGAPNFALLQAAGAQVITVDDAAVVQAMRLLWQVLKQVVEPSSAIALAAVLADPARFAGKRVGVILSGGNVDLDALPWAAA

SEQ ID NO: 31363 - DNA, 960 bp, Xanthomonas axonopodis pv. citri str. 306
  CDS (1)..(960): transl_table=11
atgatcgagacggtcccccttgcccattccgacgtcctgcaagccgctgcgcggatcgcgccgcactgcgcgccgacaccgttgctgacatcgcacagcctagatgcgctcagcagtgcgcagttgttcttcaaggccgagcatctgcagcgcagtggcgcattcaagttccggggtgcctgcaatgccgtatggtcgctgccggacgcgctggctgcgcgcggtgtggtcacgcattcctccggcaatcacggcgcggcgctggcgcttgccgcacgcacgcgcggcatcggctgccacgtggtggtgcccgagggcgcggtggcggccaagctcgccaatatctcccggaacggcgccacgttgtggcgttgcgcgccgaccatcgcggcgcgggaacagatgtgcgctgaggtgcaggccggcagcggcgccacgctggtgcacccgtataccgatcgtgcagtgatcgccgggcagggcaccgccacgctggagttgctgcaccagagcggcgtgctggatgtgctggtggcgcctgtcggcggtggtgggctggcggccggtgccgcactggcgctgcaggcttcgccggactgcgagctggtgctggccgagcctgccggcgcagccgacaccgcgcgttcgctggcggccgggcagcggctggtcgatttcgtgccggacaccatttgcgacggcctgcgcggcaccttgggcgcgcccaacttcgccgtgctgcagcgcgccggtgcgcaggtgatcacggtggacgatgccgcggtggtgcaggccatgcggctggtctggcagttgctcaagcaagtggtcgagccgtcttcggcgatcgccctggctgcggtcctggcccagccggcacggtttgccgggcggcgagtggggctgatcctgtccggcggcaatgtcgatctggacgccttgccttgggtcgcggcgtga

SEQ ID NO: 31364 - protein, 319 aa, Xanthomonas axonopodis pv. citri str. 306
MIETVPLAHSDVLQAAARIAPHCAPTPLLTSHSLDALSSAQLFFKAEHLQRSGAFKFRGACNAVWSLPDALAARGVVTHSSGNHGAALALAARTRGIGCHVVVPEGAVAAKLANISRNGATLWRCAPTIAAREQMCAEVQAGSGATLVHPYTDRAVIAGQGTATLELLHQSGVLDVLVAPVGGGGLAAGAALALQASPDCELVLAEPAGAADTARSLAAGQRLVDFVPDTICDGLRGTLGAPNFAVLQRAGAQVITVDDAAVVQAMRLVWQLLKQVVEPSSAIALAAVLAQPARFAGRRVGLILSGGNVDLDALPWVAA

SEQ ID NO: 31365 - DNA, 1119 bp, Xanthomonas axonopodis pv. citri str. 306
  CDS (1)..(1119): transl_table=11
atgcctgattccggccgcccttccgcacaggagccagaggtaggcgacgtggccgtgagcgtggccgacgtgctggccgcacaggcacgcctgcgcaagtacctgtcgcccacgccgctgcactacgccgaacgcttcggtgtgtggttgaagctggagaatttgcagcgcaccggctcctacaaggtgcgcggcgcattgaatgcgttgctggccgggctggaacgcggcgatgagcgcccggtgatctgcgcctcggccggcaaccacgcgcaaggtgtggcgtggtcggcgtaccggctgggtgtgcaggccatcacggtaatgccctatggcgcgccgcagaccaagattgccggtgtcgcgcattggggtgccacggtgcgccaacatggcaacagctacgacgaagcgttcgcgtttgcgcgcgagctggccgaccagaacggctatcgcttcctgtccgccttcgacgacccggacgtgatcgccggccagggcacggtgggcatcgagctggcggcgcatgcgccggacgtggtgatcgtgccgatcggcggcggtggcctggcctccggcgtggcgctggcattgaagtcgcaaggcgtgcgcgtggtcggggcgcaggtggaaggcgtggattcgatggcgcgcgccgtccgcggcgatctgcgcgaaatcgctccggtcccaacgctggccgatggcgtgaaggtcaagattccaggcctgctcacgcgccgcctgtgctcgagcctgctcgatgatgtcgtgatcgtgcgcgaggccgaattgcgcgaaacattggtgcgcctggcactggacgaacacgtcattgccgagggcgctggcgccctcgccctggccgccggtcgccgcgtttccggcaaacgcaaatgtgcggtggtctctggcggtaatatcgacgcaaccgtgctggccacactcttgtccgaggtgcggccgcgtccgccacgcaagccgcgccgccgcaataccgagcgactccgcaacgaacgcagcgccaatccgccacccgccacacacgttctttcccgcccatccgcagtcgcttcaacgcctgtcaccgccatcgccgtagaggagtcttcctggtga

SEQ ID NO: 31366 - protein, 372 aa, Xanthomonas axonopodis pv. citri str. 306
MPDSGRPSAQEPEVGDVAVSVADVLAAQARLRKYLSPTPLHYAERFGVWLKLENLQRTGSYKVRGALNALLAGLERGDERPVICASAGNHAQGVAWSAYRLGVQAITVMPYGAPQTKIAGVAHWGATVRQHGNSYDEAFAFARELADQNGYRFLSAFDDPDVIAGQGTVGIELAAHAPDVVIVPIGGGGLASGVALALKSQGVRVVGAQVEGVDSMARAVRGDLREIAPVPTLADGVKVKIPGLLTRRLCSSLLDDVVIVREAELRETLVRLALDEHVIAEGAGALALAAGRRVSGKRKCAVVSGGNIDATVLATLLSEVRPRPPRKPRRRNTERLRNERSANPPPATHVLSRPSAVASTPVTAIAVEESSW

SEQ ID NO: 31367 - DNA, 1041 bp, Staphylococcus aureus subsp. aureus MW2
  CDS (1)..(1041): transl_table=11
atgacaaccaacacagttacattacaaacagcacatattgtaagtttaggagatatcgaagaagctaaagcaagcattaaaccatttattcgtcgaacacctctaattaaatcaatgtatttaagccaaagtataactaaagggaatgtatttctaaaattagaaaatatgcaattcacaggatcttttaaatttagaggcgctagcaataaaattaatcacttaacagatgaacaaaaagaaaaaggcattatcgcagcatctgctgggaaccatgcacaaggtgttgctttaacagctaaattattaggcattgatgcaactatcgtaatgcctgaaacagcaccacaagcgaaacaacaagcaacaaaaggctatggggcaaaggttattttaaaaggtaaaaactttaacgaaactagactttatatggaagaattagcgaaagaaaatggcatgacaatcgttcatccatatgacgataagtttgtaatggcaggccaaggaacaattggtttagaaattttagatgatatttggaatgtgaatacagtcatcgtaccagttggcggtggaggattaattgcaggtattgccaccgcattaaaatcatttaacccttcaattcatattatcggtgttcaatctgagaatgttcatggtatggctgagtctttctataagagagatttaactgaacatcgagtggatagcacgatagcagatggttgtgatgtaaaagttcctggtgaacaaacatatgaagtagttaaacatttagtagatgaatttattcttgttactgaagaagaaattgaacatgctatgaaagatttaatgcagcgtgccaaaattattactgaaggtgcaggcgcattaccaacagctgcaattttaagtggaaaaataaacaataaatggcttgaagataaaaatgttgttgctttagtttcaggcgggaatgttgacttaactagagtttcaggtgtcattgaacatggactgaatattgcagatacaagcaagggtgtggtaggttaa

SEQ ID NO: 31368 - protein, 346 aa, Staphylococcus aureus subsp. aureus MW2
MTTNTVTLQTAHIVSLGDIEEAKASIKPFIRRTPLIKSMYLSQSITKGNVFLKLENMQFTGSFKFRGASNKINHLTDEQKEKGIIAASAGNHAQGVALTAKLLGIDATIVMPETAPQAKQQATKGYGAKVILKGKNFNETRLYMEELAKENGMTIVHPYDDKFVMAGQGTIGLEILDDIWNVNTVIVPVGGGGLIAGIATALKSFNPSIHIIGVQSENVHGMAESFYKRDLTEHRVDSTIADGCDVKVPGEQTYEVVKHLVDEFILVTEEEIEHAMKDLMQRAKIITEGAGALPTAAILSGKINNKWLEDKNVVALVSGGNVDLTRVSGVIEHGLNIADTSKGVVG

SEQ ID NO: 31369 - DNA, 1410 bp, Drosophila melanogaster
  CDS (1)..(1410)
atgtcccaggcagtgaaaacggaaacgcccaaggaaccaaatgttgtggctgccaaagccaatggcggcaccgctgtcaatggaaagttggaagcccagaagagaccccggcatgtttctggtggtgtggaggaaatcatcgatcccttttgcaatccggagaaaccgcaacgcatatccttccatgacgtcacatccgctgcctttctcatccgcggtggcgtggaacgcactccttgtccgaaatccacatcatcggatctatatggcatggagttatatctgaaaaaggatttcctacaatatacaggcagcttcaaggagcgtggcgcacgctatgccttgctatcattgaccgaggaacagaagcgaaccggagtgatcagtgcctccttgggtaatcacgcccaggccctgtgctatcatggctggaaactcaatataccagtgaccgtggtgatgcccaaggcggcgcccatcatgaagatccaaaagtgccggaactacaaggcacgcgtcatcgtcgacggaaatgacatgggcgaagccaagtccctggccatgcgaatgtcccgcgaggagggactcctgtacgtgaatggctacgatcatccgcacattatggccggccagggaactattggtttggagatactcgaacaggtgccggaaccggatgcagtggtggtgccagtgggcggcggtggactgattgccggtattgccacagccgttaaagctttgtcccccaaaaccaagattattggtgtggagtcggagaagtgcgccagcttcacccgggccatggaaaatgatggacctattcacacgcccatcaagaacacattggctgatggcttggccgttcctaaagttggctataatgcctatgccaccgcaatgccgctaatagatcgcatggtggtggtcaaggaggagtggatcgcagtggctatcctaagattggtggaggaggagaagtgcgtcgtcgagggagcgggtggtgcgggtctggcggccattctggccggacacttggatgagctcaagggaaagaaagttgtggtgcttctgtgtggaggaaacatagacaccaccgtttttggacgttgtttggagcgaggtttggctgccgttggacgcctggttaagtttaatgtggaggttagcgatcgtcctggcggaatcaacgatctttgcgccctgcttgtccgagtaggcgtgtccattaaggacatcatgcacgagcgagcctggctgagggatgtttataccgtggaagtgaaggtcgtgtgcgaaaccgtggactggacccatagtttgcagctaaaaaacgagctgaagaagttctactcgaaagttcagttctccgatgttccgctggccctgtcaaatgataccgattcgtag

SEQ ID NO: 31370 - protein, 469 aa, Drosophila melanogaster
MSQAVKTETPKEPNVVAAKANGGTAVNGKLEAQKRPRHVSGGVEEIIDPFCNPEKPQRISFHDVTSAAFLIRGGVERTPCPKSTSSDLYGMELYLKKDFLQYTGSFKERGARYALLSLTEEQKRTGVISASLGNHAQALCYHGWKLNIPVTVVMPKAAPIMKIQKCRNYKARVIVDGNDMGEAKSLAMRMSREEGLLYVNGYDHPHIMAGQGTIGLEILEQVPEPDAVVVPVGGGGLIAGIATAVKALSPKTKIIGVESEKCASFTRAMENDGPIHTPIKNTLADGLAVPKVGYNAYATAMPLIDRMVVVKEEWIAVAILRLVEEEKCVVEGAGGAGLAAILAGHLDELKGKKVVVLLCGGNIDTTVFGRCLERGLAAVGRLVKFNVEVSDRPGGINDLCALLVRVGVSIKDIMHERAWLRDVYTVEVKVVCETVDWTHSLQLKNELKKFYSKVQFSDVPLALSNDTDS

SEQ ID NO: 31371 - DNA, 1263 bp, Bacillus anthracis str. A2012
  CDS (1)..(1263): n means a or g or c or t/u, s means g or c
atggtgcaaaaggtaaaggagagagtgaaaattgaagatatcttaatggcccatacttgtatgaaagatatcgttattaaaacaccgttacaacgtgatacagttttatctgagaaatatgattgtgacgtttatgtaaaacgcgaagacttacaattaattcgctctttcaaaattcgtggtgcgtacaatttaattcgaagtttatcgaaagaacaattacaaaacggtgttgtttgtgcaagcgctggtaatcatgcacaaggggtagcttatacgtgtaatttattgaagattccgtcaaaaattttcatgccaacaacaacacctaagcaaaaagtatcacaagttcaatttttcggtggtgatttcgcagagattgtattggttggtgatacattcgatagctcttttcaagaagcgcagcgttattgtgaagaaaatagaatgacatttgttcatccgtttgatgatccgtacgtagttgctggtcaagggacagtggcagttgaaattatgcatgatatggagaaaccggttgattatatctwtacagcaatcggcggtggtggattagcatcaggtgttggtacatatgtgwmaggtgttagtcctgctacacaggtcattggggtagagccaatgggagctgcatctatgaaagaggcttttcttcaaaatgataatgtggcattggagaaaatagatagttttgttgatggggcagcggttaaaaaggtaggaaagttaacatttgaaacttgtaaagatgtaattgatgacattgttttagtaccagagggaaaggtttgtacgacgattttagaactgtataagaaaaatgcgattgtagctgaaccagctggtgcactctctattgcagcgcttgatttatacagagatgaaattaaaggtaaaacagttgtatgcacattaagtggtggaaacaatgatattgatagaatgcaagaaatgaaagaacgatctcttatttacgaagggttaaagcattatttcatcattgaattcccgcaacgttcaggtgcgttaagagaatttcttgataaaggattagggccagaagatgatattactcgctttgagtatattaagaaacataataaggaaaatggtccagcattagtcggagtagagttaaaacataaagaagattacgagcagttaattatccgttttaaagaaaataatattcaatttatggagcttaataaaaatcctgttttgtttgatttgcttatttaa

SEQ ID NO: 31372 - protein, 420 aa, Bacillus anthracis str. A2012
  Xaa in positions 184 and 201 is unknown
MVQKVKERVKIEDILMAHTCMKDIVIKTPLQRDTVLSEKYDCDVYVKREDLQLIRSFKIRGAYNLIRSLSKEQLQNGVVCASAGNHAQGVAYTCNLLKIPSKIFMPTTTPKQKVSQVQFFGGDFAEIVLVGDTFDSSFQEAQRYCEENRMTFVHPFDDPYVVAGQGTVAVEIMHDMEKPVDYIXTAIGGGGLASGVGTYVXGVSPATQVIGVEPMGAASMKEAFLQNDNVALEKIDSFVDGAAVKKVGKLTFETCKDVIDDIVLVPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLIIRFKENNIQFMELNKNPVLFDLLI

SEQ ID NO: 31373 - DNA, 1545 bp, Yersinia pestis KIM
  CDS (1)..(1545): transl_table=11
atggcagtttcgcaacccttatctgctgccccctgcggggcagaatatctgcgggcgatattacgtgcgccggtgtatgaggtggcgcaagtcaccccgttacaagtgatggagaaaatctcctcgcgcgtgggtaataccgttttagtgaagcgtgaagatcggcagccggtacacagctttaagttgcgcggtgcttacgcgatgatctccagcctgacggaagagcagaaagcctgtggcgtcgtcacggcttctgcgggtaaccatgctcaaggcgtggcgctttctgcccataaaatggggattaaagcgctgatcgtcatgcccgttgctactgcagatattaaagttgatgcggtacgtgcttttggcggcgaggtgctgctgtttggcgctaattttgatgaagccaaaaccaaagctatcgcgcttgctcaagagcagggctacacctttgtgccaccgtttgaccatccggcggtgattgccgggcaggggacgctggcgatggagttactgcaacaagatgcccatcttgatcgggtttttgtcccagtgggcggcggtgggctggtggccggtgtggcggtgcttatcaagcaattgatgccacagattaaagtgattggtgttgaagccgaggattctgcctgtttgcgggccgcgctggatgcggggcagccggtcgatttggcgcgtgtcgggctgtttgccgagggcgtggcagttaagcgtatcggtgacgagcctttccgcctgtgtcaggaatatctggacgatgtgatcaccgttgacagtgatgctatctgtgccgcagtcaaagatctgtttgaggatgttcgcgccattgctgagccttctggtgcgttggcattggcgggcctgaaaaaatatgtgcagcagcataatattcagggcgagcgtctggcacatgtgctttctggtgcaaacgtgaacttccatggtttgcgttatgtgtcagagcgttgcgagttaggtgagcagcgtgaagccctgctggcggtgactattccagagcaaaagggcagtttcctgcgtttctgtgaattactgggtggccgttcggtaacggaatttaactaccgttacgccgatgctgaaaacgcctgcatttttgttggggtacgtttgactcgtggttatgctgagcgggttgaaattcttgctgaattgcaggacaaaggttatcaggtggtcgatttatctgatgacgaaatggcgaaactgcatgtgcgttatatggttggtgggcggccctcgaaaccactgcgtgagcgcctgttcagctttgaattccccgagtcaccaggcgctttgctgaaattcctgcatacgttgggcactcactggaatatttctctgttccactaccgcagccatggcacagattttggccgggtattggcggcatttgagttgtcggctaccgaaccgcaatttgaagagcgcttagcggctctgggctactattgccacgatgaaacggataacccggcgtttaagttctttttagcgggttaa

SEQ ID NO: 31374 - protein, 514 aa, Yersinia pestis KIM
MAVSQPLSAAPCGAEYLRAILRAPVYEVAQVTPLQVMEKISSRVGNTVLVKREDRQPVHSFKLRGAYAMISSLTEEQKACGVVTASAGNHAQGVALSAHKMGIKALIVMPVATADIKVDAVRAFGGEVLLFGANFDEAKTKAIALAQEQGYTFVPPFDHPAVIAGQGTLAMELLQQDAHLDRVFVPVGGGGLVAGVAVLIKQLMPQIKVIGVEAEDSACLRAALDAGQPVDLARVGLFAEGVAVKRIGDEPFRLCQEYLDDVITVDSDAICAAVKDLFEDVRAIAEPSGALALAGLKKYVQQHNIQGERLAHVLSGANVNFHGLRYVSERCELGEQREALLAVTIPEQKGSFLRFCELLGGRSVTEFNYRYADAENACIFVGVRLTRGYAERVEILAELQDKGYQVVDLSDDEMAKLHVRYMVGGRPSKPLRERLFSFEFPESPGALLKFLHTLGTHWNISLFHYRSHGTDFGRVLAAFELSATEPQFEERLAALGYYCHDETDNPAFKFFLAG

SEQ ID NO: 31375 - DNA, 1062 bp, Oceanobacillus iheyensis HTE831
  CDS (1)..(1062): transl_table=11
atgacctggcaaggtttattaaaggaatatgcggatttattaccagtcacagaccagacaccatcattaagtctaatggaaggaaacactcctttattgtcttttccaactttatcaaaggaattaggaatagagttatatggaaaatttgaaggattaaacccgaccggctcatttaaagatagaggcatggttatggcagttgcaaaagcaatcgaagaaggcagcaaatccattatttgtgcttctacaggaaatacttcagctgcagctgctgcctatgctgctagggctggtatacgtgcaattattgtcatccctaaaggaaaagttgctttaggaaaattagctcaagccgtcatgtacggtgcagagattgttgagattgatggtaattttgatgaggcactgcaaatggttcgtaaaatcagtgagaaatcagccgttacattagttaactctgttaatccttatcgtattgacggacaaaaaactgccgcatttgaagtttgcgatcaattaggttcagctcctgatattcttgctattccagtagggaatgcaggaaatattagtgcatattggaaaggatttaaagaatataacgaaaaacaccaatcgggactacccaaaatgatgggatttgaagcagaaggtgctgctgctattgttaaaaataaagttattgagcaaccagaaacagtagctactgctatccgtatcggtaacccagcaagttgggaacttgccctaaaagcaaaagaagaatcaaatggaagtattgggtatgtaacagatgaagagattgtaaatgcgttcaagcttttaccacaaaaagaaggtatttttgcagagccaggatcagcagcatctatcgctggtgttatccaacaggttaaaagtggaactattccaaaaggtagtaaggttgttgctgtattgacagggaatggattgaaagatccacaaacggcaatcgatcaactatccattgatcctgtaagcttaccaaacaacgaaaaagcagtcatggactatcttgaagagttgattacatcatga

SEQ ID NO: 31376 - protein, 353 aa, Oceanobacillus iheyensis HTE831
MTWQGLLKEYADLLPVTDQTPSLSLMEGNTPLLSFPTLSKELGIELYGKFEGLNPTGSFKDRGMVMAVAKAIEEGSKSIICASTGNTSAAAAAYAARAGIRAIIVIPKGKVALGKLAQAVMYGAEIVEIDGNFDEALQMVRKISEKSAVTLVNSVNPYRIDGQKTAAFEVCDQLGSAPDILAIPVGNAGNISAYWKGFKEYNEKHQSGLPKMMGFEAEGAAAIVKNKVIEQPETVATAIRIGNPASWELALKAKEESNGSIGYVTDEEIVNAFKLLPQKEGIFAEPGSAASIAGVIQQVKSGTIPKGSKVVAVLTGNGLKDPQTAIDQLSIDPVSLPNNEKAVMDYLEELITS

SEQ ID NO: 31377 - DNA, 1017 bp, Oceanobacillus iheyensis HTE831
  CDS (1)..(1017): transl_table=11
gtgagttgtcttggggatcgcttaactggtgaaaaagtataccaagctatgaagaaattaacaccgattgttcatcgtacaccattagtaacatcacatacaacggatgatattgttggaaaacatgtttactgtaaaatggaaaatcaacaaaaaactggggcatttaaatttcgaggagcaagttataaattaatgcaactgtcaaaagaagaattacaacacggcgtaattacagcttcagctggtaatcatgcacaaggtgtagctcatgccgctgcaaaattaggagttaaggcaacgatttttatgtctgaaggaacgcctctagcgaaaattaatgcgacaagaaattatggggcaaccgtaaatcttgttggagaaagttttcaagaagcttatgaggcttcacttcaacatcaaaaagtaactggtgctacgtatatccacccatttgatgattatgatattatggctggtcaagggacaattgcaatggaattactccgccaagaagaccgtattgataccattattgtcccaattggtggaggtggattaattagtggcattgcagttgctgctaaacatgtaaatagaaacattaaaataatcggcgtacaggctgaaggtgctgcagcaatgcatcaaagttatcattcgagcaaagtacattctttatcaaatgtttcaacaattgcagaaggaatagcggtaaaacaaccaggagatttgaccttgccacttattcgatcctatgttgatgatattgttacggttaatgatgaacaaattgcttcagcaatcatttacatgttggaaagaaataagacgttaatggaaggtgctggtgccgctgcattagctgcactatttgcacataatgacacgatctcatccaggcattgtggtgttatagttagtggaggtaacttggacatcagtaatatgcaaaaaatacaacatctatccagtaatattaataaaaatccagaaagagcatatgtggcgctataa

SEQ ID NO: 31378 - protein, 338 aa, Oceanobacillus iheyensis HTE831
MSCLGDRLTGEKVYQAMKKLTPIVHRTPLVTSHTTDDIVGKHVYCKMENQQKTGAFKFRGASYKLMQLSKEELQHGVITASAGNHAQGVAHAAAKLGVKATIFMSEGTPLAKINATRNYGATVNLVGESFQEAYEASLQHQKVTGATYIHPFDDYDIMAGQGTIAMELLRQEDRIDTIIVPIGGGGLISGIAVAAKHVNRNIKIIGVQAEGAAAMHQSYHSSKVHSLSNVSTIAEGIAVKQPGDLTLPLIRSYVDDIVTVNDEQIASAIIYMLERNKTLMEGAGAAALAALFAHNDTISSRHCGVIVSGGNLDISNMQKIQHLSSNINKNPERAYVAL

SEQ ID NO: 31379 - DNA, 1227 bp, Brucella suis 1330
  CDS (1)..(1227): transl_table=11
atgacccccttcgtcaaatccgtggcccaggcagaaaaggcaatgcgcgcgctcttttgcgaaacgccattgcaacgcaacgattatctgtcgcggaaatatggtgcgcagatttggctgaaacgcgaagacctgacgccggtgcgctcctacaagctgcgcggtgccttcaattttatttccaaagccgttgaaacaacagataaaaatgccgttttcgtctgtgcttccgccggcaatcatgcgcagggctttgcattcgtctgccggcatttcgggcgcaagggcgtggttttcatgccagtcaccacgccgcagcagaaaatcgacaagacgcgcacctttggcggagaattcatcgaaatcaaacttgtcggcgatattttcgatgtctgttatgccgcctcgcaggaattcgcagccgccaacaagggcgtgatggtgccacccttcgaccatcccggcattgttgaagggcaggcgacagtcgcgctggaaatcgagcggcaattgccggacgacagcaagtcggacctcgtgctcctgccggttggcggtggcgggctttcaagcggcgtaacgcaatatatcgccgatcttggctggaaaaccgctttccgctttgtggagccgcagggcgcggcaagcctcaaggccagcctggaggcgggcaagcgggtcaagctttcgcatatcgataattttgtcgatggtgctgccgttgcagaaatccgcaaagaaaatttcaaacttctcaaaggcttcgatccgaaaactgtcataacggttccggaaaacaggctctgcgcgaccattgttgaaatgctgaatattgaaggtgttgtgctggaaccggccggtgcgctcggcatcgatgcgctcaaggatttcaagaaaagcgacatcaagggcaaacgcattgttatcgtcgtttctggcggcaatttcgatttcgagcggctgccggatgtgcgggaaagggcgcttcgttttgaagggctgaagaaatatttcattttccgctttcctcagcgccccggcgcattgcgctccttccttgaccttctggggccggatgacgatattgcgcgctttgaatatctcaagaaatcggcgcgaaatttcggctcggtgctaatcggtatcgaaaccagggacgcggcaaatttcaagcttctggagaagaagtttgccgaatccggctgggcatcaggatatcagcgataa

SEQ ID NO: 31380 - protein, 408 aa, Brucella suis 1330
MTPFVKSVAQAEKAMRALFCETPLQRNDYLSRKYGAQIWLKREDLTPVRSYKLRGAFNFISKAVETTDKNAVFVCASAGNHAQGFAFVCRHFGRKGVVFMPVTTPQQKIDKTRTFGGEFIEIKLVGDIFDVCYAASQEFAAANKGVMVPPFDHPGIVEGQATVALEIERQLPDDSKSDLVLLPVGGGGLSSGVTQYIADLGWKTAFRFVEPQGAASLKASLEAGKRVKLSHIDNFVDGAAVAEIRKENFKLLKGFDPKTVITVPENRLCATIVEMLNIEGVVLEPAGALGIDALKDFKKSDIKGKRIVIVVSGGNFDFERLPDVRERALRFEGLKKYFIFRFPQRPGALRSFLDLLGPDDDIARFEYLKKSARNFGSVLIGIETRDAANFKLLEKKFAESGWASGYQR

SEQ ID NO: 31381 - DNA, 1638 bp, Shewanella oneidensis MR-1
  CDS (1)..(1638): transl_table=11
atgttatctctcgcatcgtcgcaaacggaacaagcggagtctcagccagctcaggcttctcccgcttcagttgagaaaagtcagctagctcaacactatctgcaaaagatcctactatcgtcggtttatgatgttgcgaaagtgacaccactctcgagcctcaataaactctcggcgcgtttaggctgccaagtgtttttaaagcgtgaggatatgcaacccgtacattcctttaaactgcgtggcgcctataaccgcatcgcccagttgagccaagccgaatgccagcgtggcgtggtgtgcgcctcggcgggcaaccatgcccaaggtgtagccatgtcggcggcgagccgtggtgtggatgcggtgattgtgatgcccgaaaccacgccggatattaaagtcgatgcggtgcgccgcttgggtggcaacgtggtattgcacggccaagctttcgatcaagccaatggttttgcgatgacgatggcccagcaggaaggtcgggtgtatatcgcccccttcgatgatgaagccgtgatcgctggccaaggcactattgcccaagaaatgctgcaacagcagcgcgatcttgaagtgatttttgtgcccgtgggcggcggcggtttaattgcgggtattgctgcctactacaaggcggtgatgccacaggtgaaaattgtcggcgttgagcctgaagatgcggcctgcttaaaggcggcgatggaagcgggcgagcctgtgaccttatcccaagtgggcctgtttgccgacggggtcgcggttaagcgtattggtactgagccatttcgtgtcgccaaactgtgtgtagatgccgtggtgacggtcacgtccgacgaaatctgtgcagcggtgaaagatatttttgaagatacccgcgctattgccgaacccgcaggtgctttatctttagctgggcttaaaaaatatgtcagcactaatgctacaggtgagagtggtcgcggcgaaaaggtcgcggcgattttaagtggcgcgaatgtgaacttccacagtttgcgctatgtgtccgagcgctgcgagctgggtgagcaaaaagaagcggtgctggcggttaaagtgcccgagcgtccgggcagcttcctgcgtttttgtgagctgctcgaaaagcgggtgatgaccgaatttaattatcgctttagcagccgagatatggcggtggtatttgcgggtatccgtttgaccaaaggccatggtgaattagagcagatcatcaataccttagaagacaatggctttgaggtgcaggacttatccggtgatgaaactgcgaaattgcatgtgcgttatatggtcggtggtcatccgccagagccgttagaggagcgcctatttagctttgagtttcccgagcatccgggtgcactgctgaagtttttaaccaccttgcagagtaagtggaatatcagtctatttcattatcgcaaccacggcgcagcctttggccgagtgctggcggggtttgaagtgcccgcgagtgatgccttgccatttcagcagtttttaactgagctgggatttgtctatcaagaagagacccaaagccctgcttatcaactgtttttgaatgccggaaaaggaaaaaacaacctgcctgtgtag

SEQ ID NO: 31382 - protein, 545 aa, Shewanella oneidensis MR-1
MLSLASSQTEQAESQPAQASPASVEKSQLAQHYLQKILLSSVYDVAKVTPLSSLNKLSARLGCQVFLKREDMQPVHSFKLRGAYNRIAQLSQAECQRGVVCASAGNHAQGVAMSAASRGVDAVIVMPETTPDIKVDAVRRLGGNVVLHGQAFDQANGFAMTMAQQEGRVYIAPFDDEAVIAGQGTIAQEMLQQQRDLEVIFVPVGGGGLIAGIAAYYKAVMPQVKIVGVEPEDAACLKAAMEAGEPVTLSQVGLFADGVAVKRIGTEPFRVAKLCVDAVVTVTSDEICAAVKDIFEDTRAIAEPAGALSLAGLKKYVSTNATGESGRGEKVAAILSGANVNFHSLRYVSERCELGEQKEAVLAVKVPERPGSFLRFCELLEKRVMTEFNYRFSSRDMAVVFAGIRLTKGHGELEQIINTLEDNGFEVQDLSGDETAKLHVRYMVGGHPPEPLEERLFSFEFPEHPGALLKFLTTLQSKWNISLFHYRNHGAAFGRVLAGFEVPASDALPFQQFLTELGFVYQEETQSPAYQLFLNAGKGKNNLPV

SEQ ID NO: 31383 - DNA, 1251 bp, Streptococcus mutans UA159
  CDS (1)..(1251): transl_table=11
atgatttcagctaaagatgtggttgctgctaacaaagtcttaaaagatgttgttgttcaaacaccacttgattttgatcgctatttgtcagaaaaatatggagcgacaatttatttaaaacgtgaaaatatgcaaaaggtgcgttcttttaaaattcgtggcgcttattatgctatttcacaattatcagatgaagaaaaggctagaggagttgtttgtgcttctgccggaaatcatgctcaaggagttgcttatacctgtaatgaaatgaaaattcctgcaactattttcatgcctgtaacgactcctcatcaaaagattgggcaagttcaattttttggaggctcctttgtaactatcaaattggtaggtgatacttttgatgcttctgctcaggcagcccaagattatacgaaagctgaaggaatgacctttatcgatccctttgataatgacatggtacaagcgggtcaaggaacaattgcttatgaaatttatgatcaggctcaagaagatggtttgagctttgatgctattttagtacctgttggtggtggcggtcttatttcaggtgtatcagcctatgttaaagatgtggctcctgaaattgaggttattggcgttgaggcaatgggagcgcgcagcatgcgggcagcttttgataaaggacatcctgttaaattagagcatattgataaatttgcagatggcatagctgttcaaaaggttgggcgttctacctatgatgttgctagaaaatatgtggatcgcttgattggtgtagatgaaggtctcatttctgaaaccttgattgatatgtattctaaacaaggtattattgcagaaccagcaggagcagcttctattgcagctctggaagaaatgaaagatgatattaaaggcaaaactattgtctgtattatttctggtggaaataatgacattaaccgtatgcaagaaatggaagaacgtgcacttatttatgatggtgtgaagcattattttgttgtgaattttccacaacgcccaggagctctgcgggaatttgttaatgatattttaggaccaaatgatgatatcacccgttttgaatatattaaacgtgccaataaaggaacaggtccagtcctaatcggcattactttagcggataaaaatgattatcaggatctaattgatcgtttgggtgcttttgacccaggttatatcaatcttcatggcaatgaaagtctgtataatatgctcgtctga

SEQ ID NO: 31384 - protein, 416 aa, Streptococcus mutans UA159
MISAKDVVAANKVLKDVVVQTPLDFDRYLSEKYGATIYLKRENMQKVRSFKIRGAYYAISQLSDEEKARGVVCASAGNHAQGVAYTCNEMKIPATIFMPVTTPHQKIGQVQFFGGSFVTIKLVGDTFDASAQAAQDYTKAEGMTFIDPFDNDMVQAGQGTIAYEIYDQAQEDGLSFDAILVPVGGGGLISGVSAYVKDVAPEIEVIGVEAMGARSMRAAFDKGHPVKLEHIDKFADGIAVQKVGRSTYDVARKYVDRLIGVDEGLISETLIDMYSKQGIIAEPAGAASIAALEEMKDDIKGKTIVCIISGGNNDINRMQEMEERALIYDGVKHYFVVNFPQRPGALREFVNDILGPNDDITRFEYIKRANKGTGPVLIGITLADKNDYQDLIDRLGAFDPGYINLHGNESLYNMLV

SEQ ID NO: 31385 - DNA, 951 bp, Drosophila melanogaster
  CDS (1)..(951)
atgcccaaggcggcgcccatcatgaagatccaaaagtgccggaactacaaggcacgcgtcatcgtcgacggaaatgacatgggcgaagccaagtccctggccatgcgaatgtcccgcgaggagggactcctgtacgtgaatggctacgatcatccgcacattatggccggccagggaactattggtttggagatactcgaacaggtgccggaaccggatgcagtggtggtgccagtgggcggcggtggactgattgccggtattgccacagccgttaaagctttgtcccccaaaaccaagattattggtgtggagtcggagaagtgcgccagcttcacccgggccatggaaaatgatggacctattcacacgcccatcaagaacacattggctgatggcttggccgttcctaaagttggctataatgcctatgccaccgcaatgccgctaatagatcgcatggtggtggtcaaggaggagtggatcgcagtggctatcctaagattggtggaggaggagaagtgcgtcgtcgagggagcgggtggtgcgggtctggcggccattctggccggacacttggatgagctcaagggaaagaaagttgtggtgcttctgtgtggaggaaacatagacaccaccgtttttggacgttgtttggagcgaggtttggctgccgttggacgcctggttaagtttaatgtggaggttagcgatcgtcctggcggaatcaacgatctttgcgccctgcttgtccgagtaggcgtgtccattaaggacatcatgcacgagcgagcctggctgagggatgtttataccgtggaagtgaaggtcgtgtgcgaaaccgtggactggacccatagtttgcagctaaaaaacgagctgaagaagttctactcgaaagttcagttctccgatgttccgctggccctgtcaaatgataccgattcgtag

SEQ ID NO: 31386 - protein, 316 aa, Drosophila melanogaster
MPKAAPIMKIQKCRNYKARVIVDGNDMGEAKSLAMRMSREEGLLYVNGYDHPHIMAGQGTIGLEILEQVPEPDAVVVPVGGGGLIAGIATAVKALSPKTKIIGVESEKCASFTRAMENDGPIHTPIKNTLADGLAVPKVGYNAYATAMPLIDRMVVVKEEWIAVAILRLVEEEKCVVEGAGGAGLAAILAGHLDELKGKKVVVLLCGGNIDTTVFGRCLERGLAAVGRLVKFNVEVSDRPGGINDLCALLVRVGVSIKDIMHERAWLRDVYTVEVKVVCETVDWTHSLQLKNELKKFYSKVQFSDVPLALSNDTDS

SEQ ID NO: 31387 - DNA, 1311 bp, Corynebacterium efficiens YS-314
  CDS (1)..(1311): transl_table=11
atgagcgcaacacacgtgtctgagaagagcccaggagtgatcgacagcgggatggagccgattcgtgccgccgacattcagatggcgcaggcacgaatttcctccgtgatcgcgcccacccccctggagtactgcccgcgtctgtcggaggagaccggcgtggaggtctacctcaaacgtgaggacctccaggatgttcgttcctacaagatccgcggtgccctcaactccggttcccagctgagccgggagcagcgtgatgctggcattgtggcggcctccgcgggaaaccacgcgcagggtgtggcgtttgtgtgcaagtcactgggtgttcaagggcgcatctacgtgcccgtgcagaccccgaagcagaagcgcgaccgcatcctggtgcacggtggggaatatgtcaccctcgtagtgaccggcaacaacttcgatgaggcctccgctgccgcccatgaggatgccgaacgcaccggggccaccctgatcgaaccgttcgatgcccgggacaccatcatcggccagggcactgtcgcagccgagatcctctcccagctgaccacactgggtaaatccccggaccatgtcatggttcccgtcggcgggggcggactgctcgccggggtggtcagttacatggcagatatggcaccgcgcaccgccatcgtcggggtggaacccgcgggggcagcctccatgcaggcggccctgaaggccggggggccggtgaccctggagaacgcggatcccttcgttgatggtgccgccgtcaagcgcgtcggggacctcaactaccaggtggtggagaagaacctgggccgcgtccacatgatggatgtcagcgagggtgcggtgtgcaccgagatgcttgagctgtaccagaacgagggcatcatcaccgagcctgccggcgcactgtcggtggcgggtctgcgggacatgaaattcgccaaggggtccgtcgtagtgtgcatcatctccggtggtaacaatgatgtgctgcgctataacgagatcgtggagcggtccctggtccaccgtggcctcaagcactacttcctggtgaacttcccgcagaaaccgggacagctgcgcagcttcctggaggacatcctcggccccgaggatgacatcaccctcttcgagtacctcaagcgcaacaaccgtgagaccggcaccgccctggtgggtctccagctgggtgaggccagcggcctggattccctcctggcacgcatggatgcctccgcgatcgactgtcgccgcctcgaaccgggcacccccgagtacgacttcctgacctag

SEQ ID NO: 31388 - protein, 436 aa, Corynebacterium efficiens YS-314
MSATHVSEKSPGVIDSGMEPIRAADIQMAQARISSVIAPTPLEYCPRLSEETGVEVYLKREDLQDVRSYKIRGALNSGSQLSREQRDAGIVAASAGNHAQGVAFVCKSLGVQGRIYVPVQTPKQKRDRILVHGGEYVTLVVTGNNFDEASAAAHEDAERTGATLIEPFDARDTIIGQGTVAAEILSQLTTLGKSPDHVMVPVGGGGLLAGVVSYMADMAPRTAIVGVEPAGAASMQAALKAGGPVTLENADPFVDGAAVKRVGDLNYQVVEKNLGRVHMMDVSEGAVCTEMLELYQNEGIITEPAGALSVAGLRDMKFAKGSVVVCIISGGNNDVLRYNEIVERSLVHRGLKHYFLVNFPQKPGQLRSFLEDILGPEDDITLFEYLKRNNRETGTALVGLQLGEASGLDSLLARMDASAIDCRRLEPGTPEYDFLT

SEQ ID NO: 31389 - DNA, 918 bp, Pseudomonas putida KT2440
  CDS (1)..(918): transl_table=11
atgaccttgcacattcatacccccctgatcgagtcgcgcccgctgtcgttggcggccggtcgtaatatctggctcaagctcgacgccctgcaaccctgcggttcgttcaaactgcgcggtgtaggccacgcctgcgaggtacaccacgcgcgtggcgcccggcactttgtgtcctcgtcaggtggcaatgccggtttggcagtcgcctatgccggacgcaagctgggggtgccggtgaccgtggtgatacccgaaaccaccaccgaacgggccaagcagttgctgcacctggaagacgccaaggtggtggtgcaaggcagttcctggcaagaggccaacgccctggcacagacactggtaggcccgaacgatgccttcatccacccattcgacgacccactgctgtgggccgggcatgccagcctggtggatgaagtggccgaggccggcctgaagccggacgcggtggtgttgtcagtcggcgggggcggcttgctcagtggcgtggtggaggggctcaagcgcaatggctggggcgatgtgcctgtgctggcggtagaaaccgagggcgcggcgtcgctgcatgcggccatgcaggctgggcattcggtggagctggagcgcatcgcctcggtggcgacgtcgctgggggccaagcgtgtggctgatcaggcgctgatgtgcgtgcagcagcatccggtgcacagccatctggtcagcgatcgcgcagcgctggaggcctgtgagcggttcttgctggaccaccgtgtgctggtcgagcccgcgtgcggggcggcgttggcagtggcctatgatgccaaggctctgggcgccttgcgcaatgtcctggtggtggtctgtggtggcgctaccgcaacactggagcagatccaggcctggctgcagcaggcagactga

SEQ ID NO: 31390 - protein, 305 aa, Pseudomonas putida KT2440
MTLHIHTPLIESRPLSLAAGRNIWLKLDALQPCGSFKLRGVGHACEVHHARGARHFVSSSGGNAGLAVAYAGRKLGVPVTVVIPETTTERAKQLLHLEDAKVVVQGSSWQEANALAQTLVGPNDAFIHPFDDPLLWAGHASLVDEVAEAGLKPDAVVLSVGGGGLLSGVVEGLKRNGWGDVPVLAVETEGAASLHAAMQAGHSVELERIASVATSLGAKRVADQALMCVQQHPVHSHLVSDRAALEACERFLLDHRVLVEPACGAALAVAYDAKALGALRNVLVVVCGGATATLEQIQAWLQQAD

SEQ ID NO: 31391 - DNA, 1053 bp, Pseudomonas putida KT2440
  CDS (1)..(1053): transl_table=11
ttgctgtttgtggaatattattctatggtggacaaattatccacgcgcctgcaaggacccgtcatgccagccaccccgtccgttgatgcccagttccttgatacattgcaccaaaacattcaggacgcccacgcggcgctccgcccggccgtcagcattaccccgctcttgcacagccctcgtttgtcggcactgaccggctgtgaagtgctgctcaaatgcgaacacctgcagcacaccggttcgttcaagtttcgcggtgccagcaacaagatgcgcctgttgccggccgaggcacgcaagcagggggtgatagccgcctcatccggtaaccatgggcaggccctggccctggccggcaagatggctggcgtgccagtgaaggtctacaccaccacgggcgcatcggcatacaaaacagaggcaatgcgcgcgctgggcgccgaagtggtctgcctgcccaccgacccgctgagtgcagagctggaagcagccaggcaagccaaggcccagggcgtacctttcgtgtcaccttacaacgacctgcaagtcattgccggccagggcaccataggcatggagttgctcgagcaggcgccagacctggacgcggtgttcgtcgccgtgggcggtggcgggatgatttccggcatcggcgccgccctgcgcgtactcaagccgggcactgagatcatcggctgctggccggcgaatgacccaaccctgcagcaatcactcaaggccggtgaaatcatcgaattggatgcctgcgaaacgctgtcggatggcacggccggcggcgtcgagccaggctccatcaccttcccgctttgccaggcgctgctcaccgataccgtgttggtcagcgaggatgaaatccgctgcgccatgcgcgacatcgccagcagtgagcgctggatcatcgaaggcgctgctgcggttgcggtcgccggcatgcagaggctcgccgaacgctatcagggcaagcgtgtcgccgtgatcctgtgtggccgtaacatcctgctggaaaagttcctcgaggccgttcaatga

SEQ ID NO: 31392 - protein, 350 aa, Pseudomonas putida KT2440
MLFVEYYSMVDKLSTRLQGPVMPATPSVDAQFLDTLHQNIQDAHAALRPAVSITPLLHSPRLSALTGCEVLLKCEHLQHTGSFKFRGASNKMRLLPAEARKQGVIAASSGNHGQALALAGKMAGVPVKVYTTTGASAYKTEAMRALGAEVVCLPTDPLSAELEAARQAKAQGVPFVSPYNDLQVIAGQGTIGMELLEQAPDLDAVFVAVGGGGMISGIGAALRVLKPGTEIIGCWPANDPTLQQSLKAGEIIELDACETLSDGTAGGVEPGSITFPLCQALLTDTVLVSEDEIRCAMRDIASSERWIIEGAAAVAVAGMQRLAERYQGKRVAVILCGRNILLEKFLEAVQ

SEQ ID NO: 31393 - DNA, 1593 bp, Pseudomonas putida KT2440
  CDS (1)..(1593): transl_table=11
ttgggcaacgtaaaaatagccaaggagtcatcgatgaccagcttcagtgtccctcgtactaccgtcaccccccagcaactgctgtcggagcaggtgcgtcgcattcttgcggcgccggtgtacgacctggccattgaaacgcccctgcaagcggccccggccttgtctgccgccctgggcaaccaggtgttgctcaagcgcgaagacctgcagcctacgttttcgttcaagatccggggtgcctacacccgcctgtcgcgactgaccgatgtgcagcgtgagcgcggggtgatcaccgcttcggcgggcaaccatgcccagggcgtggccttggccgcatcgcatctgggtatgaaggcaaccatcgtcatgcccaccaccacgccatcgttgaaagtggaaggcgtgcgttcgcgcggcgggcatgtggtgctgcatggcgagagcttcccgcatgcgctgacccacgcactgaagctggccgacagcgaaggcgcgaccttcgtgccaccgttcgatgacccggatgtgatcgccgggcagggtaccgtggccatggaaatcctccgtcagcgccctggggcgttggacgcgatctttgtgcccgtgggcggtggcggcttgatcgccgggatcgccgcctatgtgaagtacctgcgccctgacgtgaaggtgatcggtgtcgagccggcagattccaactgcctgcaggctgccatggccgtcggcgagcgcgtgatcctgccgcaggtgggcacctttgccgacggcgtggcggtggcgcagatcggcgcccattgcttcgagctgtgccgccacttcgtcgacgaggtggtgacggtgagcagtgacgagctgtgcgcggcgatcaaggatatctacgacgacacccgttcgatcaccgagccgtccggggccttggccgtggccggtatcaagaagtacgtggcgcgtgaaggtgtgcaggggcagaccctggtggccatcgactccggggccaacgtcaatttcgaccgcttgcgccatgtggccgagcgggccgagctgggtgagcagcgcgaggcgatcatcgccgtgacgattccggagcagccgggcagcttccgggccttttgccacgcactgggcaagcggcagatcaccgaattcaactaccgcttctaccccgggaaggaggcgcgcctgttcgtgggcgtgcagacccacccggtgcacgacccacgtgagcagttgctggccagcttgcgggagcaggggtacagcgtgctggacctgaccgacaacgagctggccaagctgcatgtgcgccataccgtcggcggacatgccgcgtcaggggctgatgagcgggtactgcgcttcgagttccccgaacggccaggggcgttgctggggtttctggagcggttgggcaagcgttggaacatcagcctgttccattaccgcaaccatggtgcggcggaggcgcgggtgttcgctgccttggaagtgccagcggacgagttggcgggcttgccgtcgacgctggacgagatggggtaccggtactgggacgagactgacaacccggcgtacaagctgttcctgggctga

SEQ ID NO: 31394 - protein, 530 aa, Pseudomonas putida KT2440
MGNVKIAKESSMTSFSVPRTTVTPQQLLSEQVRRILAAPVYDLAIETPLQAAPALSAALGNQVLLKREDLQPTFSFKIRGAYTRLSRLTDVQRERGVITASAGNHAQGVALAASHLGMKATIVMPTTTPSLKVEGVRSRGGHVVLHGESFPHALTHALKLADSEGATFVPPFDDPDVIAGQGTVAMEILRQRPGALDAIFVPVGGGGLIAGIAAYVKYLRPDVKVIGVEPADSNCLQAAMAVGERVILPQVGTFADGVAVAQIGAHCFELCRHFVDEVVTVSSDELCAAIKDIYDDTRSITEPSGALAVAGIKKYVAREGVQGQTLVAIDSGANVNFDRLRHVAERAELGEQREAIIAVTIPEQPGSFRAFCHALGKRQITEFNYRFYPGKEARLFVGVQTHPVHDPREQLLASLREQGYSVLDLTDNELAKLHVRHTVGGHAASGADERVLRFEFPERPGALLGFLERLGKRWNISLFHYRNHGAAEARVFAALEVPADELAGLPSTLDEMGYRYWDETDNPAYKLFLG

SEQ ID NO: 31395 - DNA, 1275 bp, Staphylococcus epidermidis ATCC 12228
  CDS (1)..(1275): transl_table=11
atgacagtgacagtaagaactaaagtttcgacaaaagatatagatgaagcatatttacgtctaaaaaatatagtaaaagaaactcccttacaattcgaccattacttatctcaaaaatataattgtaatgtttatttaaaaagagaagatttacagtgggtacgatcctttaaattaagaggagcttataatgctatttcagtattatccaatgaagaaaaaaataaaggtattacttgcgcaagtgctggaaatcatgctcaaggtgttgcttatactgccaaaaaactcaatttaaaagctgttattttcatgccagtaactacaccacgacaaaaaatcaatcaagtcaaattcttcggggatagtaacgtagaaatagtattaattggcgatacatttgatcactgcttagcacaagctttaaactatacgaagcaacataaaatgaattttattgacccatttaataatgtatatactattgcaggacaaggcactttagctaaggaaatattaaatcaagctgaaaaagaggataaaacatttgattatgtatttgctgctataggtggtggcggtcttatttcaggagtgagcacatattttaaagcacattccccccatactaaaattattggtgttgaaccaaccggtgccagtagtatgtatcaatcagtcgttatcaaccatagtatagttactttagaaaatattgataagtttgttgatggagcttcagtagcaagagttggtgatattacctttgatattgcgaaagataaagtggatgattatgttcaagttgacgaaggagctgtttgctccacaattctggatatgtactctaaacaagcgattgttgctgaaccagctggtgctttaagtgtaagtgccttagaacaatataaaaagcagattgaaaataaaactattgtatgcatagtaagtggaggcaacaatgatattaatcgaatgaaagaaattgaggagcgttcccttctatttgaagaaatgaaacattactttattttaaatttcccacaaagacctggtgctttaagagaatttgtcaatgatgtcctcggacctcaagacgatattacaaaatttgaatatttaaagaaaacatcacaaaacactggaactgttattataggtatacagctgaaacatcatgatgatctcattcagttaaaagatcgcgtatgtcaatttgatccttctaatatttatatcaatgaaaataaaatgttatattcattacttatttaa

SEQ ID NO: 31396 - protein, 424 aa, Staphylococcus epidermidis ATCC 12228
MTVTVRTKVSTKDIDEAYLRLKNIVKETPLQFDHYLSQKYNCNVYLKREDLQWVRSFKLRGAYNAISVLSNEEKNKGITCASAGNHAQGVAYTAKKLNLKAVIFMPVTTPRQKINQVKFFGDSNVEIVLIGDTFDHCLAQALNYTKQHKMNFIDPFNNVYTIAGQGTLAKEILNQAEKEDKTFDYVFAAIGGGGLISGVSTYFKAHSPHTKIIGVEPTGASSMYQSVVINHSIVTLENIDKFVDGASVARVGDITFDIAKDKVDDYVQVDEGAVCSTILDMYSKQAIVAEPAGALSVSALEQYKKQIENKTIVCIVSGGNNDINRMKEIEERSLLFEEMKHYFILNFPQRPGALREFVNDVLGPQDDITKFEYLKKTSQNTGTVIIGIQLKHHDDLIQLKDRVCQFDPSNIYINENKMLYSLLI

SEQ ID NO: 31397 - DNA, 1245 bp, Bradyrhizobium japonicum USDA 110
  CDS (1)..(1245)
atggctgacttgtcccaaaccacgtcctccgatctcagcggccttccggtcgcgcctggtgacattcaggcagccgccgagaccatccgcggtgccgtcgtcgagacgccctgcagctacagccgcacgctgagcaacatctgcggctgtgacatctggctcaaattcgagaacctccagttcacctcctcgttcaaggagcgcggcgcgctcaaccgcctcaccgcgctgacgccggaggagcgtatgcgcggcgtcatcgccatgtcggcgggcaaccacgcgcagggcgtcgcctatcacgccaggcggctcggcattcccgccaccatcgtgatgccggtcggcacgcccatggtgaagatcgagaacacgaagcaccacggcgcggaggtggtggtgacgggcgcgacgctggaggaggcggccgcgtttgcgcgcagccacggtgaagctcacggcatgatcttcgtccacccttacgacgatccgcttgtgatcgcggggcagggcaccgtcgggctggagatgttgaaggcggtgccggagctcgacacgctggttgtcccgatcggcggtggcggcctgatcagcgggatcggcattgccgcgaaatcgatcaagccatcgctgcggattcttggcgtcgaggcctggctctatccctcgatgtacaacgccatccatgacggcaatctgccggcgcgcggcgatacgctcgccgagggcatcgcggtgaagtcgcccggcaagatcacgactgaaatcgtccggcgcctcgtcgacgacatcgcgctggtcaacgaggccgagctcgagcgcgcggtcgcgaccctgatctcgatcgagaagacggtcgtcgagggcgccggcgccgccggccttgccgcgctgatgtccgacccgtcccgctttgccggccagaaggtcggcctggtgctgagcggcggcaatatcgacacgcggttgatcgcctccgtcctgacccgcgaactggcgcgcgagggacggttgacccagttgtccctcgacattcctgaccggcccgggcagctggcggcggtggctgcgctgctggccgaggctggcgccaacatcatcgaggtctcgcatcagcggaccttctccgacctgccggccaaggcgacgctactgcaactcgtgatcgagacccgcgacagcgcccatctcgacgaggtcatggcgaggctcagtgcttccggcttgagcgcgcgctgcacctga

SEQ ID NO: 31398 - protein, 414 aa, Bradyrhizobium japonicum USDA 110
MADLSQTTSSDLSGLPVAPGDIQAAAETIRGAVVETPCSYSRTLSNICGCDIWLKFENLQFTSSFKERGALNRLTALTPEERMRGVIAMSAGNHAQGVAYHARRLGIPATIVMPVGTPMVKIENTKHHGAEVVVTGATLEEAAAFARSHGEAHGMIFVHPYDDPLVIAGQGTVGLEMLKAVPELDTLVVPIGGGGLISGIGIAAKSIKPSLRILGVEAWLYPSMYNAIHDGNLPARGDTLAEGIAVKSPGKITTEIVRRLVDDIALVNEAELERAVATLISIEKTVVEGAGAAGLAALMSDPSRFAGQKVGLVLSGGNIDTRLIASVLTRELAREGRLTQLSLDIPDRPGQLAAVAALLAEAGANIIEVSHQRTFSDLPAKATLLQLVIETRDSAHLDEVMARLSASGLSARCT

SEQ ID NO: 31399 - DNA, 1005 bp, Bradyrhizobium japonicum USDA 110
  CDS (1)..(1005)
atgggcgcgataaggttgagtatgaccgaacagccccttccgatcggccccgccgatatcgatgccgcagcacgcgtgatcgcgcccttcgccatccgcaccccgctgttgtcctttcccgtgctcaacgagcgcgtcggcgcaaaagtgttcctgaagccggagatgctccagcgcaccggctccttcaagttccgtggcgccttcaacaaggtcgcctcgatcccgcaggacaagcgcgccggcggcgtcgtggccttctcctccggcaaccatgcccagggcgtggcggccgcggccaagatcctcgacatgcaggcgaccatcgtgatgcccgcggacgcgccgctgtccaagcgcgagcgcaccaagtcctacggcgccgaggtcgtgctgtacgaccgcgatcgcgacgaccgcgaggcgatctcgcgcggcatcgccgagaagcgcggcgcgacgctggtcaggccgtatgacgatcccttcgtgatcgctggccaaggcaccgccggccgggagatcgcggacgacatggcaacgctgggccttagccccgacatcgtggtggcacccgcctccggcggcggcctgatcgccggcgtcgcgaccgcgatcaaggcgcgatatccgctggcgcaggtcgtggttgccgagccggaggcgttcgacgatcacggcatttcgctgactgcaggccatcgcgagccgcatgggccggcaggccgcaccatctgcgacgcgctgatggcgctgatccccggcgagatgacatttgcgatcaacagcaagctgctcgcgcgcggcgtcaccgcatccgacaaggaagtcggtgcggcggtggcgttcgcctatcgcgagctgaagctggtggtggagccgggaggggccgtcggccttgccgcgctgctcgcggggcgtctcgacgtcgccggcaagaacgtcgtcatcgtcctctccggcggcaatgtcgatgccgatctgttcgccgagctcgtggcctga

SEQ ID NO: 31400 - protein, 334 aa, Bradyrhizobium japonicum USDA 110
MGAIRLSMTEQPLPIGPADIDAAARVIAPFAIRTPLLSFPVLNERVGAKVFLKPEMLQRTGSFKFRGAFNKVASIPQDKRAGGVVAFSSGNHAQGVAAAAKILDMQATIVMPADAPLSKRERTKSYGAEVVLYDRDRDDREAISRGIAEKRGATLVRPYDDPFVIAGQGTAGREIADDMATLGLSPDIVVAPASGGGLIAGVATAIKARYPLAQVVVAEPEAFDDHGISLTAGHREPHGPAGRTICDALMALIPGEMTFAINSKLLARGVTASDKEVGAAVAFAYRELKLVVEPGGAVGLAALLAGRLDVAGKNVVIVLSGGNVDADLFAELVA

SEQ ID NO: 31401 - DNA, 1053 bp, Xylella fastidiosa Temecula1
  CDS (1)..(1053): transl_table=11
atggatatacctgatgtagggcacacagttgtcaagcaacccaatgcaagtaacgtcaataccgtgagtgtggccgatgtgttggctgcacaagcccgcttacgtcgttatctaatgcctactccaattcactatgccgagcgtttcggagtgatgctgaagttagaaaatctgcaacgcaccggatcctataaagtgcgcggcgcactgaacgcaatgttagttgcgctggaacgcggcgataaccgccctgtcatttgcgcatcagccggtaaccacgcccaaggcgtagcttggtcagcttaccggcttggtatacaagcaatcactgtcatgcctcacggtgctccggccacaaaggttgcaggtgtttcacattggggggcaacggtacgccaacacggccaaagctatgacgaggcctatacgttcgcatgtgagttggctgagcaaaacgattaccgctttctatcagcattcgatgatccggatgtgattgccggtcagggaactgttggcatagagatcaccgcgcatgaaccggatgtagtcattgtgccgatcggcggcggcggccttgcttcaggcattgctttggtgctgcgctcgcagggagtacgtgtcattggcgctcaggtcgagggcgtggatgcgatggcgcgtgcaatccgtggcgacacacgcgagatcgctccagtttcgaccttagctgacggggtgaaagtcaagattcctggtttcattacccgccatctgtgtgccaacttgttagacgatgtagtaatcgtgcgtgaggctgaactgcgcgaaacattggtgcgtttagtattggaagaacacctgatcgccgaaggggcaggcgcactggcattggccgctggccgccgcgttgcaggtaagcgcaagtgtgcagtggtctccggaggtaatattgacgctgcagtactggccaaactgttgtccgaagtaagaccacggccaccccgcaaaccacgtaggcgtagtgcagatcgccccaacaattgcggcaatttaccgctcccttttaactga

SEQ ID NO: 31402 - protein, 350 aa, Xylella fastidiosa Temecula1
MDIPDVGHTVVKQPNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPATKVAGVSHWGATVRQHGQSYDEAYTFACELAEQNDYRFLSAFDDPDVIAGQGTVGIEITAHEPDVVIVPIGGGGLASGIALVLRSQGVRVIGAQVEGVDAMARAIRGDTREIAPVSTLADGVKVKIPGFITRHLCANLLDDVVIVREAELRETLVRLVLEEHLIAEGAGALALAAGRRVAGKRKCAVVSGGNIDAAVLAKLLSEVRPRPPRKPRRRSADRPNNCGNLPLPFN

SEQ ID NO: 31403 - DNA, 1218 bp, Clostridium tetani E88
  CDS (1)..(1218): transl_table=11
atgactatgggattaaaacttggagatgtaaagcaagcgcaaaataatattaaaaaggttgtaagaagaacacccttggtatactcatcaacttttacaaaattaactggatataatatttatattaagtgtgaaaacaagcaaaagacaggtgcttttaaattaagaggagcttataataaaatagtaagtcttaacgaagaagaaaagaaaaaaggggttatagcatcgtcagcgggtaatcacgcacaaggtgttgcctatgcagcatctgcttttggtataaattctacaatagttatgcccgttacagcaccattagctaaagttaatgctacaaaaggttatggtgccaaggtaattcaatgtggagaagtctatgatgaatgttatataaaagcacttcaaacgcaaaaagaaaatgggtatacattcatacatccttttgatgatgaacaggttatagcaggacagggtactataggattagaaatattagaagatatggaagatgtagatgctatagtagtaccagtgggtggaggaggcttaatatcaggaatagcactagctgcaaaatctattaaaccaaatgttaagataataggagtgcaaccatctattatagcttcctctaaagtatccttagagaagggaaaggttaccacattacctggagttaagtccttagcagatggtatatctgttagtactccaggagaaataacatttaaatatatgaatgaatatgtagatgatatagtaaccgtttcagaagatgaaattgcatatagtgtattttgtttattagaaagagggaaacttttagcagaaggtgctggagcggcagctatggcagctatattaagtgataagattaatataaagggtaagaatatagtatctctcataagtggagggaatattgatatagcaacggtttctaaaataatagacagagaacttataagacttagaagaagactaagatttatagtagaaattaaagatagaataggacagttaagtagcataataacagaaattgtatccacgggagccaatgtagtaaaattaaggcaagatactaattggaataaaaaaggattggactatgtaaatgttatgtttgaaatcgaagttcagacagtagaacaatcacaagaacttatagatgctttaacaaagaaaggatacaaactagaaataatatcatag

SEQ ID NO: 31404 - protein, 405 aa, Clostridium tetani E88
MTMGLKLGDVKQAQNNIKKVVRRTPLVYSSTFTKLTGYNIYIKCENKQKTGAFKLRGAYNKIVSLNEEEKKKGVIASSAGNHAQGVAYAASAFGINSTIVMPVTAPLAKVNATKGYGAKVIQCGEVYDECYIKALQTQKENGYTFIHPFDDEQVIAGQGTIGLEILEDMEDVDAIVVPVGGGGLISGIALAAKSIKPNVKIIGVQPSIIASSKVSLEKGKVTTLPGVKSLADGISVSTPGEITFKYMNEYVDDIVTVSEDEIAYSVFCLLERGKLLAEGAGAAAMAAILSDKINIKGKNIVSLISGGNIDIATVSKIIDRELIRLRRRLRFIVEIKDRIGQLSSIITEIVSTGANVVKLRQDTNWNKKGLDYVNVMFEIEVQTVEQSQELIDALTKKGYKLEIIS

SEQ ID NO: 31405 - DNA, 1284 bp, Tropheryma whipplei str. Twist
  CDS (1)..(1284): transl_table=11
gtgcgccacggtatcgttcttgaggattttcgcgcggccgcgaaagtaatgcacagcaagttcgttgtgcatactccggtcatacagtctgttatgctgtcagaccttgtcgggtctcccgtttattttaagtgtgaaaacctgcaaataacaggatcctacaagataagaggggtgttcaattatcttcacaacctcaaaaaaagatcgactgctgtcgttgccgcaagcgctgggaatcatgcacagagcgtggcctatgctgcaaaacaaataggtatcaaggcagttatttttatgccaagcagtgttagtctgccaaagtacaacgcaaccaaaaaatacggtgcggaaattattctagatcagggtgatattcaaaccctcatactcaaggcaagacggtatgcaaaaaaacataagttcgtttttatcccgccatttgatcaccgcgatattgttgtcggccagggcacaattgccctcgaactgttagagcaggttcctgatctaagaacggtagttgtgccaactggcggcggaggactcgtggctggtattgcctctgccgttaccctggcgcagaatcccagcggaacgatcttcacaaaaagtggcttagaacagccggccaagtctggcatacgggtggttggcgttcaagcaaaaacatcggcgtcttttatagaatcgatggttgcaggaaagccagtgaaggtaaatataacctcacatttcgcagatgggatagcggttccaaaacccggaaagataacattcgaactcgcgagatgtttcgttgacaggtttgtcgaagttggtgatcacgaaattgcaggcgccatactcaccctgcttgaagactcaaaaataatagttgaacctgccgctgccagtgctgccgcagctgttctaagtaaaaaaatcacaaatctgaaagggtcaacagtgattgttttgagtggcggtaatatcgacccaatgactttgagccagataattctccgggggctatcactcaggtctcggaggctaaccttacgggcacaactcaaagatgtgcccgggcagctggctgaattttcaagagttgttgcaaaagccgaggctaatgttgttgctgtcaatcattcacgtggtaactacacggatgacaatggtcgcatctccttcggtgatgtctttatggacatcgaccttgaaacccgtggccacgagcattctcagagtattgtccgtgcccttcgagattccgggtttgtagttgaagttctgggattgtaa

SEQ ID NO: 31406 - protein, 427 aa, Tropheryma whipplei str. Twist
MRHGIVLEDFRAAAKVMHSKFVVHTPVIQSVMLSDLVGSPVYFKCENLQITGSYKIRGVFNYLHNLKKRSTAVVAASAGNHAQSVAYAAKQIGIKAVIFMPSSVSLPKYNATKKYGAEIILDQGDIQTLILKARRYAKKHKFVFIPPFDHRDIVVGQGTIALELLEQVPDLRTVVVPTGGGGLVAGIASAVTLAQNPSGTIFTKSGLEQPAKSGIRVVGVQAKTSASFIESMVAGKPVKVNITSHFADGIAVPKPGKITFELARCFVDRFVEVGDHEIAGAILTLLEDSKIIVEPAAASAAAAVLSKKITNLKGSTVIVLSGGNIDPMTLSQIILRGLSLRSRRLTLRAQLKDVPGQLAEFSRVVAKAEANVVAVNHSRGNYTDDNGRISFGDVFMDIDLETRGHEHSQSIVRALRDSGFVVEVLGL

SEQ ID NO: 31407 - DNA, 1284 bp, Tropheryma whipplei TW08/27
  CDS (1)..(1284): transl_table=11
gtgcgccacggtatcgttcttgaggattttcgcgcggccgcgaaagtaatgcacagcaagttcgttgtgcatactccggtcatacagtctgttatgctgtcagaccttgtcgggtctcccgtttattttaagtgtgaaaacctgcaaataacaggatcctacaagataagaggggtgttcaattatcttcacaacctcaaaaaaagatcgactgctgtcgttgccgcaagcgctgggaatcatgcacagagcgtggcctatgctgcaaaacaaataggtatcaaggcagttatttttatgccaagcagtgttagtctgccaaagtacaacgcaaccaaaaaatacggtgcggaaattattctagatcagggtgatattcaaaccctcatattcaaggcaagacggtatgcaaaaaaacataagttcgtttttatcccgccatttgatcaccgcgatattgttgtcggccagggcacaattgccctcgaactgttagagcaggttcctgatctaagaacggtagttgtgccaactggcggcggaggactcgtggctggtattgcctctgccgttaccctggcgcagaatcccagcggaacgatcttcacaaaaagtggcttagaacagccggccaagtctggcatacgggtggttggcgttcaagcaaaaacatcggcgtcttttatagaatcgatggttgcaggaaagccagtgaaggtaaatataacctcacatttcgcagatgggatagcggttccaaaacccggaaagataacattcgaactcgcgagatgtttcgttgacaggtttgtcgaagttggtgatcacgaaattgcaggcgccatactcaccctgcttgaagactcaaaaataatagttgaacctgccgctgccagtgctgccgcagctgttctaagtaaaaaaatcacaaatctgaaagggtcaacagtgattgttttgagtggcggtaatatcgacccaatgactttgagccagataattctccgggggctatcactcaggtctcggaggctaaccttacgggcacaactcaaagatgtgcccgggcagctggctgaattttcaagagttgttgcaaaagccgaggctaatgttgttgctgtcaatcattcacgtggtaactacacggatgacaatggtcgcatctccttcggtgatgtctttatggacatcgaccttgaaacccgtggccacgagcattctcagagtattgtccgtgcccttcgagattccgggtttgtagttgaagttctgggattgtaa

SEQ ID NO: 31408 - protein, 427 aa, Tropheryma whipplei TW08/27
MRHGIVLEDFRAAAKVMHSKFVVHTPVIQSVMLSDLVGSPVYFKCENLQITGSYKIRGVFNYLHNLKKRSTAVVAASAGNHAQSVAYAAKQIGIKAVIFMPSSVSLPKYNATKKYGAEIILDQGDIQTLIFKARRYAKKHKFVFIPPFDHRDIVVGQGTIALELLEQVPDLRTVVVPTGGGGLVAGIASAVTLAQNPSGTIFTKSGLEQPAKSGIRVVGVQAKTSASFIESMVAGKPVKVNITSHFADGIAVPKPGKITFELARCFVDRFVEVGDHEIAGAILTLLEDSKIIVEPAAASAAAAVLSKKITNLKGSTVIVLSGGNIDPMTLSQIILRGLSLRSRRLTLRAQLKDVPGQLAEFSRVVAKAEANVVAVNHSRGNYTDDNGRISFGDVFMDIDLETRGHEHSQSIVRALRDSGFVVEVLGL

SEQ ID NO: 31409 - DNA, 1524 bp, Pseudomonas syringae pv. tomato str. DC3000
  CDS (1)..(1524): transl_table=11
atgaccgatctgctcaatcactacgcccgcaaaatcctcacctcgcgcgtctacgacgtagcggtcgaaaccccgctgcatggcgcccgccagctgtccgagcggctgggcaatcaggtgctgctcaagcgcgaagatttgcagccggtgttctccttcaagattcgcggcgcgtacaacaagctcgcccaattgaccgcagaagaggccgcacgcggcgtggtcacggcctcggcgggcaatcacgcccagggcctggcgctggcggcgaaagagctgggcattctggccaccatcgtcatgccgcgcaccaccccggaaatcaaggtcgaaggggtgcgttcccgcggtgccacggtggtgttgcacggcgattccttccctgaagcgctggcctattcgctgaaactggtcgagcaacaaggcttcgtctacatccatccgtatgacgaccccgacaccattgccgggcaaggcactgtggcgatggaaatcctccgtcagcagccggggaagctggacgcgatctttgtgccggtcggtggcggcggcttgattgcagggattgcagcgtacgtgaaatacctgcggcctgagatcaaggtcatcggcgtcgagcccgacgactccaactgcctgcaagcggcgatggcggcgggcgagcgcgtggtgttgagccaggtcgggctgtttgccgatggcgtggcggtggcgcagatcggttatcacacctttgaagtgtgccgtcattacgtcgatgaagtgatcaccgtcagcaccgacgaaatctgcgcggcgatcaaggacatctacgacgacacccgctcgatcaccgagcctgcgggtgcgctgggtgttgcaggcatcaagaagtacgtcgagcagcgcggcgtgaccggccagacgctggtggccatcgactccggcgccaacgtcaactttgaccgcctgcgccacgtggccgagcgtgccgaactgggcgaaggccgcgaggcgatcattgccgtgaccattcccgagcagccgggcagcttcaaggcgttctgcgaagccatcggcaagcgccagatcactgaattcaactaccgctaccacaccgaccgtgaagcccatatcttcgtcggcgtgcagactcacccggagaacgacccacgcagcgcgctggtcgccagtctcaccgggcagggttttccggtgctggacctgaccgacaacgaactggccaaactgcacatccgccacatggttggcgggcatgccgagcgggtcaacgatgaggtggtgttgcgtttcgagttcccggagaggccgggcgcgctgttcaacttcctcaaccggctgggcgggcgctggaccatctcgatgttccactaccgcaaccacggggcagcggatggccgggtggtggcgggtctggtggtgcccgaggaagagcggcacctggtaggcgcggcgctggacgagattggttatcggtattgggacgagagcgagaacccggcgtatcggctgtttttgggctga

SEQ ID NO: 31410 - protein, 507 aa, Pseudomonas syringae pv. tomato str. DC3000
MTDLLNHYARKILTSRVYDVAVETPLHGARQLSERLGNQVLLKREDLQPVFSFKIRGAYNKLAQLTAEEAARGVVTASAGNHAQGLALAAKELGILATIVMPRTTPEIKVEGVRSRGATVVLHGDSFPEALAYSLKLVEQQGFVYIHPYDDPDTIAGQGTVAMEILRQQPGKLDAIFVPVGGGGLIAGIAAYVKYLRPEIKVIGVEPDDSNCLQAAMAAGERVVLSQVGLFADGVAVAQIGYHTFEVCRHYVDEVITVSTDEICAAIKDIYDDTRSITEPAGALGVAGIKKYVEQRGVTGQTLVAIDSGANVNFDRLRHVAERAELGEGREAIIAVTIPEQPGSFKAFCEAIGKRQITEFNYRYHTDREAHIFVGVQTHPENDPRSALVASLTGQGFPVLDLTDNELAKLHIRHMVGGHAERVNDEVVLRFEFPERPGALFNFLNRLGGRWTISMFHYRNHGAADGRVVAGLVVPEEERHLVGAALDEIGYRYWDESENPAYRLFLG

SEQ ID NO: 31411 - DNA, 1548 bp, Vibrio parahaemolyticus RIMD 2210633
  CDS (1)..(1548): transl_table=11
atgatggaatctcaacccgaaaaaaaagcgaatcaatctggcgcagactatctgcgccaaatccttcgcgcacctgtttatgaagtcgcaacagtaacgccgctgcaagaaatgcctcgtttatcggcacgtatcgggaataacgtgcagatcaagcgtgaagaccgccaacccgtacactcgttcaaactgcgcggtgcctacaatatggtggcaagcctaactgaagcacagaaagccgcgggggtgattgcagcatcggcaggcaaccacgctcaaggcatggcactgtctggcagcaagctaggtatcaaaaccacgattgttatgccaaaaaccacaccagacatcaaagtcgatgcggtacgcagtttcggtggcaatgtggtgttgcacggcaacaactttgatgaagccaaagccgaggccgaacgcttgtcagaacaacacggttatacgttcgtgcctcctttcgaccacccgttggtgatcgcaggtcaaggcaccatcggcatggaaatgctgcagcaaaatggtcatctcgactacatcttcgtgccagttggaggcggtggcttggccgctggtgtagcggttctggtcaagcaactgatgccagaaatcaaagtcatcgccgtcgaacctgaagactcgtcttgtctgaaagcggcgcttgatgctggtgaacctgtcgtactagaccaagtcagcatgtttgctgatggtgtggcggtaaaacgcatcggtgaagaaacgttccgcttgtgtcagaaatacattgatggtcatgtggcggtttcaagcgatgaaatctgcgctgccgtaaaagacatttttgaggatactcgagcgattgctgaaccatccggggcgcttgcgcttgctggcttgaagaagtttgttgagcaaaaccaactggaaaataagaaccttgccacggtgctgtctggcgcgaataccaactttcatggtttacgctatgtttcagagcgttgtgaattaggtgagaagcgtgaaggtctattagccgtgacgattccagaacgccaaggcgctttctttgaattctgtaatctgattggcggccgcgctgtcaccgagtttaactaccgttacaacgatgatgaactggcgaatatctttgttggtgtacgcctgcaaggcggtcaggaagagctggataacatcattcgcgatctacgcgaaggtggctacccagtcgtggatttgtccgacgatgaaatggccaaactgcacattcgttacatgatcggtggcaagccctcgaaacaactgaaagagcgtctctatagctttgaatttcctgagtatccaggcgcactattgaagttcttaagcacgcttggcacccattggaacatcagcctattcaactaccgcaaccacggcgccgactacggacgtgttctgtgtggtttcgagttagatgaaagcgatttagcccaattttcagcgcatttacgagaacttggctaccaatgtaaggatgaaaccgataatccatcctacaagtttttcttgtcttaa

SEQ ID NO: 31412 - protein, 515 aa, Vibrio parahaemolyticus RIMD 2210633
MMESQPEKKANQSGADYLRQILRAPVYEVATVTPLQEMPRLSARIGNNVQIKREDRQPVHSFKLRGAYNMVASLTEAQKAAGVIAASAGNHAQGMALSGSKLGIKTTIVMPKTTPDIKVDAVRSFGGNVVLHGNNFDEAKAEAERLSEQHGYTFVPPFDHPLVIAGQGTIGMEMLQQNGHLDYIFVPVGGGGLAAGVAVLVKQLMPEIKVIAVEPEDSSCLKAALDAGEPVVLDQVSMFADGVAVKRIGEETFRLCQKYIDGHVAVSSDEICAAVKDIFEDTRAIAEPSGALALAGLKKFVEQNQLENKNLATVLSGANTNFHGLRYVSERCELGEKREGLLAVTIPERQGAFFEFCNLIGGRAVTEFNYRYNDDELANIFVGVRLQGGQEELDNIIRDLREGGYPVVDLSDDEMAKLHIRYMIGGKPSKQLKERLYSFEFPEYPGALLKFLSTLGTHWNISLFNYRNHGADYGRVLCGFELDESDLAQFSAHLRELGYQCKDETDNPSYKFFLS

SEQ ID NO: 31413 - DNA, 1545 bp, Salmonella enterica subsp. enterica serovar Typhi Ty2
  CDS (1)..(1545): transl_table=11
atggcggaatctcaacctctgtcagtcgcgccggaaggggcggagtatctgcgcgcggtgctacgcgcgccagtatacgaagcggcgcaggtgacgccgctgcaaaaaatggaaaagctctcgtcacgtctggacaacgttattctcgtcaaacgcgaagaccggcagccggtacatagctttaagctgcgcggcgcttacgcgatgatggccggattgaccgaagaacaaaaagcccacggcgtgattaccgcgtcggcggggaaccatgcacagggcgtggcgttctcctccgcgcggcttggcgtgaagtctctgatcgtcatgccaaaagcaacggcggatattaaagtcgatgcggtacgcggttttggcggcgaagtgctgttgcacggcgctaattttgatgaagcgaaagcgaaagctattgagctggcgcagcagcagggttttacctgggtgccgccgtttgatcacccaatggtgatcgccgggcagggcacgctggcgctggaactgcttcagcaggattcgcatctcgatcgtgtctttgtgccggttggcggcggcggcctggcggcgggcgtagcggtactgatcaaacaattgatgccgcaaatcaaagtgattgccgtcgaagcggaggattccgcctgcctgaaagcggcgttggaagccggtcatccagtggatctcccgcgcgttgggttatttgctgaaggcgtggcggtaaaacgcatcggcgacgaaaccttccgcctgtgccaggaatatctcgacgacattattacagtcgatagcgacgcgatctgcgcggcgatgaaagacctgtttgaagatgtgcgtgcggtggcggagccgtccggcgcgctggcgctggcggggatgaaaaaatatatcgcccagcacaatattcgcggcgaacgcctggcgcacgtcctttccggcgccaacgtcaacttccacggcttgcgctatgtgtctgaacgctgcgagctgggggaacagcgcgaagcgttactggcggtgaccattccggaagaaaaggggagcttcctcaaattctgccagttgcttggcgggcgtatggtcaccgaatttaactaccgttttgccgacgcgaaacatgcctgtatttttgtcggcgtacgcgtcagtcaggggctggaggaacgaaaagagattatcacccaactgtgcgacggcggttatagcgtagtggatctctccgacgatgaaatggcgaagctgcatgtgcgctatatggtcggcgggcgcccctccaagccattacaggagcgtttgtatagtttcgaatttccggagtcgcccggcgcgttgctcaaattccttcatacgcttggcacgcactggaatatttcgctattccattaccgcagccacggtaccgattatggccgcgtgctggcggcgttcgagttaggcgatcatgagccggatttcgaaacccggctgcatgaactgggctatgaatgccatgatgagagcaataacccggcgttccggttctttctggcgggttaa

SEQ ID NO: 31414 - protein, 514 aa, Salmonella enterica subsp. enterica serovar Typhi Ty2
MAESQPLSVAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKSLIVMPKATADIKVDAVRGFGGEVLLHGANFDEAKAKAIELAQQQGFTWVPPFDHPMVIAGQGTLALELLQQDSHLDRVFVPVGGGGLAAGVAVLIKQLMPQIKVIAVEAEDSACLKAALEAGHPVDLPRVGLFAEGVAVKRIGDETFRLCQEYLDDIITVDSDAICAAMKDLFEDVRAVAEPSGALALAGMKKYIAQHNIRGERLAHVLSGANVNFHGLRYVSERCELGEQREALLAVTIPEEKGSFLKFCQLLGGRMVTEFNYRFADAKHACIFVGVRVSQGLEERKEIITQLCDGGYSVVDLSDDEMAKLHVRYMVGGRPSKPLQERLYSFEFPESPGALLKFLHTLGTHWNISLFHYRSHGTDYGRVLAAFELGDHEPDFETRLHELGYECHDESNNPAFRFFLAG

SEQ ID NO: 31415 - DNA, 1056 bp, Enterococcus faecalis V583
  CDS (1)..(1056): transl_table=11
atgtatgaaggtttgttaaaacagtatcaagcgtatttgcccgtaacagaaaaaacaccaatgatttctttagccgaaggaaatacgccactgattcctttacctaatttatccaaagaattaggtattcaattatatggaaaatacgaaggcttaaatcccactggctcattcaaagatcgcgggatggtgatggctgtagcaaaagcggtagaagaaggtgccaaagcgattgtttgtgcttctacaggaaatactagtgccgccgctgctgcgtatgccacaagagcaggcattaaagcgtatgtagtgattccagaagggaaaatcgcactgggaaaattggcgcaagctattatgtatggggcggacattatttcgattccaggtaactttgatgaagcattaaaagcggtgcgagagattgcgaaaactgaggcagttgcgctagttaattcagtgaatccttatcgcttagaagggcaaaaaacagcagcttttgaagtttgtgaacaattaggtcaagcgcccgatgtcttagcgattccagttggaaatgccggcaatatttccgcttactggaaaggctttaaagaatggcatgaaaaacaaggaacaactttaccaagaatgcatggttttgaagcagaaggtgccgcagcgatcgtgaaaggccaagtgattgagcaacctgaaaccgtggcaacagcgatccggattgggaatcctgctagttggcaattagcagaacaggcacgggatgaatccggtggtttcattgatgccgtgacagatcaagaaattttaacggcttaccgaaaaattgctgctcaagatggggttttcattgaacctggttcggctgcttcattagctggagttattcaacatgttaaaagcggtaaaatcaaagcaggtgaaaccgtcgtggcagtctttactggtaacggactgaaagatcctgatacagcaatggagacagaagtagctatttcaaaaatgagtgacgtggaagaaatgcgtctgcacttacgaaaaggagtcgcaacactatga

SEQ ID NO: 31416 - protein, 351 aa, Enterococcus faecalis V583
MYEGLLKQYQAYLPVTEKTPMISLAEGNTPLIPLPNLSKELGIQLYGKYEGLNPTGSFKDRGMVMAVAKAVEEGAKAIVCASTGNTSAAAAAYATRAGIKAYVVIPEGKIALGKLAQAIMYGADIISIPGNFDEALKAVREIAKTEAVALVNSVNPYRLEGQKTAAFEVCEQLGQAPDVLAIPVGNAGNISAYWKGFKEWHEKQGTTLPRMHGFEAEGAAAIVKGQVIEQPETVATAIRIGNPASWQLAEQARDESGGFIDAVTDQEILTAYRKIAAQDGVFIEPGSAASLAGVIQHVKSGKIKAGETVVAVFTGNGLKDPDTAMETEVAISKMSDVEEMRLHLRKGVATL

SEQ ID NO: 31417 - DNA, 1059 bp, Bacillus cereus ATCC 14579
  CDS (1)..(1059): transl_table=11
atgtataaaggactattgaaacaatatgcttcttatttaccggtgaatgaaaacacacctgatgtcagtttaatggaaggaaatacacctcttattccgttattaaatatatcaaagcaattagggattcagctatatggtaagtacgaaggagcgaatccgacaggttcttttaaagatcgtggtatggtgatggcagttgctaaggcgaaagaagaaggttcagaagcaatcatttgtgcatcaacaggtaatacatcagcatcagctgcagcatatgcggcacgtcttgggatgaaatgtataatcgtaatccctgaaggaaagattgcgcatggaaaattagcgcaagcggtcgcttatggagctgaaattatttcaatagaagggaatttcgatgatgcacttaaggctgtaagaaatattgctgcagaagagccgattacattagtaaattcagtgaatccttatcgaattgaaggacaaaaaacggcagcatttgaaatttgtgaccaattgcaaaatgcaccagatgttctagctatccctgttgggaacgcagggaatattacagcatattggaaaggtttctgtgaatatgagaaagaaaaaggttataagaagccaagaattcatggttttgaagcagaaggagcagctgcaattgtaaaagggcatgtaattgaagaacctgaaacaattgcaacagcgattcgcatcggtaacccagcaagttggtcgtatgcagtagaggctgccgagcagtcttgtggtgaaatagatatggtatcagatgaagaaattttacatgcgtataggttattagcaaaaactgaaggagttttcgctgaaccaggatcaaatgcttcattagctggcgtaattaaacatgttaaatctggaaaaatcaaaaagggagaaacagttgttgcagtattaactggaaatggtttgaaggatcctgatatcgctatttcttcaaatcaactagacatcgcaagtttgtcaaatgatatagaacagattaaagatcatattaaaggggtgattatgtcgtga

SEQ ID NO: 31418 - protein, 352 aa, Bacillus cereus ATCC 14579
MYKGLLKQYASYLPVNENTPDVSLMEGNTPLIPLLNISKQLGIQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAAEEPITLVNSVNPYRIEGQKTAAFEICDQLQNAPDVLAIPVGNAGNITAYWKGFCEYEKEKGYKKPRIHGFEAEGAAAIVKGHVIEEPETIATAIRIGNPASWSYAVEAAEQSCGEIDMVSDEEILHAYRLLAKTEGVFAEPGSNASLAGVIKHVKSGKIKKGETVVAVLTGNGLKDPDIAISSNQLDIASLSNDIEQIKDHIKGVIMS

SEQ ID NO: 31419 - DNA, 1002 bp, Bacillus cereus ATCC 14579
  CDS (1)..(1002): transl_table=11
atgataactagaaaactaccattacatatagacgatattaaaaaagctcacaaaattctagatagaaatgctcgtaaaacgccattagtaaaatctttttacttgactagtaaaacgggtggagaaattcatttgaaattagaaaatatgcaattaacgggttcttttaaatttcgtggcgcatttaataaaatgtcgcggctcacggatcaagaaaaagaaagaggtgtaattgcatgttcagcaggtaatcatgcacaaggagttgcattatctgctcatttactcggtattaagagtaaaattgttatgccaatttctgcacctcaggcaaaagttgaagcaacaaaaggatatggatctgaagtgattttacatggtgaaacctttgatgatgcaaaggtaaaatgtgaagaaattataagggaaacaggtgaaacatacttacatccatatgatgatgtagaggtaatggctggtcaaggtacaattggattagacattcttgatgatatgtgggatgtagatactgtcattgtaccaataggtggaggcggaattatttctggtatttctgtagcattgaaatcttttaatccatccattaatataattggtgtccaagcagataatgttcatggaatgaaggcatcttacgataaaggagcaatcgtagaacactatgaggcgcctactattgcagatggttgcgcagttaaaataccaggtgaattaacatttgaaattgtaaaagaattagtagatgatattgtaactgtatcagaaaaagagctggaagtagcgatgaaagatttattacaacgtgggaaagctgttgtagaaggtgcaggtgcattagcaactgctgcacttcttgcaggaaaagttgatagttatataaaagggaaaaaagtagtggctgttatatctggtgggaacgtggacttacagcgcatatcaagtgtatgtgagcacttttttgtcgctaatgaagtgaaatag

SEQ ID NO: 31420 - protein, 333 aa, Bacillus cereus ATCC 14579
MITRKLPLHIDDIKKAHKILDRNARKTPLVKSFYLTSKTGGEIHLKLENMQLTGSFKFRGAFNKMSRLTDQEKERGVIACSAGNHAQGVALSAHLLGIKSKIVMPISAPQAKVEATKGYGSEVILHGETFDDAKVKCEEIIRETGETYLHPYDDVEVMAGQGTIGLDILDDMWDVDTVIVPIGGGGIISGISVALKSFNPSINIIGVQADNVHGMKASYDKGAIVEHYEAPTIADGCAVKIPGELTFEIVKELVDDIVTVSEKELEVAMKDLLQRGKAVVEGAGALATAALLAGKVDSYIKGKKVVAVISGGNVDLQRISSVCEHFFVANEVK

SEQ ID NO: 31421 - DNA, 1512 bp, Nitrosomonas europaea ATCC 19718
  CDS (1)..(1512): transl_table=11
atggtaaatgattatctcgaaaggatactgactgcgcatgtctatgacgttgccagcgagacgccccttgatttcgctccgtcattatctgctcgtatccataaccgcgtattgctcaaaagagaggacatgcagcgggttttttccttcaagctgcgcggcgcctataacaaaatggccaggctctccccggatgtactgcaacagggtgtggtggccgcttcagcgggtaatcatgcacagggggtggcactggccgcacaaaagctgggctgttctgccaccatcgtgatgccggccaccacaccgcaaatcaaaatcaatgcggtgatggcaatgggtgcagccgtgctgctgcaaggagattcctataatgatgcctacgaatatgcacggaatctcgccgaagaaaaagaagctgaatttgtccatccttacgacgatcccgatgtaattgccggacagggcacgattgccatggaaattctgcgccagcatccgggcaggattcacgcaatttttgtaccgatcggtggcggagggctgatttcaggcattgccgcgtatgtgaaacggttgcgaccggatatcaaggtgatcggagtggagccggttgattcaaatgccatgtaccgctccctgcaggcaggctatcgtgtcgaactctcccaggtggggctgtttgcggatggcgtggctgtccgcctggtaggcgaggaaaccttccggctgtgccgtgagctggtggatgacatcatcctggtggattcggatgccatttgtgcagcgatcaaggatattttcgaggatacacgctccatcgttgaaccttcgggagcactttcaattgccgggttgaaggcatacgtcaaacaaaaaaacttgctgcacgaagtcctggttgcgattgcttccggcgcgaacatgaattttgaccgtttgcgtcatgtttctgaacgggcagaacttggtgagcagcgcgaagctatcctcgcagtcacgatccctgaaaaaccgggcagcttcaaaaaattctgcaatctgctgggcgctcgtaatatcactgaattcaattaccgctatgcggaccccgagatggcgcatgtctttgtcggtgtatcagtgcgcaatcgggaggaatcgttacatttgatcgagattctgcaggaaaacggtttgaaaaccgaagacatgaccgataacgaaatggccaaactgcatatccgtcacatggtgggcgggcgcagcagagaagtcatgcatgaaattttgtatcgcttcgaattccctgatcgcccgggtgcactcatgaattttctgaatcacatgagcgaccactggaacatcagcctgtttcactatcgtaatcatggtgccgatttcggccgtgtgctgatcggtatacaagttccgccggaagaaaaacaggaattcagggagttcctcgataaactgggctacagcttctgggatgaaaatgacaacccggcttaccagctttttctcgcctga

SEQ ID NO: 31422 - protein, 503 aa, Nitrosomonas europaea ATCC 19718
MVNDYLERILTAHVYDVASETPLDFAPSLSARIHNRVLLKREDMQRVFSFKLRGAYNKMARLSPDVLQQGVVAASAGNHAQGVALAAQKLGCSATIVMPATTPQIKINAVMAMGAAVLLQGDSYNDAYEYARNLAEEKEAEFVHPYDDPDVIAGQGTIAMEILRQHPGRIHAIFVPIGGGGLISGIAAYVKRLRPDIKVIGVEPVDSNAMYRSLQAGYRVELSQVGLFADGVAVRLVGEETFRLCRELVDDIILVDSDAICAAIKDIFEDTRSIVEPSGALSIAGLKAYVKQKNLLHEVLVAIASGANMNFDRLRHVSERAELGEQREAILAVTIPEKPGSFKKFCNLLGARNITEFNYRYADPEMAHVFVGVSVRNREESLHLIEILQENGLKTEDMTDNEMAKLHIRHMVGGRSREVMHEILYRFEFPDRPGALMNFLNHMSDHWNISLFHYRNHGADFGRVLIGIQVPPEEKQEFREFLDKLGYSFWDENDNPAYQLFLA

SEQ ID NO: 31423 - DNA, 1002 bp, Bacillus anthracis str. Ames
  CDS (1)..(1002): transl_table=11
atgataactaaaaaactaccattacatatagacgatattaaaaaagctcaaagcattctggatagaaatgctcgtaaaactccattagtaaaatcattttatttgactagtaaaacgggtggagaaattcacttgaaattagaaaacatgcaattaacaggttcgtttaaattccgtggtgcgtttaataaaatgtcacagctgacagatcaagaaaaagaaagaggagtaattgcttgttctgctggtaatcatgcgcaaggaattgctttatctgctcatttacttggtattaagagtaaaattgttatgccgatttctgcaccgcaggcgaaagttgatgcgactaaaggatatggatctgaagtagttttacatggtgaaacctttgatgatgcgaaggcaaaatgtgaggagattattagggaaacaggtgaaacatacttacatccatatgacgatgtagaagtaatggcaggtcaaggtacaataggattagatattcttgatgatatgtgggatgttgatacggtcattgtaccaattggtggaggaggaattatttctggaattgctgtcgcattaaaatcttttaatccgtcgattcatataattggtgtgcaagcagaaaatgttcatgggatgaaggcatcttatgacaaaggcaaaattatagaacattatgaggcacctacgatagcagatggttgcgcggtaaaaatacctggcaatttaacttttgaagttgtaaaagaattagtagatgatattgtaacggtatcagaaaaagagctggaagtagcgatgaaagacttattacaacgcgggaaagctgttgtagaaggtgcaggcgcattagctactgctgctctacttgcagggaaagtggatacatatattaaagagaaaaaagtagtagcagttatatctggtgggaacgtagacttacagcgcatatcgagtgtttgtgaacaattttttgtggcgaatgaagtggaatag

SEQ ID NO: 31424 - protein, 333 aa, Bacillus anthracis str. Ames
MITKKLPLHIDDIKKAQSILDRNARKTPLVKSFYLTSKTGGEIHLKLENMQLTGSFKFRGAFNKMSQLTDQEKERGVIACSAGNHAQGIALSAHLLGIKSKIVMPISAPQAKVDATKGYGSEVVLHGETFDDAKAKCEEIIRETGETYLHPYDDVEVMAGQGTIGLDILDDMWDVDTVIVPIGGGGIISGIAVALKSFNPSIHIIGVQAENVHGMKASYDKGKIIEHYEAPTIADGCAVKIPGNLTFEVVKELVDDIVTVSEKELEVAMKDLLQRGKAVVEGAGALATAALLAGKVDTYIKEKKVVAVISGGNVDLQRISSVCEQFFVANEVE

SEQ ID NO: 31425 - DNA, 1227 bp, Helicobacter hepaticus ATCC 51449
  CDS (1)..(1227): transl_table=11
atgaaaaagcagatatatgaaaaagtaataaaagccaagcaacgtttagaaaatgtgattattccctcgcctttaagctatgcacctatgctctctcttttagctcaagctgatatttatcttaaaaaagagaatctgcaactgacgggagcatttaagattcgtggagcgttcaataaaattgcctctttggttgaacaatctactcattcccaaatacagggcgttatcgctgcaagtgctgggaatcacgcgcaaggtgttgcctatgctgcaaagcattttggtataaaagccgtgattgtaatgcccgaagctactcctttacttaaggtaagtgcgacaaaagctcttggtgcggaagtggttttaagtggagataattatgatgaagcctatgctaaagctttgcaggttgctaaagagcgtgatttagtgtttattcacccttttgctgacgaggaggtgattgcagggcagggcagtattgcgcttgagatgatacaagaatgtgaggatttaaatgtagtagttgtgcctattggtggaggtggtttgattagtggtatagggagtgtgtataagcaactatatccgaatgtaagagttataggtgtagtggcaagtggtgcagacgctatgaaacgctcttttgagagtggtgctatccaaaaaatagaatctgtgcggagcattgctgatggtatagctgtgcgtgatgttaatgaggagaattttgcgcttgtgcaagaatgtgttgatgaaatagtgagcgtagatgatgaagaaattgcaaatgctattttatttttgattgaaaaacaaaaacttgttgttgagggtgcaggagcagcgagtgtagcaagtattttgcacaaaaagtttgcacttacaaagcaagataaagtagcacttgtgctaagtggaggaaatattgatattactttgcttaatgttattattgaaaaaggtttattgaaatctaatcggaagatgaagcttgaagtcgtgctcatagataagcccggtagtttgcaagggctaacaaatattttaagtaaagtgggtgcaaatatcgttcagattgaatatgataggacttctgttatgcttaaatatggagatgcacttgtaacaatggcattagagacaaaaaatgaagaacacaaagtgctcattcgcgagcaacttcaacattatggttatcattttaatgagattaattag

SEQ ID NO: 31426 - protein, 408 aa, Helicobacter hepaticus ATCC 51449
MKKQIYEKVIKAKQRLENVIIPSPLSYAPMLSLLAQADIYLKKENLQLTGAFKIRGAFNKIASLVEQSTHSQIQGVIAASAGNHAQGVAYAAKHFGIKAVIVMPEATPLLKVSATKALGAEVVLSGDNYDEAYAKALQVAKERDLVFIHPFADEEVIAGQGSIALEMIQECEDLNVVVVPIGGGGLISGIGSVYKQLYPNVRVIGVVASGADAMKRSFESGAIQKIESVRSIADGIAVRDVNEENFALVQECVDEIVSVDDEEIANAILFLIEKQKLVVEGAGAASVASILHKKFALTKQDKVALVLSGGNIDITLLNVIIEKGLLKSNRKMKLEVVLIDKPGSLQGLTNILSKVGANIVQIEYDRTSVMLKYGDALVTMALETKNEEHKVLIREQLQHYGYHFNEIN

SEQ ID NO: 31427 - DNA, 1248 bp, Rhodopirellula baltica SH 1
  CDS (1)..(1248): transl_table=11
atgtcccctctgatcgccgccgacaaaattgaagcggctcgcaagcgaatcgccaaagtggttcgccacacgccattgatgcgaaacgctcggctctctgcactttatgatgcggagattttgctcaaacgtgaggacttgcaggaagttcgcagctacaaaattcgtggcgcgtacaaccggatgtcgcaactcagtgatgcacaacgtgccgcgggagtcgtttgcgctagtgccggaaatcacgcgcaaggattcgcctacgcctgccatgccatggggattcaggggcgagtttttatgccggcggtcacgccgaagcaaaaggtcgacaaagtcaagctgtttggacaggaacacgttgaggtcatcttgattggtgacacctttgacgacgccgccgcggaggctcatcgcgcagctgaggaaggcctgacgtacattcctccgtttgatgatcccgcgatcattgagggacaaggcaccgttggtgctgaaattttagaggaccattccgagccaattgatatggtgctcgttgccgtcggtggcggcggtctgatctcgggattgggcagcatcttcaaacagctttcaccgaaaacgaagatcatcggcattgaacccaccggtgcaccagcgatgcatgatagccttcgagcaggcgaggtgatcacgctggaaaagatcgacaacttcgttgatggagccgcggtcaggcgtgtcggagatttgaatttcaagatcgctcaacatgtgattgacgaaatgattttggtgccggaaggaaaggtgtgcagcgtgatgttgcagctctacaacgacgaaggtttggtcgtggaaccggctggcgcgttgtcgatcgccgcactggaccagctcgcatccgaaatttgcggcaaaactgttgtctgcgttgtcggcggaagcaacaacgacatcactcgcaccgaagaaattcgtgaccgagcaatgttgtacgaaggtttgcagcactacttcatcatcaagtttccgcagcgagccggggctttgcgagagttcctcaacaatgtgcttgggccaaccgacgacatcacacactttgagtacacacgaaagcacaatcgcgaaaccgggccggcgctcgttggtttgcaggtcgcccaccgcgacgactaccaaggcttgctcgaccggatggccgccagcaatatcgaataccaagtcgtcaacgaacaacgcatgctgttcgagttgttggtgtaa

SEQ ID NO: 31428 - protein, 415 aa, Rhodopirellula baltica SH 1
MSPLIAADKIEAARKRIAKVVRHTPLMRNARLSALYDAEILLKREDLQEVRSYKIRGAYNRMSQLSDAQRAAGVVCASAGNHAQGFAYACHAMGIQGRVFMPAVTPKQKVDKVKLFGQEHVEVILIGDTFDDAAAEAHRAAEEGLTYIPPFDDPAIIEGQGTVGAEILEDHSEPIDMVLVAVGGGGLISGLGSIFKQLSPKTKIIGIEPTGAPAMHDSLRAGEVITLEKIDNFVDGAAVRRVGDLNFKIAQHVIDEMILVPEGKVCSVMLQLYNDEGLVVEPAGALSIAALDQLASEICGKTVVCVVGGSNNDITRTEEIRDRAMLYEGLQHYFIIKFPQRAGALREFLNNVLGPTDDITHFEYTRKHNRETGPALVGLQVAHRDDYQGLLDRMAASNIEYQVVNEQRMLFELLV

SEQ ID NO: 31429 - DNA, 1545 bp, Candidatus Blochmannia floridanus
  CDS (1)..(1545): transl_table=11
atgatgaagaagtatcaggaatcattttcttgtcaggaaatgtgtccatcagagtatttgaaaattgctttgcattctcatgtatatgaagttgcacaagttactccgttgcaggtgatgcataagttatcgagtagacttaaaaatatagtgttagttaaacgtgaagatagacagccagtacatagttttaagttacgtggggcttatgctatgctttcgaatcttaccgaaaaacaacaatcgtctggggtaatcacagcttctgccggtaatcatgcccaaggagtggcattttcagctagtcatttaggaattagttctgtagttgtaatgcctgtgaatacggctgatataaaaattgatgcagtacgtcattttggaggaaaaccattgttgtttggatcaaattttgatgaagctaaagttaaagctatttatttagctgataagaattgtttgacttttattcctccttttgatcatccgtttgttattgcaggtcaaggtactgtggcgatggagttattacaacaagattcgcatttagatcgtatttttgtgccagtaggcggaggtggattagcagcaggtattgctgtattaattaaatatcttatgccaaaaattaaagttattggagtggaatcagaagaatcagcatctttatgtgcagctttggaagctgggtttccagtatatttaagtaaggtgggattatttgcagagggagtggcagtacgatgtataggtcatgaaacatttcgtttgtgtcaaaaatatcttgatgatgttattactgtagataatgattcaatttgtgctgcaataaaagatctatttgaagatgttcgagctatagctgaaccatcaggtgcgttagcgttagctggaatgaagaaatatattcagcgacatgcgatacatggagaaaaattagtacatgttctttccggggctaatattaattttcatgaattaagatatatttcagagcgttgtgaactaggagaacaaagagaggcgttaatggtagttactattccagaaaaaaaaggtagttttttagaattttttaaaattttagaagataaatcagtaacagaatttaattatcgttataatggatctaaaaatgtttgtgtatttattggtgtgcgtttacagaatggacgttgtgaacgagatagtatagtagaaaatattcttaatcatggatttcctgttgtagatttgtctgataatgaaatggctaaattacatgctagatatatggtgggatctcgttctttacagtcttttcgtgagcgaatttttagttttgagtttccagaagctccaggagcattattgaaatttttgaatactttaggaactgattggaatatttctttatttcattatcgtaatcatggtacggattatggtcgagttttagctggatttgaattatctcatcaggaactagaatttgatcagcatttatctaaattagggtatacatgtcatgatgtgactactaatccagtatttcaatttctttag

SEQ ID NO: 31430 - protein, 514 aa, Candidatus Blochmannia floridanus
MMKKYQESFSCQEMCPSEYLKIALHSHVYEVAQVTPLQVMHKLSSRLKNIVLVKREDRQPVHSFKLRGAYAMLSNLTEKQQSSGVITASAGNHAQGVAFSASHLGISSVVVMPVNTADIKIDAVRHFGGKPLLFGSNFDEAKVKAIYLADKNCLTFIPPFDHPFVIAGQGTVAMELLQQDSHLDRIFVPVGGGGLAAGIAVLIKYLMPKIKVIGVESEESASLCAALEAGFPVYLSKVGLFAEGVAVRCIGHETFRLCQKYLDDVITVDNDSICAAIKDLFEDVRAIAEPSGALALAGMKKYIQRHAIHGEKLVHVLSGANINFHELRYISERCELGEQREALMVVTIPEKKGSFLEFFKILEDKSVTEFNYRYNGSKNVCVFIGVRLQNGRCERDSIVENILNHGFPVVDLSDNEMAKLHARYMVGSRSLQSFRERIFSFEFPEAPGALLKFLNTLGTDWNISLFHYRNHGTDYGRVLAGFELSHQELEFDQHLSKLGYTCHDVTTNPVFQFL

SEQ ID NO: 31431 - DNA, 1581 bp, Bordetella parapertussis 12822
  CDS (1)..(1581): transl_table=11
atgtccgataccgccaccgccccgacgaccgccgagccgcgcaccgcgccgccggcgcgcgccgatctgcttgcccactacgcccgcaagacgctttccgcgccggtctacgacgtcgcgctggagacgccgctgcaagcggcgccgcgcctgtcgcgccagctggattgccgcgtgctgctcaagcgcgaagacctgcagccggtgttctcgttcaagatccgcggcgcctacaaccgcgtcgcgcagttgagcgccgaggagcgccgccgcggcgtcatcgccgcctcggccggcaaccatgcgcaagggctggcgctggccgccgcgcgcctgggcattccggcgctcatcgtcatgccgcgcaccgcgcccgagctgaagatcgacggcgtgctggcgcacggcgcgcaggtggcgctgcatggcgacgcctttccggcggcgctggcgcacgcgcaggcgctggctgaacgcgagggcagggtgttcatcccgccgtacgacgatcccgacgtgatcgccggccagggcacggtgggcatggagatcctgcgccagcatccgggccgcctggacgccattttcgtgccggtcggcggcggcagcctgatcgcgggcgtggccgcctacgtcaagcatgtgcgtccggagatccgcatcatcggcgtcgagccggtggattcgaactgcctgcaggccgcgctggcggcgggccggcgcgtggtgctcgaccgcgtgggcaccttcgccgacggcgtggcggtggcgcagatcggccatcacaatttcgagatctgccgcgaccatgtcgacgaggtgatctgcgtcaccaacgatgaaatctgcgccgccatcaaggacatctacgacgatacccgctccatcaccgaaccggccggcgcgctggcggtggcgggcctgcgcaagtacgccgagcgcggcgaggcggccgggcgcaccctggtggcgatcgactcgggcgccaacatcaacttcgaccgcctgcggcacgtggccgagcgcgccgcgctgggcgagcagcgcgaagccttgatcgcggtgaccatccccgagcggccgggcagctttaaggccttctgcgcggcattggggccgcgccagatcaccgaattcaactatcgctaccatcccggcgacgaggcgcagatcttcgtcggggtgcggacccatcccgagcacgaccggcgcgatgcgctgctggccgggctgcgcggccagggcttcgcggtgcaggacctcagcgacgacgaactggccaagctgcacgtgcgccacatggtgggcgggcgcgccaaccagatcgacgacgagcaggtgttccgcttcgagttccccgagcgtcccggcgcgctgttcgacttcctgagcaaactgggcggccgctggaacatcaccatgttccactaccgcaaccacggctcggccgacggccgcgtggtggccggcctgcaggtgccggccgacgagcgccacctggtgccgcaggcattgacgcgcatcggctatccgttccgggacgagacggccaatccctcgtatcgcctgttcatccggtga

SEQ ID NO: 31432 - protein, 526 aa, Bordetella parapertussis 12822
MSDTATAPTTAEPRTAPPARADLLAHYARKTLSAPVYDVALETPLQAAPRLSRQLDCRVLLKREDLQPVFSFKIRGAYNRVAQLSAEERRRGVIAASAGNHAQGLALAAARLGIPALIVMPRTAPELKIDGVLAHGAQVALHGDAFPAALAHAQALAEREGRVFIPPYDDPDVIAGQGTVGMEILRQHPGRLDAIFVPVGGGSLIAGVAAYVKHVRPEIRIIGVEPVDSNCLQAALAAGRRVVLDRVGTFADGVAVAQIGHHNFEICRDHVDEVICVTNDEICAAIKDIYDDTRSITEPAGALAVAGLRKYAERGEAAGRTLVAIDSGANINFDRLRHVAERAALGEQREALIAVTIPERPGSFKAFCAALGPRQITEFNYRYHPGDEAQIFVGVRTHPEHDRRDALLAGLRGQGFAVQDLSDDELAKLHVRHMVGGRANQIDDEQVFRFEFPERPGALFDFLSKLGGRWNITMFHYRNHGSADGRVVAGLQVPADERHLVPQALTRIGYPFRDETANPSYRLFIR

SEQ ID NO: 31433 - DNA, 1218 bp, Bordetella parapertussis 12822
  CDS (1)..(1218): transl_table=11
gtgatcgatcttgccgccatccagaccgcccgggacatcctgcggggacaggtcctcaatacgccgttcacgcattcccgcacgctgtccgatatcctcggcgccgaaatctggctgaagttcgagaacctgcagttcaccgcctcgttcaaggagcgcggcgccctcaaccggatgctcaacctgaccgaggccgagcgcgccgccggcgtgatcgccgtgtcggccggcaaccatgcccagggcgtggcgtaccacgcgcagcgcatgggcgtgccggcggtgatcgtcatgccgcgcttcactcccacggtcaaggtggccaacacgcggcgcttcggcgccgaagtcgtcctggccggcgacaccttcgacgacgccaaggcgcgcggctacgaactggcgcgcgagcgcggcctggtcatgatccatccctacgacgatccagccgtgattgccgggcagggtacggtggcgctcgaaatgctgcaggcgcgcccagacctggacgccatcgtggtgggcatcggcggcggcggcctgatcgcgggcatcgccaccgccgccaaggccatcaagccggacatcgagatcatcggcgtgcagaccgagcgctttccgtccatgtacgccgccgtcaagggcgtggccatggaaagcggccactacacgatcgccgagggcatcgccgtcaagtcacccggcacgctgacccaggagatcgtcacgcgcctggtcgaccacatcgagctggtcaacgaaagcgatatcgagcatgccatcgtggtcctgctggaaatcgagaagaccgtggtcgaaggggccggcgcggccggcctggcggcgctgctgcggctgcaggaacgccgcgacgagcggttccgcggcaagcggctggggctggtgctcacgggcggcaacatcgatcccctgatgctgggcgagctgatcgagcgcggtatggtgcgcgccgggcgcctggcgcgcatccgggtcgacctgcgcgacctgccgggcgcgctggcgcaggccaccaagctgatcgccgacgcgcacgccaacattaccgaggtgcatcaccagcgcgccttcaccaccttgccagtgcgcaatgtcgaggtcgatttcgtgctgcagacgcgtggccatgaccacatccaggaagtcatcgcggtgctcaatgccgcgggcttcgcggccagcaaccacgatcactga

SEQ ID NO: 31434 - protein, 405 aa, Bordetella parapertussis 12822
MIDLAAIQTARDILRGQVLNTPFTHSRTLSDILGAEIWLKFENLQFTASFKERGALNRMLNLTEAERAAGVIAVSAGNHAQGVAYHAQRMGVPAVIVMPRFTPTVKVANTRRFGAEVVLAGDTFDDAKARGYELARERGLVMIHPYDDPAVIAGQGTVALEMLQARPDLDAIVVGIGGGGLIAGIATAAKAIKPDIEIIGVQTERFPSMYAAVKGVAMESGHYTIAEGIAVKSPGTLTQEIVTRLVDHIELVNESDIEHAIVVLLEIEKTVVEGAGAAGLAALLRLQERRDERFRGKRLGLVLTGGNIDPLMLGELIERGMVRAGRLARIRVDLRDLPGALAQATKLIADAHANITEVHHQRAFTTLPVRNVEVDFVLQTRGHDHIQEVIAVLNAAGFAASNHDH

SEQ ID NO: 31435 - DNA, 969 bp, Bordetella parapertussis 12822
  CDS (1)..(969): transl_table=11
atgcagccccaattgcccacttatgccgacgtcgaacaggcggccgccacgctggctggcgtggcgcatcgcacccccgtgctgacctcggccaccgccgacgccatggcgggcgcgcaggtctttttcaagtgcgagaacttccagcgcatgggggcgttcaagttccgcggcggctacaacgccatcgcccgcctgacgcccgaacagcgccgcgccggcgtggtgacgttttcgtcgggcaaccatgcccaggccatcgccctggccgcgcgcctgcagggcgtgcaggccaccatcatcatgccgcaggacgcgccggcggccaagcgcgcggccaccgagggctacggcggccggatcgtcacctacgaccgctacagcgaggaccgcgaggccatcgcgcgccggctgcaggaagaaaccggcgccacgctgatcccgccctatgaccacgccgacgtgatcgccgggcaggggaccgccgccaaggaactgttcgacgaggtcggcgaactcgactacctgttcgtgtgcctgggcggcggcggactgctggcgggctcggccctggcggcgcgggccctcagcccggcctgccgcgtctacggcgtcgagccggcggccggcaacgacagccagcactccttgcgcaagggcgagatcgtcaccatcgccgcccccaagtcgatcgccgacggcgcggtcacgacgcacctgggccggctgaccttcgccatcatccagcagcaggtggcggacatcctgaccgtcagcgatgccgaactggtgcaaagcatgaggttcttcgccgagcgcatgaaaatggtggtcgaacccaccggctgcctggccgccaccgccgcgttgcgcaaactcatccccgaggcggccggcaagcgcgtcggcgtcatcatcagcggcggcaacgtcgacctgccggtctacgcgcgcctgctggccgactga

SEQ ID NO: 31436 - protein, 322 aa, Bordetella parapertussis 12822
MQPQLPTYADVEQAAATLAGVAHRTPVLTSATADAMAGAQVFFKCENFQRMGAFKFRGGYNAIARLTPEQRRAGVVTFSSGNHAQAIALAARLQGVQATIIMPQDAPAAKRAATEGYGGRIVTYDRYSEDREAIARRLQEETGATLIPPYDHADVIAGQGTAAKELFDEVGELDYLFVCLGGGGLLAGSALAARALSPACRVYGVEPAAGNDSQHSLRKGEIVTIAAPKSIADGAVTTHLGRLTFAIIQQQVADILTVSDAELVQSMRFFAERMKMVVEPTGCLAATAALRKLIPEAAGKRVGVIISGGNVDLPVYARLLAD

SEQ ID NO: 31437 - DNA, 987 bp, Bordetella bronchiseptica RB50
  CDS (1)..(987): transl_table=11
atgctcgacgtgacctccgacacctccgccgtacccgacagttccgccatcgcctacctgcacgcccagctgcagcgctgggtgcgcgccacgccgatcctggagaaaaccgatttcgagccggtggccggcatcgcggtgtgcttcaagttcgaactgctgcaggccagcggcaccttcaaggcgcgcggcgccttctcccacctgctggcgctggacgacgcgcaacgccaggccggcgcgacctgcgtctcggccggcaaccatgccgtggccgtcgcctacgcggccatgcggctgggcctgtcggccaaggtagtcatgatcaagaccgccagcccggcgcgcgtggcgctgtgccgccagtacggcgccgaggtcgtcctggccgacgacggcccgcaggccttcgagacggtgcgccgcatcgagaacgaggaaggccgctacttcgtgcatccgttcaatggctaccgcacggtgctgggcaccgccacgctgggccacgaatggctgcagcaggccggcgagctcgatgcggtcatcgtgcccgtcggcggcggcgggctgatctcgggcgtggccaccgcgatcaagctggccgcaccgcaatgccaggtcatcggcgtcgaacccgaaggcgccgacgccatgcaccgcagcttcgcggccggcggcccgatcaggatgggcccgatgcacagcatcgccgacagcctgatggcgccgcacaccgagcagtacacctacgacctgtgccggcgccacgtcgaccggctggtcaaggtggacgaccacgcgctgcgcgccgccatgcggctgctgttcgaccagctcaagctggccaccgagccggcctgcgcggccgccaccgccgcgctggccgggcccttgcgcaacgacctggccggccggcgcgtgggcgtgctgctgtgcggcaccaacaccgatccggccaccttcgcgcgccacctgggcgcggactga

SEQ ID NO: 31438 - protein, 328 aa, Bordetella bronchiseptica RB50
MLDVTSDTSAVPDSSAIAYLHAQLQRWVRATPILEKTDFEPVAGIAVCFKFELLQASGTFKARGAFSHLLALDDAQRQAGATCVSAGNHAVAVAYAAMRLGLSAKVVMIKTASPARVALCRQYGAEVVLADDGPQAFETVRRIENEEGRYFVHPFNGYRTVLGTATLGHEWLQQAGELDAVIVPVGGGGLISGVATAIKLAAPQCQVIGVEPEGADAMHRSFAAGGPIRMGPMHSIADSLMAPHTEQYTYDLCRRHVDRLVKVDDHALRAAMRLLFDQLKLATEPACAAATAALAGPLRNDLAGRRVGVLLCGTNTDPATFARHLGAD

SEQ ID NO: 31439 - DNA, 1509 bp, Bordetella bronchiseptica RB50
  CDS (1)..(1509): transl_table=11
atgtccaccgactacctcaaacgcatcctgacctccaaggtctacgacgtcgccgtcgaatcgccgctggagcgcgcgcccctgctgtcgcagcgcatcgcgaacaacgtgctgctcaagcgcgaggacacccaggcggtattcagcttcaagctgcgcggcgcctacaacaagatggccaacctgacgccggcggcgcgcagccgcggcgtgatcgccgcctcggcgggcaatcatgcccagggcgtggccctggcggccaccaggctgggctgccgcgcggtcatcgtcatgcccaccaccagcccgcaggtcaaggtcgacgccgtgcgccggctcggcggcgaggtcgtgctggccggcgacagcttcaccgacgcctacgaacacgcgcagcagctggaaaagcgcgaaaagctgaccttcgtgcatcccttcgacgatcccgacgtgatcgccggccagggcaccatcggcatggaaatcctgcgccagcatccgggcgagatcgaggcgatcttcgtggccatcggcggcggcggcctgatcgccggcgtggccgcctacatcaagcagttgcggccggaaatcaagatcatcggcgtgcagaccgaagactccgacgccatggtccgcagcgtacgcgccggccggcgcgtgcagctcagcgatgtcggcctgttctcggacggcacggccgtcaagctggtgggcgccgaaacgttccggctggcgcgccagtacgtggacgacttcgtggtggtcaataccgacgcgatctgcgcggccatcaaggacgtgttccaggacacccgcagcgtgctggagcccgccggcgccatggcggtggccggcgccaagcagtacgcggccgagcacaagctcaagggcaagaccctggtggcggtggcatgcggcgccaacatgaatttcgaccggctgcgcttcgtggccgagcgcgccgaagtgggcgaaatgcgcgaggcggtgttcgccgtcaccatgcccgagcagcgcggcagcttccgccgcttctgcgagctggtcggcaaccgcagcgtcaccgagttcaactaccgcatctccgatgccgagcgtgcgcacgtcttcgtgggcgtgcaggtctccacgccggccgaaccggaaaagatcgccgccaacttccgccggcacggcttcgacaccctggacctgacgcacgacgaactggccaagacgcacctgcgccacatggtcggcggccattcggcgctggcgcgcaacgaactgctctaccgcttcgagttccccgagcgcccgggcgcgttgatgcgctttctcaacgccatgaaccccgactggaacatcagcctgttccactaccgcaaccagggcgccgactacggcaacatcctgatcggcatccaggttccgcccaccgacaagaaactgttcaagaccttcgtcgccgaactgggctacccgcactggaacgaaacggacaacccggcgtacaggctgttcctgtag

SEQ ID NO: 31440 - protein, 502 aa, Bordetella bronchiseptica RB50
MSTDYLKRILTSKVYDVAVESPLERAPLLSQRIANNVLLKREDTQAVFSFKLRGAYNKMANLTPAARSRGVIAASAGNHAQGVALAATRLGCRAVIVMPTTSPQVKVDAVRRLGGEVVLAGDSFTDAYEHAQQLEKREKLTFVHPFDDPDVIAGQGTIGMEILRQHPGEIEAIFVAIGGGGLIAGVAAYIKQLRPEIKIIGVQTEDSDAMVRSVRAGRRVQLSDVGLFSDGTAVKLVGAETFRLARQYVDDFVVVNTDAICAAIKDVFQDTRSVLEPAGAMAVAGAKQYAAEHKLKGKTLVAVACGANMNFDRLRFVAERAEVGEMREAVFAVTMPEQRGSFRRFCELVGNRSVTEFNYRISDAERAHVFVGVQVSTPAEPEKIAANFRRHGFDTLDLTHDELAKTHLRHMVGGHSALARNELLYRFEFPERPGALMRFLNAMNPDWNISLFHYRNQGADYGNILIGIQVPPTDKKLFKTFVAELGYPHWNETDNPAYRLFL

SEQ ID NO: 31441 - DNA, 1545 bp, Prochlorococcus marinus str. MIT 9313
  CDS (1)..(1545): transl_table=11
atggacgattatctacagaggattctgagggcacgtgtctatgacgtagcccatgaaacccccctggaactggccaaaaacctcagtcgccgttttcagaacaagatctggttgaaacgtgaggacctacagccagtcttctcattcaagctgcgtggtgcgtataaccgcatgtcccttctcagccaagaagagttgcagcgtggcgtgattgcttcaagtgctggaaaccacgctcagggagtggcactgagcgcctcttatctcaattgcagagctgtgattgtgatgcctatcaccacacccgaaatgaaggtacgggcagtccgtgctcttggcgctgaagtcgcacttcatggagagacctacgacgaggcctatcaagaggccatgcgtcgcagtgaaaaagatggactcacgtttatccacccgtttgatgatccagaggtgattgctgggcaagggacgattgctctagaaatcctgcgccagatccaagatccaccagatgcaatctatgtcgcagttggcggtggcggactgatcggagggattgccacctatgtcaaaagcttgtggccgcaagtcgaaattatcggtgtcgagccctacgacgctgcagcaatgaagctctctcttgaggctggtgaacgtattcagctgcccaatgttggcctatttgccgacggagtcgctgtacgtcaagtaggcaaactcaccttctcattagcccagatgcacgtagacgcgatggtgacggtaagcactgatgaaatctgtgcagcgatcaaagatgtttttgaagatacccgctcaattcttgaaccagctggcgcactggcaattgctggcatgaaggcagatatcgccaaacgtgatcttcaagaccgcactcttgtggccgtggcctgtggcgcaaacatgaactttgaacggcttcgttttgtcgccgaaagagcagagctaggggaagaaagggaagcaatactcgctgtggaaatcccagaacaggcaggcagcctgcgaaagctctgcaatgtccttgcagggaaaaatctcaccgaattcagttaccgaatggcagaaggggatagagcacaaatattcatcggggtacaggttttagacctggatgatcgaaccaagcttttaacgcgactgcagtcgtcaggattcgcatgccttgatctcagcaacgacgagctcaccaaagggcaccttcgtcacatggtgggtggtcggcttcctgcctcagccaaaaccctttgccgagatggatgtcgcgaactgctctatcgctttgagttccctgagcgaccaggagctcttatgacctttgttagtgcccttcaccctgaatggagtatcagcatcttccactaccgcaatcacggagcagatgtcggcaggatcgttgtaggtgtgttggttcaggacaacgaaatggacgattggcagcgctttcttgaagatctgggctacccaaactgggaagaaacaaacaaccccgcctactgcttatttctgggtgcacagaccgtttga

SEQ ID NO: 31442 - protein, 514 aa, Prochlorococcus marinus str. MIT 9313
MDDYLQRILRARVYDVAHETPLELAKNLSRRFQNKIWLKREDLQPVFSFKLRGAYNRMSLLSQEELQRGVIASSAGNHAQGVALSASYLNCRAVIVMPITTPEMKVRAVRALGAEVALHGETYDEAYQEAMRRSEKDGLTFIHPFDDPEVIAGQGTIALEILRQIQDPPDAIYVAVGGGGLIGGIATYVKSLWPQVEIIGVEPYDAAAMKLSLEAGERIQLPNVGLFADGVAVRQVGKLTFSLAQMHVDAMVTVSTDEICAAIKDVFEDTRSILEPAGALAIAGMKADIAKRDLQDRTLVAVACGANMNFERLRFVAERAELGEEREAILAVEIPEQAGSLRKLCNVLAGKNLTEFSYRMAEGDRAQIFIGVQVLDLDDRTKLLTRLQSSGFACLDLSNDELTKGHLRHMVGGRLPASAKTLCRDGCRELLYRFEFPERPGALMTFVSALHPEWSISIFHYRNHGADVGRIVVGVLVQDNEMDDWQRFLEDLGYPNWEETNNPAYCLFLGAQTV

SEQ ID NO: 31443 - DNA, 1530 bp, Synechococcus sp. WH 8102
  CDS (1)..(1530): transl_table=11
atgaccgactatctccagcggatcctgcgggctcgcgtctacgacgtcgcgcgggagacgccgcttgaccctgccccaaacctcagtcgccgacttggcaatgaggtgctgctgaagcgcgaagacctgcaaccggtgttctcgttcaagcttcgcggtgcttacaaccgcatggcccagctcacgccggaggaactcagtcgtggcgtgatcgcctccagcgcaggaaaccatgcccagggcgtggccctaagtgccaaaaaactcggctgccgcgccgtcatcgtgatgcccgccaccacacccgaggtgaaggtgcgggccgtgcgcaccattggcggggaagtcgtgctccatggggagacctacgacgaatgttcagcagaagcgagacaacgctgcgctgatgagggactcacctacatccatccctttgacgacccggaagtgatcgccggccagggaaccatcggtctggaaatcatgcggcagagccctgaaccgccggatgccatttatgtagcggtcggcggcggcggactaattgccggaatcgcggcttacgtcaaacagctgtggcccagcaccgagatcgtcggcgttgaaccggttgatgcggacgccatgacccagtcgttagagaagggagtacgggttgagctggcccaggtgggcctgttcgccgacggcgttgcggtccgcagggtgggggagcacacctttgccctggcccaacaatttgttgaccgcatggtgcgggtcgacaccgatgcgatctgtgccgccatcaaggacgtttttgaagacacgcgctccatcctcgaaccggctggagcacttgccgtggctgggctgaagcaggacgtggccgattgccaaatgacggaccgccgactggtggcggtggcctgcggcgccaacatgaacttcgatcgcctgaggttcatcgccgaacgctccgaactgggagaggaacgcgaggcgatgctggcggtggagatccctgagcaaccgggaagcctcagaaccctgtgtgatcacctacgcagccgcagcctcaccgaattcagttaccgaatgagtgagggcgcatcagcccacatcttcatcggcgtgcaggtgaacggcgcacaggatcgttaccagctcgtggatggactccagcagcagggcttctcctgtcttgacctcagcgacaacgaattgtccaaggttcacctccgccacatggttggcggtcgtcttccatccacttcgcaggacagttgcgctgggggctgcctcgaactgctgtaccgctttgaatttccagagaggccgggggcactgatgcgcttcgtcagcgctctcaatcccggttggagcatcagcatcttccactaccggaaccatggagctgacgtgggtcggatcgtggtgggtgtgctgataccggtggaagaacagccgcagtggacggccttcctcaatgagcttgggtatccctattggaatgaaaccgacaatccggcttacaccctgttcctctga

SEQ ID NO: 31444 - protein, 509 aa, Synechococcus sp. WH 8102
MTDYLQRILRARVYDVARETPLDPAPNLSRRLGNEVLLKREDLQPVFSFKLRGAYNRMAQLTPEELSRGVIASSAGNHAQGVALSAKKLGCRAVIVMPATTPEVKVRAVRTIGGEVVLHGETYDECSAEARQRCADEGLTYIHPFDDPEVIAGQGTIGLEIMRQSPEPPDAIYVAVGGGGLIAGIAAYVKQLWPSTEIVGVEPVDADAMTQSLEKGVRVELAQVGLFADGVAVRRVGEHTFALAQQFVDRMVRVDTDAICAAIKDVFEDTRSILEPAGALAVAGLKQDVADCQMTDRRLVAVACGANMNFDRLRFIAERSELGEEREAMLAVEIPEQPGSLRTLCDHLRSRSLTEFSYRMSEGASAHIFIGVQVNGAQDRYQLVDGLQQQGFSCLDLSDNELSKVHLRHMVGGRLPSTSQDSCAGGCLELLYRFEFPERPGALMRFVSALNPGWSISIFHYRNHGADVGRIVVGVLIPVEEQPQWTAFLNELGYPYWNETDNPAYTLFL

SEQ ID NO: 31445 - DNA, 1530 bp, Chromobacterium violaceum ATCC 12472
  CDS (1)..(1530): transl_table=11
atgagcaacaagcaagactatctggaacgcatcctcacctcgcgggtgtacgacgtggcggtggaaacgccgctggagctggcgcccaatctgtcgcgccgttaccgcaaccacatcctgctcaagcgcgaggatctgcagccagtgttctcgttcaagctgcgcggcgcttacaacaagatggccaagctgacgccggagcagcgcgcgcgcggcgtgatcaccgccagcgccggcaaccacgcccagggcgtggcgctgtcggccagcaagctcggctgcgaggcggtgatcgtgatgccggtcaccacgccgcagatcaagatagacgcggtgaagcagcgcggcggccaggtggtgctgtcgggagactccttcaacgaagcctacctgcatgcggtgaagctggccgaggagagcggccgcacctacatcccgcctttcgacgacccggacgtgatcgccggccaggggacggtgggcatggaaatcctgcgccagcatccggatgatctggatgccgtattcgtcgccatcggcggcggcggcctggcggccggcgtggccagcttcatcaaacggctgaagcccgagatcaagatcatcggcgtgcagcctgtcgactcggacgcgatgcgccagtccatagagaagggcgagcgggtcgagctgaaggatgtgggtttgttcgccgacggcgtggcggtgaagctggtgggcgaagagaccttccgcatctgccgcgagctgctggacgagatcatcctggtggattccgacgccatctgcgcggcgatcaaggatatttttgaagatacccgctccatcgtcgagccggccggcgcgctggcggtggcgggcgccaaggcctacatcgagcgcgagggctgcgagggccagtcgctggtggcgatctcctgcggcgccaacatgaatttcgaccgcctgcgccatgtctcggagcgatccgagctcggcgagcggcgcgaggccatcattgccgtcaccattccggagaagccgggcagctttaagcgcttctgttcggtgataggcggccgcaacatcaccgagttcaactaccgtttcgccgaccccagcgtcgcccatgtgttcgtcggcgtgcagatcgccggcaaggaggatgtggaaaagctgttgcgcgacttgcgcgcggcggagctggatggcatcgacctgaccgacaacgagctggccaagctgcacatccgccacttggtcggcggccacgcgccgcaactgaaggacgaacgcgtgctgcgcttcgagtttcccgaccgtcccggcgcgctgatgcgctttttggaggcgatgcgcaccgactggaacatcagcctgttccactaccgcaaccatggcgcggactatggccgggtgctggtcggcatccaggtgccgtccggcgacgcccaggcctttcagcaattcctcgacacgctcggatatccttatatagaggaaaccgaaaatccggcctatcgattgttccttggcaagaccatccgttga

SEQ ID NO: 31446 - protein, 509 aa, Chromobacterium violaceum ATCC 12472
MSNKQDYLERILTSRVYDVAVETPLELAPNLSRRYRNHILLKREDLQPVFSFKLRGAYNKMAKLTPEQRARGVITASAGNHAQGVALSASKLGCEAVIVMPVTTPQIKIDAVKQRGGQVVLSGDSFNEAYLHAVKLAEESGRTYIPPFDDPDVIAGQGTVGMEILRQHPDDLDAVFVAIGGGGLAAGVASFIKRLKPEIKIIGVQPVDSDAMRQSIEKGERVELKDVGLFADGVAVKLVGEETFRICRELLDEIILVDSDAICAAIKDIFEDTRSIVEPAGALAVAGAKAYIEREGCEGQSLVAISCGANMNFDRLRHVSERSELGERREAIIAVTIPEKPGSFKRFCSVIGGRNITEFNYRFADPSVAHVFVGVQIAGKEDVEKLLRDLRAAELDGIDLTDNELAKLHIRHLVGGHAPQLKDERVLRFEFPDRPGALMRFLEAMRTDWNISLFHYRNHGADYGRVLVGIQVPSGDAQAFQQFLDTLGYPYIEETENPAYRLFLGKTIR

SEQ ID NO: 31447 - DNA, 966 bp, Chromobacterium violaceum ATCC 12472
  CDS (1)..(966): transl_table=11
atgaatgacttgtaccagtacatactcgatgcccatcgggcattgcggccgcaggtcgccgtcacgcctctgagccacagcccggcattgtcggcgctgaccggctgcgaagtgtatttgaagtgcgagcacctgcagcacaccggctccttcaagttccgcggcgccagcaacaagatccggctgctggacgccgcgtcgcgccggctgggcgtggccacggtgtccagcggcaaccacggcctgggcgtggcgctggccggcaagctggccggcgtgccggtcacggtgtacgcgtcggccgcggcgtccgaggtgaagctggacgcgatccgcgcccacggcgcgaaggtggtcgtcatcgacgcgccaatgctggaagtggagctggaggccgcgcggctcgccgagcgggccgggctgcccttcgtctcgccgtacaacgacgtcgacgtcatcgccggccagggcacgatagggatggagctggccgagcagcatcccggcctggtggcggtgttcgcgtcggtgggcggcggcggcatgatttccggcatcggctccgcgctggagatgatgagcccgagtaccgagatcgtcggctgctggccgcgccattcccaggcgctgtaccagagcatgctggccggcgagatcgtcgaatacgaggagctggacaccatttccgacggcaccgccggcggcgtggagcccggcgccatcaccctgcccatcgcgcagcgggtgataggcaagaccgcgctggtggacgaggcggcgatcaaggcggcgatgcgcaagatcgccgaggccgagcgttggatcgtcgagggcgcggccggcgtcgcgatggcggggctgttccagctggccgaggcatatcgcggccggccggtggcggtggtgctgtgcggccgcaacatcaagctggagactttcctggaggcttgccatgaagctgcttga

SEQ ID NO: 31448 - protein, 321 aa, Chromobacterium violaceum ATCC 12472
MNDLYQYILDAHRALRPQVAVTPLSHSPALSALTGCEVYLKCEHLQHTGSFKFRGASNKIRLLDAASRRLGVATVSSGNHGLGVALAGKLAGVPVTVYASAAASEVKLDAIRAHGAKVVVIDAPMLEVELEAARLAERAGLPFVSPYNDVDVIAGQGTIGMELAEQHPGLVAVFASVGGGGMISGIGSALEMMSPSTEIVGCWPRHSQALYQSMLAGEIVEYEELDTISDGTAGGVEPGAITLPIAQRVIGKTALVDEAAIKAAMRKIAEAERWIVEGAAGVAMAGLFQLAEAYRGRPVAVVLCGRNIKLETFLEACHEAA

SEQ ID NO: 31449 - DNA, 1212 bp, Wolinella succinogenes DSM 1740
  CDS (1)..(1212): transl_table=11
atgattccattatctaaaatcgttgaggcgcatgagcgtgtcaaaaaagtgatccaaaaaaccaaactcgcctacgcgccaagactaagtgagttaagcggagccaatgtctatctcaaaaaagagaatctccaacacacgggcgcctacaagctaagaggcgcttataatagaatcgccaccctgagccaagaggagcgagccaagggagtgattgccgctagtgcggggaatcacgctcaaggagtggcctatagcgccaaacaatttgggattcgtgcggtgattgtgatgcctgaggcaactccattgcttaaagtcacgggtgtgaagcgcttgggggctgaggtgatcttagcgggcaacaactacgatgaggcctatgcccatgcactagagtgcgccaaggagcaggagctgtgctttatccacccttttgctgatgatgaggtgatcgcagggcaggggacggtggctttggagatgatcgaggagaagagcaacatccaaaccgtagtgcttcctatcgggggcggggggctcatctcgggcgtggcagcggcgtataagcagatgcttcccaatgtgagaatcattggtgtgacggccaagggagcgccagccatgcacgattctttccatgccaagaaaatcgtttctgtcaaaggcgtgaagacaatcgccgatggaatcgccgtcagagatgtcactcctagaaattttgagtacatcttagagggcgtggatgatgtggtgcaagtggatgatgaggagatcgctaacgcggtcttgtatctattagagaatcaaaagcttgttgttgaaggcgcaggagcggttggtgtggcggctttgttgcacgagaagttgcccgtgagcaagggtgagaatgtcgctatcgtgctaagcggcgggaatatcgatgtgacgatgctcagtgtcatcatcgagaagggtctcatcaaatcccagcgcaagatgaagtttagcgtcatcttggtggacaagcctggaagcctcaaagggctcacggatattctctcgcaagtgggggctaatattgtgcgaatcgactatgatcgcacctctacctctttggcttacggggatgccaatgtcactatcgcgctagagaccaaggggggagagcaccaggaggagattcgccaagagctctggaaatatcactatcgattcgtcgaaatcgattag

SEQ ID NO: 31450 - protein, 403 aa, Wolinella succinogenes DSM 1740
MIPLSKIVEAHERVKKVIQKTKLAYAPRLSELSGANVYLKKENLQHTGAYKLRGAYNRIATLSQEERAKGVIAASAGNHAQGVAYSAKQFGIRAVIVMPEATPLLKVTGVKRLGAEVILAGNNYDEAYAHALECAKEQELCFIHPFADDEVIAGQGTVALEMIEEKSNIQTVVLPIGGGGLISGVAAAYKQMLPNVRIIGVTAKGAPAMHDSFHAKKIVSVKGVKTIADGIAVRDVTPRNFEYILEGVDDVVQVDDEEIANAVLYLLENQKLVVEGAGAVGVAALLHEKLPVSKGENVAIVLSGGNIDVTMLSVIIEKGLIKSQRKMKFSVILVDKPGSLKGLTDILSQVGANIVRIDYDRTSTSLAYGDANVTIALETKGGEHQEEIRQELWKYHYRFVEID

SEQ ID NO: 31451 - DNA, 1188 bp, Gloeobacter violaceus PCC 7421
  CDS (1)..(1188): transl_table=11
atgtttgcttttatcagccatttgatttgcccgcgctgcgacagccgctttgatccgcgcaaagtccacaacctttgcactgcctgcgcttcgcctttgttggtcgagtacgacctcgaacaggtccgtgcctcggtggataaagagacgctcgcccgccgcggcgagtcgatgtggcgctaccgggaactgctgcccgtgatggacccggcccatatcgtgagcttcggcgaagggttcacaccactgctacccatcgacgcgctcacccgaacctggggattggagacagtctggatcaaagacgacgggctcaatcctaccggctccttcaaggcgcggggtgcctcctgcggcatctcgaaggctaaagaactcggtatccgggaggtggccctgcccacggcgggcaacgcgggcggtgcctgggcctgctacggggccgccgccggtttgcgcgtgcacgtggcgatgcccagggacgccccggccgtcaaccagctcgaatgccgtctgtacggcgcggatctgacattagtggacgggttgatttcggacgcgggaaaattgattgcccagggggtgcgcgagcatggctggttcgacgtctcgacgctcaaggagccttaccgcatcgagggcaagaagaccctgggtcttgaacttgccgagcagatgaactggcagttgcccgatgccatcctctacccggccgggggcggcgtcggaatcatcggcatctggcggggcttgcagcaattgaaagcgatgggctgggtgacgggaagtctgccccggctcattgtcgtgcaggcagaaggctgcgctccgctggtcaaggcgttcgaggagggccgcaccgagtccgaattctggccggatgcccggacttttgcctccggactgcgcgtacctaaggccctgggcgattttctggtgctgcaggcggtgcgcgagaccggcggcaccgccatcgccgtcagcgacgagcagtgcggcgagatgatgaaacttttggccggtcgcaccgggatatttgcagcaccggaaggagccgccaccctggctgccgccaaaatcctgcgcgagcgcggcgatctggcttcccgcgatcgggtggtgctcatcaacaccggctccgctctcaagtacccggaggcaatgagcgaggcactggcgatgcggtag

SEQ ID NO: 31452 - protein, 395 aa, Gloeobacter violaceus PCC 7421
MFAFISHLICPRCDSRFDPRKVHNLCTACASPLLVEYDLEQVRASVDKETLARRGESMWRYRELLPVMDPAHIVSFGEGFTPLLPIDALTRTWGLETVWIKDDGLNPTGSFKARGASCGISKAKELGIREVALPTAGNAGGAWACYGAAAGLRVHVAMPRDAPAVNQLECRLYGADLTLVDGLISDAGKLIAQGVREHGWFDVSTLKEPYRIEGKKTLGLELAEQMNWQLPDAILYPAGGGVGIIGIWRGLQQLKAMGWVTGSLPRLIVVQAEGCAPLVKAFEEGRTESEFWPDARTFASGLRVPKALGDFLVLQAVRETGGTAIAVSDEQCGEMMKLLAGRTGIFAAPEGAATLAAAKILRERGDLASRDRVVLINTGSALKYPEAMSEALAMR

SEQ ID NO: 31453 - DNA, 996 bp, Gloeobacter violaceus PCC 7421
  CDS (1)..(996): transl_table=11
atgtcctcatccgcccccactttgccggtgagtttcggcgatatccaggcggctgctgaccgtttgaggggagtcgctcaccgcacgccggttctgacttcgcgtacggtggacgacctgactggagcgcaggtcttcttcaagtgcgaaaatttccaacgcatgggggcgttcaagttccggggagcctacaatgccctctcgcaactggacaaagcgcaaaggcggcgcggggtgctcgcctactcctccggcaaccacgcccaggcgattgccctggcgggacaaatcctggagattccaacgacgatcgtgatgcccagcgacgctccggcggtcaagcggcgtgccaccgaaggttacggcggcgaggtgatcctttacgagcggtctgaaaccacccgcgaagccctcgccgaccaactggcgcgcgaacggggactggcggtgatcccgccctttgaccacccccaggtggtagcagggcagggaaccgccggattggaacttttcgagcaggtgggggcgctcgatgtgctcgtcgtctgctgcggcgggggcggcttgctctcaggatgcgccatcgccgcggcggccgtgagccccggttgtcaggtagtcggggtcgaacccgcgcaggcggacgatgcgatgcgctcgttttatacgggcgtcctgcacacagtccacaaccccgccacgatcgccgatggggcgcgcactccatcgctgggagccgtcacctttccactggtgcgccactacgttcatcagatggtgaccgtggaggaggaagcgatcgtgcgggcgatgctgtttttgtgggagcggctcaagatcgtcgtggagcccaccggtgcccttggggcggcagcccttttcgaaggccgggtgcaggcagcggacaggcgcgttggagtcattattagcggtggcaacgtcgatttgcagcttctccatgaattcatacgcgatatcgataaggggtacagttaa

SEQ ID NO: 31454 - protein, 331 aa, Gloeobacter violaceus PCC 7421
MSSSAPTLPVSFGDIQAAADRLRGVAHRTPVLTSRTVDDLTGAQVFFKCENFQRMGAFKFRGAYNALSQLDKAQRRRGVLAYSSGNHAQAIALAGQILEIPTTIVMPSDAPAVKRRATEGYGGEVILYERSETTREALADQLARERGLAVIPPFDHPQVVAGQGTAGLELFEQVGALDVLVVCCGGGGLLSGCAIAAAAVSPGCQVVGVEPAQADDAMRSFYTGVLHTVHNPATIADGARTPSLGAVTFPLVRHYVHQMVTVEEEAIVRAMLFLWERLKIVVEPTGALGAAALFEGRVQAADRRVGVIISGGNVDLQLLHEFIRDIDKGYS

SEQ ID NO: 31455 - DNA, 969 bp, Photorhabdus luminescens subsp. laumondii TTO1
  CDS (1)..(969): transl_table=11
atgaaaaatatttctgtttatgatgatgtcattgccgccgcccggcgaatagaagcttatgcttaccgtacgccagtcctgacttcccgcactgctaatgaaatgacaggagccaggttatttttcaaatgtgaaaattatcagcgaatgggagcctttaaatttcgtggtgcttttaatgcgttatcacaatttaatgatgaacagcgccgcaatggggttgtcacttattcatcgggtaatcatgctcaggcaatttcattggcggctcgtatactgaatatttcggcgacaatcatcatgccgttcgatgcgccagtggctaaggtcgccgcgaccgaaggttatggtggcaaaattgttttctatgatcgttatacggacgatcgtgaacaaattagccgtgaattatcagaaaagcagggattgaccttaattcctccctatgatcatccgcatattattgccggacagggaactgcggcaaaagagttgtttgaagaggtcggtgaactgaatgcgttgtttgtctgtctcggtggaggagggctgctttcaggcagtgcgcttgcagctcgccatttctctcctgaatgtaaaatttatggtgtagaaccggaaaccggtaatgacgctcagcaatcatttcgtcagggcaaaattattcacatcgatacgcctaaaactattgctgatggcgcacaaactcaacatcttgggcaatatactttcgatattattcgaaaaaatgttgatgatattttcactgtttctgatgaagaattggtggatgcaatgcgattttatgcagaaagaatgaagatgattgtcgaaccgaccggctgcttgagttttgccgctgcccgcaaaatgtgtgagtcattgcgaggccaaaaggtagggattattgtcagtggcggtaatgtggatatcgaacgttactgctcgttgctggcaaaacaaccttag

SEQ ID NO: 31456 - protein, 322 aa, Photorhabdus luminescens subsp. laumondii TTO1
MKNISVYDDVIAAARRIEAYAYRTPVLTSRTANEMTGARLFFKCENYQRMGAFKFRGAFNALSQFNDEQRRNGVVTYSSGNHAQAISLAARILNISATIIMPFDAPVAKVAATEGYGGKIVFYDRYTDDREQISRELSEKQGLTLIPPYDHPHIIAGQGTAAKELFEEVGELNALFVCLGGGGLLSGSALAARHFSPECKIYGVEPETGNDAQQSFRQGKIIHIDTPKTIADGAQTQHLGQYTFDIIRKNVDDIFTVSDEELVDAMRFYAERMKMIVEPTGCLSFAAARKMCESLRGQKVGIIVSGGNVDIERYCSLLAKQP

SEQ ID NO: 31457 - DNA, 1560 bp, Photorhabdus luminescens subsp. laumondii TTO1
  CDS (1)..(1560): transl_table=11
atggctgcatgtcttcccttaacttcctcaccaaatggtgcagagtatttgaaagcagcattaagcgcgcctgtttatgaagttgctcaggtgactcctttgcaggaaatggagaaaatttctgcccgcttgggaaatactattttggtaaagcgggaagatcggcaacctgttcacagtttcaagctccgtggtgcgtatgccatgattgcgagtttgactgaggaacaaaaaaaccgaggagtgattaccgcgtcagccggtaaccatgctcagggggttgcactttctgccaatcgtttgggaattaactctttgattgttatgccggttactactgcggatattaaagtcgatgcggtccggagtttcggtggtaaggctctgttgtatggtgctaattttgatgaggctaaagctaaagcgatagaaatggcacaacaggagggctatacctttgttcctccgtttgatcatcctgctgtaatcgcaggtcaggcaacactggcgatggaacttttgcaacaggatgtgcgtctggatcgaatctttgtacctgtcggtgggggggggttgattgctggcgttgctgtgttgattaagcaactgatgccagaaattaaaattattggggtggaagcggaagattcagcttgcctgaaagcagcaatggaggctggacatccggtagatttaccacgagttggtttgtttgctgaaggtgttgcggttaagcgtatcggtgatgaaacatttcgtttgtgtcagcaatatgtagatgatgttatcacggtagacagtgatgctatttgtgccgcggtaaaagatctgtttgaggatgtgcgtgcgattgctgagccatccggtgcattggcacttgctggattgaaaaagtatgttcagcagcatcagcttagaggtgagcgactggcacatattctttctggcgctaacgtaagcttccacgggttacgttatgtctctgagcgttgtgaattgggcgagcagcgggaagcattgctggcagtgactattcctgaacagaaagggagtttcctgagtttttgccagaaattgggcgatcgggtggtaacagagtttaattatcgttatacggatgcagatcctgatcaggcttgtcttttcgttggtgttcgcctgagtcgtggtgaggtagaacgacgggaaattatcgaggaattgcgtaccgcaggatatcaggttgccgatctctctgatgatgagatggcgaaattacatgttcgctatatgatcggcggtcgtccatctaagccattgaaagagcgcttatttagttttgaatttcctgaatcaccgggggctttgctaaagttcctccaaactttgggaactcactggaatattacgttattccattatcgcaattatggtacagattatggtcgggtgttagccgcatttgaattgtcaggagcggaagtgcgttttaagcgtcatcttgatgcattaggctatgcgtatcatgatgagacggatacccctgcgtttaaattctttttgatgtgccaaaacatttaa

SEQ ID NO: 31458 - protein, 519 aa, Photorhabdus luminescens subsp. laumondii TTO1
MAACLPLTSSPNGAEYLKAALSAPVYEVAQVTPLQEMEKISARLGNTILVKREDRQPVHSFKLRGAYAMIASLTEEQKNRGVITASAGNHAQGVALSANRLGINSLIVMPVTTADIKVDAVRSFGGKALLYGANFDEAKAKAIEMAQQEGYTFVPPFDHPAVIAGQATLAMELLQQDVRLDRIFVPVGGGGLIAGVAVLIKQLMPEIKIIGVEAEDSACLKAAMEAGHPVDLPRVGLFAEGVAVKRIGDETFRLCQQYVDDVITVDSDAICAAVKDLFEDVRAIAEPSGALALAGLKKYVQQHQLRGERLAHILSGANVSFHGLRYVSERCELGEQREALLAVTIPEQKGSFLSFCQKLGDRVVTEFNYRYTDADPDQACLFVGVRLSRGEVERREIIEELRTAGYQVADLSDDEMAKLHVRYMIGGRPSKPLKERLFSFEFPESPGALLKFLQTLGTHWNITLFHYRNYGTDYGRVLAAFELSGAEVRFKRHLDALGYAYHDETDTPAFKFFLMCQNI

SEQ ID NO: 31459 - DNA, 1530 bp, Vibrio vulnificus YJ016
  CDS (1)..(1530): transl_table=11
atgtcattaacccaacaaactggcgcagactacctgcgccagatactacgcgctccagtgtatgaagtggcaaccgtcacccctttgcaagagatgccgcgtttatcggcacgtattggtaacaatgtgcagatcaaacgtgaagaccgccagccggtgcattcgtttaagttacgtggcgcttacaatatggtggccaatctgtcgcaagcgcagaaggacgcgggggtgattgctgcctctgcgggcaaccatgcgcaaggcatggctctgtcaggaacgcgccttggcattgaaaccaccatcgtgatgcctcgcacgacgccggatatcaaagtcgacgcggtgcgcggttttggcggcaaagtcgtcttgcacggcagcaacttcgatgaagccaaagccgaagccgagcgtctttcgcaagagaaaggttacacttttgtcccacctttcgatcatcctttagtgattgctgggcaaggcaccatcggcatggaaatgctgcagcaaaacggccatctcgaccacattttcgtccctgttgggggcggtggtttagccgctggtgtggcggtgttggtgaaacagctgatgccagagatcaaagtcattgcggtggaacctgaagattctgcctgcctcaaggcggcattggatgcaggtgagcctgtggtgctggatcaagtcagtatgtttgctgatggtgtggcggtaaaacgcattggcgatgaaactttccgtctatgccagcactacattgacgatcacgtcaccgtctccagtgatgaaatctgcgcggcggtcaaagatattttcgaagacacccgtgcgattgctgagccttccggagcactggcgctggcggggctgaaaaagtatgccgagaaacacaaactcaaaggacacaacttgggtaccgtgctttcgggtgccaataccaacttccacggtttacgttatgtttccgagcgttgtgagctgggtgaaaaacgcgaaggcttgcttgcggtgaccattccagagcgcaaaggggcattttttgagttctgccatttgattggtggccgtgcggtgacggagttcaactaccgttacaacgacgactcgctggccaatatttttgtcggtgttcgtctgcaaaatggtcaagaggagttggatggtatcattcgcgacttacgcgaaggcggctacccagtggtggacctttctgaggatgaaatggccaagctgcacgtacgctacatgattggcggtaaaccctccaaaccactcaaagagcgcttatacagctttgagtttccagaatacccaggcgcactgcttaagttcctgagcacactgggcacacactggaacattagcctatttaactaccgcaaccatggggccgattatggccgcgtactgtgtggttttgagcttgatgagagtgatttatcccgcttttcggcgcatttgcgcgaacttggctaccaatgcaaagatgtcacggataacccatcctaccgtttctttctttcctaa

SEQ ID NO: 31460 - protein, 509 aa, Vibrio vulnificus YJ016
MSLTQQTGADYLRQILRAPVYEVATVTPLQEMPRLSARIGNNVQIKREDRQPVHSFKLRGAYNMVANLSQAQKDAGVIAASAGNHAQGMALSGTRLGIETTIVMPRTTPDIKVDAVRGFGGKVVLHGSNFDEAKAEAERLSQEKGYTFVPPFDHPLVIAGQGTIGMEMLQQNGHLDHIFVPVGGGGLAAGVAVLVKQLMPEIKVIAVEPEDSACLKAALDAGEPVVLDQVSMFADGVAVKRIGDETFRLCQHYIDDHVTVSSDEICAAVKDIFEDTRAIAEPSGALALAGLKKYAEKHKLKGHNLGTVLSGANTNFHGLRYVSERCELGEKREGLLAVTIPERKGAFFEFCHLIGGRAVTEFNYRYNDDSLANIFVGVRLQNGQEELDGIIRDLREGGYPVVDLSEDEMAKLHVRYMIGGKPSKPLKERLYSFEFPEYPGALLKFLSTLGTHWNISLFNYRNHGADYGRVLCGFELDESDLSRFSAHLRELGYQCKDVTDNPSYRFFLS

SEQ ID NO: 31461 - DNA, 1341 bp, Corynebacterium diphtheriae NCTC 13129
  CDS (1)..(1341): transl_table=11
gtgttaggaagcagtagtaccccgtggttaaaattgttgcccatgagtaaagaagcagaaaaccagcaggtcactttcggcgcaattcacgccgctgatattcaaatggcacagtctcgaatttctgcttctattgcaccgacgcccctgcagcattgcccacggttgtcgcaaatgacgggatgcgaagtctatctcaagcgcgaagaccttcaagacgttcggtcctataaaatccgtggtgctgtcaatgcgatctcgcaactgacagaggaacaacgagtggctgggatcgtggcggcgtcggcaggcaatcatgctcaaggtgtggctttcgcctgccgaaccatgggtatcaaaggtcgaatctacgttccggcagcaacgccaaagcaaaaacgcgaccgtatcatggtccatggtggcgacgctgtagaactcgtagtcaccggtgccaattttgatgaagcggcagctgctgcacgtgagtacgctcgcgttgaaggcgcaacgatggtggaaccattcgataaccgcgataccgttatcggccaaggaactgtagcagcagagatcttggcacaattaacaacgctgggtaaaacacttgataccgtcgtcgtgcccgttggtggtggtggattgctttccggcgttgtcagctatcttgctgatatggcgccacgcaccgcgatcgttggagtagaaccagaaggtgcggcatccatgcgcgccgctctggatgcgcacggtcctgtgaccttggataatgttgacccatttgtcgacggtgccgctgtgaaacgtatcggtgatcttaactatcacatcatcgaacacaaccaaggccgtattcaccccatcagcgttaatgaaggtgctgtatgtactgagatgcttgacttgtatcaaaacgagggcatcattacagaacctgcaggggcgctgtcagttactggattgaaagagctgtcacttggaagcagggacgtagttgtctgcatcatctctggtggtaacaacgatgtgctgcgttatggggaaatcatggagcgctccctcgttcatcgcggactcaagcactacttcctcgtcaatttcccacaggagccagggcagctacgtactttcctgaacgacatcttgggcccagatgacgacatcactttgtttgaatatctcaaacgcaacaaccgtgaaaccggaacagcgctcgtaggacttcaactcggagttgcttccgaacttgacggtttgctcgagcgaatgaatgcttcgcggattgattgccggcgactagaacctggaacgccagagtatagttacctcgttaatttgtaa

SEQ ID NO: 31462 - protein, 446 aa, Corynebacterium diphtheriae NCTC 13129
MLGSSSTPWLKLLPMSKEAENQQVTFGAIHAADIQMAQSRISASIAPTPLQHCPRLSQMTGCEVYLKREDLQDVRSYKIRGAVNAISQLTEEQRVAGIVAASAGNHAQGVAFACRTMGIKGRIYVPAATPKQKRDRIMVHGGDAVELVVTGANFDEAAAAAREYARVEGATMVEPFDNRDTVIGQGTVAAEILAQLTTLGKTLDTVVVPVGGGGLLSGVVSYLADMAPRTAIVGVEPEGAASMRAALDAHGPVTLDNVDPFVDGAAVKRIGDLNYHIIEHNQGRIHPISVNEGAVCTEMLDLYQNEGIITEPAGALSVTGLKELSLGSRDVVVCIISGGNNDVLRYGEIMERSLVHRGLKHYFLVNFPQEPGQLRTFLNDILGPDDDITLFEYLKRNNRETGTALVGLQLGVASELDGLLERMNASRIDCRRLEPGTPEYSYLVNL

SEQ ID NO: 31463 - DNA, 996 bp, Rhodopseudomonas palustris CGA009
  CDS (1)..(996): transl_table=11
atgccggccatgacccattccgctgtgctgcccgtttccgtcgccgatatcgatgcggctgccgaggtgctcgcgcccgtcgcggtgcggacgccgctgctgtcgtcgccggcgctcgatgccgccaccggcgcgcgcgttttccttaaaccggaagtcttgcagcgcaccggctcgttcaagtttcgcggcgcctacaacaaactggcgtcgctgtcgccggagctacggcgtgccggcgtggtcggattcagctccggcaatcacgcccagggcgtcgccgcggcggcgcagctgctcggcgtccacgccaccatcgtgatgccgtcggatgcgcctgcctcgaagcgcgaacgcaccgccggctttggcgccgaggtggtgctgtatgatcgcgaccgcgaggatcgcgaagcgatcgctcgcgacattgccgagcgcagcggcgcgacgttggtgcggccgttcgacgatccgatggtgatcgccgggcagggcacggtcggccgcgagatcgccgaggaccttgctgcgctggggctcgcgccggatctggtggtggcgccggcctccggcggcgggctgatcgccggcacagcgcttgccgtcaaggcgcggtttccccaggcgctggcgatgtcggctgagccggagggcttcgacgaccacgcccgctcgctggtggcgggacgccgcgagtccaatccggccggcggacgcacgatctgcgatgcgttgatgatgtcgatcccgggcgaggtcaccttcgcgatcaatcgcgtgctgctcgccggcggcgtggccgcgtccgatgccgaggtcggcactgcggtcggcttcgcattccgcgagctgaagctggtggtggagccgggcggagcggtggcgctcgcggcattgctcgccggcaagctcgacgtccgcggcaagaccgtcgcgatcgtgctgtcgggcggcaatgtcgatgctgacctgttcagccgcctgatcgcctga

SEQ ID NO: 31464 - protein, 331 aa, Rhodopseudomonas palustris CGA009
MPAMTHSAVLPVSVADIDAAAEVLAPVAVRTPLLSSPALDAATGARVFLKPEVLQRTGSFKFRGAYNKLASLSPELRRAGVVGFSSGNHAQGVAAAAQLLGVHATIVMPSDAPASKRERTAGFGAEVVLYDRDREDREAIARDIAERSGATLVRPFDDPMVIAGQGTVGREIAEDLAALGLAPDLVVAPASGGGLIAGTALAVKARFPQALAMSAEPEGFDDHARSLVAGRRESNPAGGRTICDALMMSIPGEVTFAINRVLLAGGVAASDAEVGTAVGFAFRELKLVVEPGGAVALAALLAGKLDVRGKTVAIVLSGGNVDADLFSRLIA

SEQ ID NO: 31465 - DNA, 1209 bp, Geobacter sulfurreducens PCA
  CDS (1)..(1209): transl_table=11
atgctcccctacacactgattcaggaagccgacgaccgactcaggaagcgggttcgtcgcaccgagctcatccactcccatcacttcagcgagaaactgggaatcccgatctatttcaagtgcgagaacctccagcgcaccggtgcgttcaagatccgaggcgccctgaacttcatgacgtcgcagccgcgggaggcactggcaaagggtgtcattaccgcttctgccggtaaccatgcccaaggagtcgcgttctcggccgacctgctgggagtgccgtccacggtgttcatgccggaaagcacgccgccgcagaaggtctttgccacccgtgactacggcgccgaggtggtactcaccggccgcaacttcgacgaggcatacgctgcagcggtccaggcgcaggaggaacggggcgccctcttcgtccacccctttgacgacccgctcgtgatggccgggcaaggcaccatcggcctggaagttctccaggagcttcccgatgtagccaatatcctcgtccccatcggcggcggcggtctcatcgcgggcatcgccacggccatcagagaaacccacccccacgtgcggatcatcggcgttgaaacagcggcggccccatccgcccactattcgctgcaaaaggggaagatcgtccaggtccccgtgacggtcacccttgccgacggcatcgcggtcaagaagccaggggtgaacacctttcccatcatcagggacttggtggacgaggtggtcttggtggaagaagaggagatcgcccttgccatcgtggcgctgctggagcgaaccaagctcttggtcgagggggccggggccgttccgttggccgcgcttctcaaccggcgggtgactgatctttcgggaaaaacggtctgcgtgctgtcgggcgggaatatcgacgtgaagaccatctcagtagtggtggaacggggtctggtggctgccgggcgctacctgaagctgaaggtggagctggacgatctccccggtgccctggcgcgacttgcgacggaaattgccgaggctaaagccaacatctccatcatcacccatgaccggcgctcgaaatcgctccccatcggcaagaccgaggtcctcatcgagctggagacccgggggttcgagcacattcaggaggttatctctcacctgcagggggtggggtatctggtggatgtgctgaaataa

SEQ ID NO: 31466 - protein, 402 aa, Geobacter sulfurreducens PCA
MLPYTLIQEADDRLRKRVRRTELIHSHHFSEKLGIPIYFKCENLQRTGAFKIRGALNFMTSQPREALAKGVITASAGNHAQGVAFSADLLGVPSTVFMPESTPPQKVFATRDYGAEVVLTGRNFDEAYAAAVQAQEERGALFVHPFDDPLVMAGQGTIGLEVLQELPDVANILVPIGGGGLIAGIATAIRETHPHVRIIGVETAAAPSAHYSLQKGKIVQVPVTVTLADGIAVKKPGVNTFPIIRDLVDEVVLVEEEEIALAIVALLERTKLLVEGAGAVPLAALLNRRVTDLSGKTVCVLSGGNIDVKTISVVVERGLVAAGRYLKLKVELDDLPGALARLATEIAEAKANISIITHDRRSKSLPIGKTEVLIELETRGFEHIQEVISHLQGVGYLVDVLK

SEQ ID NO: 31467 - DNA, 1212 bp, Bdellovibrio bacteriovorus HD100
  CDS (1)..(1212): transl_table=11
atgaaagtcagctttgcagacatccaaaaagcccgtgaacttctgaaagacatcatctgtccaaccgagatgagtcattccatcagcgccagcaacctgcttaaaagcgaagtgtacctgaagtttgaaaacactcagcgcacgggaagttttaaattccgcggggcctataacaaaatctccaatctgacagccgacgaaaaagcccgcggtgtggtcgccagctctgccggaaatcacgcgcaaggtgtcgccctgtcagcgaaactggccggagtcaaatccaccatcgtgatgccggagacagcctcgatcagcaaagcttccgcgacccgtgattacggcgccaacgtcgtgcttaaaggcgagatctacgacgaggctttcgaacatgcccagaaactggaaaaagaacacggctacaccttcgtgcacccttatcaggacccttatgtgatcgctggccagggaaccatcgggatcgagatcctggaaaaggttccagacctggatacggtgattgtgcccatcgggggtggcggtctgatcagtggtgtggcgttggcggtgaaggccatcaatccaaagatccgcgtgatcggtgtgcaaagcgaccgctctccgggaatggcgcatctttataacaaacagcctttgtcccagatcaaacgtgccgccacgattgctgacggcattgcgatcaaaaacccttcccaggtgatgctggacagtttcatttccaagtatgtcgatcaggtggtgacagtcagtgatgacgagatcgctgaagcgattgtgttcctgatggaaagagccaaaaccgtagctgaaggctctggcgcagcggcgatggcagctgcgatgtcccgcggactggatctgggtaaaaagacctgtgtgattatcagcggtggaaatatcgatctgaacatcgtttcaaagatcatcgaccgtggtcagattctgcgcggacgcctgtgtgagttgtccgtgattgtggatgaccttccggggaatttgagccgtttgactcaggcaattgcctctcaaaaagccaacatcctggaagtgcgtcacgaccgtgtgtcgaaggggctttcactgcgtgaaacccgcatcgacttcgttctagagactacgagcattgaacatgttgaacggattaagcgggctcttgaggaaactggagccaaggttatccaaagcacctaa

SEQ ID NO: 31468 - protein, 403 aa, Bdellovibrio bacteriovorus HD100
MKVSFADIQKARELLKDIICPTEMSHSISASNLLKSEVYLKFENTQRTGSFKFRGAYNKISNLTADEKARGVVASSAGNHAQGVALSAKLAGVKSTIVMPETASISKASATRDYGANVVLKGEIYDEAFEHAQKLEKEHGYTFVHPYQDPYVIAGQGTIGIEILEKVPDLDTVIVPIGGGGLISGVALAVKAINPKIRVIGVQSDRSPGMAHLYNKQPLSQIKRAATIADGIAIKNPSQVMLDSFISKYVDQVVTVSDDEIAEAIVFLMERAKTVAEGSGAAAMAAAMSRGLDLGKKTCVIISGGNIDLNIVSKIIDRGQILRGRLCELSVIVDDLPGNLSRLTQAIASQKANILEVRHDRVSKGLSLRETRIDFVLETTSIEHVERIKRALEETGAKVIQST

SEQ ID NO: 31469 - DNA, 1227 bp, Mycoplasma mycoides subsp. mycoides SC str. PG1
  CDS (1)..(1227): transl_table=4
atgtcgcatccattttcagtagatgaaattaaacaaattcatcaagaaatttctaaaataattcattatacacctttacattatgcagataaattatcagctttaactggtaataatatttatttaaaattagaaaatttacaaaaaacaggaagctttaaattaagaggagcaactaataaaattaataaactaactaatgaagaaaaagaacatggaattattgcagctagtgctggaaatcatgcacaaggtgtagcttatgcagctactaatttagggttaaaatcaacaattgttatgcctgaaaatgccccaatggcaaaaattcaagcaacagaaaaatatggtggaaaagttgttctaagtggaagattttttgatgatgctttagctaaagcaattgaattaaaagaaaaagaaaatctaactttaattcatgcttttgatgatattgaaattattaaaggtcaagctactattacatatgaaattgatcaacaaattaaaaacatcgattattgtttagtaccaattggtggtggtggattaatgagtggtattgctacttatttaaaacaagttaatccaaatattaaaatgattggtgttgaagctgctaatgttaattcctatcaacaagcaaaagctttgagtagaccagtgatggttgattctaaaccatcaatagcagatggaattgctgttaaaaaagttagtgatttaactttttcaatattaaatcaatatgttgatgatgtagttgttgtaagtgaagaagaaattgctgaagcaatgttatttttaatggaaaattgtaagtttgtaactgaaggttcaggagcagttactgctgctgctttaatgtttgataaattaaatattaaaaatcaaaataaaacaatagttggtttagttagtggtggaaatattgatattgcaatggttggtaatattattaataaagctttaattaaaactaatagaagattagtattatcagttaatataacatcagataataaagaaatactaaaaataattaatattattaattcttgtggagctaaaatttttaaaataaaaactaatagagatattatgtatttagaattaagtgaaattcatgcaacatttattattgatttatcaaatactgatcaacaacagcaaatcattgacaaaattattcaagctaattacaaaattacaagcattacagattaa

SEQ ID NO: 31470 - protein, 408 aa, Mycoplasma mycoides subsp. mycoides SC str. PG1
MSHPFSVDEIKQIHQEISKIIHYTPLHYADKLSALTGNNIYLKLENLQKTGSFKLRGATNKINKLTNEEKEHGIIAASAGNHAQGVAYAATNLGLKSTIVMPENAPMAKIQATEKYGGKVVLSGRFFDDALAKAIELKEKENLTLIHAFDDIEIIKGQATITYEIDQQIKNIDYCLVPIGGGGLMSGIATYLKQVNPNIKMIGVEAANVNSYQQAKALSRPVMVDSKPSIADGIAVKKVSDLTFSILNQYVDDVVVVSEEEIAEAMLFLMENCKFVTEGSGAVTAAALMFDKLNIKNQNKTIVGLVSGGNIDIAMVGNIINKALIKTNRRLVLSVNITSDNKEILKIINIINSCGAKIFKIKTNRDIMYLELSEIHATFIIDLSNTDQQQQIIDKIIQANYKITSITD

SEQ ID NO: 31471 - DNA, 1683 bp, Eremothecium gossypii
  CDS (1)..(1683)
atggttttcaatgcctgcggaagacgcagcggcaaccttgtgagttccgctttaagaacgggccggaggtactccggcacgttacataaactttacactcagttgaaaccacaagaactacttccagacaatacgccggattatgtgcggatgatactgcgctcctcagtttacgatgttatcgaggaatcgcctatgtctgaagcgaaactgctctcggccaagctggatacaaatgtgtgcctgaagcgtgaagacctgctgcctgtgttctcattcaaactacgaggcgcgtataatatgatatccaacctagacgaataccagaagagcgcaggtgtcatcgcgtgctctgcgggaaaccacgcgcagggtgttgcgttctccgcacgggaattgggtatacgagcaatgattgtgatgcccacttcgacgccgtctatcaaatacaacagtgtcgcagcgatgggggcggaggtagtattgtacgggaaagacttcgatgaggcgaaagccgagtgtgcccggcttgcgcagcttcacaagctcaccgatatacccccctttgaccacccatatgtcattgctggccagggaaccatcgcaacggaaattctccggcaagtgcacaatgccagtcagattggcgcggtgttctgcggcgtgggcggagggggtctgatagccggcattgggtcgtacctgaaacggattgcgccacatatcaaaatcataggtgtcgagacgcatgacgcccccactctgcacaccgctctgaagcagggacgccgcacaatgctgcctgcggtcggctgtttcgcagatggcacgtccgtgcgaatgatgggcgaggaaacgttccgtgtagcacgcgatgttgtcgatgaggtggtgctggtcaacacggacgagctttgcgccgcaatcaaggatatattcgaggacacaagagcgattgttgagccttccggcgcgctgggggttgcaggtctaaagaagtacatagccagccatcaagacgccgagaacagtcgccacacctatgtccccgtgctatcgggcgcgaacatgaatttcgaccgcttacgcttcgtcagcgagcgcgcggtgctaggcgaaggcaaggaggtgttcctggccgtcactatcccggacgtgcctggctcctttaagcgcatgaaccagatcatccacccccgcgccgtaacagagttctcctaccgctacaatgagcatgctcgccgcaaccaagacggcaccgcccgggcctgtatctacacctcttttagcgtggccgaccctgccgccgaggtgcccgacgttctcactcgtcttcgcgcgctcggcttcgatgcccgcgatatttccgcgaacgagctcgccaagtcccacgcgcgctacctcgtcggcggtgccgcccgtgtcccgaacgagcggctctttgccttcgagttccccgagcggcctggcgcgctgaccaacttcctcgctggtctcgactcctcctggaacatcacgctgttccattaccgcaaccacggcgcggacgtgggccgcgtacttgtaggcatcgcagtcccttctgacgaatactcggccttcgatgcgttcctgagcgggctcggctacgcctaccaagaagaaaccggtaaccctgtctatcgcgagtttctgctctgctaa

SEQ ID NO: 31472 - protein, 560 aa, Eremothecium gossypii
MVFNACGRRSGNLVSSALRTGRRYSGTLHKLYTQLKPQELLPDNTPDYVRMILRSSVYDVIEESPMSEAKLLSAKLDTNVCLKREDLLPVFSFKLRGAYNMISNLDEYQKSAGVIACSAGNHAQGVAFSARELGIRAMIVMPTSTPSIKYNSVAAMGAEVVLYGKDFDEAKAECARLAQLHKLTDIPPFDHPYVIAGQGTIATEILRQVHNASQIGAVFCGVGGGGLIAGIGSYLKRIAPHIKIIGVETHDAPTLHTALKQGRRTMLPAVGCFADGTSVRMMGEETFRVARDVVDEVVLVNTDELCAAIKDIFEDTRAIVEPSGALGVAGLKKYIASHQDAENSRHTYVPVLSGANMNFDRLRFVSERAVLGEGKEVFLAVTIPDVPGSFKRMNQIIHPRAVTEFSYRYNEHARRNQDGTARACIYTSFSVADPAAEVPDVLTRLRALGFDARDISANELAKSHARYLVGGAARVPNERLFAFEFPERPGALTNFLAGLDSSWNITLFHYRNHGADVGRVLVGIAVPSDEYSAFDAFLSGLGYAYQEETGNPVYREFLLC

SEQ ID NO: 31473 - DNA, 990 bp, Yersinia pestis biovar Medievalis str. 91001
  CDS (1)..(990): transl_table=11
ttgaaaataaaatttaaaggaatcgagatgaatacgttgtttgatgccatcagagaggcccaccagatattacgcccacaagtgagagtcacgccgttggagcatagcccactgctatctcaacacagcggttgtgagatctatcttaaatgtgagcacctgcagcacaccggttcttttaaatttcgtggggccagtaacaagttacgtttactcaatgaggcacaacgccagcaaggtgtgatcaccgcctccaccggtaaccatgggcaaggtgtggcgctggccgcaaaactggcggggattaaatccactatttacgccccagaacaggcggcagccatcaagctggatgtgatccgtgcactgggggggcaaattgaattagtctccggagatgccttaaatgctgaactggccgccggtatcgccgctgagcaacaaggtaaagtgtatatctcaccgtataacgacccgcaggtcattgccgggcaaggcacctgtggcatggagatggtcgaacagcagcccgatcttgatgcggtgtttgttgccgttggtggtggtggcctgatttcaggtattgcgaccgtattgaaaacattatcggataaaacgcaggtgattggttgctggccagccaatgccaccagcctgtatacctgtctggagaaaggacagattcaggaggtggcagagcaagaaacgctgtctgacggaaccgccggtggtatcgaaccgggagcgatcacctttgcactgtgccaacagttaatcgatcagaaggtgctggtgagtgagcaagaaatcaaagaggccatgggtttgattgcccgtactgaccgctggatgattgaaggtgccgccggtgtggcactggctgcggcactgaaattggctccgcaatggcaaggtaagaaagtggcggtggtgttgtgcggtaaaaatatcgtgctggagaaatatctgggagctgtcagcggatgctaa

SEQ ID NO: 31474 - protein, 329 aa, Yersinia pestis biovar Medievalis str. 91001
MKIKFKGIEMNTLFDAIREAHQILRPQVRVTPLEHSPLLSQHSGCEIYLKCEHLQHTGSFKFRGASNKLRLLNEAQRQQGVITASTGNHGQGVALAAKLAGIKSTIYAPEQAAAIKLDVIRALGGQIELVSGDALNAELAAGIAAEQQGKVYISPYNDPQVIAGQGTCGMEMVEQQPDLDAVFVAVGGGGLISGIATVLKTLSDKTQVIGCWPANATSLYTCLEKGQIQEVAEQETLSDGTAGGIEPGAITFALCQQLIDQKVLVSEQEIKEAMGLIARTDRWMIEGAAGVALAAALKLAPQWQGKKVAVVLCGKNIVLEKYLGAVSGC

SEQ ID NO: 31475 - DNA, 1380 bp, Anopheles gambiae str. PEST
  CDS (1)..(1380)
atggtctctgcggcggattatctacgcaaggtgctgctctcccccgtctacgaggcggcgcgggtcacccccctgcaaaccctgaagaaactctccgagcggctcggcaatcacgtcagcctgaagcgggaggacctgcaaccggtccactccttcaagctgcgcggcgcctaccacaagatcgccaccctgaccgaggagcagaaggagcgcggcgtcatcgccgcctccgccggcaaccacgcccagggggtcgccctgtcggccgccaagctcggcatcaaggcgatcatcgtgatgcccaagaccacgccggacatcaagatcgacgcagtgcgccgtcagggcggcaacgtcatgctgtttggcaacagcttcgacgaggcctacggcgagagccgccgtctcgctgaattggaaggctacaccctgatcccgccgtttgacgacgtcgaggtgatcgccggccagggcaccatcggcaaggagctgctggagcaggatacccacctcacccacgtcttcgtgccggtggggggcggcgggttggccgccggggtggcggtctatatcaagcagctgctgccggatgtgaaggtgatcggggtggaggcggagggttctgcctgcctcaaggccgcgctggcggccggcgagccggtcaatctggagcgggtctcgctgtttgcggacggggtggcggtcaagcgcatcggcgaggagaccttccgcctgtgcaaccagtatctggacgaggtggtgaccgtctccaacgaccagatctgcgccgcactgaaagacatcttcgacgactgccgcgccattgccgagccgtcgggcgccctgtccctggcgggtctcaaggcctacagcgagcgggagcaggccaaggggggccggatggcggccattttgtccggcgccaatgtcaacttccacagcctgcgctatgtgtcggagcgctgcgagatcggcgagaagcgcgagggcatgctggcggtgaccatccccgagcgcaagggggccttcctcgacttctgccgtcagctcgggccgcgcatggtgaccgagttcaactaccgttatgcagatgccgagcaggcgtcgctgttcgtctcggtgcgcctcaccggcggtgacgaggagctgggccagatcatcgatcagctcggtggcaacggctatccggtggtcaacatgaccgagagcgagctggccaagaaccacaccctgggctgtcgctggaacatcagcctgttccactaccgcaaccacggtgccgactatggccgggtgctctgtgccttcgagctgccggacgaggacgtggcggcttttcacgactacctgcgcgagattggctacggctggaaagagtag

SEQ ID NO: 31476 - protein, 459 aa, Anopheles gambiae str. PEST
MVSAADYLRKVLLSPVYEAARVTPLQTLKKLSERLGNHVSLKREDLQPVHSFKLRGAYHKIATLTEEQKERGVIAASAGNHAQGVALSAAKLGIKAIIVMPKTTPDIKIDAVRRQGGNVMLFGNSFDEAYGESRRLAELEGYTLIPPFDDVEVIAGQGTIGKELLEQDTHLTHVFVPVGGGGLAAGVAVYIKQLLPDVKVIGVEAEGSACLKAALAAGEPVNLERVSLFADGVAVKRIGEETFRLCNQYLDEVVTVSNDQICAALKDIFDDCRAIAEPSGALSLAGLKAYSEREQAKGGRMAAILSGANVNFHSLRYVSERCEIGEKREGMLAVTIPERKGAFLDFCRQLGPRMVTEFNYRYADAEQASLFVSVRLTGGDEELGQIIDQLGGNGYPVVNMTESELAKNHTLGCRWNISLFHYRNHGADYGRVLCAFELPDEDVAAFHDYLREIGYGWKE

SEQ ID NO: 31477 - DNA, 1431 bp, Anopheles gambiae str. PEST
  CDS (1)..(1431)
atgtctcccacgatgcaagtgtcatccgtaacgacgcaaatggcttccgcgaagctgacagctcgcccgtcggcggcagagcggccgacagcagcaggccaaaatgggcacgaggccggagtgaatggtgcacccgccggcgccccaacagccgcaacgaccgagccggaaatcgtcgatccgttttgcaatgcggacaatccgcagataatcaccttccaggacgtaacgtccgcggcgttcaaaatcagaaaaggtgtcgagctgacgccgtgcgtgaaatcacacttctccgacctgatcgacatggacatctacctgaagaaggaatttctgcagtttactggcagcttcaaggagcggggagcgcgctacgcgttgctaatgctgtcggacgagcagaaaaaaacgggcgtcatctcggcctccctcgggaatcatgcgcagggtctgtcctatcacggctggaagctgggcatcccggtgacggtcgtgatgccgctgaaggcttcgctgatgaaaatccagaaatgccgtaactatcacgctaatgtcgtcgtacagggagcggacatgggcgaggctaaaaggattgcactgaaaatggcacacgaccggggactcacgtacattaacgggtacgaccatccgcacatcatgtccggtcagggcacgatcgggctggagatcgtggagcaggtcagcgacatcgacgccgtcgtggtgccggtcggtggcggcggactgattgccggtgttgcaactgccatcaaaaatctcagcccaaataccaaaatcatcggtgtcgagtcggagaagtgtcccagcttcacgcgagcgctcgagaacaagagcccagtgtttgtcgcgaaccaggaaacgctggcggacgggttggcagtgccgcaggtagggtacaacgcgtacgccacgaccgtgccgctgctggacaaaatgatcgtcgtgaaggaggagtggattgcgctggcgattctgcgactggtcgagctggaaaagtgcgtggtggagggagcgggtgccgccggcctggcagccattttggccggccatctggatgaattcattggaaaacgagtggtgctgctaatttgcggaggcaatatcgatacgaccatgttcggcaaatgtctcgagcgtggcatggctgccgagggccgtttgcagagattcaccgtcaccgtcagcgatggaccgggcggtgtagctaagctgtgcaatctgctcgccagcctgggcgtttccatcaaggacataatgcacgaacgtgccttcattcgtgatattcaccatgtagaggtgaaagtgatttgtgaaacacgtgactgggaacattcaaaggaaatgcgcagggtgctacaggaaacgtatagcaaagttcacttctatgacatgccaatggcgatcacctag

SEQ ID NO: 31478 - protein, 476 aa, Anopheles gambiae str. PEST
MSPTMQVSSVTTQMASAKLTARPSAAERPTAAGQNGHEAGVNGAPAGAPTAATTEPEIVDPFCNADNPQIITFQDVTSAAFKIRKGVELTPCVKSHFSDLIDMDIYLKKEFLQFTGSFKERGARYALLMLSDEQKKTGVISASLGNHAQGLSYHGWKLGIPVTVVMPLKASLMKIQKCRNYHANVVVQGADMGEAKRIALKMAHDRGLTYINGYDHPHIMSGQGTIGLEIVEQVSDIDAVVVPVGGGGLIAGVATAIKNLSPNTKIIGVESEKCPSFTRALENKSPVFVANQETLADGLAVPQVGYNAYATTVPLLDKMIVVKEEWIALAILRLVELEKCVVEGAGAAGLAAILAGHLDEFIGKRVVLLICGGNIDTTMFGKCLERGMAAEGRLQRFTVTVSDGPGGVAKLCNLLASLGVSIKDIMHERAFIRDIHHVEVKVICETRDWEHSKEMRRVLQETYSKVHFYDMPMAIT

SEQ ID NO: 31479 - DNA, 1167 bp, Neurospora crassa
  CDS (1)..(1167)
atggccgaccccagcaccacccctccccttacccgtgcctccgtcctcgccgctcactccctcataaagccctacattcacgagacgcccgtgcttacgaataccactttcgaccaactcgcttccacccctcgtactcccgaagagctgcaaggaacggaatgggaggctaccgaaagaccggcgaacccaaagattcggttctggttcaagtgcgagaatttccagcggattggcgcgttcaaggctagaggagcgtttcatgctgtggagaggttgaagcaaactgaggggttagaggggttgaagaagggcggagtagtgacgcatagttctggtaaccacgcccaagccctttccctcgctgcccgcgagaacggcatcccggcgcacatcgttatgcctaccatctcgcctccgcccaagatcgctgccaccaagggttacggcgccaacataacctttagcggaagcacgagtaccgagcgtgaagcagttacaagggaggtgattgagaagacgggtgcgaggctggtgccgccttatgatcacccagacatcatcctcggccaaggcaccgccgccctagagctccaacgccaagtcgccgcctctctctccacctccggcaccaccaccaccaccaaccgtcgtcgtcttaacgcgataataaccccctgcggcggcggtggtctcctctccggcaccgctctcgcctgttccgacctctccccttccgatccctccacacccggtccaatcctggtcttcggcgccgaaccctccttctcgggcgcggacgacggtcgtcggggttactactcgggcactcgcatcgagagcgtcaaatccttgacgattgccgatgggctgcggactcctctgggggcgtatccgtggagtatcatctatgagcggaagctggtggcgggcatgtacagtgtgggcgaggaagagatcaagaaggcgctgaggctggtttatgagaggatgaaggttgttgttgagccgagcgcggtagtggggttggcggtagcgttatttaatgaggagtttaggagtatggtggagagggaagggggggaggaagggtgggatttgggggtggtgtttagcggagggaatgttgagctggcggcgttggggaggttgtttggtgaggaatag

SEQ ID NO: 31480 - protein, 388 aa, Neurospora crassa
MADPSTTPPLTRASVLAAHSLIKPYIHETPVLTNTTFDQLASTPRTPEELQGTEWEATERPANPKIRFWFKCENFQRIGAFKARGAFHAVERLKQTEGLEGLKKGGVVTHSSGNHAQALSLAARENGIPAHIVMPTISPPPKIAATKGYGANITFSGSTSTEREAVTREVIEKTGARLVPPYDHPDIILGQGTAALELQRQVAASLSTSGTTTTTNRRRLNAIITPCGGGGLLSGTALACSDLSPSDPSTPGPILVFGAEPSFSGADDGRRGYYSGTRIESVKSLTIADGLRTPLGAYPWSIIYERKLVAGMYSVGEEEIKKALRLVYERMKVVVEPSAVVGLAVALFNEEFRSMVEREGGEEGWDLGVVFSGGNVELAALGRLFGEE

SEQ ID NO: 31481 - DNA, 1773 bp, Neurospora crassa
  CDS (1)..(1773)
atggcttcgacacttagtgcacagccgttgctcgtcaacggtgcttccctgcaggtagtcaacggtctcaacagcgagaggccagcgagcccgtcttcggttggcaacctcgcactgaccgagtacagcgcgatgccatcgccgccatcggaggatgccacggccaacaagatgaagcgcattgttcctgatgagttcctgcttcctaacggtcatccagattacttgcgcctcatcattacctcttacccacgtgtccgcgaagtttgcagtgaggtgcccctaacccgggctgtcaacctgagcaaccgcctcgagtgcaatgtcctactcaagcgtgaagatgaacagcccgtcttcagctttaaacttcgtggcgcctacaacaagatggcccatctcgaccccaaggagtcctggaagggggtagtctgctgcagtgccggcaaccacgcccaaggagttgcatactctgcccgtaagctgaagatccccgccactgtcatcatgcccaagggcactcccagcatcaagcacctcaacgtttcccgtatgggtagccacgtcgttctccatggtgccgacttcgacgaagcaaaggaggagtgtgctcgaagggccaagctggacggcctcatcaacatcccgcctttcgatgatccgtacgtaattgccggccaaggaaccatcggcatggaaattttgtcacagaccaatctgcagaagctacaggccatcttctgtgctgtcggcggtggtggcttgattgctggtgttggggtctacgtgaagcgtattgcccctcatgttaagatcatcggcgtcgagacgtacgatgcagacgccatgacccagtcgctcgctaagggcgaacgtgtccttcttcaagatgtgggtttgtttgccgatggtgccgccgtcaagacagttggtgaggagaccttccgtatctgtcaagaagtcgtcgacgagatggtccaagtcaccacggacgaggcttgtgccgccatcagagacatgttcgaggacacgcgctctatcatcgagcctgctggcgcgctggccgttgccggactcaagaagtgggttgctgccaacccatccgctgaccccacccggtccgtcgtcgccatcacctcaggcgcaaatatggactttgatcgcctgggctttgtctcagcgcgtgccaaatatggcgaaggcaaagaggccctcctctctgttaccatccccgagcgccccggcgcttttgccgaattagtcaacgccatcatgccacatgccatcaccgagttcagctaccgatacgctaccgaatccaaggcaaacgtcatggttggcatttctctggccgattccggcagccgccgggcagagcaactgcagaccatcatcggccgtatcaaacaatcaggtgacatggacgtaacagatctgtccgccgacgagcttgccaagagccatcttcgatacatggttggcggccgctcaaatgtccccaaggaaaggctttacacattccgctttcccgagcggccaggcgccctcgagcgttttttgcgactactgagaccaaagtacaacattagcctcttccaatatcgaaactacgggggagatattggccaggtattgacgggtattcagtgccctgacgaggaagttggcgaactacaaagcttttttaaggagatcggatacccatgggaagactcggacccgcactacaaatatgtgggtctcccctcctcgaacttttgtgagaggagatag

SEQ ID NO: 31482 - protein, 590 aa, Neurospora crassa
MASTLSAQPLLVNGASLQVVNGLNSERPASPSSVGNLALTEYSAMPSPPSEDATANKMKRIVPDEFLLPNGHPDYLRLIITSYPRVREVCSEVPLTRAVNLSNRLECNVLLKREDEQPVFSFKLRGAYNKMAHLDPKESWKGVVCCSAGNHAQGVAYSARKLKIPATVIMPKGTPSIKHLNVSRMGSHVVLHGADFDEAKEECARRAKLDGLINIPPFDDPYVIAGQGTIGMEILSQTNLQKLQAIFCAVGGGGLIAGVGVYVKRIAPHVKIIGVETYDADAMTQSLAKGERVLLQDVGLFADGAAVKTVGEETFRICQEVVDEMVQVTTDEACAAIRDMFEDTRSIIEPAGALAVAGLKKWVAANPSADPTRSVVAITSGANMDFDRLGFVSARAKYGEGKEALLSVTIPERPGAFAELVNAIMPHAITEFSYRYATESKANVMVGISLADSGSRRAEQLQTIIGRIKQSGDMDVTDLSADELAKSHLRYMVGGRSNVPKERLYTFRFPERPGALERFLRLLRPKYNISLFQYRNYGGDIGQVLTGIQCPDEEVGELQSFFKEIGYPWEDSDPHYKYVGLPSSNFCERR

SEQ ID NO: 31483 - DNA, 1467 bp, Rattus norvegicus
  CDS (1)..(1467)
atgccctcaggtaggattctccggtctccagtggtcgaacttcttggtcagagatggggagtctttgaacttggccaaggagccacgctgcgttgtgtgtcggaagaactggatccccaacagcttaacctgccccgtccttgttcccacctggtggctcagaagtcattcaaggaagagcccctcctctccctcatcacggccagcaactgtgtgactttagcaatggacttggtttctccgaacacgttccggatcattggaatgtttttgttcaggaccccagaatcaagagctgtccctttaacaaggaggaggggccagggcctgatagcggaagctgatctggtagcctgtcgtcagcgttctgttggaatggagggagcctcggcagagtgtgtcagggcagagcctttccacagggtcacacccctgctggagagctgggcgctgtctcaggtggcaggcatgcctgtcttcctcaaatatgagaacgtgcagatagctggctcctttaagatccggggcatcggacatttctgtcagcaggtgaaggaggatggccaagaggggatgcagacatctggtgtgctcctcaggccccacagtagcctgggtgacatacttatgtctgaagcagtcacgggccaggaggttgtgttctccgattggcttgacataaatcagcaagggggcaacgcaggcattgcggccgcatactccgctcagaagctgggcatccccgtcaccatcgtgctcccagagagcacctccaagcaggtggtgaggcggctggagggagagggggccgaggtccagctgactgggaaggtctgggatgaagccaatgtaagggcacaagaactggccaccagggacggctgggtgaacgtctccccgtttgaccatcccctgatatgggaaggcaatgccagcctagtgcgggagctcaaggagtccctgaggacgcctccaggtgccgtggtgctggccgtggggggtggagggctcctggccggtgtggttgctggcttactggaggtaggctggcagcatgtgcccatcgttgccatggagacccggggggcacacagtttcaacgcggctttgctggcgggcaggctggtcactctgccagacatcaccagcgtagccaggagcctgggagccaagactgtggctgcacggaccttggagtgtgcaaaggagtgtgaagtcctctctgaggtggtagaagaccgggaggctgtcagagctgtgcagaggttcctggacgatgagcgcatgctggtggagcctgcctgcggtgctgccctggctgctgtctactcaggcatcctggggaggctccagactgagggccgcctgagccctgccctggattccgtcgtggtcatcgtgtgtggtggcaacaacatcagtagccaacagcttcaggagctgaaaacacagctgaactgcagctga

SEQ ID NO: 31484 - protein, 488 aa, Rattus norvegicus
MPSGRILRSPVVELLGQRWGVFELGQGATLRCVSEELDPQQLNLPRPCSHLVAQKSFKEEPLLSLITASNCVTLAMDLVSPNTFRIIGMFLFRTPESRAVPLTRRRGQGLIAEADLVACRQRSVGMEGASAECVRAEPFHRVTPLLESWALSQVAGMPVFLKYENVQIAGSFKIRGIGHFCQQVKEDGQEGMQTSGVLLRPHSSLGDILMSEAVTGQEVVFSDWLDINQQGGNAGIAAAYSAQKLGIPVTIVLPESTSKQVVRRLEGEGAEVQLTGKVWDEANVRAQELATRDGWVNVSPFDHPLIWEGNASLVRELKESLRTPPGAVVLAVGGGGLLAGVVAGLLEVGWQHVPIVAMETRGAHSFNAALLAGRLVTLPDITSVARSLGAKTVAARTLECAKECEVLSEVVEDREAVRAVQRFLDDERMLVEPACGAALAAVYSGILGRLQTEGRLSPALDSVVVIVCGGNNISSQQLQELKTQLNCS

SEQ ID NO: 31485 - DNA, 1212 bp, Magnaporthe grisea 70-15
  CDS (1)..(1212)
atggcagacccggtaacttcgcctcccctcgagagagcctcgatattcgccgcgcacgagctcataaaaccctacgtgcaccggacccccgtgctcaccaatgcgaccctcacggcactggcctcgaccccgcggaccgccgaggacctgcgcggcaccaggtgggccgaccgggccgaccgccccgctcggccggtgctgcggctgtggttcaagtgcgagaactttcagcgcatcggcgccttcaagccgaggggggcgttccacgccgtcgagcgcctcaagcttatccccgggtggctcgagggtcaggggaggactaacggcgtcgtgactgctagctctggcaaccatgctcaggcactagcccttgcggcgcgcacagctggaataccagcacacatcgtgatcccaagcatcgcgccggcaccaaagctggcggcgacgaaggcgctaggggcaaccatctaccgcagcggaagcactggtgctgagcgcgaagcggtggcggccaaggttgttgcagacactggaggccgctatattcctccttatgatcacccggacatcattctgggccagggaacgctgggacttgagatgcaggagcaggttgaggcgctcatggccggcggggatgcagctgcgacaggcggtgatttcactcggcgaggtcaaacctcaggaacgcagggccaagctggaggtcagaagaagggcctcaatgccataatcgcgccatgcggcggcggtggtatgctctcgggtgtagcattatcctgcgagggaaccggcatccgcgtctttggcgccgagcccgagttccagggggcggacgagtgcaagcggtcctttgaggcgggcaagcgcatcgacacggtcaagtcgctaacgatcgccgacggactacggactgcggttggtaaatacccgtggtccatcatctacgagcgccgcctagtgtcgcaaatgttcaacgtgaccgaggacgagatcaaggacgccctgcggctgatcttggagcgcttcaagctagtcgtcgagcctagtgctgctgtgccggtggctgtcgcactattcaacgaggatttcagggccatggtcgagaccgaggccggcgagaacgggtgggatctgggcatcgttctcagtggtggcaacgttagtttggagatgcttgggaagctgttccccgagggcttgcctgcctag

SEQ ID NO: 31486 - protein, 403 aa, Magnaporthe grisea 70-15
MADPVTSPPLERASIFAAHELIKPYVHRTPVLTNATLTALASTPRTAEDLRGTRWADRADRPARPVLRLWFKCENFQRIGAFKPRGAFHAVERLKLIPGWLEGQGRTNGVVTASSGNHAQALALAARTAGIPAHIVIPSIAPAPKLAATKALGATIYRSGSTGAEREAVAAKVVADTGGRYIPPYDHPDIILGQGTLGLEMQEQVEALMAGGDAAATGGDFTRRGQTSGTQGQAGGQKKGLNAIIAPCGGGGMLSGVALSCEGTGIRVFGAEPEFQGADECKRSFEAGKRIDTVKSLTIADGLRTAVGKYPWSIIYERRLVSQMFNVTEDEIKDALRLILERFKLVVEPSAAVPVAVALFNEDFRAMVETEAGENGWDLGIVLSGGNVSLEMLGKLFPEGLPA

SEQ ID NO: 31487 - DNA, 1857 bp, Magnaporthe grisea 70-15
  CDS (1)..(1857)
atggcggcgccctcagatctagaggtcacggcgacaaaaatcaacggttcttcctgccaggagaccgtcaccaatggtgacggtatcaacggccccaatggctgcagcgtggcgcccgcaacgcctgcgacgcccaccactccagttatgactgtaacgcgcccctcgcggacgcccagcttgaccggtctttcactcacagagtacagcgccaacccatcaccaccggcggagagcaaacgtcgaaaggcaaagaaggtgatacctgacgactacatactgccaagtggacaccctgactatctccgcctgatcttgacttccaaggtctacgaggtatgcaaggagacgtcactcacccatgccgtcaacctcagcaacaggctcgagtgcaaagtccttctgaagagggaggatgagcagcccgtcttcagcttcaagctgcgcggtgcatacaacaagatggctcacctcgaccgcgctcaatcatggcggggtgtcgtctgctgctcagctggcaaccacgctcagggggtagccttttctgcccgcaagctcaagatccccgccaccatcgtcatgcccgagggcacgccaagcatcaagcaccttgccgtggctcgtatgggtggccatgtcgtgctgcacgggcccgatttcgacgcggccaaggaggagtgcgcccggcgcgagaagcacgacgggcttatcaacatcccgccctttgacgatccctatgtcatcgccggccagggcaccattggcatggagctgctccgccagaccaacctgcagaagctagaggccatcttctgctgtgtgggcggaggcggtctcatcgccggcataggtgtctacgtaaaacggattgcaccgcacatcaagatcatcggcgtcgagacccatgacgccaacgctatgactcagtcgttggccaagggtgagcgtgtactcctcaaggacgtcggcctctttgcagatggtgccgccgtcaggacagtaggcgaagagaatttccgcatctgccaggaggtcatcgatgagatggtccaggtgactacggacgaggcgtgcgctgccatcaaggacatattcgaggataccaggtccgtcgtcgaacccgccggggctctggctctggccggactcaagaagtgggtcgcggccaacccgtccaccgactcgagccgttcccttgtcgccataactagcggtgcaaacatgaactttgaccggctgcgcttcgtagcagagcgtgccaacgttggtgagggccgcgaggcgctactggcggcccgcattcccgagaagccgggttctttcgccaagctcatcgaagccatcatgcccaacaacgtcaccgagttcacttaccggtacactgatggcgaggtggccaacataatgctgggactctcgctgacagcgccagtagcgcagcgtgcccaccagctgcagctactcatgggccgcatcgcagaggccggtatggaggtgacggacctgtcgggtgacgaactggccaaaagccacgtgcggtatcttgttggaggacgggccaaagtgcccaacgaaaggctgtacatgtttgagttcccggagcggcccggcgcgctggagaagttcctggcaacgctgcggccgcgttacaacatcagcctgttccagtaccgtaactacggcagcgacgtcggcaagatcttggcgggcatccagtgcccagacggagaaatgccggagctggtcaaattcctcaaggagattggatacccgtggtttgactgcacgcaatcggaggtggccaagacctttttgggtggtccaggggtcaacgaagagggggcagtccctctttag

SEQ ID NO: 31488 - protein, 618 aa, Magnaporthe grisea 70-15
MAAPSDLEVTATKINGSSCQETVTNGDGINGPNGCSVAPATPATPTTPVMTVTRPSRTPSLTGLSLTEYSANPSPPAESKRRKAKKVIPDDYILPSGHPDYLRLILTSKVYEVCKETSLTHAVNLSNRLECKVLLKREDEQPVFSFKLRGAYNKMAHLDRAQSWRGVVCCSAGNHAQGVAFSARKLKIPATIVMPEGTPSIKHLAVARMGGHVVLHGPDFDAAKEECARREKHDGLINIPPFDDPYVIAGQGTIGMELLRQTNLQKLEAIFCCVGGGGLIAGIGVYVKRIAPHIKIIGVETHDANAMTQSLAKGERVLLKDVGLFADGAAVRTVGEENFRICQEVIDEMVQVTTDEACAAIKDIFEDTRSVVEPAGALALAGLKKWVAANPSTDSSRSLVAITSGANMNFDRLRFVAERANVGEGREALLAARIPEKPGSFAKLIEAIMPNNVTEFTYRYTDGEVANIMLGLSLTAPVAQRAHQLQLLMGRIAEAGMEVTDLSGDELAKSHVRYLVGGRAKVPNERLYMFEFPERPGALEKFLATLRPRYNISLFQYRNYGSDVGKILAGIQCPDGEMPELVKFLKEIGYPWFDCTQSEVAKTFLGGPGVNEEGAVPL

SEQ ID NO: 31489 - DNA, 1035 bp, Magnaporthe grisea 70-15
  CDS (1)..(1035)
atgggatcctactcagtagagcctgtgaagccatgggttgagaccccatgcttgtactctccccaagtctcgcgcgcagctggctgcaacatctacctcaaattagacaacctccagccctcgggctcgttcaagtccaggggtatcggcaacatgatgcaacgcgccatagccctgacgccgagggacgacgtgcacttctactgcccatcaggcggaaacgccggcctggcctgcgccacgtctgccgcatcactcggcaagcccgccactatcgtcgtcccgatcaagaccccggcccacatggtcgagaagcttgaggcgctaggagcagaggtgctccgccggggcggcagcatcgccgaggcggacgcgtacctcaagtcgcagctgctgataaacgacccgaacggcgtctacgtctcgccctttgaccaccctgacatctgggagggcgcctcgagcatcgtcgacgagatcacgacccagatgaggctgcagccgggagggcccaaggaggccgacggcatcgtctgcaacgttggcggcggcggcctgctgatcggcatcatggacgggctggaccgcatctactgcggccgcccgcagaaccagccccgggtgctggccgtcgagacgcgcggtgccgagagcctcgacgccagcatccgtgccggcgagctggtgacgctgccaaacattacttccatctgctcgtcgctgggcgtagctagagtggcaccccgcgcttacgagtggaccaaggccgcggccggtcagctcgccacgacggtggtggacgacgccgatgccgtcatggggtctgtcaagttcctggacgacgcgaggctgctcgtcgaggttgcctgcggcgctaccatttcggttgtgtacaacggccaactgaggcagaagctggggaagggcctgagcgacgccgagtgggccgagaagaacatagtgctggtggtgtgcggtgggtctcacaccactctcgaggcactgttgaggtacagggaagagtttggagtataa

SEQ ID NO: 31490 - protein, 344 aa, Magnaporthe grisea 70-15
MGSYSVEPVKPWVETPCLYSPQVSRAAGCNIYLKLDNLQPSGSFKSRGIGNMMQRAIALTPRDDVHFYCPSGGNAGLACATSAASLGKPATIVVPIKTPAHMVEKLEALGAEVLRRGGSIAEADAYLKSQLLINDPNGVYVSPFDHPDIWEGASSIVDEITTQMRLQPGGPKEADGIVCNVGGGGLLIGIMDGLDRIYCGRPQNQPRVLAVETRGAESLDASIRAGELVTLPNITSICSSLGVARVAPRAYEWTKAAAGQLATTVVDDADAVMGSVKFLDDARLLVEVACGATISVVYNGQLRQKLGKGLSDAEWAEKNIVLVVCGGSHTTLEALLRYREEFGV

SEQ ID NO: 31491 - DNA, 1746 bp, Gibberella zeae PH-1
  CDS (1)..(1746)
atgccttctgctgatcccatcgtggccgtccctgccaatggcgctgtcaatggcaccgccaatggaacaaatgacgactctcgtccgcagacgccgatgaccggaatggccttgaccgagtatagcgcaaacccctcgacaccgtccgcagagaagcaggctcgcctcaaagagattgttcccgaggaatacctcctccctactggataccctgactaccttcgtctcatcgccggcgctacttctcgagtctacgaggcctgcaaagtcactcccctcacccacgccatcaacctgagcaaccggctcgaatgcaatgtcctcctcaagcgtgaagacgagcagcccgttttcagcttcaagctgcgcggcgcttacaacaagatggcccatctcgaccccaagaagagctggaagggcgtagtctgctgctccgccggtaaccatgcccagggcgtcgcctattccgctcgcaagctcaagatccccgcgaccatcgtcatgcccgaagcgactcccagtatcaagcatctcaacgttgcccgtctcggcggccatgtcgtgttgcacggcgctgactttgacgccgccaaggaggagtgtgctcgacgagaggtccaggatggactcatcaacatcccccctttcgacgacccctatgtcattgctggtcagggcactatcggaaacgaattgttcggccaggtcaacatggccaaggtggaggctatcttctgctgtgtcggcggcggcggtctcattgctggaatcggtctctatgtcaagcgcatggctccccacgtcaagatcatcggtgtcgaggctcaggatgccaacgccatggcgcaatcgctaaagaagggcgagcgagttcttctcaaggaggtcggcctgttcgctgacggcgccgctgtcaagattcccggagaggaaactttccgcatctgcaaggaggttatcgacgatgttatcgaggtgtcaaccgacgagatctgcgccgctatcaaggacatgtacgacgacacccgttcaggtctcgagcccgccggtgccctttccatcgccggtctcaagaaatacgtcagccagaacccctcggacgattcgaagcgcaaccttatcgctgtgacgtccggcgccaacatgaactttgatcgcttgagatttgtcgctgaacgtgccaccatgggtgagggcaaggaagctcttctttctgtccagatccccgagcgtcctggtgctttctccgaactcatcaacaacatcatgccccacggtgtcacagagttcagctaccgatactccacagacgaagtcgccaacatcctcatcggtgtctccctcacagcccccgcccaccaacgatccgaagaactccgctccctcatcgaccgcatccaatcaaacaacatgaccgtgacagacctctcaaacgacgagctcgccaagagccacatccgatatctcgtcggtggacgatccggcgtccccaatgagcgcctctacatgttcaccttccccgagagaccaggagctctcgagaagttcctcgtcacgctccgtcccaagttcaacatcagcctgttccagtaccgtaactacggcggcgacgttggcaagatcgttaccggaatcctatgtcctgacgaagaggtcaccgagcttcacaactttttgcgcaagatcggttatccttacgaggactgcaccgagtcaccagtattcaagacatttttgcgatcatga

SEQ ID NO: 31492 - protein, 581 aa, Gibberella zeae PH-1
MPSADPIVAVPANGAVNGTANGTNDDSRPQTPMTGMALTEYSANPSTPSAEKQARLKEIVPEEYLLPTGYPDYLRLIAGATSRVYEACKVTPLTHAINLSNRLECNVLLKREDEQPVFSFKLRGAYNKMAHLDPKKSWKGVVCCSAGNHAQGVAYSARKLKIPATIVMPEATPSIKHLNVARLGGHVVLHGADFDAAKEECARREVQDGLINIPPFDDPYVIAGQGTIGNELFGQVNMAKVEAIFCCVGGGGLIAGIGLYVKRMAPHVKIIGVEAQDANAMAQSLKKGERVLLKEVGLFADGAAVKIPGEETFRICKEVIDDVIEVSTDEICAAIKDMYDDTRSGLEPAGALSIAGLKKYVSQNPSDDSKRNLIAVTSGANMNFDRLRFVAERATMGEGKEALLSVQIPERPGAFSELINNIMPHGVTEFSYRYSTDEVANILIGVSLTAPAHQRSEELRSLIDRIQSNNMTVTDLSNDELAKSHIRYLVGGRSGVPNERLYMFTFPERPGALEKFLVTLRPKFNISLFQYRNYGGDVGKIVTGILCPDEEVTELHNFLRKIGYPYEDCTESPVFKTFLRS

SEQ ID NO: 31493 - DNA, 1098 bp, Gibberella zeae PH-1
  CDS (1)..(1098)
atggcagacatctcaacttgccctcccctaacaagggactctgttatcgaggcacatcgcctaattgagcctcatgtgcatctaactccagtcatgacaagcagctacattaacaaacttgcttcaacgccaagagaccccgcctcttttgctaatcaaaaaaatctcccgcagcttgccaaacctcagttcaggctgtggttcaaatgcgagaacttccaacgtgctggggcctttaaagcacgtggagctttccacgctattgaaagattaaagttggagcctggatgggctgagaatggtgggaaggaaaaaggcgttgctacacatagctcgggtaatcatgcccaagcgcttgcactagctgcccgagaaaacggcatgcctgctcatgtcgtgatgccttcaatcactattccaagcaaggtcgctgctaccaagggctacggggcaaatgtcatcttcagcactttgaccgatcgccttgctgttgctgaaaacgttgtagcagaaacaggcgcacgccttgttccgccatatgatcaccccgatattattctagggcagggcaccatgggcctcgaactgcagcaacaggtcaaaggcctcaacggcatcattacaccctgcagtggtggcggaatgttgtcgggagtagcattgagttgcgaaaacacagggatcaaagtcttcggagccgaaccttcgtttcaaggcgcggatgatgccaagcggggaatggaacaaggtgaaagaatcacctatgtggatagtatgtccattgctgacgggctgcgctcctacttgggcgtttatccgtggagcatcctctacgagcgaaaacttgtccatggcatgtacagcgtgtcagaagacgagatcaaggcggccatgaagttgatattggagagaatgaagttattcgttgaaccaagtgccgctgtaccacttgcggtagtattgttcaacgaggagttccggtccatggttgagaaagaggcgaaaggggatgtttgggacttgggcattgtgctaagtgggggaaataccacaacagacggcattgcagatctctttccgagcgatgtatacacatag

SEQ ID NO: 31494 - protein, 365 aa, Gibberella zeae PH-1
MADISTCPPLTRDSVIEAHRLIEPHVHLTPVMTSSYINKLASTPRDPASFANQKNLPQLAKPQFRLWFKCENFQRAGAFKARGAFHAIERLKLEPGWAENGGKEKGVATHSSGNHAQALALAARENGMPAHVVMPSITIPSKVAATKGYGANVIFSTLTDRLAVAENVVAETGARLVPPYDHPDIILGQGTMGLELQQQVKGLNGIITPCSGGGMLSGVALSCENTGIKVFGAEPSFQGADDAKRGMEQGERITYVDSMSIADGLRSYLGVYPWSILYERKLVHGMYSVSEDEIKAAMKLILERMKLFVEPSAAVPLAVVLFNEEFRSMVEKEAKGDVWDLGIVLSGGNTTTDGIADLFPSDVYT

SEQ ID NO: 31495 - DNA, 1026 bp, Gibberella zeae PH-1
  CDS (1)..(1026)
atgggatctctagactctggcgcaaaattgccatggattaagacaccatgtatcatcagcactcaattatcccgccttacaggctgcaatgtctatctcaagcttgaaaatcttcaaccttcagggtccttcaagactcgtagcattagtagtctcatgacccaagctgctgccgcagccacaggtcctgttcatttttactgctcttcaggcggcaatgccggtctggcatgcgcaacatcagctatttcgctcggtcataaagccacaattgttatgcctaccattgttagcccgctcatgaaaagcaagctacttgatctgggagtagaagtgcaccagaaaggcaagaactgggctgagtgcgataagtacatgcgcgaagagctggtggccaacgatccttcagctatctatgtcgcaccattcgacgatcctcgactctgggatggagcggcaactatggtggatgagattcgggatcagctcgaggatcgtgtcgatggcatcgtctgcagcgttggcggtggcagtttagttaacggtttaatgcaaggcatcgagagccgtccctggctgggaacaaagcctgccgttctggccgttgagactgagggagccgacagtctcaatgccagtgtcctcgctggagagcacgtaacgctgcccgagatgacttcgatcgcaacgtctctcggtgctacaagagtgtcggagcagacatggaagtggagtcagcatccttcagggatgatgaagagtcttgttgtgtctgacgcagatgctgccataagtactgtgcgatttgcggacgatgcactacagctggttgaagtagcatgtggtgcagcattggcgattgcttatcggggagacctaagggatgttctcggaaagggcttgtctgatgaagaatggagtaagacgaacgtggtgtttgtggtttgtggtggctctggtatcacgttgagtatgttgtctgagtaccgggaaaagtactctggacagtcatccatcaaggtctga

SEQ ID NO: 31496 - protein, 341 aa, Gibberella zeae PH-1
MGSLDSGAKLPWIKTPCIISTQLSRLTGCNVYLKLENLQPSGSFKTRSISSLMTQAAAAATGPVHFYCSSGGNAGLACATSAISLGHKATIVMPTIVSPLMKSKLLDLGVEVHQKGKNWAECDKYMREELVANDPSAIYVAPFDDPRLWDGAATMVDEIRDQLEDRVDGIVCSVGGGSLVNGLMQGIESRPWLGTKPAVLAVETEGADSLNASVLAGEHVTLPEMTSIATSLGATRVSEQTWKWSQHPSGMMKSLVVSDADAAISTVRFADDALQLVEVACGAALAIAYRGDLRDVLGKGLSDEEWSKTNVVFVVCGGSGITLSMLSEYREKYSGQSSIKV

SEQ ID NO: 31497 - DNA, 1197 bp, Gibberella zeae PH-1
  CDS (1)..(1197)
atggcagacatctctaaaactcctcctctgactcgtgactcagtcattgaggctcacaaactcatcggccaatacgtccactatacgccagttctcaccaaccggaccatcacagaacttgcctcaacccctcgtacagcagaggaacttgagggaactcgctatgctggaagaacacccgcccgaccggtgttgagactctggttcaagtgtgagaatatgcagcgcataggcgctttcaaagctagaggcgcttttcatgctgttgagagattaaagcaggaacctggatggttggaaggagggggtaaagagaagggcgttgtcacgcatagttctgggaatcatgcccaggcgttagcccttgctgctcgtgagagtggcatcaatgctcatatcgtcatgcctgagatctccaaccccaagaagatcgccggcacaaaaggctatggtgctcgcgtgattttcagcggaagcacatcaactgaacgtgaagccatggctgaaaaggtaattgccgaaacaggtgctcgccttatcccaccttatgaccacccagatatcatgcttggtcaaggaactatgggattggagttccagcagcaagtcgccgagttgatgacgactgatgctgtggttgatggccaacgaaaactgtttcgtgcaccttcgactgggagggacaatgaggcaccacgtacaaagaaggaaaagccaggcttgaatgccatcatgacaccgctgggtggaggtggcatgctctcgggtgtagctctcagttgcgagggcactggaatccgcgtctttggatcggagccatcctttgaaggagctgatgatggcaagcgtggatacgagtcaggttctcgaatcacagcagtcaagactcttaccgttgccgacggactgcgcactcctgtaggggcccatccttggtcggtcatctacgaacgtcgtttggtgtcaggcatatacagtgtcaccgaagatgagatcctgtcagctatgaagctggtatttgagcgattcaagctcgtcgttgagcccagtgcttgcgttccgctggccgtggcgctgtacgatgaagattttagatccatggttgagaaggaggctggagaagagggatgggatctcggcttggtgtttagcggtggtaatgttggtcttgatgctattggcaagctctttgcgtag

SEQ ID NO: 31498 - protein, 398 aa, Gibberella zeae PH-1
MADISKTPPLTRDSVIEAHKLIGQYVHYTPVLTNRTITELASTPRTAEELEGTRYAGRTPARPVLRLWFKCENMQRIGAFKARGAFHAVERLKQEPGWLEGGGKEKGVVTHSSGNHAQALALAARESGINAHIVMPEISNPKKIAGTKGYGARVIFSGSTSTEREAMAEKVIAETGARLIPPYDHPDIMLGQGTMGLEFQQQVAELMTTDAVVDGQRKLFRAPSTGRDNEAPRTKKEKPGLNAIMTPLGGGGMLSGVALSCEGTGIRVFGSEPSFEGADDGKRGYESGSRITAVKTLTVADGLRTPVGAHPWSVIYERRLVSGIYSVTEDEILSAMKLVFERFKLVVEPSACVPLAVALYDEDFRSMVEKEAGEEGWDLGLVFSGGNVGLDAIGKLFA

SEQ ID NO: 31499 - DNA, 2019 bp, Ustilago maydis 521
  CDS (1)..(2019)
atgtacgacaagcaagtacaagtggtgactcaatcctcagatcctccaagcatccctttccgccatacgctgcggagcatcgaccttgttttggtccgggaaacgcgcagcttgatacagccaccaactatggcggacaccgcttcgacgtcgtcgtcttcggcggcgtacctttcgggacccttcccctcggctcgagcactgaccgagaacgatgtcacaccgtcagtgccacccactcggtcagaggagaaatctgcgcctacgcatctctacacggatctgccgcctcatctgatgcaggcagacaacacacccgactatctgcggctcatcctcaatgcggacgtctacgatctagtaaagcagacaccgctacaggcgggagtcaacctgtcgtccaagttgggctgtcaagtgcttctcaagcgcgaagatttgcagcccgtgttcagcttcaagctgcgtggtgcgttcaacatgatgcagcagctcgattcggagcaaaagtggaagggggtgatcgcttgttcggctggcaaccacgcgcagggtgtagctatggcgggtgcgcatctcaagatcccgtgtacgattgtgatgcccaagggtacaccggagatcaagacggcgaatgtcaagaggctgggtgccaaagtggtgctgttcggacaggatttcgatgaggccaaggcagagtgtacgcggctgtccaaggcgtatgggttgacgattatcccgccgtttgatcatcctcgcgtgatcgcaggtcagggtacgatcgctgtcgagatctgccgtcagacagacatgtcgcaagtcgacgctatcttctgctgcgtaggtggcggaggcttgctggccggtgtggcggcttacattaaacgcatcgctccgccgcatgtcaaggtgatcggtgtcgagacgttcgatgcggatgcactggctcagtcgctcgaagctggacatcgcgttctattgaatgaagtcgggcttttcgccgacggtaccgcggtgcgcatcgtgggcgaggaatgtttccgcatctgccgcgataccgtcgacggcgtggtgcgtgtaacgaacgacgaaatctgcgccgctatcaaggacacgtttgaagacacacgctctatcccggaaccgtcaggtgctctcgccgtcgccggtatgaagcgctacattgccgcgcacaatctgcaaggctcgggcaagaaattcgtcgcgctcgtctcgggcgccaacatgaactttgggcgcttgcgcttcgttgcagaacgtgccgagctaggcgaaaacaaagaagcgctcttgagcgtcgagatcgcggaagaaccgggcgcgttcttgaagctgcacaaccatatcaacccgaggatggtgaccgaattcagttatcgatacggcgatagcagcaaggcacagatcttactgtcattcatgctgaacggcaccaacgcgcgtgctgctagcgcgagcagcgaatcgcaatcgcatgcgagcggcgccgtacctgtacctgaagtggtgacgaatacggcctcgactggtgatgcgtcgatctcgtcgtcaagcgcatcgatcgatacagatgtgaaccagctcgctcagtcggtggcgccatcgacactgtcgacgtcgagcgaactcgcgtcgatccttgccgctctcactgcggacggcatgacaccgatcgacctgtcaggcgacgaagtgtccaagtcgcacctccgctacctcgtcggcggcaagacgagcgtcgccaacgaacgcattttccgcttcgagtttccggaacgtcccggtgcgctgcgcaagttcttggtcggaatgcagagcggctggaacatcagcttgttccattaccgaaaccacggtgctgacatgggcaagatcttgctaggcatccaagcgccgaaacaagatgagatcaagtttgaaaccttcctcaaggagctcggataccagtatcatgaagagaccaacaaccctgtgctgaggagatatctcgcacaataa

SEQ ID NO: 31500 - protein, 672 aa, Ustilago maydis 521
MYDKQVQVVTQSSDPPSIPFRHTLRSIDLVLVRETRSLIQPPTMADTASTSSSSAAYLSGPFPSARALTENDVTPSVPPTRSEEKSAPTHLYTDLPPHLMQADNTPDYLRLILNADVYDLVKQTPLQAGVNLSSKLGCQVLLKREDLQPVFSFKLRGAFNMMQQLDSEQKWKGVIACSAGNHAQGVAMAGAHLKIPCTIVMPKGTPEIKTANVKRLGAKVVLFGQDFDEAKAECTRLSKAYGLTIIPPFDHPRVIAGQGTIAVEICRQTDMSQVDAIFCCVGGGGLLAGVAAYIKRIAPPHVKVIGVETFDADALAQSLEAGHRVLLNEVGLFADGTAVRIVGEECFRICRDTVDGVVRVTNDEICAAIKDTFEDTRSIPEPSGALAVAGMKRYIAAHNLQGSGKKFVALVSGANMNFGRLRFVAERAELGENKEALLSVEIAEEPGAFLKLHNHINPRMVTEFSYRYGDSSKAQILLSFMLNGTNARAASASSESQSHASGAVPVPEVVTNTASTGDASISSSSASIDTDVNQLAQSVAPSTLSTSSELASILAALTADGMTPIDLSGDEVSKSHLRYLVGGKTSVANERIFRFEFPERPGALRKFLVGMQSGWNISLFHYRNHGADMGKILLGIQAPKQDEIKFETFLKELGYQYHEETNNPVLRRYLAQ

SEQ ID NO: 31501 - DNA, 1131 bp, Ustilago maydis 521
  CDS (1)..(1131)
atggtctcgttcaaagacattcaagaggcgcacgtccgtgtctcaccgtacactcactatacgcccgtactcaccaaccaggcgatcgaccaactcgcgaccgagtcactctttggccctgccacatctgcttctccttcgcccagacctcgcatacgtctcgcctttaaagccgagcatcttcagcgcgtaggagcattcaagtaccgaggcgctaccaactctgtgcttgtccacctcggcgcagctaaagcgcaacacgatgcctcggcatccaaatcgaccaagttcagcccgggcaagctggttgttgtaacgcattccagcggaaaccatgctgctgcgcttgcgtgtgctgccaagtcggccggctgtgtcgcagcggttgtgatgccgaacaacgcgcccaagccgaagaaggaggcggttgctgggtacggcgccagaatcacgttctgcgagccaacgctcgaggcacgtgaatcgacggccgaggctgtcatgcaggattacgagaagcaggggtatatcgtgcgctttgtacatccgtatgatgagccattagtgattgctgggcagggaacgatggcgctcgaattgctggatcaggctgcacaactggaggagtgggcaacttgctcgcatgcagctgatcgcataccgtcaaacgcaagaccactgcatggtacaagaaacgtcgctccctccggcccgaaggcggagtcagtatggcgaaagagagacatgtcggaagctgcgctcgatatcatcatcgctcccgttggaggcggaggaatgctctctggtgtcgctaccgcaatcaagggagccgacgaccgaatcgttgtcatcggcgctgagcccgacctagtcgacgacgctttccactcataccaaacaggttcagtacaacagccaccgcagcctccgaaaaccatctgcgatggactcctcacctcgctctcgcctctgacactcgaacacatccgaaatcacgtcgatggcatcgtcacggctcgtgaagaaaacgtgctgaaagccttacagctgcactggacccgacagaagcagtttgtcgaaccaagcgctgccgcttcaatcaagctgcagagcaggcaggtggtgctttga

SEQ ID NO: 31502 - protein, 376 aa, Ustilago maydis 521
MVSFKDIQEAHVRVSPYTHYTPVLTNQAIDQLATESLFGPATSASPSPRPRIRLAFKAEHLQRVGAFKYRGATNSVLVHLGAAKAQHDASASKSTKFSPGKLVVVTHSSGNHAAALACAAKSAGCVAAVVMPNNAPKPKKEAVAGYGARITFCEPTLEARESTAEAVMQDYEKQGYIVRFVHPYDEPLVIAGQGTMALELLDQAAQLEEWATCSHAADRIPSNARPLHGTRNVAPSGPKAESVWRKRDMSEAALDIIIAPVGGGGMLSGVATAIKGADDRIVVIGAEPDLVDDAFHSYQTGSVQQPPQPPKTICDGLLTSLSPLTLEHIRNHVDGIVTAREENVLKALQLHWTRQKQFVEPSAAASIKLQSRQVVL

SEQ ID NO: 31503 - DNA, 1086 bp, Aspergillus nidulans FGSC A4
  CDS (1)..(1086)
atggctcctcaactcccgaccccaaattctatacaagaagcttacaccctcataaccccgtacatccaccgcaccccgctccttacaaatcgcaccctcaacgccattgcttcagcccggcagtcacccgatgcgctacgcggaacacctttcgaaggctcgaccccagcgcaccccaagataaacttcttcttcaaatgcgagaactttcaacgcatcggcgcgttcaaggcccgcggcgcatttcacgcgctgctgaggctgattgagcgtgagggcgaggagaatgcccttgcgctcgcctcctcaactctcgggattcccgcgtatattgtcatgccgaaaatcagcactccctccaagatcgcagggacgcagtctcacggcgcagaagtgattttcagcggctcaacgagtgtagagcgggaagcggtagttgcggacgtccaagcgcgcacaggggcgattcttgtcccaccgtatgacgattaccatattatttgcggccaggggacgacgggactagagatgcatgcacagtatcttgatgctgtgcgcgagaagcctgagttgagtgtacatgagtccgagtctccgtccgctagggaaggtctagatgcggtgattacgccgattggaggaggcggtctcaattccggggttgcaactttcttctcggataagacgacgaaagtctttggcgcggaaccgagcttcgagggcgcggacgattgtcggcgtgggcttgacgctggacagagggttgagagcgtgaagactctgacgattgcggatgggttaagaacgccggtgggcgtgttgaattgggaggttatttcagacaagagcaaagtggcgggtgtgttttccgtcactgaggagcagatcaaggctgcaatgaggcttgttctggaacgaatgaaggtggttgttgaaccaagcgctgttgtgggattggctgtttgtctgtataatgaggagtttcgacggcttgtcgaacgcgaggcgccagccggctgggatgtaggaattgtgtttagtggtgggaatacgacggttgaggcgattgggaaattgtttggttga

SEQ ID NO: 31504 - protein, 361 aa, Aspergillus nidulans FGSC A4
MAPQLPTPNSIQEAYTLITPYIHRTPLLTNRTLNAIASARQSPDALRGTPFEGSTPAHPKINFFFKCENFQRIGAFKARGAFHALLRLIEREGEENALALASSTLGIPAYIVMPKISTPSKIAGTQSHGAEVIFSGSTSVEREAVVADVQARTGAILVPPYDDYHIICGQGTTGLEMHAQYLDAVREKPELSVHESESPSAREGLDAVITPIGGGGLNSGVATFFSDKTTKVFGAEPSFEGADDCRRGLDAGQRVESVKTLTIADGLRTPVGVLNWEVISDKSKVAGVFSVTEEQIKAAMRLVLERMKVVVEPSAVVGLAVCLYNEEFRRLVEREAPAGWDVGIVFSGGNTTVEAIGKLFG

SEQ ID NO: 31505 - DNA, 1764 bp, Aspergillus nidulans FGSC A4
  CDS (1)..(1764)
atgaccgagaacgcgtccatgaatggcgctgcgacaccactttcctcgaggttgagcaatttggctctgacggaatactctgctattccgactcctacttcggagaaggaagaatacaaaggacccgacagtccacccgcgtgggatatccctgatgctttcttacttcccaatggctacccggatgtgcgacatgtccctgctgcctacccaaatcgttctaccgctaacaatcgttatctgcagtatcttaaactgattttgacttcccgcgtctacgagatcactaccgagtcccctctccaccatgcagtcaatctcagtaaccgaatggaatgtcgagtgcttctcaagcgggaagacctgctacctgtattcagcttcaaactccgcggagcatacaacaagatggctcatttgaccgacgagcagcgatggaaaggcgtgattgcttgctcagcaggcaatcatgctcagggtgtcgcgtactctgcccgcaagctcaaaattcccgctaccattgtcatgccctccggcaccccagcgatcaaacacttgaatgtcgctcgccttggcggtagtgttgtccttcatggaaacgatttcgacgctgccaaagaagaagctcaccgccgggaaaagcagcacggtcttacaagcattccccccttcgatgacccgtacgttattgctggacaaggaaccatcggaatggagatcttgcgccaagcgaatctggacaagctggaagctgtcttttgcgccgttggcggaggaggtctgatctccggtgttggcgtttacatcaagcgcattgcgccgcatgtcaaggtcattggtgtggagacccacgacgccaacgcaatggcccagtctcttgatgaaggctctcgtgtgttgctgaacgaggtcggcctctttgcagatggcgctgcggtcaagagtgtggggtcggaatgttggcgcgtggcccgcgaggtagtagatgagattatcttggtttcaaccgatgagacttgcgctgcgatcaaggatgcatttgaggatacacgctcgatcatcgaacccgctggtgcgctggccattgcaggattaaagaaatatgtcgccaagcgccccagccccaacaccagccgtgaactggttgcaatcacctcgggagcaaatatggattttgaccggctgcggtttgttgcggaacgcgctgccttgggggagaaaaaggaagctcttctgagcgtaaaaatccctgaacaaccgggcgctttcgccaagctagtggaggtcgtccttccgcatgctgtaaccgcattcaactaccggtatgctgatgaaacaactgccgatgttctcatgggtatctccttgtccgcttcaacaggtcaagaagacctggctaagattatgacggaattaacccgaaacggcatggactcgaaggatctcagcgatgatgagcttgctaaacggcacctgcgcttcttggttggcggacgcagtgaagtgaaggatgagcgcctgttcatgttcgagttccccgagcgtcccggagcgttagccaaatttctcaggacgcttcgtcctagccagaacatctctctattccactaccggaattacggcggcgatgttggcaaggttctggcgggtattcagtgcccggaatgcgagaaggaacaacttgaggctttcctcaaggaccttggatacccatttaccgaggagacgcaatccgaaacttacaagactttccttcgtcgttga

SEQ ID NO: 31506 - protein, 587 aa, Aspergillus nidulans FGSC A4
MTENASMNGAATPLSSRLSNLALTEYSAIPTPTSEKEEYKGPDSPPAWDIPDAFLLPNGYPDVRHVPAAYPNRSTANNRYLQYLKLILTSRVYEITTESPLHHAVNLSNRMECRVLLKREDLLPVFSFKLRGAYNKMAHLTDEQRWKGVIACSAGNHAQGVAYSARKLKIPATIVMPSGTPAIKHLNVARLGGSVVLHGNDFDAAKEEAHRREKQHGLTSIPPFDDPYVIAGQGTIGMEILRQANLDKLEAVFCAVGGGGLISGVGVYIKRIAPHVKVIGVETHDANAMAQSLDEGSRVLLNEVGLFADGAAVKSVGSECWRVAREVVDEIILVSTDETCAAIKDAFEDTRSIIEPAGALAIAGLKKYVAKRPSPNTSRELVAITSGANMDFDRLRFVAERAALGEKKEALLSVKIPEQPGAFAKLVEVVLPHAVTAFNYRYADETTADVLMGISLSASTGQEDLAKIMTELTRNGMDSKDLSDDELAKRHLRFLVGGRSEVKDERLFMFEFPERPGALAKFLRTLRPSQNISLFHYRNYGGDVGKVLAGIQCPECEKEQLEAFLKDLGYPFTEETQSETYKTFLRR

SEQ ID NO: 31507 - DNA, 1278 bp, Aspergillus nidulans FGSC A4
  CDS (1)..(1278)
atggcgttcgtgaagagaataccctggatcgaaacacccctgattgaatctgcttccttatcaaagacggctggatgcagagtattcctcaaactagacctccttcagccttctggctctttcaaatctagaggaattggaaacctcatctgcaatgcccttcaagacccagccaacagaggcaaagaactccacttctttagctcctctggcggaaacgccggtctggctgccgttatcgcggcgcgtgatctcggctgccgttgtacagttgtcgtgccgtactcgacgaaacctatgatgatcacaaagctgcgggaggccggtgccactgatgtgatccaacatggggacagttggtttgaggccgatacgtatcttcgggagacatttattgagaatcaggaccaaggaggcgatgccgcgacaaagaggaatatctacgttccaccgtttgatcatccgcagatctggaagggtgtcgggactatgattgatgagatcgcacagcaaatgccgcctagggatgtttcgaaaggttcttttcccgcagatgctgtgatttgtagcgttggtggaggtggcctctttaatggtgtggttgaggggctgggtcgacatctggcaactaaaaatggcgatgctcctgggggcaaggtccgcgttttagccgtcgaaactgaaggaactgattccctcgctttgtcccttcgaaaaggtacattgcagccgctcccggctattacgtccctcgctacatcgctaggagcacttcaagtggcgccgcagactctgaagaacgcgcagtgcccgcccgccagagtagatgtcgtcagcgttgtcggctctgatgcggaagctgcccaaggcgtgattcggctcgcggatgaacaccggttgcaagttgaattggcttgtggtatcagtgtagaggttggtggctcggtgaagctgagggattacatgcctgatctgacgccggacagccggatagttattgttatttgtggaggaagcaatgtcactgcggagatggtggtggagtataggaaaaggcttcatgatggttgggatagcgcatacgcggcttttgcgtcgcctgcggtcggatccgtagttcacgcatttgacgccattcttggtagtcaggtccccgtcttatttctaatgtatccatccatatgctccagctgtaaagctgccagcataaacaagaagagcacaatgcactccagctttacttggagaagtagacaaattcagacttcgactgtgtga

SEQ ID NO: 31508 - protein, 425 aa, Aspergillus nidulans FGSC A4
MAFVKRIPWIETPLIESASLSKTAGCRVFLKLDLLQPSGSFKSRGIGNLICNALQDPANRGKELHFFSSSGGNAGLAAVIAARDLGCRCTVVVPYSTKPMMITKLREAGATDVIQHGDSWFEADTYLRETFIENQDQGGDAATKRNIYVPPFDHPQIWKGVGTMIDEIAQQMPPRDVSKGSFPADAVICSVGGGGLFNGVVEGLGRHLATKNGDAPGGKVRVLAVETEGTDSLALSLRKGTLQPLPAITSLATSLGALQVAPQTLKNAQCPPARVDVVSVVGSDAEAAQGVIRLADEHRLQVELACGISVEVGGSVKLRDYMPDLTPDSRIVIVICGGSNVTAEMVVEYRKRLHDGWDSAYAAFASPAVGSVVHAFDAILGSQVPVLFLMYPSICSSCKAASINKKSTMHSSFTWRSRQIQTSTV

SEQ ID NO: 31509 - DNA, 2076 bp, Gallus gallus
  CDS (1)..(2076)
atgcacttatgtgacatggccggggtatgggcttgccttaaactggacatgaagaaggcaccagtgaagccatcccgagctttagtcttagagctgactgcccttttgtctcctcacttctggcagcagcatgctgcagggttatggactcctagggttatgcagaaggactcccatccccatcccactacgcagccatctcgtgtttggaaagccctcaccgcttttgtcacaaaagcctgtgtcccccggtgctgccctaaaggatctctgcacgtgactcaaacaccacaggaagaagttgggccttccttgctacttgtgtcgaccctagtgcatgttgttaactcgtgggccctgcacaagtcggccgctcttcccacccaggcagtgcagggctggcagtgcccgtgggcaagcgtgtccctcctgctgtgctttgcacctggaattacaatgaattttgcagcacagttgatctactccagggtgttaaaaaacagaactcccagggaccgctacagggaagatgaagactacgatcctttctggcaaagttatgctgagcagctgttcttgaaaaaggatgacagtaaagtaaagaaacaagatgccccagcactttgcgatcttcgcctttgtaaggatgggccaataagaaatggacacattgggcagaggccacccccaatcaaccctgaaagactgaaggatttcgttgaggaggattacctcaatggggatgtgaagacgtgggaaatgaagatcgtcagccgtaatgaggagttacttggggatgccctttccctcgtccctcagtcaagcagcaggatcagcctgtccagccacaacaaattgattcgatttgaagacattagtgcagcagctttcaaaatccagtccggtgttcagaaaaccccttgcatgtactccaggctatccaagctgtacggagttgacatctacctaaagaaagagttcctccagtacacgggatctgtgaaggagcgaggtgtactttatcttctgacatcactgcctcaggatcagcaaaggaagggggtgattgtggcttcagatggcaacttttccatggctgttgcttaccatgcttcagagcttcgtatcccagtgtttgtcatcatgtcaaccagcacttcccctgccagagtgaaaacgtgccgtgaatacggtgccatggttatatcctatggcactacagctaaggactcccagatgcatgcaagaaggttggcacaggagaatggctatctctacctggaagaggaggacagtgctgtgtacctgtcgggcctgggcaccatggggctggagatgtatgagcaggtgcccaagctggatgcggtgattttccctgcaggaggccactgtggcttgctggcgggctcggctgctgcactcaaacacctcaacccacgtatttctgtcatcggggttgagtctgaaagctttcctgtattgcagcagtccctgaaggctggccatccagctgaagaccaggcttgcaacaaccaccacttttatggagatgtgagcggactttgcttcggcagcaattctttgcagctgactgggaagcttgtggataaggttgttgctgtgagcgaggaggacgtcctcatttcaatgctgagattgctggagtatgagcgagccacagttgatgcagaaggggccattggacttgcagcactggttgctgggaagctgcctgagttgaagggtaaaagagtggcgattgctatatgcagcggaaatgtggacttgcatttgctgcaacgatgcattgctcgtgccctgacccttgagagcagagtgtgcagattttccctggtgatttctgacagcccagcagatgtttcaaagctactggaggttttggctcgggaggaagcaagagttttggatatcagacaagaacgcacatttgtgacatctgagctcttcactgttgaggtcacctgcaccgtggagaccagagacaagatccacacagcccagctgcggaacgcgctgctggaacgctaccccacagccgcgtggacggagcgatga

SEQ ID NO: 31510 - protein, 691 aa, Gallus gallus
MHLCDMAGVWACLKLDMKKAPVKPSRALVLELTALLSPHFWQQHAAGLWTPRVMQKDSHPHPTTQPSRVWKALTAFVTKACVPRCCPKGSLHVTQTPQEEVGPSLLLVSTLVHVVNSWALHKSAALPTQAVQGWQCPWASVSLLLCFAPGITMNFAAQLIYSRVLKNRTPRDRYREDEDYDPFWQSYAEQLFLKKDDSKVKKQDAPALCDLRLCKDGPIRNGHIGQRPPPINPERLKDFVEEDYLNGDVKTWEMKIVSRNEELLGDALSLVPQSSSRISLSSHNKLIRFEDISAAAFKIQSGVQKTPCMYSRLSKLYGVDIYLKKEFLQYTGSVKERGVLYLLTSLPQDQQRKGVIVASDGNFSMAVAYHASELRIPVFVIMSTSTSPARVKTCREYGAMVISYGTTAKDSQMHARRLAQENGYLYLEEEDSAVYLSGLGTMGLEMYEQVPKLDAVIFPAGGHCGLLAGSAAALKHLNPRISVIGVESESFPVLQQSLKAGHPAEDQACNNHHFYGDVSGLCFGSNSLQLTGKLVDKVVAVSEEDVLISMLRLLEYERATVDAEGAIGLAALVAGKLPELKGKRVAIAICSGNVDLHLLQRCIARALTLESRVCRFSLVISDSPADVSKLLEVLAREEARVLDIRQERTFVTSELFTVEVTCTVETRDKIHTAQLRNALLERYPTAAWTER

SEQ ID NO: 31511 - DNA, 1083 bp, Candida glabrata CBS138
  CDS (1)..(1083)
atgtcagtatacaacaagacaccactaatacgtcagatatttccaagcataccacagatgtacttgaaacatgaatgtttccaaccaagtggaagtttcaaaagcagaggtattggccatctaatatcgaaacaatcacaaagaatattaggcaatggcctgggtaagaagccaatggtattcgccagctctggtggtaatgcaggactagcagcagccacagctgcaaaatttttaaacctaccttgtaccgtcgtcataccaaccgctacgaaacagaggatggcagataagattagagctaccggagctaatgtcattgtttctggtaacttctggaaggaggcagataactacctgaaagataatatcctatctaagttagaagagttacataaaaatgtggaaccaatatatgtacacccatttgataatccagatatatgggaaggtcatgcttcaatggtagatgaaattgttgaagactttaaaaataaaatgatacctcttaacaagataaaagctatagtgtgcagtgttggaggaggcggactttacaatggtataatacaaggcctcgaaaaatataacttagctgacaagatacctattgtaggcgtagagactaaaggttgccatgtattcaatacatctttgagaatgaacaaagtggtgagcttcaagaagatcaccagtattgctacctcgttaggtactgccgacatatctacagaggcctttaaatacgccaaaagatatggtacgaagtctgtggttttaagtgatcaggacgttgtcaagacatgcctaagatacactcatgactttaacatggtaattgaaccagcatgtggcgctgccgtccatttggcttatcacaccgagatcttagaaaaagaactcggcacaaaactaaatgcggatgacattgtactagtagtggcctgtggaggttcatcgaacactgtcgaagatatggaatcgatactacaaagactgtccaccgaggagaataacatcaatatcccaaatgttgcagaaaatattattgtcagaatgcctgaggtgtctgtcctagcttaa

SEQ ID NO: 31512 - protein, 360 aa, Candida glabrata CBS138
MSVYNKTPLIRQIFPSIPQMYLKHECFQPSGSFKSRGIGHLISKQSQRILGNGLGKKPMVFASSGGNAGLAAATAAKFLNLPCTVVIPTATKQRMADKIRATGANVIVSGNFWKEADNYLKDNILSKLEELHKNVEPIYVHPFDNPDIWEGHASMVDEIVEDFKNKMIPLNKIKAIVCSVGGGGLYNGIIQGLEKYNLADKIPIVGVETKGCHVFNTSLRMNKVVSFKKITSIATSLGTADISTEAFKYAKRYGTKSVVLSDQDVVKTCLRYTHDFNMVIEPACGAAVHLAYHTEILEKELGTKLNADDIVLVVACGGSSNTVEDMESILQRLSTEENNINIPNVAENIIVRMPEVSVLA

SEQ ID NO: 31513 - DNA, 1716 bp, Candida glabrata CBS138
  CDS (1)..(1716)
atgatacccaagctgctgtgtggtaacacactgttgagtgcatctgttacaacaagtaggtctgtctatggcttatctaccagatattttactcaggatctcgcaccttcattggttaaactgcattccgagttaaagcctgatgagcttcttactgataacacaccagactatgtgcgtttggtgctaagatcatcggtctatgatgttataaaggaatcgccaatctcacatggtgttggtctatcgtctagactaaacacaaatgtccaactgaaaagagaagatttactaccagtgttctctttcaagctgcgtggtgcatacaacatgatagcgaagttagacgatactcagagaaatcaaggtgtcatcgcatgttccgcaggtaatcatgcacaaggtgtagcatatgccgctagacatttggatattccagcaactattgtcatgcctgtgtctactccatctataaaatatcaaaatgtgtcgagactgggttcacaagttgttctatatggtaatgattttgacgaagctaaagctgaatgtactaaactggcagaagagcgtggtttgactaacatccctccatttgatcatccatatgtcattgctggtcaaggaacagttgcgatggaaatcttgagacaggtctataactcaaataagatcggtgctgtctttgttccagttggtggtggtgggttgattgccggtgttggtgcctatttgaagagagtcactccacacatcaagattataggtgtggaaacacatgatgcagcaactttacacacatctcttcaaagaaataaaagaacaaatctagctagcgttggtacttttgctgatggtacttctgtgcgtattattggtgaagaaacctttagagttgccagagaagttgtcgatgaaattgtattggtcaatactgatgaaatttgtgctgcggttaaggatgtctttgaggataccagaagtattgttgaaccatctggtgctcttgcggttgctggtatgaagaagtatattactcaacttcatccagaaatagatcactctaagcaaacatatgtcccaattttgtcaggtgctaatatgaacttcgatagattaagatttgtttctgagcgtgctgtattaggtgaaggtaaggaagtttttatgctggttaccattcctgacgttccaggctctttcaaaaaaatgcagaaggttattcatccaagagctgttactgagttctgttaccgttataatgaacatcgtcatgaatcttctagtgaggttccaaaggcctatatctatacatctttcagtgtggtagaccgcgaaaaggagattaaacaagtaatgcagcaactgaacaccctcggttttgaagccgtcgatatttctgacaatgaattagcaaaatcacatggtagatatttagttggtggtgcgtcaaaggtcccaaatgaaagaattatttcgttcgaattcccagaaagacctggggccttaaccagattcttggcaggtttaagcgagtcttggaatttgacattgttccattacagaaaccatggtgctgatattggtaaagtattggctggtatttctgtgccacctagagaaaatttaactttccaaaaattcttggaagatttaggctataagtaccaagatgaaacagaaaatatggtatatcaaagactactgaaatattaa

SEQ ID NO: 31514 - protein, 571 aa, Candida glabrata CBS138
MIPKLLCGNTLLSASVTTSRSVYGLSTRYFTQDLAPSLVKLHSELKPDELLTDNTPDYVRLVLRSSVYDVIKESPISHGVGLSSRLNTNVQLKREDLLPVFSFKLRGAYNMIAKLDDTQRNQGVIACSAGNHAQGVAYAARHLDIPATIVMPVSTPSIKYQNVSRLGSQVVLYGNDFDEAKAECTKLAEERGLTNIPPFDHPYVIAGQGTVAMEILRQVYNSNKIGAVFVPVGGGGLIAGVGAYLKRVTPHIKIIGVETHDAATLHTSLQRNKRTNLASVGTFADGTSVRIIGEETFRVAREVVDEIVLVNTDEICAAVKDVFEDTRSIVEPSGALAVAGMKKYITQLHPEIDHSKQTYVPILSGANMNFDRLRFVSERAVLGEGKEVFMLVTIPDVPGSFKKMQKVIHPRAVTEFCYRYNEHRHESSSEVPKAYIYTSFSVVDREKEIKQVMQQLNTLGFEAVDISDNELAKSHGRYLVGGASKVPNERIISFEFPERPGALTRFLAGLSESWNLTLFHYRNHGADIGKVLAGISVPPRENLTFQKFLEDLGYKYQDETENMVYQRLLKY

SEQ ID NO: 31515 - DNA, 1134 bp, Kluyveromyces lactis NRRL Y-1140
  CDS (1)..(1134)
atgtatgtccatatctttccaacttcatatagtcaaacgagtattaatagattaataatgaaagcccaattgttcagcaaaacaccgttattgaaacatcaattcaaaagaagtaaaggccctcaagtgcttttgaagtatgaatttttacagccgagtggtagtttcaaaagtagaggtatcggacatttaatctctacaaaggtagaagaaataaagaaatcctcgcctgaaaaaatcggtcacgtgtttgctagctctggcggtaacgctggattggcggcggcggttgcgtccctcgaattgaacgttccctgtacagtagttgtgtcgaatgcaacacgtccaagaattatagaaaagattcgctcctacggcgcagatgttgttgttcatggtaaccattggaaagaggcagattctttcatgaaggagcaccttatgaagaaacttgattcctttaaatacgagccaatttacagccatcctttcgataatccgctaatttgggaaggccattcctttatggtggatgaaatcatggatgtcttggctagttcaaaaatacctataaccaaaattaaaggtattgtttgcagttttggaggcggaggtctatataacgggttgattttgggtttgcaacggtataatttagctgacaaaattccgatagtatgtgtcgaaacgaagggaacagacgtattgagcgcctctttgcgtgtaggagcaccagtggagtttgaaaaaatatccagttgtgctacttcactagggacagcaaccatatcaacaacggcttaccaaaatgtgaaacgtcacggaagcaagtcagctgtcatctctgatactgaagtgatttcaacttgccttcaattttctaacgataccaacatagttgcggaacctgggtgtggggcaacgttatacttcgggtataatatcgataaactacaaaatattctcggttcagacattaaagatgatgattatgtcatcttgatcggttgtggtgggtcatctacaagcttagaggatcttaaagagttatctagttttactaattgtgaatttgagcttccttctactggtgtgagccgtctgaattcccattcgttacacacactccagtag

SEQ ID NO: 31516 - protein, 377 aa, Kluyveromyces lactis NRRL Y-1140
MYVHIFPTSYSQTSINRLIMKAQLFSKTPLLKHQFKRSKGPQVLLKYEFLQPSGSFKSRGIGHLISTKVEEIKKSSPEKIGHVFASSGGNAGLAAAVASLELNVPCTVVVSNATRPRIIEKIRSYGADVVVHGNHWKEADSFMKEHLMKKLDSFKYEPIYSHPFDNPLIWEGHSFMVDEIMDVLASSKIPITKIKGIVCSFGGGGLYNGLILGLQRYNLADKIPIVCVETKGTDVLSASLRVGAPVEFEKISSCATSLGTATISTTAYQNVKRHGSKSAVISDTEVISTCLQFSNDTNIVAEPGCGATLYFGYNIDKLQNILGSDIKDDDYVILIGCGGSSTSLEDLKELSSFTNCEFELPSTGVSRLNSHSLHTLQ

SEQ ID NO: 31517 - DNA, 1704 bp, Kluyveromyces lactis NRRL Y-1140
  CDS (1)..(1704)
atgctacaatctatagtgagaactcctagagttcttcgtgcttcaaatgcattaaaactttctgttcgctgtgttagcacggaccagttctctgataatttgcagaggatgtactcccatttgaaggctgacgaacgattggaagatggatctccagactacgtgcgtttaattttaaggtcttctgtttatgaagtcattgaagagacccccatttcacgtgcggtgtcattgtcctctagactaaacactaacgttaaattgaaaagagaggatttgttgccagtgttttccttcaagctgcgtggtgcttataacatgattgccaagctagacgaaacacagaagaatgctggtgttattgcgtgctctgctggtaatcacgcacaaggtgttgccttttcaagtaatcatatgaacattccagctaccattgtgatgcctgtttcaacaccatcaatcaaatatcaaaacgtgtcgagattaggtgcccaagtggttctatacggtgacgacttcgatgaagccaaattggaatgtgcgaggttagctgaagaacgtggtatgacagatattccaccatttgatcatccttacgttatcgctggtcaaggtactattgccatggagattctaagacaagtacaaaatgggtctaacatcggagcagtgttctgtgccgtaggtggtggtggtttgatttcaggtattggttcatacttgaagagaatcgcacctcatatcaaggttattggtgtggaaacttacgatgccgctacgttagatgtttcattaaagaacggtaaacgtaccccattgccaagtgttggaacgttcgctgatggtacctctgtgaggttaatcggtgaagaaacattccgtgtttgtcaagacgtagtcgatgaagttatcttggtgaacaccgatgaaatctgtgctgccgttaaagatgtgtttgaggacacaagatcaattgtcgaaccaagtggtgctcttgctgttgccggtttgaaaaaatatgtctctcaactacaccctgaaatagaccattctaagaagacatacgttccaattctttccggtgccaacatgaatttcgaccgtttaagattcgtctcagaacgtgctgtattgggtgaaggtaaagaagtgtttatgttggtcaccattccagatactccaggttctttcaagaagctacagaatgtgatccatccaagagctgtcactgaattctcataccgttataacgagcattgtcacgaaaatgactccgatgtaccaaccgcttgtatctacacatcttttaacgtcgttgaccgtgaaaaggaaatcaagcaagtggttcaacaattgcatgctttaggtttcgaagccgtagatatctctgacaacgaaatggccaagtctcacggtagatatttggtcggtggtgcttctaaaattgaaaatgagaaagtcattgcattcgaattcccagagagaccaggtgcactaactaaattcttatcaggattgaacgtttcctggaacttgactttattccattacagaaaccatggcgctgatattgggaaaattttggctggtatcagtgtgcctccacaagacaacgaaatcttccaaaagttcttggacgatctaggatataaatatcaagatgaaactgacaatatggtttaccagaagtttttgaagtactag

SEQ ID NO: 31518 - protein, 567 aa, Kluyveromyces lactis NRRL Y-1140
MLQSIVRTPRVLRASNALKLSVRCVSTDQFSDNLQRMYSHLKADERLEDGSPDYVRLILRSSVYEVIEETPISRAVSLSSRLNTNVKLKREDLLPVFSFKLRGAYNMIAKLDETQKNAGVIACSAGNHAQGVAFSSNHMNIPATIVMPVSTPSIKYQNVSRLGAQVVLYGDDFDEAKLECARLAEERGMTDIPPFDHPYVIAGQGTIAMEILRQVQNGSNIGAVFCAVGGGGLISGIGSYLKRIAPHIKVIGVETYDAATLDVSLKNGKRTPLPSVGTFADGTSVRLIGEETFRVCQDVVDEVILVNTDEICAAVKDVFEDTRSIVEPSGALAVAGLKKYVSQLHPEIDHSKKTYVPILSGANMNFDRLRFVSERAVLGEGKEVFMLVTIPDTPGSFKKLQNVIHPRAVTEFSYRYNEHCHENDSDVPTACIYTSFNVVDREKEIKQVVQQLHALGFEAVDISDNEMAKSHGRYLVGGASKIENEKVIAFEFPERPGALTKFLSGLNVSWNLTLFHYRNHGADIGKILAGISVPPQDNEIFQKFLDDLGYKYQDETDNMVYQKFLKY

SEQ ID NO: 31519 - DNA, 1719 bp, Debaryomyces hansenii CBS767
  CDS (1)..(1719)
atgatgattgccagaaacctattgaagggcatacacaagcctgtaaacagaagggtttgtataccaaaaattggttcgttaacttcggccaaattctattccactcaatctacggttcaacaatttccagaattgcaagaagctgattttacgcccgaaggtgagccagattatattaagttgatattgacatctcgggtttacgatgtcgtcgatgaaggtggatctcctctcactcatgctgttaacttatcacagaaatgcaataccaatatattcttaaagcgtgaagatttattaccggtattttcattcaagttacgtggagcatataatatgattgcacatttacattctaattcaaagtcaccagtatcaggggtaattgcatgttctgctggtaatcatgcacaaggtgttgctttctctgctagtaaattaaagattcaatctactatagtcatgccaacagctactccttctatcaaatataaaaatgtttctagattaggatcacaagttgttttatacggagacgattttgatagcgcgaagaaagaatgtgatcggttgagttcattgaacggattgaccaatatccctccttttaaccacccatatgtcatcgcaggtcaaggtactatagccctagaaatcaccagacaattgaggttagacaaacttgatgccttatttgttccagtaggtggaggtggattgatagctgggattgctgtttatttaaaaaagattgctccccatgtcaagattattggtgtcgagacttttgatgcagatgcattgtatcagtcattgcaaaaccatcaactgaagacattggatcaggttggagtttttgctgacggtactgctgtcaaggttcttggtgatgaaacttggaagctttgccataaatatgttgatgaagtagttagggttctgaccgatgaattatgtgcagcaattaaagatatttttgaagataccagactgattgttgaaccatctggagcgttatctgttgctgggttgaagagatatcttagtgataattctgaaattgatcataggaataagaattacgttccaattttaagtggagccaatatgaatttcgatagattaagatttgtaagtgaaagagctgtactcggtgaaggtaaggaagtatcattagctgtcaccattcctgagagacctggtgagtttgctatattacagaatataatcgacccaagagctattacagaattttcctatagatttaacaatagtggtcctgcaaatatttttgttagtttcaatgttaccaataaggacaaagaattagctcctattgttgaatctatgaagagtaatgattatgaagttattgatatctcagagaatgagttggcgaagactcatggtcgttatttagtcggcggaaaatctacaacggctaactgcaataagatttctaaagaaaggttattcagattcgaatttcctgaaagaccaggtgctttaacaaaatttttacaaaccttgaagtatgattgggatataaccttgtttcactatagaaatcatggccatgatgttgggaagattttgtgtggttttgtacttccagaaggcacaagcgatgaggacttccaggatttcttgaaaaaaattggttataattttgttgatgaaacagacaatgtcgtatataaaaaattcttacaaagctag

SEQ ID NO: 31520 - protein, 572 aa, Debaryomyces hansenii CBS767
MMIARNLLKGIHKPVNRRVCIPKIGSLTSAKFYSTQSTVQQFPELQEADFTPEGEPDYIKLILTSRVYDVVDEGGSPLTHAVNLSQKCNTNIFLKREDLLPVFSFKLRGAYNMIAHLHSNSKSPVSGVIACSAGNHAQGVAFSASKLKIQSTIVMPTATPSIKYKNVSRLGSQVVLYGDDFDSAKKECDRLSSLNGLTNIPPFNHPYVIAGQGTIALEITRQLRLDKLDALFVPVGGGGLIAGIAVYLKKIAPHVKIIGVETFDADALYQSLQNHQLKTLDQVGVFADGTAVKVLGDETWKLCHKYVDEVVRVLTDELCAAIKDIFEDTRLIVEPSGALSVAGLKRYLSDNSEIDHRNKNYVPILSGANMNFDRLRFVSERAVLGEGKEVSLAVTIPERPGEFAILQNIIDPRAITEFSYRFNNSGPANIFVSFNVTNKDKELAPIVESMKSNDYEVIDISENELAKTHGRYLVGGKSTTANCNKISKERLFRFEFPERPGALTKFLQTLKYDWDITLFHYRNHGHDVGKILCGFVLPEGTSDEDFQDFLKKIGYNFVDETDNVVYKKFLQS

SEQ ID NO: 31521 - DNA, 1809 bp, Oryza sativa (japonica cultivar-group)
  CDS (1)..(1809)
atggcggccgccgccaccgccgcggccgcggccacctccaccttcaccgccgccgtgccgcgcgcgcgcgggcgcaggcatccaacgcgcgtggcggcggcggcggcggcgacggcgtcgtcaccggaggcggcgatggcggcggcggcgccgccgttgccgatgatgcgggtggcgcccgagacgctgcagcggcagagcgggtacctcgtgcggggccgcggggaggaggggattggggagggggaggcggaggcggtgggaggggacgcggcgggagggctcggcgcgatggagtacctgaccagcgtgctctcgtccaaggtgtacgacgtcgccatcgagtcgccgctccagctcgccaccaagctctccgagcgcctcggcgtcaacttgtggatcaagcgcgaggacctgcagcccgtattctcattcaagttgagaggagcatacaatatgatggcaaagctctcgcgtgaacagttggagaggggtgtcatctgctcctctgctgggaaccatgcccagggagtggccctttccgctcaaagactcggttgcgatgctgttattgtcatgcctgtgacaacgcctgaaatcaagtggcgatcggtggagagattgggtgcaacagttgtactcaaaggggactcatatgatgaagctcaatcatatgcaaaacaaagatgcgagcaggaaggccgcacattcatacctccttttgaccatcctgatgttataagtggacaaggaacgattggcatggaaattgttcggcagttgcaaggcccacttcatgccatatttgtacctgtaggaggaggtggattaattgctgggatcgctgcctatgtaaaaagggttcgcccagaggtgaaaataattggagtggagccatcagatgcaaatgcaatggcattgtccttgtgtcatggtcaaagggtcatgctggagcaagttggtgggtttgctgatggtgtggctgtcaaagttgtaggggaggaaacatttcgcttgtgccgggaacttgtagatggtattgttcttgtcagtcgagatgctatttgtgcttcaataaaggatatgtttgaggagaaaagaagcatacttgaacctgctggtgcccttgcgctggcaggagctgaagcttactgcaaatactatggcttgaaaggggaaaatgttgttgcaataactagtggagcaaatatgaactttgatcggctcagattagtaactgagctggctgatgttggtcgaaaacgagaagcagttcttgccacatttttgccagaggagcagggaagcttcaaaaagtttgcagagctggttggccggatgaatattactgaattcaaatacagatacgattgcaatgcaaaagatgcccttgtcctttacagtgttggcatctacactgacgatgaacttaaagcaatggtggaacgtatggaatcttcaaaattgagaactgttgatcttactgacaatgatttggcaaaggatcatctaagatactttattggtggcaggtcagaagtaacagatgaacttgtttaccggttcattttcccagaaaggcctggtgcacttatgaaatttttggatgcattcagcccccgctggaatatcagccttttccattaccgtgcacaggtgtgtgacagatttattattcatcagtttccctgctgtaaagtagtcttgtatgaaaattgcaatctcatgcatctgaaatcgtcattttattgccatctatcctgtacaatattccctttccattttcacttgacaaaaatgtacatctaa

SEQ ID NO: 31522 - protein, 602 aa, Oryza sativa (japonica cultivar-group)
MAAAATAAAAATSTFTAAVPRARGRRHPTRVAAAAAATASSPEAAMAAAAPPLPMMRVAPETLQRQSGYLVRGRGEEGIGEGEAEAVGGDAAGGLGAMEYLTSVLSSKVYDVAIESPLQLATKLSERLGVNLWIKREDLQPVFSFKLRGAYNMMAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEVKIIGVEPSDANAMALSLCHGQRVMLEQVGGFADGVAVKVVGEETFRLCRELVDGIVLVSRDAICASIKDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDELVYRFIFPERPGALMKFLDAFSPRWNISLFHYRAQVCDRFIIHQFPCCKVVLYENCNLMHLKSSFYCHLSCTIFPFHFHLTKMYI

SEQ ID NO: 31523 - DNA, 1020 bp, Oryza sativa (japonica cultivar-group)
  CDS (1)..(1020)
atggggagcagaggtggaagtggcggcgatggcgcagaaagccatggctatgccgcggacatccactccatcagggaggcgcaggctcgcatcgcaccatacgtgcacaagacgcccgttctgtcatcaacatcgatcgatgccatagtggggaagcagctgttcttcaagtgcgagtgcttccagaaggcaggggcgttcaagatccgaggcgcttccaattcgatatttgcgcttgatgatgatgaggcatccaagggcgttgtgacgcatagcagtgggaaccatgctgctgcagtggctcttgctgcaaagctacgcggaatacctgcttacattgtcattccaagaaatgcaccggcatgtaaggttgacaatgttaagcggtacggtggccatattatctggagtgatgtctccattgaatcaagagaatctgttgctaaaagagttcaggaggaaactggtgctattcttgttcacccattcaataataaaaacactatcagtggtcaaggtacagtgtctctcgaacttttggaggaagtccctgaaattgacacaataattgttccaatcagtggtggtggtttaatttctggtgtggcactggctgccaaggccataaacccttcaatacgtattctggcagcagaaccaaagggtgctgatgattctgcccagtccaaggctgctggaaagatcataacattgccttcaaccaacaccattgctgatggacttcgagcttttcttggtgacctgacatggccggtggtgcgcgacttggtggatgatatcattgttgtggatgacaatgccattgtggacgccatgaaaatgtgctacgagatgctgaaggtggctgttgagccgagtggagcaataggcctcgcagccgccctctctgacgagtttaagcaaagctctgcttggcatgagagcagtaagatagggatcattgtttctggaggcaatgttgacctcggtgtcctctgggagtctctctataaacgttga

SEQ ID NO: 31524 - protein, 339 aa, Oryza sativa (japonica cultivar-group) [sequence omitted]

SEQ ID NO: 31525 - DNA, 972 bp, Yarrowia lipolytica CLIB99
  CDS (1)..(972)
atgactggcgaaggaatcacctacaaggatgtcaagcacgcacacaagcgactcgacaaggtcgccgtcaagacacccgtgctgtcgatccagctcgacgacactcaatactttctcaagtgcgagaatatccagcgaaccggagccttcaagttccgtggagcctacaatgccttgtcgcagttctcgtccaagcaaaaggccggtggagtactaacgtactcatctggtaaccatgctcaggccattgcccatgctgctgccatgctcggaatcaaggccaccatcatcatgcccacggatgcccctaaaagcaagttgcaaggtaccaaggacctgggggctacaattgtgccctacgacagatacaaacaggaccgtgacgaggtagccaatgcaattctcacggaacatcccgaaatgacgctcattcctccatatgatcatcccgacatcatcgcaggacaaggtacagtggtcaaggagctgctagaggaaacaggacctctggacgatatctttgtgccgctgggtggaggaggactgctggcaggctcccttctggcagcagaaaaactcgctccaaagtgtaaggtgtggggtgtggagcccgagacaggaaacgacggtaagctgtcacttcaaagaggccaaatcgtgcatattgacaccccggtgacgattgccgacggtgctcagacccagcatctgggagaactcaccttccccatcattcagagacttgtcacggatatcaagacggtcaacgagggagagatgattgctatgacgcaatggtacgcccgaaagatgaagctggtggtggagccaactggatgcatggctttggcagcggcgttctcgtgctgtggaggcacccacaagaagcgagtgggagtcatcatcagtggaggaaacgtggatctcgataagtatgccacctatctaaccactccggtcgttcagcattga

SEQ ID NO: 31526 - protein, 323 aa, Yarrowia lipolytica CLIB99
MTGEGITYKDVKHAHKRLDKVAVKTPVLSIQLDDTQYFLKCENIQRTGAFKFRGAYNALSQFSSKQKAGGVLTYSSGNHAQAIAHAAAMLGIKATIIMPTDAPKSKLQGTKDLGATIVPYDRYKQDRDEVANAILTEHPEMTLIPPYDHPDIIAGQGTVVKELLEETGPLDDIFVPLGGGGLLAGSLLAAEKLAPKCKVWGVEPETGNDGKLSLQRGQIVHIDTPVTIADGAQTQHLGELTFPIIQRLVTDIKTVNEGEMIAMTQWYARKMKLVVEPTGCMALAAAFSCCGGTHKKRVGVIISGGNVDLDKYATYLTTPVVQH

SEQ ID NO: 31527 - DNA, 1590 bp, Yarrowia lipolytica CLIB99
  CDS (1)..(1590)
atgtccgaacccgactatctgaagctcatcttgaagagccgcgtctacgacgtgtgcaaggaaacacctgtgacatctgctcatggtctgagcgagaagctgggctgcaaagtgctgctcaagcgggaagatcttcagccggttttctcgttcaagctgcgaggagcctacaacatgatttcgcagctgagtgacgaggaaaagtggaagggagtgattgcgtgtagcgccggtaaccatgcccaaggagtcgccttttcagccaactatctcaacattccagcgactattgtcatgccgttggccactccttccatcaagcacagtaatgtttctagactaggtggcaaggtggttttgcacggagacgattttgattcggccaaggcccactgcaagcagctgtgtgagaaatatggactcacagatatccctccctttgatcacccccacgtgattgcaggccagggaactattggtatggagattcttcgtcaggcgtcggacaacctgaaggccgtgtttatctgtgttggaggcggcggtctgattgccggagtaggcgcttacatcaagcggatccagcccgatgtcaaaatcattgccgtggagacctatgatgcatgtgctctgaaacagagtctcatcaagggcgaacgggtgactctgcctgaagtcggtctgtttgccgatggagctgctgtcaagctgtgtggcgaggagactttccgactctgtcgcaagtacgttgatggagttgtgcttgtgaacacggacgagatctgcgccgctatcaaagatgtatttgaggccactagatcggtggtggagcctgctggtgctctgtcggtggctggtctcaagaagtactgctccgacccctcggccatttggtggtcacctgagtccgattccgcaaaggccaatggtatccccactaacgttgccatctcagaaaccgacgagtatctgtcaattctctctggagccaacatgaactttgaccggcttcgattcgtggccgaacgagctatgcttggagaaggaaccgaagtcttcatggtcgtcaccatccccgatattcccggagcgtttgaaaagctgcacgagatcattctccccagagctgtcaccgagttctcctacagaaagaagtccactgctgagaacgaagacgctaacatttttgtgtctttttcagtcaaaaaccgacaagaggaaattgcagacgtgctggaaaagctgcaagctgccggtatgagcggagtcgacgtttcagacaacgaactggcaaagacccacgctagatatctcgtgggaggccagccagacgtgcctaatgagagactgttccggttcgagttccctgaacgacccaacgcgctcaaaaacttcctcggaggtgtccagacaaagtggaatatcaccctgttccactacagaaacaacggcagtgatattggaaagattctgacagccttggacgtgccggaaagcgacaatgaggcgctcaaggagtttcttgagaagctcaagtacccctttgtggaggagacagacaatgtggtgtacaagcagtttatgaagtaa

SEQ ID NO: 31528 - protein, 529 aa, Yarrowia lipolytica CLIB99
MSEPDYLKLILKSRVYDVCKETPVTSAHGLSEKLGCKVLLKREDLQPVFSFKLRGAYNMISQLSDEEKWKGVIACSAGNHAQGVAFSANYLNIPATIVMPLATPSIKHSNVSRLGGKVVLHGDDFDSAKAHCKQLCEKYGLTDIPPFDHPHVIAGQGTIGMEILRQASDNLKAVFICVGGGGLIAGVGAYIKRIQPDVKIIAVETYDACALKQSLIKGERVTLPEVGLFADGAAVKLCGEETFRLCRKYVDGVVLVNTDEICAAIKDVFEATRSVVEPAGALSVAGLKKYCSDPSAIWWSPESDSAKANGIPTNVAISETDEYLSILSGANMNFDRLRFVAERAMLGEGTEVFMVVTIPDIPGAFEKLHEIILPRAVTEFSYRKKSTAENEDANIFVSFSVKNRQEEIADVLEKLQAAGMSGVDVSDNELAKTHARYLVGGQPDVPNERLFRFEFPERPNALKNFLGGVQTKWNITLFHYRNNGSDIGKILTALDVPESDNEALKEFLEKLKYPFVEETDNVVYKQFMK

SEQ ID NO: 31529 - DNA, 990 bp, Yarrowia lipolytica CLIB99
  CDS (1)..(990)
atgcgaccaggctacattgaaacaccgctgctgaagaacgacatcttctcgcaccaggtcgggtgcaacgtgtacctgaaaatggagaacttgcagccctcagggtcgttcaaatcccgaggcatgacccaggtcatctccgatgcgctggactcagacccccaggcttctctagacactctccacgtgtgttccagctctggaggcaacgcagggctcgccgcagcagtcacctcgcgactcaatggtgtcgcgtgcacggtggttgtgccggaatcgactaaacctcgaatggtggagaaactgagagctgcaggagcagaagtgattgtgcacggaaaacactggtcagaagccaacgactttctgcaaaaggaagagatgccgcggctcgaaaagacgggaaaaacgccaatctactgccatccctttgacgctccagcggtgtggaagggaaactcgactctcatcgacgaaatcatcaagcagggaatcaccccagacgccgtcgtgtgcagcgtgggaggcggaggactgttcaacggagtagtcgagggccttaaacgacacaagctcaactgccccgtgattgtagtggaaacaaacggtgctgatgctctgagccggagtctacagaagggcgagcaggtcactctacctggaattacgtcaattgccacttctctgggagccgttcgagtcgctgacaagacgtttgaaaacgcccagacataccctactgtgtctgcagtcgtttcagatgacgacgcagtatcagctctggtggagtacgctgagaccaagcagatcatcgtggaacccgcctgtggagcttccctcgctgttctgcctgctctaaaggatctggttgatttgaaacctgattctaacgttgttgttgttctctgtggaggctcggctactggcatttctgatatcgcgcagttcaagaaagacttggaagcaaaggagacaactgaagagaagtag

SEQ ID NO: 31530 - protein, 329 aa, Yarrowia lipolytica CLIB99
MRPGYIETPLLKNDIFSHQVGCNVYLKMENLQPSGSFKSRGMTQVISDALDSDPQASLDTLHVCSSSGGNAGLAAAVTSRLNGVACTVVVPESTKPRMVEKLRAAGAEVIVHGKHWSEANDFLQKEEMPRLEKTGKTPIYCHPFDAPAVWKGNSTLIDEIIKQGITPDAVVCSVGGGGLFNGVVEGLKRHKLNCPVIVVETNGADALSRSLQKGEQVTLPGITSIATSLGAVRVADKTFENAQTYPTVSAVVSDDDAVSALVEYAETKQIIVEPACGASLAVLPALKDLVDLKPDSNVVVVLCGGSATGISDIAQFKKDLEAKETTEEK

SEQ ID NO: 31531 - DNA, 1179 bp, Canis familiaris
  CDS (1)..(1179)
atgcccactcacctggtggttcgagagttcagtgagaccccatacagcaacccttggcaggggatcgggcacaaacagacgctcaggcaaccgatgacgcctggagagcccctgcacgtgaagacccccatccgtgacagcatgtcgctgtccaaagtggcaggcaccagcgtctacctcaagatggacagtgcccaaccttcaggctccttcaagatccggggcattggacacctctgcaagatgtgggctgagcaaggctgtgaacatttcgtctgctcctcggcgggcaatgcaggcatggcagccgcctatgctgccaggaagctgggcatccctgccaccatcgttgtgcccagcaccacccctgccctcaccattgagcggctcaagaatgagggtgccatagtcaaggtggtgggtgagatgttggatgaggccttcgagctggccaaggccctggccaagaacaaccctggctgggtgtacattcctccctttgacgaccccctcatctgggaaggccacacttccatcgtgaaggagctgaaggagaccctgagtgcaaagccaggggccatcgcgctgtcagtgggcggtgggggcctgctgtgcggagtggtccaggggctgcaagaggtgggctggggggacgtgcctgtcatcgccatggagaccgccggagcccacagcttccacgctgccaccactgccggcaagctggtctccctgtcccaggttaccagcgtggccaaggccctgtgcgtgaagactgtgggggctcaagccctgaagctgtttcaggaacaccccatcttctctgaagtcatctcggaccaggaggctgtggctgccattgagaagttcgtggatgacgagaagatcctggtggagcccgcctgcggggcagccctggccgccgtgtacagccgcgtggtgcagaagctgcaaggggaggggaagctccaggccccgctgtcctccctcgtggtcattgtctgcgggggcagcaacatcagtctgagccagctgcgggcccctcaaggaacagctgggcatgaatgggctgcccaacctgtggcccggaccagccggttccctcctcgttcccatgagcccaccctgccaacaggccgcagctccgaggcggagccgggtcggcagccagcaaagctgtga

SEQ ID NO: 31532 - protein, 392 aa, Canis familiaris
MPTHLVVREFSETPYSNPWQGIGHKQTLRQPMTPGEPLHVKTPIRDSMSLSKVAGTSVYLKMDSAQPSGSFKIRGIGHLCKMWAEQGCEHFVCSSAGNAGMAAAYAARKLGIPATIVVPSTTPALTIERLKNEGAIVKVVGEMLDEAFELAKALAKNNPGWVYIPPFDDPLIWEGHTSIVKELKETLSAKPGAIALSVGGGGLLCGVVQGLQEVGWGDVPVIAMETAGAHSFHAATTAGKLVSLSQVTSVAKALCVKTVGAQALKLFQEHPIFSEVISDQEAVAAIEKFVDDEKILVEPACGAALAAVYSRVVQKLQGEGKLQAPLSSLVVIVCGGSNISLSQLRAPQGTAGHEWAAQPVARTSRFPPRSHEPTLPTGRSSEAEPGRQPAKL

SEQ ID NO: 31533 - DNA, 936 bp, Thermus thermophilus HB27
  CDS (1)..(936): transl_table=11
atgccttccctccaagacctctacgccgccttccgccgcatcgccccccacacccaccgcacccccctcctcacctcccgcctcctggacgggcttttgggaaagcgcctcctcctcaaggccgagcacctgcagaaaacggggagcttcaaggcccggggagcgctttccaaggccctcgccctggaaaaccccaaggggctcctcgccgtctccagcggcaaccacgcccagggggtggcctacgccgcccaggtgctcggggtgaaggccctggtggtcatgcccgaggacgcgagcccctacaagaaggcctgcgcccgggcctacggggccgaggtggtggaccggggggtgacggcggagaaccgggaggaggtggcccgggcccttcaggaggaaacgggctacgccctgatccacccctttgacgaccccttggttatcgccgggcaagggacggcggggcttgagcttctggcccaggcggggcggatgggggtcttccccgaggccgtcctcgcccccgtggggggcggggggctcctcgcgggcctggccacggcggtgaaggccctctcccccacgaccctcctcctcggggtggagcccgaggtcgcggacgacgccaggaggagcctggaggcgggaaggcttttccgcttggaagcgccccccaggacccgggcggacggggtgcggacgctaagcctgggggagcacaccttccccatcctcaaggagaaggcggacgggatccttgtggtgagcgaggaggcgatcctcgaggcggagcgcctcctcttcacccgcaccaagcaggtggtggagcccacgggggcccttcccctggccgcggtgctggagcacggggcgaggcttccccaaaccctcgccctcctcctctccgggggcaaccgggacttctctccctag

SEQ ID NO: 31534 - protein, 311 aa, Thermus thermophilus HB27
MPSLQDLYAAFRRIAPHTHRTPLLTSRLLDGLLGKRLLLKAEHLQKTGSFKARGALSKALALENPKGLLAVSSGNHAQGVAYAAQVLGVKALVVMPEDASPYKKACARAYGAEVVDRGVTAENREEVARALQEETGYALIHPFDDPLVIAGQGTAGLELLAQAGRMGVFPEAVLAPVGGGGLLAGLATAVKALSPTTLLLGVEPEVADDARRSLEAGRLFRLEAPPRTRADGVRTLSLGEHTFPILKEKADGILVVSEEAILEAERLLFTRTKQVVEPTGALPLAAVLEHGARLPQTLALLLSGGNRDFSP

SEQ ID NO: 31535 - DNA, 1269 bp, Listeria monocytogenes str. 4b F2365
  CDS (1)..(1269): transl_table=11
atggaattagttgatttattagtaacagaagaagatgtcgaaaaggcctatgaagtcttaaaggcggtcgtcaaacatacgccactagaatatgatttttatctttcggaaaaatatcattgcaatgtctatctgaaacgcgaagatttgcaaagagtgcgttcttttaaattacgtggtgctttttatgctatttctagattatcagcggaacaattggaaaaaggtgtggtatgtgcaagtgcgggaaaccatgcgcaaggagttgcatatacgtgcaaacgaatgaccgtcccagctacgatttttatgccaacgactacgccgcaacaaaaagtatcacaagtaaaatttttcggtggtagtaatgtcgaagtggttttagttggcgatacgtttgatgcttctgcaactgccgcgaaagaatttgctgcaacgcatggccaaactttcatccctccgtttgatgatcctgatattatcgctggccaaggctctcttgctgtggagatggtgaaagatttaaataaagcacatgagcaagcagattatgtttttgcaggaatcggtggtggtggcttaattagcggtgttgcaacgtatctcaaagcaaagagcccgattacaaaaatcatcggggtagaacctgatggcgcgccttcaatgacagcagctttaaaacaaaatcaagtcgtaacactagataaaatcgataaatttgttgatggcgctgcggtaaaagaagttggtggcttaacgttccaacatgcgaaagtattagttgatgaagtgacaaccgtctctgagggagctgtttgttctacgattttggatatgtatacgaagcaagcaattgttgcagaacctgctggagcactatccgttgccgcacttgaaatttaccgtgaagagattaaagacaagaccgttgtctgtattgtaagtggcggaaacaacgacatcaaccggatgcaagaaattgaagagcgttccctcttacacgaaggattaaaacattattttatcgtcaatttctcgcagcgtcctggggctttgaaagaatttgttaacgatgtgctcggtccacatgacgatatcaccaaattcgaatatacgaaaaaagtgaatcgaggtaatgggcctgtaattatcggtgttttgttgcaagataaaaatgattatgaaggattgcttgagcgggttgctgcttttgacccgagctatattccgattaatgataatcaaaccctatacacattacttgtataa

SEQ ID NO: 31536 - protein, 422 aa, Listeria monocytogenes str. 4b F2365
MELVDLLVTEEDVEKAYEVLKAVVKHTPLEYDFYLSEKYHCNVYLKREDLQRVRSFKLRGAFYAISRLSAEQLEKGVVCASAGNHAQGVAYTCKRMTVPATIFMPTTTPQQKVSQVKFFGGSNVEVVLVGDTFDASATAAKEFAATHGQTFIPPFDDPDIIAGQGSLAVEMVKDLNKAHEQADYVFAGIGGGGLISGVATYLKAKSPITKIIGVEPDGAPSMTAALKQNQVVTLDKIDKFVDGAAVKEVGGLTFQHAKVLVDEVTTVSEGAVCSTILDMYTKQAIVAEPAGALSVAALEIYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLERVAAFDPSYIPINDNQTLYTLLV

SEQ ID NO: 31537 - DNA, 1206 bp, Picrophilus torridus DSM 9790
  CDS (1)..(1206): transl_table=11
atggaattcgatgatatattatatgcaaaatcagttgtatcaaggtatctgcacaggacgcctgtttttcattcaaagaccttcagcgacatgttccacggagatatattttttaaaatggagaatttccagaagaccggctcatttaaatcaaggggtgcagttacaaagttctcaaggttaagcgatgaggaactaaaaaacggtgtcataacggcaagcgctggaaaccatgcgcagggcgttgcatatgccgcatcgatctttaaaacagatgcaaagatagtaatgcctgaaaacacaacaccggcaaaggtaaacgctgttgaggcatacggcggccatgtgatactaaccgggagatcatacgatgaatcacatagccatgcattaaaaatagcaatggatgaaaatagaacatttatagaggcatacaatgatgaggccattatagcaggccagggtacaatagcacttgagctctttgaggatcttggaaatcttgatcagataatagtgcccattgggggtggcggtttaatatccgggatagcctttgccgcaaagcacataaatccaaatgtaaaaatcataggggtcgaatcagaaaaggcaaatgcaatgatgctatcattaagggaaaacagaatagttccatacacaagctctgatacaatagccgatggcatagccgtgaaatatcccggggatataacatttgacattgtaaaaaactatgttgacgatgttgttacagtaaatgatgaaagcatagcctattcattgtttaaactgcttgagcgtgaaaaggttcttgttgagccatccggggcagttggtcttgccgcactctacgagggtaagatagactcagaatcaaagaaaactgcaataatactatcaggcggaaacataaattttctgctgctatcaaaaattatatacaaatccatggagatggagaataaattaataaggcttgagttcaaccttcctgacaggccgggaaccatggtaaaaatagtaaacgcaatatcaagcgttggcgcaaatatataccatgccgaggtcgataatttaaaaaagaacacgcctataggctatcaaaatcttacatttaccgtaaacatagttgacgcaaatagaatagaaaaactattgaacgcactggactcccttggatataaatataatataataaattaa

SEQ ID NO: 31538 - protein, 401 aa, Picrophilus torridus DSM 9790
MEFDDILYAKSVVSRYLHRTPVFHSKTFSDMFHGDIFFKMENFQKTGSFKSRGAVTKFSRLSDEELKNGVITASAGNHAQGVAYAASIFKTDAKIVMPENTTPAKVNAVEAYGGHVILTGRSYDESHSHALKIAMDENRTFIEAYNDEAIIAGQGTIALELFEDLGNLDQIIVPIGGGGLISGIAFAAKHINPNVKIIGVESEKANAMMLSLRENRIVPYTSSDTIADGIAVKYPGDITFDIVKNYVDDVVTVNDESIAYSLFKLLEREKVLVEPSGAVGLAALYEGKIDSESKKTAIILSGGNINFLLLSKIIYKSMEMENKLIRLEFNLPDRPGTMVKIVNAISSVGANIYHAEVDNLKKNTPIGYQNLTFTVNIVDANRIEKLLNALDSLGYKYNIIN

SEQ ID NO: 31539 - DNA, 1149 bp, Picrophilus torridus DSM 9790
  CDS (1)..(1149): transl_table=11
atgagtgtcttaaaatgcccggtatgcgggaacgaatatgatataaacagaagcaattatctctgcgataaatgcggaaacatacttgaggtaattcatgaaaatgattttgtaaaagaaaattttaggggtgtctggaggtacaaaagcattatacatccgggcatagataaaaggctaattgttacaaggggtgagggcaatacctttgtgtacggtcatgaaaatatatcatcatattcaggaataaaaaatataaaactgaagcatgagggtgaaaatccaacaggttcatttaaggatcgtggcatgacagttgcagtatccgaggccatgaggctcggatataaaaagaccctatgcgcatcaaccggaaatacatccgcatctgctgcaagctattctgcaatggcaggcattgaaaacttcgtcctgataccagatggtaaaatagcggtaaacaagcttgcccaggcctacgtttatggttcaaaaataataaaggttcctggcaatttcgacgatgcaatggggaagctaatgaacataatatctaaaaataataatttttatgttttaaattcaataaatccctggcgtgttgagggtcaaaaaaccattgcctttgagatacttgaggaaaatgagccggactttatagcactacctgcaggaaaccttggaaacacaacggcaataggcaaggcaataaaggaatttcatgatcttggtttaataaaaaagataccaagaatcgtttcagttcaggccgagggcgcaagcccattctataaccttgtcaataaccatgagggcagtcttaatccggtaaatcctgaaacaattgcatcggcaataagaataggaaaccctgtcaactggaaaaaggcattaaaatacataaaattcacaaaaggtatagtcgagaaggttacagatgacgagatactaaatgcaaaaagaattatagacagatccggaataggctgtgaaacggcctctgccgcatcacttgcaggtgtaaaaaagctctcagatgcaggtataatagacagaaacgatgaggttttttgtatattaaccggaaacgttttaaaggatatacatatagaaaatataaattccatggatattaatattttatcttaa

SEQ ID NO: 31540 - protein, 382 aa, Picrophilus torridus DSM 9790
MSVLKCPVCGNEYDINRSNYLCDKCGNILEVIHENDFVKENFRGVWRYKSIIHPGIDKRLIVTRGEGNTFVYGHENISSYSGIKNIKLKHEGENPTGSFKDRGMTVAVSEAMRLGYKKTLCASTGNTSASAASYSAMAGIENFVLIPDGKIAVNKLAQAYVYGSKIIKVPGNFDDAMGKLMNIISKNNNFYVLNSINPWRVEGQKTIAFEILEENEPDFIALPAGNLGNTTAIGKAIKEFHDLGLIKKIPRIVSVQAEGASPFYNLVNNHEGSLNPVNPETIASAIRIGNPVNWKKALKYIKFTKGIVEKVTDDEILNAKRIIDRSGIGCETASAASLAGVKKLSDAGIIDRNDEVFCILTGNVLKDIHIENINSMDINILS

SEQ ID NO: 31541 - DNA, 1266 bp, Bartonella henselae str. Houston-1
  CDS (1)..(1266): transl_table=11
atgagtaaatttattcaagatgtaaacaaggctatggtggctttgcataatgtatttgctgaaacacctcttcaaagaaatgattttcttagtcaaaaatatgatgcagaaatttatttgaaacgtgaagatttaactccggtgcgatcttataaaattcgcggtgcttttaattttgtttcagaaatgcttagtaagatatctcaaaatgcagcatttgtttgtgcgtcagcggggaatcacgcgcaaggggtttcatttgtttgtcgctattttaaacgtaaaggcgtgatttttatgcctgtgacgactccgcaacagaaaattgataagacgcgcgtttttggcaaagagtttgttgatatccgtttaattggtgaaacgtttgaccaatgttatgcggcagcacaatcttttgctacggagagtggtggtgttatggcaccgccttttgacgatactcgcattattacggggcaggcgacagttttgtgtgaggctgttttgcaatggaaaaaactcaatggtgaaagcgagccagatttgattcttgttcctgtaggtggaggtggtttggccagtggtgtgagcaagtttttacatgaatatggttggaaaaccgagcttcgctttgttgagccgaagagagctgcaagcttgttcgcttgtttgaagagtggaaaacgtgtcaaacttgaaaatatcgatacatttgtagatggagctgctgtagcggaaattggtgcattaaattacacaatgctgaagaatttttcaccagattctgttattacagttcctgagaaccgtgtgtgctctacaatggttgaaatgctcaatgttgaaggtgtggtccttgaaccagctggtgctttatcgattgatgctcttaatagtcttcctcctcaagagttaaaaggcaaaaaaattcttcttgttatttcaggtggtaattttgattttgagcgtttgccagatattaaagaacgttctctccgttttcagggattgagaaaatattttatttttagttttccgcaacatcctggtgcgttgcgtagttttcttgctcaactttctcccgatgatgatatcgtacgttttgaatatcttaagaaatcatctagaagttttggctctgtgttgattgcaattgagacaaaaaaatatgataatttttgtcttttagagaaaaaatttcaagagttaggttggcgctatcgtgatattaccgatgatcaaacgttatttgattttgttatctga

SEQ ID NO: 31542 - protein, 421 aa, Bartonella henselae str. Houston-1
MSKFIQDVNKAMVALHNVFAETPLQRNDFLSQKYDAEIYLKREDLTPVRSYKIRGAFNFVSEMLSKISQNAAFVCASAGNHAQGVSFVCRYFKRKGVIFMPVTTPQQKIDKTRVFGKEFVDIRLIGETFDQCYAAAQSFATESGGVMAPPFDDTRIITGQATVLCEAVLQWKKLNGESEPDLILVPVGGGGLASGVSKFLHEYGWKTELRFVEPKRAASLFACLKSGKRVKLENIDTFVDGAAVAEIGALNYTMLKNFSPDSVITVPENRVCSTMVEMLNVEGVVLEPAGALSIDALNSLPPQELKGKKILLVISGGNFDFERLPDIKERSLRFQGLRKYFIFSFPQHPGALRSFLAQLSPDDDIVRFEYLKKSSRSFGSVLIAIETKKYDNFCLLEKKFQELGWRYRDITDDQTLFDFVI

SEQ ID NO: 31543 - DNA, 1539 bp, Acinetobacter sp. ADP1
  CDS (1)..(1539): transl_table=11
atgctgtctcgtttggttcgacaaattttacaagcaacggtatatgacgttgcaatcgaaactccactcgaagcagcgccacgaattagtgaaaaactaaacaacaatattcgctttaaacgcgaagaccttcaacccgttttctctttcaaactacgcggtgcttataaccgtattagtcaattaccgaaatctcagttggaacgtggcgttattactgcttcagcaggtaaccatgctcaaggtgtggctttatctggtcaaaagctggggattcgcgccattatcgtgatgccaaaaacaacgccagatattaaggtacaagcagttaaacgtttgggtggcgaagtggttttgcatggtgattcttttgatgttgccaataaatacgcgattcagcgtgcgcaagatgaaggtatgacttttattccgccatatgatgatgaattggtgatggcaggtcagggcacgattgccaatgaaattctgcgtcagtggcgtgatgttgaatatgtatttgttgccgtaggtggtggtggactcattgcaggcgttgcagcgtatttgggtgatgttgctcctcacgtaaaaatcattccagtcgaatatgatgaatctgcttgcctgaaagccgcattcgaacacaatgaacgtgttattttgccacaagtcggtttatttgcagatggtactgcggttgcacaaattggtgaaaaaccctttgaagtaattcagcttcaaaaatcagataactctggtccaattgttgaacgcgatgtgatcttggtcaataccgatgaaatttgtgctgccatcaaagacacttttgatgaatgccgtagcattgtagaaccatctggtgcaatggcgctggcaggtatcaaaaaatatatcgaacaacatcaaattacagataaaaatatcgtttcgattgtttgcggtgcaaacatgaattttgaccgattgcgttatattgctgaacgtacagaacttggcgaacgtaaagaggccatttttgctgtcaccattcctgaacaaaaaggcgcctttttaaatttctgccgtgcattacatggacgcaatattacagaatttaactatcgtgcaagcgatagcgatgatgctcaagttttcgtcggaatcagtttaaaatctggcgaaaaagaacgtcatgacattcacgagttacttaaaagccaatataatgttgatgatttatccgatgacgaagttgctaagctgcatattcgctatcttatcggtggtcatgccaatatcgaaaatgaacgcttgtttcgtgttgaatttccagagcgacccggtgcacttctaaccttccttgaacgccttggacctagtcataatattagcctgttccattatcgtaatcacggtgctgccgaaggacgtgtattggtaggtttacaggctaccgatacgcaagaaaacccagatgtactaattgaaacattggaaaatattacttatccatatgaagaaattacacacaatgtgggttataaacgctttttgcagtaa

SEQ ID NO: 31544 - protein, 512 aa, Acinetobacter sp. ADP1
MLSRLVRQILQATVYDVAIETPLEAAPRISEKLNNNIRFKREDLQPVFSFKLRGAYNRISQLPKSQLERGVITASAGNHAQGVALSGQKLGIRAIIVMPKTTPDIKVQAVKRLGGEVVLHGDSFDVANKYAIQRAQDEGMTFIPPYDDELVMAGQGTIANEILRQWRDVEYVFVAVGGGGLIAGVAAYLGDVAPHVKIIPVEYDESACLKAAFEHNERVILPQVGLFADGTAVAQIGEKPFEVIQLQKSDNSGPIVERDVILVNTDEICAAIKDTFDECRSIVEPSGAMALAGIKKYIEQHQITDKNIVSIVCGANMNFDRLRYIAERTELGERKEAIFAVTIPEQKGAFLNFCRALHGRNITEFNYRASDSDDAQVFVGISLKSGEKERHDIHELLKSQYNVDDLSDDEVAKLHIRYLIGGHANIENERLFRVEFPERPGALLTFLERLGPSHNISLFHYRNHGAAEGRVLVGLQATDTQENPDVLIETLENITYPYEEITHNVGYKRFLQ

SEQ ID NO: 31545 - DNA, 1005 bp, Erwinia carotovora subsp. atroseptica SCRI1043
  CDS (1)..(1005)
atgacaagcaaataccaaagagcaaccgactctgtaacgttgaaagatatttacacggcatctcagcagattaaaacgacgatacgcagaacgccgctagaccgctcgcaggaattatccgctcttgttggtgcagaaattcggctcaagatggaaaacctccaacagaccggtagcttcaagttacgtggcgcggcaaacgttcttgccaatctgggtgcagaacaacgccgtattggcgtcatcgccccaacggcaggaaatcacggattagggctcgcctatgccggacaagtggcgggcgtccccgtaaccatctttttgccacgctcagcagacccgatgaaagtcgcggccatgaaaggttgtggtgcccacattacgttttttgatgacatcgaagaagcgaggcaggcggcaatagcagcagcgcaacagtctagtgctaccttcgtttcagcctacgataatccgcatatgattgctggtggcggcaccgtcggccttgagattatggaagactggatggatgcagagataatcctggtgaatatcggcggcggcgggcttatttcggggattgcgacggcagtaaaagcaatcaaccccgcgatcgaagtatgggggatacaaagtgaagtcagcccgacatttgcccgttggaaagacgccggtgaaacgcttcccgtcgaactgactccctccatcgctgagggcgttagcggctatattgagcccagtgcgatgacctggccgctggttcgtgaccgtgtcgatcgcgtgctcacggtatcagaagttgaaatcaaagccgcaatgctgtcaatgctcgaacttcaccgtcatgttgtcgaaccttcaggggtgccagccgtcgcgggagccattcgctacgcgaaggagattgggggacgtaaaaccgtctgcgttgtcaccggtaggaacatttcgagttcacgttatctcacgctgcttaatgaggcgacggccggtgtagataagtag

SEQ ID NO: 31546 - protein, 334 aa, Erwinia carotovora subsp. atroseptica SCRI1043
MTSKYQRATDSVTLKDIYTASQQIKTTIRRTPLDRSQELSALVGAEIRLKMENLQQTGSFKLRGAANVLANLGAEQRRIGVIAPTAGNHGLGLAYAGQVAGVPVTIFLPRSADPMKVAAMKGCGAHITFFDDIEEARQAAIAAAQQSSATFVSAYDNPHMIAGGGTVGLEIMEDWMDAEIILVNIGGGGLISGIATAVKAINPAIEVWGIQSEVSPTFARWKDAGETLPVELTPSIAEGVSGYIEPSAMTWPLVRDRVDRVLTVSEVEIKAAMLSMLELHRHVVEPSGVPAVAGAIRYAKEIGGRKTVCVVTGRNISSSRYLTLLNEATAGVDK

SEQ ID NO: 31547 - DNA, 975 bp, Erwinia carotovora subsp. atroseptica SCRI1043
  CDS (1)..(975)
atgagcgacttacgcctcccaaccttcgacgatgtggtagccgcagcggaacgcattgatggctatgccaataaaacgccagtgatgacatcacgcacggtcaatgatgccttcggcgcagaggttttcttcaagtgtgaaaactttcagcgtatgggcgcattcaagttccgcggagccatgaacgcgctgttgcagttctcagatgagcagaaagccgcaggcgtggtcaccttttcttccggtaaccatgcgcaggccattgccctttccgccaaattacttggcattccggcaacgatcgttatgccgcacgatgcacccgcagcaaaggtcgctgcgacacgtggctatggcggaaacgtggtggaatataatcgatataccgaagatcgtgagcagatcggtagagatctggctgaaaagcagggtctgacgctcattcccccttatgaccacccgcacgtcattgcaggacaaggtacggctgcgaaagagctgttggaagaaaccggtgagctggacgccctgttcgtctgcttgggcggcggtggattgttggcaggttccgcactgtccgcgcgtcagctgtctccacgctgtaaaatttatggcgtcgaacctctcgcgggcaacgacgggcagcaatctttccgcagcggcaatattgtgcatatcgatacgcccaaaaccatcgccgatggcgcacagactcaacatctgggcaactataccttcccgctgattcgccagaacgtcgacgatattctgaccgtgacggatgacgacctgattgacgcaatgcggttttacgctgagcgcatgaagatcgtcgttgagccgacggggtgcctcagttttgcggcggcgcgtaatctcagggaatcactacacggcaaacgtatcggtatcattatcagcggcgggaatgtcgatatcagccgctacggcgcatttctgaccggcagcgtttga

SEQ ID NO: 31548 - protein, 324 aa, Erwinia carotovora subsp. atroseptica SCRI1043
MSDLRLPTFDDVVAAAERIDGYANKTPVMTSRTVNDAFGAEVFFKCENFQRMGAFKFRGAMNALLQFSDEQKAAGVVTFSSGNHAQAIALSAKLLGIPATIVMPHDAPAAKVAATRGYGGNVVEYNRYTEDREQIGRDLAEKQGLTLIPPYDHPHVIAGQGTAAKELLEETGELDALFVCLGGGGLLAGSALSARQLSPRCKIYGVEPLAGNDGQQSFRSGNIVHIDTPKTIADGAQTQHLGNYTFPLIRQNVDDILTVTDDDLIDAMRFYAERMKIVVEPTGCLSFAAARNLRESLHGKRIGIIISGGNVDISRYGAFLTGSV

SEQ ID NO: 31549 - DNA, 1551 bp, Erwinia carotovora subsp. atroseptica SCRI1043
  CDS (1)..(1551)
atgctgatggctgtgtcacaacctcttcctgccgcgccgggaggcgcggagtacctgcgcgcgatcttgcgctcgccagtgtatgaaatcacgcaggtcacgccgctggagaagatggataagctctcttcgcggctgggtaatgtcattctagtaaaacgtgaagaccgacacgcggtgcacagctttaagctgcgtggcgcgtacgcaatgatggcgggtctgagcgatgaacagaaatcgcacggcgtggtgacggcgtcagccggtaaccatgcgcaaggtgttgcactctcctccagcaagctggggattaaatcgctgattgtgatgccggtggcgacagccgacatcaaggtggatgcggtgcgtggttttggcggagaagtgctgctacacggcgctaactttgatgaagccaaagccaaggcgattgagctgtcagagcaacaacatatgacttttctgccgccgttcgatcaccctgcggtgattgccgggcagggcacgctggcgatggagttgttacagcaggatgcgcatctggatcgcgtgtttgtgccagttggtggtggtggcttggcggcaggcgttgccgtactgattaaacagctgatgccgcagattcaggtgatcggcgtggaagcggaagattccgcctgtctgcgcgcggcgctggatgctgggcaaccagtcgatctgccgcgtgtcgggctgtttgccgaaggcgtggcggtgaagcgcatcggcgatgaaacgtttcgcctatgtcgggaatatctggatgacgtgattaccgtcgacagcgatgccatctgtgcggcagtgaaagatctgttcgaagatgtccgcgcgattgctgaaccgtctggtgcgctggcgttggcggggatgaaaaagtacatccaacagcatcagattcagggtgagcgcttggcgcatgttctgtccggtgcgaacgttaacttccacggattacgttacgtttccgaacgctgcgagctgggcgaacagcgcgaagccttgctggctgtgacgatccctgagcaacagggaagcttcctgaagttttgccaactgttgggtggtcgttctgtcacggagttcaactatcgctacgcggatgccaaagacgcctgcatttttgtcggtgtgcgcttgacgcgcggctatgcggaacggcaggagatcatcgctgagctttccgcagacggttatgaagtagtggatttgtccgatgatgaaatggcgaagctacacgttcgctatatggtcggcggacgtccttccaaaccgttgcaggaacgtctgtacagctttgaattcccagagtcgccgggtgcattactgaaattcctgcatacgctgggggcgcactggaatatttctctattccattaccgcagccacggcacggattttggccgcgttctggctgggttcgagctggaggcgggcgatcgggagtttgagcagcacttgctggcgctgggctatgaatgccatgacgaaaccaataacccggcattccgcttctttctagcgggttaa

SEQ ID NO: 31550 - protein, 516 aa, Erwinia carotovora subsp. atroseptica SCRI1043
MLMAVSQPLPAAPGGAEYLRAILRSPVYEITQVTPLEKMDKLSSRLGNVILVKREDRHAVHSFKLRGAYAMMAGLSDEQKSHGVVTASAGNHAQGVALSSSKLGIKSLIVMPVATADIKVDAVRGFGGEVLLHGANFDEAKAKAIELSEQQHMTFLPPFDHPAVIAGQGTLAMELLQQDAHLDRVFVPVGGGGLAAGVAVLIKQLMPQIQVIGVEAEDSACLRAALDAGQPVDLPRVGLFAEGVAVKRIGDETFRLCREYLDDVITVDSDAICAAVKDLFEDVRAIAEPSGALALAGMKKYIQQHQIQGERLAHVLSGANVNFHGLRYVSERCELGEQREALLAVTIPEQQGSFLKFCQLLGGRSVTEFNYRYADAKDACIFVGVRLTRGYAERQEIIAELSADGYEVVDLSDDEMAKLHVRYMVGGRPSKPLQERLYSFEFPESPGALLKFLHTLGAHWNISLFHYRSHGTDFGRVLAGFELEAGDREFEQHLLALGYECHDETNNPAFRFFLAG

SEQ ID NO: 31551 - DNA, 1251 bp, Leifsonia xyli subsp. xyli str. CTCB07
  CDS (1)..(1251): transl_table=11
gtgaccgatcccacgcgcaccccgttcgccggccccagcctggccgctttcgaggctgcgcgcgcgatcgtggcgacggtggcccagccgaccccgctggagagctcccgctatctcgcgggcgtgctcggtgcgcccgtcctgctgaagtgcgagaatctgcaacgcaccggctcctacaagatccgtggcgcctacaaccgcatgtccaagcttaccgccgaggaacgtaatcgtggggtcgtcgccgcctccgccggaaaccacgcacagggcgtggccttcgcggcccgggagctcggcatccacgccacgatcttcatgccggtcggtgtggccatccccaagttccaggcgacgcgggcgtacggcgctgatgtggtcctgagcggcagcattgtggatgaggcgctgcgcgcggcggcggatttcgcggccgagaccggcgctgtgctcatcccgccgttcgaccacccggacgtggtggccggtcagggcacgctcggcctcgagatcctcgacgaggtccccgacgtgagcacgatcgtcgtcccgatcggtggtggcggactcatctccggcatcgccagcgcggtcaagcagcgttccgcacgcgagggccgcacggtgcgcgtgatcggcgtgcaggccgccaacgccgccgcctacccgccctcactcgaagccggcgcccccaccgagatctccctcgtcgcgaccatcgccgacggcatcgccgtcagccgcccgggcgcgctcaacttccagatcgttcaggacgcggtggatgccgtggtcacggtcaccgaggacgacatcgcccgagccctcctcgtcctcctcgaacgcgcgaagctcgtggtcgagcccgccggggccgcggccgtcgccgccgtcctcgccgggcacatccccgccgatggcacgacggtcgtcatcctctccggtggcaacatcgacccgttgctgatgcagcgtgtgatcagccacggtctcgccgcctcagaccgctacctcaagctgtcgatcatgctgcccgaccggccgggccagctggctcgcatcgcggagatcctcgcgggcgtcaacgcgaatgtggtcgaagtgctgcacacccggcatggccgcgggctgcagctcagtcaggtcgaactcgatgtctccgtggagacccgcggctccgagcaccgtcagcaggtcatctccgttctccgcgccgcgggatacgatccggtcctcgaagaggactga

SEQ ID NO: 31552 - protein, 416 aa, Leifsonia xyli subsp. xyli str. CTCB07
MTDPTRTPFAGPSLAAFEAARAIVATVAQPTPLESSRYLAGVLGAPVLLKCENLQRTGSYKIRGAYNRMSKLTAEERNRGVVAASAGNHAQGVAFAARELGIHATIFMPVGVAIPKFQATRAYGADVVLSGSIVDEALRAAADFAAETGAVLIPPFDHPDVVAGQGTLGLEILDEVPDVSTIVVPIGGGGLISGIASAVKQRSAREGRTVRVIGVQAANAAAYPPSLEAGAPTEISLVATIADGIAVSRPGALNFQIVQDAVDAVVTVTEDDIARALLVLLERAKLVVEPAGAAAVAAVLAGHIPADGTTVVILSGGNIDPLLMQRVISHGLAASDRYLKLSIMLPDRPGQLARIAEILAGVNANVVEVLHTRHGRGLQLSQVELDVSVETRGSEHRQQVISVLRAAGYDPVLEED

SEQ ID NO: 31553 - DNA, 1506 bp, Desulfotalea psychrophila LSv54
  CDS (1)..(1506): transl_table=11
atgaaaaaaataattcgtgacatcctcacctcccgggtctatgaggcagcggtggagacaccacttgaacaggcagtacaactctcccaccaactcggaaacaaaatccttctaaaaagagaagatcaacaaccggtattctcctttaaaatacgcggcgcttacaataaaattgcccatctgagcgaagaggagcgagcacggggggttattaccgcctcggcgggaaatcatgcccaaggcgtggcctattctgccaagaaactcggcatctcagccctgatcgttatgcccaccaccacccctaagatcaaggtagatgcagttcgccgtatgggcggccaggttatcctccacggcgacaactactccgaggcagccacccacaccgaacagatcatggcggagacaggtagatactatatccccccctttgacgatgagttggtcattgccggtcaaggcactattgccgatgaaattcttcgccaaaatcccggaaaaattgacgcaatttttattcccgtgggtgggggcggactcattgccggcattgccgcctatatgaaaaatctccgtcctgagatcaggataatcggggtagagccgaccgatagcaatgccatgcactgctcccttaaggcgggtaaacgggtggaactctccaccgttggtatctttgccgatggcgttgccgtacggaaggttggagagcaaacctttgccctctgccaggagtatgtagatgagatcatcgaaatcagcagcgacgaactctgcagtggtatcaaggccatctaccaggcgacccgctccattgtcgaacctgcaggcggccttggcatggccggtctcttaaaatatatccgggagacaggctgcaaggacaagactcttattgccattaattccggagccaatatgaactttgagcgcctgcgttacgttgccgagcgcaccctgatcggggaggagcaggaggcactttttgcggtaaccatgcctgaagaggcgggaagcctgaaaacattctgccagaggatagttgaaaaacgaaatatcaccgaattcaactatcgccatatctctccagaaaaggcacatatctttgtcggtatctccatagaacaggcaaaagaacgacaagagttcagccaacagctcacggcagccggttatgaaaatatcgatctgaccgataacgatcttgccaaaaaccatatccgctatatggtgggtggcaaaccggcaagcgtccaagaggagagactctttcgtttctggtttcctgaaacacccggagcccttgtccgttttctcgacgccacccgtggcgcactctccatctccctcttccactaccgcatgcagggtggaaattatagccgggtacttgttggctttaactcctgccgggatgacgatgagctattggagagattagatatactgggctaccgctttaaagaagagacagacaatcccgcatacaagatgtttttatag

SEQ ID NO: 31554 - protein, 501 aa, Desulfotalea psychrophila LSv54
MKKIIRDILTSRVYEAAVETPLEQAVQLSHQLGNKILLKREDQQPVFSFKIRGAYNKIAHLSEEERARGVITASAGNHAQGVAYSAKKLGISALIVMPTTTPKIKVDAVRRMGGQVILHGDNYSEAATHTEQIMAETGRYYIPPFDDELVIAGQGTIADEILRQNPGKIDAIFIPVGGGGLIAGIAAYMKNLRPEIRIIGVEPTDSNAMHCSLKAGKRVELSTVGIFADGVAVRKVGEQTFALCQEYVDEIIEISSDELCSGIKAIYQATRSIVEPAGGLGMAGLLKYIRETGCKDKTLIAINSGANMNFERLRYVAERTLIGEEQEALFAVTMPEEAGSLKTFCQRIVEKRNITEFNYRHISPEKAHIFVGISIEQAKERQEFSQQLTAAGYENIDLTDNDLAKNHIRYMVGGKPASVQEERLFRFWFPETPGALVRFLDATRGALSISLFHYRMQGGNYSRVLVGFNSCRDDDELLERLDILGYRFKEETDNPAYKMFL

SEQ ID NO: 31555 - DNA, 1002 bp, Rickettsia typhi str. Wilmington
  CDS (1)..(1002): transl_table=11
atgaatttattactacaatctcctcaaaatgtagcaatcgcacataatagaataaaacaatatataaatttaacaccgataattcactctgaaagcttaaatgagatgctaggtcatgagattttttttaaggttgaatcattacaaaaaactggagcatttaaagttagaggagtattaaataatttgttagaattaaaagaacaagaaaaattaccgaataaaatagtttgttatagtagtggtaatcatggcattggccttgcttattcaagtaaattatttggtattaaaacaagaatttatttaccgttaaatacttcaaaagtaaaactgcaagcagctctttattacggatgtgaagttatatacacaaatactcggcaagaagcagaatcaagagcaaaggaagatgaagaacaaggattctactatatgcacccttctgatagtgattctataatagcaggagcaggcacgttatgctatgaagcattacagcaattagattttattcctgatgctatttttgcatcttgcggcggcggaggtttaatttctggctcatatcttgctaaagaattaatatcacctacaagcttattaataggttcagaaccagctgcagctaatgatgcttatttatcgattaaaaataataatatatatagatttaatgacacaccaataaccattgcagatggtcttaaaactttaagtgtatcagctcgtacatttgaatatttaaaaaaacttgaccatttttatttagcagaagaatatgaaatatattactggacagcgtggcttattcatttactgaaagttatatgcgagccatcaagtagtataaatatggtttcagtaataagttggttaaaaacacaaaccagaacacagaaactactagtattaatctcaggcggcaatatcgaccctactctttataatgagttatggcaagatgattatttaactgttccaccaagcattagtaactaa

SEQ ID NO: 31556 - protein, 333 aa, Rickettsia typhi str. Wilmington
MNLLLQSPQNVAIAHNRIKQYINLTPIIHSESLNEMLGHEIFFKVESLQKTGAFKVRGVLNNLLELKEQEKLPNKIVCYSSGNHGIGLAYSSKLFGIKTRIYLPLNTSKVKLQAALYYGCEVIYTNTRQEAESRAKEDEEQGFYYMHPSDSDSIIAGAGTLCYEALQQLDFIPDAIFASCGGGGLISGSYLAKELISPTSLLIGSEPAAANDAYLSIKNNNIYRFNDTPITIADGLKTLSVSARTFEYLKKLDHFYLAEEYEIYYWTAWLIHLLKVICEPSSSINMVSVISWLKTQTRTQKLLVLISGGNIDPTLYNELWQDDYLTVPPSISN

SEQ ID NO: 31557 - DNA, 963 bp, Yersinia pseudotuberculosis IP 32953
  CDS (1)..(963): transl_table=11
atgaatacgttgtttgatgccatcagagaggcccaccagatattacgcccacaagtgagagtcacgccgttggagcatagcccactgctatctcaacacagcggttgtgagatctatcttaaatgtgagcacctgcagcacaccggttcttttaaatttcgtggggccagtaacaagttacgtttactcaatgaggcacaacgccagcaaggtgtgatcaccgcctccaccggtaaccatgggcaaggtgtggcgctggccgcaaaactggcggggattaaatccactatttacgccccagaacaggcggcagccatcaagctggatgtgatccgtgcactgggggggcaaattgaattagtctccggagatgccttaaatgctgaactggccgccggtatcgccgctgagcaacaaggtaaagtgtatatctcaccgtataacgacccgcaggtcattgccgggcaaggcacctgtggcatggagatggtcgaacagcagcccgagcttgatgcggtgtttgttgccgttggtggtggtggcctgatttcaggtattgcgaccgtattgaaaacattatcggataaaacgcaggtgattggttgctggccagccaatgccaccagcctgtatacctgtctggagaaaggacagattcaggaggtggcagagcaagaaacgctgtctgacggaaccgccggtggtatcgaaccgggagcgatcacctttgcactgtgccaacagttaatcgatcagaaggtgctggtgagtgagcaagaaatcaaagaggccatgggtttgattgcccgtactgaccgctggatgattgaaggtgccgccggtgtggcactggctgcggcactgaaattggctccgcaatggcaaggtaagaaagtggcggtggtgttgtgcggtaaaaatatcgtgctggagaaatatctgggagctgtcagcggatgctaa

SEQ ID NO: 31558 - protein, 320 aa, Yersinia pseudotuberculosis IP 32953
MNTLFDAIREAHQILRPQVRVTPLEHSPLLSQHSGCEIYLKCEHLQHTGSFKFRGASNKLRLLNEAQRQQGVITASTGNHGQGVALAAKLAGIKSTIYAPEQAAAIKLDVIRALGGQIELVSGDALNAELAAGIAAEQQGKVYISPYNDPQVIAGQGTCGMEMVEQQPELDAVFVAVGGGGLISGIATVLKTLSDKTQVIGCWPANATSLYTCLEKGQIQEVAEQETLSDGTAGGIEPGAITFALCQQLIDQKVLVSEQEIKEAMGLIARTDRWMIEGAAGVALAAALKLAPQWQGKKVAVVLCGKNIVLEKYLGAVSGC

SEQ ID NO: 31559 - DNA, 1200 bp, Symbiobacterium thermophilum IAM 14863
  CDS (1)..(1200): transl_table=11
atggcccgctggcacggtgtcatccggcagtaccaacgttttctgcccgtgagcgagaggaccccggtggtgacgctgctggagggcaacaccccgctggtgccggcgccccggctgggggcggagctggggctcgatctctacctgaagttcgaggggctgaaccccaccggctccttcaaggaccgggggatgaccctcgccatgtccaaggcggtcgaggcgggggcgaaggcggtgatctgcgcctccaccggcaacaccagcgcctccgcggcggcctacgccgcccgggcggggctgccctgctacgtcgtcatccccgacggcgcggtcgccatgggcaagctcgcccaggcgctgatgtacggcgcccgcacgattcagatcgagggcaacttcgacgacgggctccggctggtgcgccgcctgacccaggagcacccggagatcgcgctggtcaactcggtcaacccgtaccggctccaggggcagaagaccgccgccttcgaggtggtggacgccctggggggctaccccgatttcctggcgatcccggtgggcaacgccggcaacatcaccgcctactggatgggcttccaggagtacgccgccgccggcgtgggcgccgtcgagtcctgtagctccagcggggcgcctgcgggggccctcctgccccgcatgctgggcttccaggcggcaggggcggcgccgctggtgcacggcggcgaggtggaggacccgcagacggtgggcacggccatcaggatcggccgcccagccagccgcgccggggcgctggccgcggcccgggagtcgggcggggcgttctgggcggtgacggacgaggagatgctggcggcctaccgccggctggcggcgaccgagggcatcttcgctgagcccgcctcctgcgcctccgtggccgggctgatcaagctgtgccggctcgggtacttcgaggggcgcaccggcagtgccggcgatgtgtccggggtcggcggtttcatcgacggcgtgcccgccccggtgccgacccaccggcccttcactggccggggcggccggcccaaggtcgtcgccgtactgaccggacacgggctcaaggaccccgacacggccatccgggtttcgccgctgcctgagaagctgcccgccgactacggccggctggagcggctgatcctctccgggagctga

SEQ ID NO: 31560 - protein, 399 aa, Symbiobacterium thermophilum IAM 14863
MARWHGVIRQYQRFLPVSERTPVVTLLEGNTPLVPAPRLGAELGLDLYLKFEGLNPTGSFKDRGMTLAMSKAVEAGAKAVICASTGNTSASAAAYAARAGLPCYVVIPDGAVAMGKLAQALMYGARTIQIEGNFDDGLRLVRRLTQEHPEIALVNSVNPYRLQGQKTAAFEVVDALGGYPDFLAIPVGNAGNITAYWMGFQEYAAAGVGAVESCSSSGAPAGALLPRMLGFQAAGAAPLVHGGEVEDPQTVGTAIRIGRPASRAGALAAARESGGAFWAVTDEEMLAAYRRLAATEGIFAEPASCASVAGLIKLCRLGYFEGRTGSAGDVSGVGGFIDGVPAPVPTHRPFTGRGGRPKVVAVLTGHGLKDPDTAIRVSPLPEKLPADYGRLERLILSGS

SEQ ID NO: 31561 - DNA, 1233 bp, Symbiobacterium thermophilum IAM 14863
  CDS (1)..(1233): transl_table=11
gtgacggtaacctttgcggacatcgagaaggcgcgcattctgctgagcggacacatcaagcggacacccatgcttcagagccctggcatcaccgagcacctgggacttccggtctacctgaaggccgagaacctgcagcgggccgggtcgttcaaggtgcggggagcgctcaacaagatccactcgctgactgaggaagagaaggcgcgcggcgtcatcgcggcgtcggccggcaaccacgcgcagggcgtggccctggcggcgtccagtctcggcatccggtcggtcatctgcatgccggagggcgccccgatcgccaagctggaggcgacccagggctacggcgcccaggtggtcctgcacggcgagacctacgacgacgcctaccagaaggcgcgggcgctgcaggcggagcacgggtacacgttcatccacggcttcgatgacccgtacaccatcgccggccaggggacggtcgggctggagatcgtggaggacctgcccgacatcgcgacggtggtggtgccgatcggcggcggcggcctcatggcgggcgttgccctggcggtcaagtccctgaagcccggcgtacgggtggtgggggtccaggccgcgggcgcgccggcggtcttcctcagccggcagcagggcaagctggtggcgaccgactcggtccacaccatcgcggacggcattgccatcaagaagccgggggcgctgtgctgggagattatccgggaacacgtggacgacatcgtgctggtggacgaggaggagatcgcacagtcgatcctcttcctgctggagcgtgcgaaggtcatcgtcgagggcgccggcgccgtgggcatggccgcgctcctcggcgacaagatcccggatctgcagggaccggtctgcgtcgtgctctcgggcggcaacattgacgtgaacatcatctcccgcatcatcgagcgcggtctggtgaaggcggggcggtacatccggatctccacgttcgtgcccgaccggcccggcgggctgcagcagctcctcgcgaccgtggcccaggccggggccaacgtgatcgacgtgcgtcatgagcgctggctgaacaaggtgaccatcggcgaggtggagatcaccctggcgctggagactcgcaacgcccgccatgtcgatgagattctcgccaccctcaaggcgaaggggtatcatgtctggatcattccgccgtatcgtcccaacgactggtag

SEQ ID NO: 31562 - protein, 410 aa, Symbiobacterium thermophilum IAM 14863
MTVTFADIEKARILLSGHIKRTPMLQSPGITEHLGLPVYLKAENLQRAGSFKVRGALNKIHSLTEEEKARGVIAASAGNHAQGVALAASSLGIRSVICMPEGAPIAKLEATQGYGAQVVLHGETYDDAYQKARALQAEHGYTFIHGFDDPYTIAGQGTVGLEIVEDLPDIATVVVPIGGGGLMAGVALAVKSLKPGVRVVGVQAAGAPAVFLSRQQGKLVATDSVHTIADGIAIKKPGALCWEIIREHVDDIVLVDEEEIAQSILFLLERAKVIVEGAGAVGMAALLGDKIPDLQGPVCVVLSGGNIDVNIISRIIERGLVKAGRYIRISTFVPDRPGGLQQLLATVAQAGANVIDVRHERWLNKVTIGEVEITLALETRNARHVDEILATLKAKGYHVWIIPPYRPNDW

SEQ ID NO: 31563 - DNA, 1263 bp, Bacillus cereus ZK
  CDS (1)..(1263): transl_table=11
atggtgcagaaggtaaaggagagagtgaaaattgaagatatcttaatggcccataattgcatgaaagatatcgttatgaaaacaccgttacaacgtgatacagttttatctgagaaatatgattgtgatgtttatgtaaaacgagaagatttacaattgattcgctctttcaaaattcgtggtgcgtataatttaattcaaagcttaccgaaagaacaattacaaaacggtgttgtttgcgcaagcgctggtaatcacgcacaaggggtagcttatacgtgtaatttattgaaaattccatcaaaaattttcatgccaacaacaacacctaagcaaaaagtagcacaagttcaatttttcggtggtgatttcgcagagattgtattggttggtgatacattcgatagctcttttcaagaagcacagcgttattgtgaagaaaatagaatgacgtttgttcatccgtttgatgatccgtatgtagttgctggtcaagggacagtggcagttgaaattatgcatgatatggagaaaccggttgattatatctttacagcaattggcggtggcggattagcatcaggtgttggtacatatgtgaaaggtgttagtcctgctacacaggtcattggggtagagccaatgggagctgcatctatgaaagaggcttttcttcaaaatgataatgtggcattggagaaaatagatagttttgttgatggggcagcggttaaaaaggtaggaaagttaacatttgaaacttgtaaagatgtaattgatgacattgttttagtaccagagggaaaggtttgtacgacgattttagaactgtataagaaaaatgcgattgtagctgaaccagctggtgcactctctattgcagcgcttgatttatacagagatgaaattaaaggtaaaaccgttgtatgcacattaagtggtggaaataatgatattgatagaatgcaagaaatgaaagaacgttctctcatttatgaaggattaaagcattatttcatcattgaattcccgcaacgttcaggtgcgctaagagaatttcttgataaaggattaggaccagaagatgatattacgcgctttgagtatattaagaaacataataaagaaaatggtccagcattagtcggagtagagttaaaacataaagaagattacgagcagttaattatccgttttaaagaaaataatattcaatttatggagcttaataaaaatcctgttttgtttgatttgcttatttaa

SEQ ID NO: 31564 - protein, 420 aa, Bacillus cereus ZK
MVQKVKERVKIEDILMAHNCMKDIVMKTPLQRDTVLSEKYDCDVYVKREDLQLIRSFKIRGAYNLIQSLPKEQLQNGVVCASAGNHAQGVAYTCNLLKIPSKIFMPTTTPKQKVAQVQFFGGDFAEIVLVGDTFDSSFQEAQRYCEENRMTFVHPFDDPYVVAGQGTVAVEIMHDMEKPVDYIFTAIGGGGLASGVGTYVKGVSPATQVIGVEPMGAASMKEAFLQNDNVALEKIDSFVDGAAVKKVGKLTFETCKDVIDDIVLVPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLIIRFKENNIQFMELNKNPVLFDLLI

SEQ ID NO: 31565 - DNA, 1539 bp, Mannheimia succiniciproducens MBEL55E
  CDS (1)..(1539): transl_table=11
atggttaataatttatcgaacgccccgaccggggcggagtatttaagagcgatcttaatttctaaagtttatgaggcggcaaaagttactccgttgcaattaatgccgaaattgtcggaacgtttaggcaatcggatttatgttaaacgtgaagatcatcaacccgtacatagctttaaattacgcggcgcctacgccatgatttcaggtttaacccaggcgcagaaagaggccggcgtcattaccgcatcggcgggaaatcacgcgcaaggcgtagccctttcggcaaaaaatgccggtattcgtgcgctgattgtaatgccgcaaaatacgccttccattaaagtggatgcggtacgcggacacggcggcgaagtacttttacacggcgcgaatttcgatgaggccaaagccaaagcgattgaactttcgcaaacggagcaaatgacctttatcccgccttttgatcatcctgcggtgattgcggggcagggctccatcggtatggaattattgcagcaaaacggtcacatcaaccgcatttttgtaccggtaggtggcggcggtttgcttgcgggcgttgccgtgctgattaaacaattaatgccggaaattaaggtgatcggcgtagaagcgaaggattccgcctgtttatattatgcactgaaagcgggtcgtcccgttgatttagaacgcgtcggactttttgccgacggtgtggcggtaaaacgaatcggtgacgaaactttccgcatttgtcagcaatatgtggatgatgtgattctggtggatggtgatgaaatctgtgcggcgatgaaagatatgtttgaaaacgttcgtgcggtaccggaaccttcgggcgcattatcgctcgccggcttgaaaaaatatgctaaacagcataatttgcaaggcgaaaccttagtaaatctgctgtccggcgcgaatttaaatttccatacgctgcgttatgtttccgaacgttgtgaaatcggtgaaaaacatgaagccttatttgcggtaacgattccggaacaacggggcagcttcttaaaattctgtcagattttaggacaaaatgcggtgacggaattcaactatcgctatgctgatgaaaaacaggcttgtatttttgtcggtgtgcgcattaccggcgaacaggaaaaacaagttattatccagcaattaaaacagggcgggtatgacgtgcaggatttgtctgacgacgatattgctaaaactcatattcgttatatggtcggcggccgctcatccagtgatttaaacgaacgtctatatagctttgaatttccggaacaaaaaggcgcattgctgaagttcctggaaaccctcggcaccacggatgcgaatatttccctgttccattaccgcggacacggtgcggattacggcgatgtgttggcaggtttccaaattaatgacgcggatttaccggcatttaaacaacatttggaaaaattaggctatgcttatcaggatgttaccgacagcccgtcttatcggtatttcttaggatag

SEQ ID NO: 31566 - protein, 512 aa, Mannheimia succiniciproducens MBEL55E
MVNNLSNAPTGAEYLRAILISKVYEAAKVTPLQLMPKLSERLGNRIYVKREDHQPVHSFKLRGAYAMISGLTQAQKEAGVITASAGNHAQGVALSAKNAGIRALIVMPQNTPSIKVDAVRGHGGEVLLHGANFDEAKAKAIELSQTEQMTFIPPFDHPAVIAGQGSIGMELLQQNGHINRIFVPVGGGGLLAGVAVLIKQLMPEIKVIGVEAKDSACLYYALKAGRPVDLERVGLFADGVAVKRIGDETFRICQQYVDDVILVDGDEICAAMKDMFENVRAVPEPSGALSLAGLKKYAKQHNLQGETLVNLLSGANLNFHTLRYVSERCEIGEKHEALFAVTIPEQRGSFLKFCQILGQNAVTEFNYRYADEKQACIFVGVRITGEQEKQVIIQQLKQGGYDVQDLSDDDIAKTHIRYMVGGRSSSDLNERLYSFEFPEQKGALLKFLETLGTTDANISLFHYRGHGADYGDVLAGFQINDADLPAFKQHLEKLGYAYQDVTDSPSYRYFLG

SEQ ID NO: 31567 - DNA, 1269 bp, Bacillus licheniformis ATCC 14580
  CDS (1)..(1269): transl_table=11
atgaaaccgttgcttaaagaaaactctctcatccaagtcaaagacattttaaaagcccaccaaaatgtaaaagatgttgttattcatacccctctccaaaaaaatgagaggctgtccgagaggtacgattgcaacgtatatttaaaaagagaagacctgcaggttgtccgctcttttaaactgagaggcgcctattataaaatgaagcagctttcaaaagaaacgacgaaaaacggggtggtctgcgccagtgcaggaaaccatgcgcagggagtcgctttttcctgcaaacatctcggtattcacggaaagatttttatgccgtcgacgaccccgaggcaaaaaatttcccaagtcgaattgttcggcaaggaatacgtcgagatcatcctgacaggcgacacgtttgatgatgcttatcaaagcgcagtcgcctgctgcgaggaagaaaagcgcgcatttatccacccgtttgacgatcctgccgtcatggctggccagggtacggtcgcggtcgaaatcttaaacgatatcgaaacggaaccccattatttattcgcaagcgtaggcggagggggtctgctttcaggagtgggaacctatatgaaaaacgtgtccccggatacaaagctgatcgcggttgagcctaaaggcgcgccggctctttttgaatcaaacaaaaaaggcgaagtcgtcatccttgagaaaatcgataaatttgtcgatggagccgctgtgcagaaaatcggcgaagagacatttaaaacgcttgaaaccgttgtcgatgatattttgctcgttcctgaaggaaaggtgtgcaccgcgattcttgagctgtacaaccaatgcgcgattgtcgccgaacctgcgggagcgctgccgatcgccgctttagatctttacagggatgaaattaaagggaaaaatgtcgtatgcattgtgagcggaggaaacaacgatatcggcagaatgcaggaaatcaaagacagatcgatgatgtatgaaggactccagcattatttcatcgtgaacttcccgcaaagggcgggagctttgcgcgaatttttagatgaagtgctcgggccgaccgacgatatcacccggtttgaatatacgaagaaaaataataaaagcagcggccctgcgctcgtcggcatcgaattgaagcagcgcgaagattacgagccgctgatcgcaagaatggacaggaaaggcttccgctatgtcgaagtcaataaagatgaagggctctttcatttgctgatttaa

SEQ ID NO: 31568 - protein, 422 aa, Bacillus licheniformis ATCC 14580
MKPLLKENSLIQVKDILKAHQNVKDVVIHTPLQKNERLSERYDCNVYLKREDLQVVRSFKLRGAYYKMKQLSKETTKNGVVCASAGNHAQGVAFSCKHLGIHGKIFMPSTTPRQKISQVELFGKEYVEIILTGDTFDDAYQSAVACCEEEKRAFIHPFDDPAVMAGQGTVAVEILNDIETEPHYLFASVGGGGLLSGVGTYMKNVSPDTKLIAVEPKGAPALFESNKKGEVVILEKIDKFVDGAAVQKIGEETFKTLETVVDDILLVPEGKVCTAILELYNQCAIVAEPAGALPIAALDLYRDEIKGKNVVCIVSGGNNDIGRMQEIKDRSMMYEGLQHYFIVNFPQRAGALREFLDEVLGPTDDITRFEYTKKNNKSSGPALVGIELKQREDYEPLIARMDRKGFRYVEVNKDEGLFHLLI

SEQ ID NO: 31569 - DNA, 1056 bp, Burkholderia mallei ATCC 23344
  CDS (1)..(1056): transl_table=11
gtggctgcgcgcggcgcgcgaagctgggacaatggccgcttccttgtccaacgcgttttcgcactcgccgccatgtccgttcaatccgcctccgaccttattttgccgaccttcgacgacgtgaccgacgcagccgcccggctcgccggcgtcgcgcatcgcacgcccgtcctcacgtcgagcaccgccgacgcgcgcgcgggcgcgacgatcttcttcaaatgcgagaacttccagcggatgggcgcgttcaagtttcgcggcgcatacaacgcgatttcgcacttcgacgccgagcagcgccgcgcgggcgtgctcacgtattcgtcgggcaaccatgcgcaggcgatcgcgctcgccgcgcgtctcgcgggcatccgcgcgacgatcgtgatgccgcacgacgcgccggccgcgaaggtcgcggcgacgaagggctacggcggcgaagtcatcacctacgatcgctacacggaaagccgggaggagatcggcgcgcggctcgcgcaggagcgcggcatgacgctcgtgccgccgtacgatcacccgcacgtgatcgccggccaggggacggccgcgaaagagctgatcgacgaagtcggcgagctcgacatgctcgtcgcgccgctcggcggcggcgggctgatcgcgggcaccgcgctgtcggccgccgcgctgtcggcgggctgcgcggtgatcggcgtcgagccggaggcgggcaacgacgcgcagcagtcgctcgagcgcggcgaggtcgtgcgcattccggtgccgcggacgatcgcggacggcgcggcgtcgacgcacgtcggcgcgtacaactttccggtcatccagcggctcgtcaagcggatcgtcacggcgagcgacgcgcagctcgtcgatacgatgcgttttttcgcggagcggatgaaactcgtcgtcgagccgaccggctgcctcggcgcggccgcggtgcttgacggcgtgctgcccgtcgcgggcaggcgcatcggcgtgatcctgagcggcggcaacgtcgatctcgcgcgctacggcgagttcctgcgcgggtga

SEQ ID NO: 31570 - protein, 351 aa, Burkholderia mallei ATCC 23344
MAARGARSWDNGRFLVQRVFALAAMSVQSASDLILPTFDDVTDAAARLAGVAHRTPVLTSSTADARAGATIFFKCENFQRMGAFKFRGAYNAISHFDAEQRRAGVLTYSSGNHAQAIALAARLAGIRATIVMPHDAPAAKVAATKGYGGEVITYDRYTESREEIGARLAQERGMTLVPPYDHPHVIAGQGTAAKELIDEVGELDMLVAPLGGGGLIAGTALSAAALSAGCAVIGVEPEAGNDAQQSLERGEVVRIPVPRTIADGAASTHVGAYNFPVIQRLVKRIVTASDAQLVDTMRFFAERMKLVVEPTGCLGAAAVLDGVLPVAGRRIGVILSGGNVDLARYGEFLRG

SEQ ID NO: 31571 - DNA, 1524 bp, Burkholderia pseudomallei K96243
  CDS (1)..(1524): transl_table=11
atggcctcccacgattatctgaagaaaatcctgaccgcccgggtgtacgacgtcgcgctcgaaaccgagctcgaacgcgcgcgcaacctgtccgcgcggctgggcaacgccgtctacctgaagcgcgaggacaaccagccggtgttctcgttcaagctgcgcggcgcgtacaacaagatggcgcacatcccggccgacgcgctcgcgcgcggggtgatcaccgcgtcggcgggcaaccatgcgcagggcgtcgcgttctcggccgcgcggatgaacgtgaaggcggtgatcgtcgtgccggtgacgacgccgcaggtgaaggtcgacgcggtgcgcgcgcacggcgggccgaccgtcgaggtgatccaggcgggcgaatcgtacagcgacgcgtacgcgcacgcggtgaaggtgcaggccgagcgcggcctcacgttcgtccatccgttcgacgatccgtacgtgatcgcgggccagggcacggtcgcgatggagatcctgcgtcagcatcaggggccgattcacgcgatcttcgtgccgatcggcggcggcgggctcgcggcgggcgtggccgcgtacgtgaaggcggtgcgcccggagatcaaggtgatcggcgtgcagaccgacgattcgtgcgcgatgaagcaatcgctcgcggcgggccggcgcatcgagctcaccgaggtggggctcttctccgacggcaccgcggtcaagctcgtcggcgaggagacgttccgcctctgcgcggcgtatctcgacgaggtcgtgaccgtcgataccgacgcgctttgcgcggcgatcaaggacgtgttccaggacacgcgcagcgtgctcgagccggccggctcgctcgcggtggcgggcgcgaagcggtatgcggagcaggcgggcatcgagggcgagacgctcgtggcggttacctccggcgcgaacatgaatttcgaccggatgcgcttcgtcgccgagcgcgccgaggtgggcgaggcgcgcgaggcggtgttcgcggtgacgattcccgaggagcgcggcagcttcaagcgcttctgcgcgctcgtcggcgagcgcaacgtgaccgagttcaactaccggatcgccgatgcgcgatcggcgcatctcttcgtcggtgtgcagatccggcggcgcgacgaatcggacgagatcgccgccaacttcgccgcgcacggtttcacgagcgtcgacctgtcgggcgacgagctatcgaagcagcatatccgctacatggtgggcgggcgctcgccgctcgcgcacgacgagcggctgttccgcttcgagtttcccgagcggcccggcgcgctgatgaagttcctgtcgtcgatggcgcccgactggaacatcagcctgttccactaccggaaccagggcgccgactacagctcgatcctcgtcggcctgcaggtgccgcaggccgaccacgcggcgttcgatcgcttcctcgcggcgctcggctatccgttctgggaagaaagcggcaatccggcgtatcgtctcttcctgtcgtaa

SEQ ID NO: 31572 - protein, 507 aa, Burkholderia pseudomallei K96243
MASHDYLKKILTARVYDVALETELERARNLSARLGNAVYLKREDNQPVFSFKLRGAYNKMAHIPADALARGVITASAGNHAQGVAFSAARMNVKAVIVVPVTTPQVKVDAVRAHGGPTVEVIQAGESYSDAYAHAVKVQAERGLTFVHPFDDPYVIAGQGTVAMEILRQHQGPIHAIFVPIGGGGLAAGVAAYVKAVRPEIKVIGVQTDDSCAMKQSLAAGRRIELTEVGLFSDGTAVKLVGEETFRLCAAYLDEVVTVDTDALCAAIKDVFQDTRSVLEPAGSLAVAGAKRYAEQAGIEGETLVAVTSGANMNFDRMRFVAERAEVGEAREAVFAVTIPEERGSFKRFCALVGERNVTEFNYRIADARSAHLFVGVQIRRRDESDEIAANFAAHGFTSVDLSGDELSKQHIRYMVGGRSPLAHDERLFRFEFPERPGALMKFLSSMAPDWNISLFHYRNQGADYSSILVGLQVPQADHAAFDRFLAALGYPFWEESGNPAYRLFLS

SEQ ID NO: 31573 - DNA, 984 bp, Burkholderia pseudomallei K96243
  CDS (1)..(984): transl_table=11
atgtccgttcaatccgcctccgaccttattttgccgaccttcgacgacgtgaccgacgcagccgcccggctcgccggcgtcgcgcatcgcacgcccgtcctcacgtcgagcaccgccgacgcgcgcgcgggcgcgacgatcttcttcaaatgcgagaacttccagcggatgggcgcgttcaagtttcgcggcgcatacaacgcgatttcgcacttcgacgccgagcagcgccgcgcgggcgtgctcacgtattcgtcgggcaaccatgcgcaggcgatcgcgctcgccgcgcgtctcgcgggcatccgcgcgacgatcgtgatgccgcacgacgcgccggccgcgaaggtcgcggcgacgaagggctacggcggcgaagtcatcacctacgatcgctacacggaaagccgggaggagatcggcgcgcggctcgcgcaggagcgcggcatgacgctcgtgccgccgtacgatcacccgcacgtgatcgccggccaggggacggccgcgaaagagctgatcgacgaagtcggcgagctcgacatgctcgtcgcgccgctcggcggcggcgggctgatcgcgggcaccgcgctgtcggccgccgcgctgtcggcgggctgcgcggtgatcggcgtcgagccggaggcgggcaacgacgcgcagcagtcgctcgagcgcggcgaggtcgtgcgcattccggtgccgcggacgatcgcggacggcgcggcgtcgacgcacgtcggcgcgtacaactttccggtcatccagcggctcgtcaagcggatcgtcacggcgagcgacgcgcagctcgtcgatacgatgcgttttttcgcggagcggatgaaactcgtcgtcgagccgaccggctgcctcggcgcggccgcggtgcttgacggcgtgctgcccgtcgcgggcaggcgcatcggcgtgatcctgagcggcggcaacgtcgatctcgcgcgctacggcgagttcctgcgcgggtga

SEQ ID NO: 31574 - protein, 327 aa, Burkholderia pseudomallei K96243
MSVQSASDLILPTFDDVTDAAARLAGVAHRTPVLTSSTADARAGATIFFKCENFQRMGAFKFRGAYNAISHFDAEQRRAGVLTYSSGNHAQAIALAARLAGIRATIVMPHDAPAAKVAATKGYGGEVITYDRYTESREEIGARLAQERGMTLVPPYDHPHVIAGQGTAAKELIDEVGELDMLVAPLGGGGLIAGTALSAAALSAGCAVIGVEPEAGNDAQQSLERGEVVRIPVPRTIADGAASTHVGAYNFPVIQRLVKRIVTASDAQLVDTMRFFAERMKLVVEPTGCLGAAAVLDGVLPVAGRRIGVILSGGNVDLARYGEFLRG

SEQ ID NO: 31575 - DNA, 1530 bp, Methylococcus capsulatus str. Bath
  CDS (1)..(1530): transl_table=11
atgctgcaaaaatacatagagaagattctgcgcgcccgtgtctacgacgttgcccaggagaccccgctggacccggcgcccggcctgtcgcggcggctggacaacacggtgctgatcaagcgcgaggacctgcagccggtgttctcgttcaagctgcgcggcgcctacaacaagatcgcctcgctcacacccgaggcgcgcgcggccggcgtgatcgcggcctccgccggcaaccacgcccagggcgtggcactggcggcgcagcggctgggcatccgcgccgtgatcgtgatgccttgcaccaccccgcatatcaaggtcgatgcggtgcgcaaccgaggcggtgaggtcgtactgcatggcgacgcctatgacgaagcctacgaacatgcgctggaactggcccgcgaccagtgcctgaccttcgtccacccctacgacgatccggaagtcatcgccgggcaaggcaccatcggcatggaaatcctgcgccagcaccaggacgccatccacgccatcttcgtgcctgtgggcggcggcggattgatcgccggcatcgccgcctacgtcaagttcgtgcgcccggacatccgcgtcatcggcgtggaaccagtggactccgactgcctgcaccgggcgctgaaagccaagcggcgggtgatcctgaagcaggtgggcctgttcgccgacggcgtcgcggtgaagcaggtcggcaaggaaccgttccatctcgcccaccagtgggtggacgaggtcgtgaccgtcgacaccgacgaaatctgcgccgccatcaaggacatcttcgacgacacccgctccatcgccgagccggcgggcgcgctgggcatcgccgggctcaagaaatacgtggccgaaacaggaatcaagaacgcgtgcctggtggcgatcgaaagcggcgccaacatcaacttcgaccggctgcgccacgtcgctgagcgcgccgagatcggcgaaaagcgcgaactgctgctggcagtgacgatccccgagcggcccggcagcttcctcgaattctgccgggtgctgggccgccgcaacatcaccgaattcaactaccgcttcttcgacgaaaaggccgcccaggtgttcgtcggcctcccggtggcgagcggcgcgatcgaccgcgaaagcctggtccgcgaattcgaacgccagggtttcggcgtgctcgacctgaccggcaacgaactcgccatcgaacacatccgctacatggtcggcggccacgcgccgaaactgctggacgaacaggtctacagcttcgaattccccgagcgacccggcgcgctgctgcgcttcctgtccatcatgggcgggcgctggaacatcagcctgttccattaccgcaaccacggcgccgccttcggccgggtactgatgggcatccaggtgccgaaaccggaacgcaaggccttccgggaattcctcgaagccatcggctacgccttcaaggaggaaacccaaaatcccgcctaccggctgttcgcggggggcagcgagcgggggtga

SEQ ID NO: 31576 - protein, 509 aa, Methylococcus capsulatus str. Bath
MLQKYIEKILRARVYDVAQETPLDPAPGLSRRLDNTVLIKREDLQPVFSFKLRGAYNKIASLTPEARAAGVIAASAGNHAQGVALAAQRLGIRAVIVMPCTTPHIKVDAVRNRGGEVVLHGDAYDEAYEHALELARDQCLTFVHPYDDPEVIAGQGTIGMEILRQHQDAIHAIFVPVGGGGLIAGIAAYVKFVRPDIRVIGVEPVDSDCLHRALKAKRRVILKQVGLFADGVAVKQVGKEPFHLAHQWVDEVVTVDTDEICAAIKDIFDDTRSIAEPAGALGIAGLKKYVAETGIKNACLVAIESGANINFDRLRHVAERAEIGEKRELLLAVTIPERPGSFLEFCRVLGRRNITEFNYRFFDEKAAQVFVGLPVASGAIDRESLVREFERQGFGVLDLTGNELAIEHIRYMVGGHAPKLLDEQVYSFEFPERPGALLRFLSIMGGRWNISLFHYRNHGAAFGRVLMGIQVPKPERKAFREFLEAIGYAFKEETQNPAYRLFAGGSERG

SEQ ID NO: 31577 - DNA, 963 bp, Nocardia farcinica IFM 10152
  CDS (1)..(963): transl_table=11
ttgaccgatcgggacggcgcgctggtcgcgggggagcacgcccggctgtatcgatccgatgtccgcctcgcgcggcgcaggctcgccgggcggatccggaagacgcccgtcttccacacgagcgtggccgggcccgccgggccggtcccggtgacgttgaaactcgagcatctccagcacgcgggcaccttcaaggtgcgcggcaccctcaacgcgctgctcgccgccgacccggaggaccacgtggtgatcgcctcggcgggcaattccggcatcgccgcggcgctggcggcggcctggctgggcaagacgtgcacggtggtggtgcccgagtcggcgccgcacaccaaggtggccgcgatgtggtcgcacggcgccgaggtgctgtggcacggcaccacctaccgcgaggccgaacggtacgccgccgagctggcggccgaccgcggcgcactggtgctgcacgcctacgaccagctcgacgtgatcgccggtgcgggcgtgctcgcgctcgagctggaggagcaggtgcgcggcaggccgccggtgctggtctcggtgggtggcggcggcctgctggcgggcgtggccgccgcgttcgggcgcaggcagcgggtgatcggggtggagccggtcggcatgcccgcgctgcgcgccgcactgacggccgaacgcccggtggacgtgggcccggcccggccggtgctgcatccgctgggcgccacccgggtcggcgaactcgcgttgcgcctggcgcgccgctacgacgtgcccgcgctgctggtcaccgaggaggcgatcacgaccgcgcgcgagtacctgtggcgtgagttccggatcgtggtggaactggccggcgcgaccgcgctggccgcgatcctcagcggcgcctacgtcccggccccgggtgagcggccggtggtggtgctgtgcggggcgaacaccgacgcgaccggtctctga

SEQ ID NO: 31578 - protein, 320 aa, Nocardia farcinica IFM 10152
MTDRDGALVAGEHARLYRSDVRLARRRLAGRIRKTPVFHTSVAGPAGPVPVTLKLEHLQHAGTFKVRGTLNALLAADPEDHVVIASAGNSGIAAALAAAWLGKTCTVVVPESAPHTKVAAMWSHGAEVLWHGTTYREAERYAAELAADRGALVLHAYDQLDVIAGAGVLALELEEQVRGRPPVLVSVGGGGLLAGVAAAFGRRQRVIGVEPVGMPALRAALTAERPVDVGPARPVLHPLGATRVGELALRLARRYDVPALLVTEEAITTAREYLWREFRIVVELAGATALAAILSGAYVPAPGERPVVVLCGANTDATGL

SEQ ID NO: 31579 - DNA, 1356 bp, Nocardia farcinica IFM 10152
  CDS (1)..(1356): transl_table=11
gtggccaatccgctggaactgatcgatgacctgtccccgtctcgtcgcgcgctcaacgccgacgagatcgacgccgcggccaagcgaatttccgacatcatcgagcccacccccctccagctcagcccccgcctgtccgccgccaccggcgcccgcgtctacctcaagcgcgaggacctcaccgccgtgcgctcctacaagctgcgcggggcctacaacctgatcgtgcagctcgacgagcgcgagcgcgcggcgggcgtggtcgcggccagtgccggcaatcacgcccagggcgtggcgttcgcctgccaggcgatgggcatccagggacgcatctacgtgccgaccacgacgccgaagcagaagcgcgaccggatccgggtacacggcgggcagttcgtggagctgatcgccgtcggcgacacctacgacgccgccgcggccgccgcggccgccgacgtggaacgcaccggcgcgacgatggtcgctcccttcgacgacccgcgcaccgccgccggtcagggcaccatcgcggtggagatcctcgaacagctcggcgcggcacccgatttggtcgtggtgccggtgggcggcggcggctgcctggccggtatcggcacctacctgcgcgaccgctcccccgccaccggcatcctggcggccgagcccgccggggcggcctccatgacggcggcgctgatcgcgggcgggccggtgaccctgcccgagatcgatcccttcgtcgacggcgcggcggtgcgccgcgtcggcgcgctgccctatgccgcggcggtcggcttcggcggccgggtggtcacgcacgcctcgctgccgctgctcaccgccgtcgactcaccgcagggacacggcgcgttccggttgctccaggtcgacgagggcgccatctgcacgacgatgctcgagctctaccagaacgagggcatcatcgccgagcctgcgggcgcgctggcggtggccgccctggccgaggtcgacgtcgaacccggttcgacggtggtgtgcctgatctccggcggcaacaacgacgtctcccgctacggcgagatcatcgagcgctccctggtgcaccagggtctcaagcactacttcctggtcgatttcccgcaggagccgggcgcgctgcgccggttcctggacgaggtgctcggcccggacgacgacatcaccctgttcgagtacgtcaagcgcaacaaccgggagaccggggcggcgctggtcggcatcgaactcggcgcggccgacgggctggacgcgctgctcgaacgcatcgcggcctcgcccatccaatgcgaacggctggagccgggctcgcccgcctaccgctacctgacctga

SEQ ID NO: 31580 - protein, 451 aa, Nocardia farcinica IFM 10152
MANPLELIDDLSPSRRALNADEIDAAAKRISDIIEPTPLQLSPRLSAATGARVYLKREDLTAVRSYKLRGAYNLIVQLDERERAAGVVAASAGNHAQGVAFACQAMGIQGRIYVPTTTPKQKRDRIRVHGGQFVELIAVGDTYDAAAAAAAADVERTGATMVAPFDDPRTAAGQGTIAVEILEQLGAAPDLVVVPVGGGGCLAGIGTYLRDRSPATGILAAEPAGAASMTAALIAGGPVTLPEIDPFVDGAAVRRVGALPYAAAVGFGGRVVTHASLPLLTAVDSPQGHGAFRLLQVDEGAICTTMLELYQNEGIIAEPAGALAVAALAEVDVEPGSTVVCLISGGNNDVSRYGEIIERSLVHQGLKHYFLVDFPQEPGALRRFLDEVLGPDDDITLFEYVKRNNRETGAALVGIELGAADGLDALLERIAASPIQCERLEPGSPAYRYLT

SEQ ID NO: 31581 - DNA, 936 bp, Nocardia farcinica IFM 10152
  CDS (1)..(936): transl_table=11
gtgccgatcgaaccgaccgttatcgacgtcgacgccgccgccgaacggatcgccgggctgatccgtccggtcaccgtcgccccggccgaaccgccgggtgagtgctggctggcgctggagttcctccagcacaccggctcgttcaaggcgcgcggcgcgcagaatttcgtggaggcccaccggctcgcgggcaccatgcccgccgccggggtgaccatcgcctcgggcgggaacgccggactggcctgcgcgtgggctgcggcgagccggggcgtgcccgcgacggtgttcctgccgcgcaccgcgcccacggtgaaggtgcagcggctgcgcggctacggcgccgaggtgcggctggtcggcgcggaatacgccgacgcgctggcggcctgccgtgacttcgccgccgagtccggcgcgttgatgtcccacgcctacgacgatccactgatcgcggccggcgccggcacgctgctcaccgaaatccaccgggcgataccgaaactggacacggtggtgctcgccgtcggcggcggtgggctgttcgccggcatcgccaccgcggccgcgcagctcggggtgcggacggtggcggtggagcccgagcgctgccgcgccctcgacgccgcgctggccgcgggcgaaccggtggacgtggaggtgaactcgatcgccgccgacgcgctgggcgcccggcgggtcaccgagctggcgctggccgccgcccggcaggccgacacggtgtcggtgctggtgcccgacgagcagatcgtcgcggcgcggcgcggcctgtgggccgaacggcgtctcgcggtcgagcatgccgccgcgaccgcgctcgcggccctggaatcgggcgcctaccggccggcgccgggcgaacgcgtctgtgtcgtgttgtgcggggccaacaccgacccggccgatctgggctga

SEQ ID NO: 31582 - protein, 311 aa, Nocardia farcinica IFM 10152
MPIEPTVIDVDAAAERIAGLIRPVTVAPAEPPGECWLALEFLQHTGSFKARGAQNFVEAHRLAGTMPAAGVTIASGGNAGLACAWAAASRGVPATVFLPRTAPTVKVQRLRGYGAEVRLVGAEYADALAACRDFAAESGALMSHAYDDPLIAAGAGTLLTEIHRAIPKLDTVVLAVGGGGLFAGIATAAAQLGVRTVAVEPERCRALDAALAAGEPVDVEVNSIAADALGARRVTELALAAARQADTVSVLVPDEQIVAARRGLWAERRLAVEHAAATALAALESGAYRPAPGERVCVVLCGANTDPADLG

SEQ ID NO: 31583 - DNA, 1554 bp, Photobacterium profundum SS9
  CDS (1)..(1554): transl_table=11
atgagcgaagtaacacaggccaaggatgcagagctattaagcggagccgattaccttcgcaatattcttcgagcacctatctatgaagtggcgcaagtgacgcccctccaagatatggatcgattgtcagcaaggatcggcaatcgcatccagttaaaacgagaagatcgccagccggttcactcgtttaaactgcgtggtgcttacaacatgatgtctcagctaaccccagcgcaacgtaaagcgggggctattgcagcctctgcgggcaatcatgctcaagggttagcattatccggtcataagcttgatgttagtgcaaccatcgttatgccactgaccacacctgcgattaaagtcgatgcggtgagaagctttggtggcaaagtggttttgcacggcaataattttgatgaagccaaagcccacgctgaagaattagcgcaacaatatggttataccttcattccaccctttgatcacccatcagtgattgcaggacagggcaccatcggtatggaactgctccaacaaaatgggcatcttgattatgtttttgttcctgttgggggcggcggtttagcggctggaatatcggtattacttaaacagttaatgccgaatattaaaatcatcggtgtggaagctgaagattcagcctgcttgaaagccgcgctcgatgcgggttgtccggttacactcgaccaagttggcatgtttgctgacggtgtcgcggtaaaacgcattggtgaagaaacattccgtttatgccagcagtatcttgatgatgttattaccgttagcagcgatgaaatttgctctgccgttaaagatatttttgaagatacccgggccattgcagaaccatctggtgcactctctttagcaggactcaaaaaatacgttgaggtacaccagctacaagataagcagctagcatccattttatcgggggctaacctcaactttcatggtctacgctatgtatcagagcgttgtgaattaggtgagaaacgagaaggtctcttagcggtaacagtgccagaacggcctggggcttttcttgatttttgccatatcttaggtggccgaacagtgactgagtttaactatcgctacaacgacgatgcactggctaatgtctttgtgggggtgcgcttaatgcaagggcaagaagagctggacggcatcattcacgatcttcgaaaagggggctaccccgttgtcgatttatctgatgatgaaatggcaaaagttcacgtgcgctatatgattggtgggcgtccatcaaagccactaaaagaacgtttatatagttttgaatttccagagtaccctggcgcactattaaagtttcttaatacgctaggtacacactggaatattagcctatttaattaccgtaatcatggtgcagattttggtcgagtattatgtggttttgaattggaagacaaagatctgctgtcttttactagtcacttacacgaattaggctaccaatggaaagatgaaacggaaaacctagcatataagttttttctagcccaataa

SEQ ID NO: 31584 - protein, 517 aa, Photobacterium profundum SS9
MSEVTQAKDAELLSGADYLRNILRAPIYEVAQVTPLQDMDRLSARIGNRIQLKREDRQPVHSFKLRGAYNMMSQLTPAQRKAGAIAASAGNHAQGLALSGHKLDVSATIVMPLTTPAIKVDAVRSFGGKVVLHGNNFDEAKAHAEELAQQYGYTFIPPFDHPSVIAGQGTIGMELLQQNGHLDYVFVPVGGGGLAAGISVLLKQLMPNIKIIGVEAEDSACLKAALDAGCPVTLDQVGMFADGVAVKRIGEETFRLCQQYLDDVITVSSDEICSAVKDIFEDTRAIAEPSGALSLAGLKKYVEVHQLQDKQLASILSGANLNFHGLRYVSERCELGEKREGLLAVTVPERPGAFLDFCHILGGRTVTEFNYRYNDDALANVFVGVRLMQGQEELDGIIHDLRKGGYPVVDLSDDEMAKVHVRYMIGGRPSKPLKERLYSFEFPEYPGALLKFLNTLGTHWNISLFNYRNHGADFGRVLCGFELEDKDLLSFTSHLHELGYQWKDETENLAYKFFLAQ

SEQ ID NO: 31585 - DNA, 1260 bp, Haloarcula marismortui ATCC 43049
  CDS (1)..(1260): transl_table=11
atgggcatgacgcaagtcacaaccctcgagtgtacactctgtggggcagagtacgacccgaaccggatcatctacacctgtcccgaacacgagggcgtgaagggaattctcgaggtgacgtacgactacgatgctatcgatgatgcgtttgacggcgacctcggcgggccgatcgcaagtcaatggaagtacgaggcgtttctgccagtcgcagcggacgccgatatcgtgacgctcaacgagggcgggacggacctcttcgacgcgccgaatctcagcgctgcgctgggcgtggagacactggtcaaagacgacggacggaacccgaccggctgcttcaaggaccgcgccagcgctatcgcggtcacgaaagcaaaacacgccgggcgcgatatcatcacctgcgcctccaccgggaacgccgccgcgtcactgtcgggctatgccgcccgcggggggatggactgccgtattttcgtccccggtgacgccccgacggggaaactcgcacagccgctcgtctacggcgcggatgtccttgctgtcaacggcaactacgacgaagcctacgacctcagcgtcgaggtcaccgagaagtacggctggtacaaccgcaacgcggctatcaatccgttccaggtcgagggcaagcgcaccgtcggccacgagctcgcagaccagtctatcgcccgcggacacgtcccggactgggtcgtgttttcgatgggcgacggctgtacgattgccggggcctggaaggggttcaaggagttctacgacctcggctacgtcgatgaccaccccaaaatgctaggggttcaggccgaaggggcgtcggcgatccacgacgccttccacaaccacgaggatatcgacgatatcgccgaaacgctggccgattcaatcgcagtcggacggccgcggaacacgattaaggcttgccgcgcgctggaacagagcggtggcaccagcgtgctggtctccgatgaagagattctggaagccgaaacgctacttggcagcaccgaaggaatctactccgagccggcgggagcagcgcctatcgcgggcgttcagacggcgctcgaccggggaatcatcgaacaggacgaaacggtcgtcgtggtgtccaccggcttcggcctgaaggacacgaaaagcgccgagaaggcgaccggcggggtggatcgaatcgaccccgaaatcgcagaggtcgaaggtctgtacggcacggccgaagaagccgcagccgacgactga

SEQ ID NO: 31586 - protein, 419 aa, Haloarcula marismortui ATCC 43049
MGMTQVTTLECTLCGAEYDPNRIIYTCPEHEGVKGILEVTYDYDAIDDAFDGDLGGPIASQWKYEAFLPVAADADIVTLNEGGTDLFDAPNLSAALGVETLVKDDGRNPTGCFKDRASAIAVTKAKHAGRDIITCASTGNAAASLSGYAARGGMDCRIFVPGDAPTGKLAQPLVYGADVLAVNGNYDEAYDLSVEVTEKYGWYNRNAAINPFQVEGKRTVGHELADQSIARGHVPDWVVFSMGDGCTIAGAWKGFKEFYDLGYVDDHPKMLGVQAEGASAIHDAFHNHEDIDDIAETLADSIAVGRPRNTIKACRALEQSGGTSVLVSDEEILEAETLLGSTEGIYSEPAGAAPIAGVQTALDRGIIEQDETVVVVSTGFGLKDTKSAEKATGGVDRIDPEIAEVEGLYGTAEEAAADD

SEQ ID NO: 31587 - DNA, 1263 bp, Haloarcula marismortui ATCC 43049
  CDS (1)..(1263): transl_table=11
atgacacataccgaatcggacacgctacccgtcacatacgcagacatcgaacgagcccgcgaacgtctggacgacgacacagttgtaaagaagacgccagtcgaacggagctcgtcccttggtgggttcgtcgacgccgaggtgtacctgaagatggagcacctccagtggacagggtcgttcaaaaccagaggcgcgtacaacaagatctcgcaggacgttgccgatgacgtggagtccttcgtcgccgccagcgccgggaaccacgcccagggtgtcgctctcgccgcgacgaaatgtggggcagagtcaacgattttcatgccggagaacgcgccacaggccaagatcgacgccacgagggcctacggcggaagcgtcgaactggtcggcaacgactttcaggagacgatgtcccacgccaaagctgtcgtcgaggagaccgacgccgagttcgttcacgcctatgacgatctggacatcattgctggacaggggaccctcggaacggaaatgtaccacgactgccccgatgtcgacacagtcatcgtccccattggcggcggcggacttatcagcggtgtctcgaccgcaatcaagcacctctcgcccgagacgcgcgtcatcggtgtgcaggcgaccggcgctgagacggtgcatgaaagcctcgacaaagggattccggtcgtgcttgatgaagtcgacaccatcgccgacggtatcgctacgggcggtatctcggagacgacgctcgacatcatcgaggcgaacgtcgacgaagtcgtgacggtttcggacaccgatatcgcacaggcgattctcctgttgatggaacgagccaaacaggtcgtggaaggtgccggggccgcctccgtggctgccatactgagtgacagcctcgacgtgtcgggtgaaacggtgatgccgctgctctgtggcgggaacctcgatatgacacagatgcgagaagttctcattcatgcactcacggagcgccagcagctcctccagctccgggttcggatcgatgaccagccgggtgtgatggaggagatatctggcgtcatcgccagacagggagccaacatccacgacgttcggcacgaacggtccgtcgagaatctcgaaatcggggaggcgtatctcgtattcaacgtcgaaacgagtggtgccgagcacgcacagagtattatcacggcgatacgtgatgcgggctatcccgtcgataacgttgcacgggaggccaaaagtggcgcactgtga

SEQ ID NO: 31588 - protein, 420 aa, Haloarcula marismortui ATCC 43049
MTHTESDTLPVTYADIERARERLDDDTVVKKTPVERSSSLGGFVDAEVYLKMEHLQWTGSFKTRGAYNKISQDVADDVESFVAASAGNHAQGVALAATKCGAESTIFMPENAPQAKIDATRAYGGSVELVGNDFQETMSHAKAVVEETDAEFVHAYDDLDIIAGQGTLGTEMYHDCPDVDTVIVPIGGGGLISGVSTAIKHLSPETRVIGVQATGAETVHESLDKGIPVVLDEVDTIADGIATGGISETTLDIIEANVDEVVTVSDTDIAQAILLLMERAKQVVEGAGAASVAAILSDSLDVSGETVMPLLCGGNLDMTQMREVLIHALTERQQLLQLRVRIDDQPGVMEEISGVIARQGANIHDVRHERSVENLEIGEAYLVFNVETSGAEHAQSIITAIRDAGYPVDNVAREAKSGAL

SEQ ID NO: 31589 - DNA, 1029 bp, Haloarcula marismortui ATCC 43049
  CDS (1)..(1029): transl_table=11
atggccggtcgctacgaaccgatcgactccccggacgagacgaccctctttccgtaccacgacctgacgccgccgacagttgcaacggtcgctcgcgcccggcaacgcatccgacagcacctcccggagacgcccctggtccgaagcgaagccctctccgaagccctcgacgcggatgtcttgctcaagcgagaagatacgctcccgaccggcgcgttcaaagtccgcggcggggtgaacctcgtcgcgtccctcgacgaggagttccacgacgccggactgctcgccgcgagcacgggaaaccacggccagtctatcgcctgggccgggcgtgagttcgacgtacccgttactatcggcgtccccgaagaagccaacgccggaaaggtcggcgcgctggagcaactcggcgcagaagtcatccagtacggcgaggactacgacgaggcccgcgaacacatcgaggacttggcgacccagcgcgaggcgcgctacgtccactcgggcaacgaaccgaagctgctcgccggcgtcggcacggcggggctcgaaatccttgacgagcgccccgacgtcgaccgtgtgttctgccccgtcggcggcggcaccgccgcggccgggtactgcactacgctcggggcgatgaccgacgccgatgtcgtcggcgtgcaggctgcgggcgcgcccgcggtgtaccgcgcttggcaggacgagacgctggacgccctcgacagcgtcgacactatcgccgagggtgtcgcaacccgggttccgttcgcgctcccgaccgaaatcctgcaggcgggactcgccgatttccgactcgtgtccgaagacgccattaccgatgccgtggcgcgcctgttcgaaacagaccgcatcgtcatggaaggggcctgtgcgacggctgtcgccgcagcgattcaggctggtgacgaactacggggcgagacggtcgtccttcccatttcgggacggaacatcgaccgagagaagtttgaccgactgctggccgaaagcgagtactag

SEQ ID NO: 31590 - protein, 342 aa, Haloarcula marismortui ATCC 43049
MAGRYEPIDSPDETTLFPYHDLTPPTVATVARARQRIRQHLPETPLVRSEALSEALDADVLLKREDTLPTGAFKVRGGVNLVASLDEEFHDAGLLAASTGNHGQSIAWAGREFDVPVTIGVPEEANAGKVGALEQLGAEVIQYGEDYDEAREHIEDLATQREARYVHSGNEPKLLAGVGTAGLEILDERPDVDRVFCPVGGGTAAAGYCTTLGAMTDADVVGVQAAGAPAVYRAWQDETLDALDSVDTIAEGVATRVPFALPTEILQAGLADFRLVSEDAITDAVARLFETDRIVMEGACATAVAAAIQAGDELRGETVVLPISGRNIDREKFDRLLAESEY

SEQ ID NO: 31591 - DNA, 1212 bp, Haloarcula marismortui ATCC 43049
  CDS (1)..(1212): transl_table=11
atgctctcatttgaggatgtcctcgcggcacaggacaccgtctccgagacggccagacacacaccgcttgattactcgcacacgttttcggcgatgacgggcgcggatatccatctcaaactcgaactgttccagcgtacggggtcgttcaagatacggggtgcgaccaaccgtatcgcgtcgctttcagatgctgaacgggaggctggcgtcgtcacagcgagcgccggcaaccacgctcagggggtcgcgctggccgccacgcgaatcggcgtcgactcgaagattgtgatgccggagcgggccccggtatcgaaagtgaaggccacccggagctacggcggtaacgtggtccttcacggtcgggactacgacgcggccgccgaacacgcccacgaactcgaacgcgaggaaggccggacatacgtccatgccttcgacgacgagaaagtgatggcagggcaggggaccatcggactggagatctacgaggacctccccggcgttgatacggtcgtcgtccctatcggcggcggcggacttattagtggcatcgccacggcgctcaaaggcaaggacgaacgtatccgcgtcatcggcgtgcaggccgagggagcgtccagcgtggccgaatccctggagaagggccaccgcatcgagcgtgacagcgtcgaaactatcgccgacggtatcgccacccgcactgtcggcgagcagacgttcgaggtcatcagcgaccgcgtcgacgaggtcgtgacggtgtcggactcggaaatcgcagtcgcgctgacgacactgttagagcgctcgaaaacgcttgccgagggcgcgggtgccgtcgcgctggctgccgtcatggaagagaagttcgacttcgaggacgacgagacgatcgttcccgcgctgtgtggcgggaacatcgacctgaacaccctgaccaacgtcatcatgcgcggcctcgttgagactggccggtatctcaaaatccggaccgtccttcaggaccggcccggcgcgctggaagagctcgtcgaggtcctgtcacgcgagcaggtcaacatctacggcatcgagcacgaccggaccagtcgcgacgtggcgatgagttcggccgaggtcgaactggacctggagacccgcggccacgaccacgtcgccgaactcatcgacgcgctcaccgacgaggggtatgaggtcgacgtgctcgtctga

SEQ ID NO: 31592 - protein, 403 aa, Haloarcula marismortui ATCC 43049
MLSFEDVLAAQDTVSETARHTPLDYSHTFSAMTGADIHLKLELFQRTGSFKIRGATNRIASLSDAEREAGVVTASAGNHAQGVALAATRIGVDSKIVMPERAPVSKVKATRSYGGNVVLHGRDYDAAAEHAHELEREEGRTYVHAFDDEKVMAGQGTIGLEIYEDLPGVDTVVVPIGGGGLISGIATALKGKDERIRVIGVQAEGASSVAESLEKGHRIERDSVETIADGIATRTVGEQTFEVISDRVDEVVTVSDSEIAVALTTLLERSKTLAEGAGAVALAAVMEEKFDFEDDETIVPALCGGNIDLNTLTNVIMRGLVETGRYLKIRTVLQDRPGALEELVEVLSREQVNIYGIEHDRTSRDVAMSSAEVELDLETRGHDHVAELIDALTDEGYEVDVLV

SEQ ID NO: 31593 - DNA, 1251 bp, Streptococcus thermophilus CNRZ1066
  CDS (1)..(1251): transl_table=11
atgattactgcaaatgatatcgtaaaggctaatgaagtcttaaaaaacgtggtggagcgtaccccactagattttgatcgctacttatctgaaaaatatggagcgactatttatattaaaaaagaaaatatgcaaaaggtacgttcctttaaattacgtggtgcctactatgcgatccatcagttaagtgatgaagacaaggaacatggtgtggtctgtgcatcagccggaaaccatgcccaaggtgttgcttatacttgtaatgaaatgaagattcctgcaactatctttatgccagtaacaactcctctccaaaaaattggtcaagtacgtttctttggtggcaagtttgtaacaattaaattggttggagatacctttgatgaatctgctaaagcggcacaagagtatacgaagtcggaagggatgactttcattgatccattcgatgattataatgtccaagcgggtcaaggaactgttgcttatgaaatttatgagcaagctcaagaggaaggtgtttcctttgatagtatcttagtgccggtaggtgggggtggactcatctctggtgtggctacctatatcaaggatgtggcaccctctatagaggttgtaggtgttgaggctagtggtgctcgtagtatgcgtgcagcctttgaccatggttatcctgtaaaacttgaaaagattgataagtttgcagatgggattgctgtccaaaaggtaggtgcaaaaacttacgaagttgctcgtaaatatgtagatcgtctcttgggagttgatgaaggattaatctcagaaaccttaattgatatgtactcgaaggttggtactatcgcagaacctgcaggggcagcatcagttgcggcacttgaagtgattaaagatgaaatcaaaggaaaaactatcgtttgcatcatttcaggcggtaataatgatatcaaccgtatgccagagatggaagaacgtgcccttatctatgatgggatcaagcactattttgtggttaatttcccacaacgtccaggagcccttcgtgagtttgtaaatgatatcttagggccaaatgatgacattactcgttttgagtacatcaaacgtgccaataaaggaaaaggtccagttctcattggtatagctcttagtgataagaatgattatgatggccttcttgagcgtctttctgaatttgatccaagttacattaatcttaacggaaatgaaacactttacaacatgcttgtctga

SEQ ID NO: 31594 - protein, 416 aa, Streptococcus thermophilus CNRZ1066
MITANDIVKANEVLKNVVERTPLDFDRYLSEKYGATIYIKKENMQKVRSFKLRGAYYAIHQLSDEDKEHGVVCASAGNHAQGVAYTCNEMKIPATIFMPVTTPLQKIGQVRFFGGKFVTIKLVGDTFDESAKAAQEYTKSEGMTFIDPFDDYNVQAGQGTVAYEIYEQAQEEGVSFDSILVPVGGGGLISGVATYIKDVAPSIEVVGVEASGARSMRAAFDHGYPVKLEKIDKFADGIAVQKVGAKTYEVARKYVDRLLGVDEGLISETLIDMYSKVGTIAEPAGAASVAALEVIKDEIKGKTIVCIISGGNNDINRMPEMEERALIYDGIKHYFVVNFPQRPGALREFVNDILGPNDDITRFEYIKRANKGKGPVLIGIALSDKNDYDGLLERLSEFDPSYINLNGNETLYNMLV

SEQ ID NO: 31595 - DNA, 936 bp, Thermus thermophilus HB8
  CDS (1)..(936): transl_table=11
atgccttccctccaagacctctacgccgccttccgccgcatcgccccctacacccaccgcacccccctcctcacctcccgcctcctggacgggctcctgggaaagcgcctcctcctcaaggccgagcacctgcagaagacggggagcttcaaggcccggggggcgctttccaaggccctcgccctggaaaaccccaaggggctcctcgccgtctccagcggcaaccacgcccagggggtggcctacgccgcccaggtgctcggggtaaaggccctggtggtcatgcccgaggacgcgagcccctacaagaaggcctgcgcccgggcctacggggccgaggtggtggaccggggggtgacggcaaagaaccgggaggaggtggcccgggcccttcaggaggagacgggctacgccctgatccacccctttgacgaccccctggtcatcgccgggcaggggacggcggggcttgagcttctggcccaggcggggcggatgggggtcttccccggggccgtcctcgcccccgtggggggcggggggctcctcgcgggcctggccacggcggtgaaggccctctcccccacaaccctcgtcctcggggtggagcctgaggccgcggacgacgccaagagaagcctggaggcgggaaggatcctccgcctggaagcgccccccaggacccgggcggatggggtgcggacgctaagcctgggggagcgcaccttccccatcctgcgggaaagggtggacgggatccttacggtgagcgaggaggccctcctcgaggcggagcgcctcctcttcacccgcaccaagcaggtggtggagcccacgggggcccttcccctggccgcggtgctggagcacggggcgaggcttccccaaaccctcgccctcctcctctccgggggcaaccgggacttctctccctag

SEQ ID NO: 31596 - protein, 311 aa, Thermus thermophilus HB8
MPSLQDLYAAFRRIAPYTHRTPLLTSRLLDGLLGKRLLLKAEHLQKTGSFKARGALSKALALENPKGLLAVSSGNHAQGVAYAAQVLGVKALVVMPEDASPYKKACARAYGAEVVDRGVTAKNREEVARALQEETGYALIHPFDDPLVIAGQGTAGLELLAQAGRMGVFPGAVLAPVGGGGLLAGLATAVKALSPTTLVLGVEPEAADDAKRSLEAGRILRLEAPPRTRADGVRTLSLGERTFPILRERVDGILTVSEEALLEAERLLFTRTKQVVEPTGALPLAAVLEHGARLPQTLALLLSGGNRDFSP

SEQ ID NO: 31597 - DNA, 1209 bp, Geobacillus kaustophilus HTA426
  CDS (1)..(1209): transl_table=11
atgttgacattagcagacattgaacaagcgcgagcgaaaatgaaaggcatcgtccatcaaacgccgcttgagcattcgcaaacgttcagccggctgtctggcaatgatgtatatatgaaactcgaaaatttgcaaaaaacgggctcgtttaaagtaagaggttcattcaataaaattatgtcgctcacggaagaagagagggcgcgcggcgtcatcgccgcttcggccggcaaccacgcccaaggggtcgcctatgcgagcggcatgcttcatattccgtgcacgatcgtcatgccaaaaggcgcgccgctcagcaaaattgaagcgacgaaaagctacggggcggaagtcgtgctgtacggcgatgtgtttgacgagtctttggaatatgcgttagagttgcagcgtgaacgggggatgacgtttgttcatccgtttgacgacttggcggtgatggccggccaagggacgatcggcttagagctgatcgagcagcttcccgacgtcgatgtcgttctttgtccagtcggcggcggcgggttgcttgcgggggtggcgcttacgttaaaacagctgaagccgtcggttgaagtgtacggcgttgagtcatcggcttgccccggcatgacggcggccatacgccataaacagcccgtctccattgccgcatcgaatacgatcgccgatgggattgccgtgaaaaagccgggcaatattacgtaccaatacattgagcaatacgtcgatggcgttgtatgcgtggaagaggcggaaatttcgcggacgatgctgtatgtgctcgagcggaacaagctgttgatcgaaggggcggcagcttgtccgctggcggcattgttgtatcaaaagctgccgtttcgcggcaaaaaagtcgccgccattttaagcggcggcaacgtcgatgtgacgctcatttcccgcatcatcgagcgggggctcgtcgaagccgggcgattcgttacgtttacaacggtcatctccgacaagccgggccagttgaacaagctgctgcgcattattgcggagcttgaggcaaacgtgatgtcgattcatcatcagcgcatcggcgccaaagtgctgccaggtcaggcggaaattcacttttcgctcgagacaaaaaacgaagaccacattcagcaaatctaccaagtgttgttgaaagaaggctacgatgtacagttttaccgatga

SEQ ID NO: 31598 - protein, 402 aa, Geobacillus kaustophilus HTA426
MLTLADIEQARAKMKGIVHQTPLEHSQTFSRLSGNDVYMKLENLQKTGSFKVRGSFNKIMSLTEEERARGVIAASAGNHAQGVAYASGMLHIPCTIVMPKGAPLSKIEATKSYGAEVVLYGDVFDESLEYALELQRERGMTFVHPFDDLAVMAGQGTIGLELIEQLPDVDVVLCPVGGGGLLAGVALTLKQLKPSVEVYGVESSACPGMTAAIRHKQPVSIAASNTIADGIAVKKPGNITYQYIEQYVDGVVCVEEAEISRTMLYVLERNKLLIEGAAACPLAALLYQKLPFRGKKVAAILSGGNVDVTLISRIIERGLVEAGRFVTFTTVISDKPGQLNKLLRIIAELEANVMSIHHQRIGAKVLPGQAEIHFSLETKNEDHIQQIYQVLLKEGYDVQFYR

SEQ ID NO: 31599 - DNA, 1272 bp, Geobacillus kaustophilus HTA426
  CDS (1)..(1272): transl_table=11
atggaacaacagctgaaacggaagcaaggggcggtatacgtcgaggacattttgatcgcgtatcatacgctgaaggatgttgttttccatacgccgctgcaaaaaaatccgctgttatccgagcgctacgagtgcaatgtctacttaaagcgcgaggatttgcaagtcgtgcgttcgtttaagttgcgcggggcgtacaaccggatgaagcatttaaccgatgaggagcggagaaacggggtggtatgcgccagcgccggcaaccatgcccaaggggtggcctattcatgccgggcgcttggcgtgcacgggaaaatttatatgccggcgacgacgcctcggcaaaaagtgtcgcaagtgcagctgtttggcaaagacatggtcgagatcgtgcttgtcggcgacacgtttgacgattcctacaacgaagcggtgaagtgcgccgaggcggaagggcggacgttcatccatccgtttgatgatgaatacgtcattgccggacaggggacgattggcgtcgaggtgttaaacgactgtgatgaaccgatcgactttttgttcgccagcatcggcggcgggggattgatggccggactagggacgtatgtgaaaagcatttctccgtccaccaaagtcatcggggtcgagccggctggcgccccatcgatgaaagcggcgctcgagcgcggacatgtggtgacgctcgatgaaatcgacaagttcgttgacggcgctgccgtcaagacggtcggggaaaagacattcgccttatgccgcggggtgcttgatgacatcgtcgtcgttccggaaggaaaagtatgcacgacgattttggagctgtacaacgaaaacgccattgtcgctgaaccggcaggggcgctgccgatcgccgcgcttgatttttacaaggaacaaatccgaggcaaaacagtcgtctgcgtcataagcggcggcaacaacgacatcgaccggatgcaggaaatcaaagagcgttcgatgatttacgaaggactgcagcactatttcatcgtcaacttcccgcagcgggctggggcgttgcgtgagtttttggatgaagtgcttgggccgaccgatgacatcacccggtttgaatacacgaagaaaaacaacaaagaaagcggaccggcgcttgtgggcatcgaactgaaacggcgcgaagactacgcgccgctcatcgagcggatgaagaaaaaaggcttcccgttccaagaagtgaacaaagacccgaacttgttccatttattgatctaa

SEQ ID NO: 31600 - protein, 423 aa, Geobacillus kaustophilus HTA426
MEQQLKRKQGAVYVEDILIAYHTLKDVVFHTPLQKNPLLSERYECNVYLKREDLQVVRSFKLRGAYNRMKHLTDEERRNGVVCASAGNHAQGVAYSCRALGVHGKIYMPATTPRQKVSQVQLFGKDMVEIVLVGDTFDDSYNEAVKCAEAEGRTFIHPFDDEYVIAGQGTIGVEVLNDCDEPIDFLFASIGGGGLMAGLGTYVKSISPSTKVIGVEPAGAPSMKAALERGHVVTLDEIDKFVDGAAVKTVGEKTFALCRGVLDDIVVVPEGKVCTTILELYNENAIVAEPAGALPIAALDFYKEQIRGKTVVCVISGGNNDIDRMQEIKERSMIYEGLQHYFIVNFPQRAGALREFLDEVLGPTDDITRFEYTKKNNKESGPALVGIELKRREDYAPLIERMKKKGFPFQEVNKDPNLFHLLI

SEQ ID NO: 31601 - DNA, 960 bp, Idiomarina loihiensis L2TR
  CDS (1)..(960): transl_table=11
atgccgaagttatcgctcccctgccatgccgatgtcgtacaagcgcagcaaagaattaatagctataccgtcaagacccctgtgctgacaaaccctgcgttaaatcagcaattgggctgcgaattatttttcaaatgcgagaatttgcaacgtaccggggcctttaagttccgtggtgccactaacgcgctacttaagcttagcccggagcagcgccagcaaggggttatcaccgtgtcttccggcaatcatggtgcggcattagcccatgcaggtaaagctttgggtgtaaaagtaaaagtgggtgtacccattaatgctcccgcaataaaacggcaaaatattgaagccggtggtgcggaaactaccgacatagaacccggtatggcagcgcgtgaagccattgtggccaagtggcaaaaggaaggtaaaagtcactttataccgccttatgatcatgccgacattattgccggtcagggcacagcaacacttgagttactggagcaaactgacgcactggatgctgtaatcacgccactgggtggtgggggcttgctttcaggagcttgtcttgcctgcgacggtaccgaaatacaagtgttcggtgcggagccggaattagcgaatgatgctttcttgtcattaaaagccggagagcggcaaccggcgttacccgcgaaaagcctgtgcgatggcttactgactcaaatcggtgaattgccgtttgccattattcagcaacgtatctgcggtatcttagtcttgaaggatgaagacaccctaagcgccatgaagctgatttggcatcatctgaaaattattgtggaaccgtcgtctgctatcgctttagctgcggttatacaaaataagtcgctatttgaaggtaaacgagtggggttggtgctgagcggtggtaatgttgcagcgcagccggaagatataaagctgcgccagtag

SEQ ID NO: 31602 - protein, 319 aa, Idiomarina loihiensis L2TR
MPKLSLPCHADVVQAQQRINSYTVKTPVLTNPALNQQLGCELFFKCENLQRTGAFKFRGATNALLKLSPEQRQQGVITVSSGNHGAALAHAGKALGVKVKVGVPINAPAIKRQNIEAGGAETTDIEPGMAAREAIVAKWQKEGKSHFIPPYDHADIIAGQGTATLELLEQTDALDAVITPLGGGGLLSGACLACDGTEIQVFGAEPELANDAFLSLKAGERQPALPAKSLCDGLLTQIGELPFAIIQQRICGILVLKDEDTLSAMKLIWHHLKIIVEPSSAIALAAVIQNKSLFEGKRVGLVLSGGNVAAQPEDIKLRQ

SEQ ID NO: 31603 - DNA, 1521 bp, Azoarcus sp. EbN1
  CDS (1)..(1521): transl_table=11
atgactgccgcaatcccggattatctggaaaaaaccctcaacgcccgcgtctatgacgtcgcggaagaaactccgctcgacctcgccccgaacctgtccgcacgcatccacaaccgcatctacctcaagcgcgaggacatgcagccggtattcagcttcaagctgcgcggggcctacaacaagatggcgcacctgccgccgcaggcgctcaagcggggggtgatctgcgcctcggccggcaatcatgcacaaggcgtcgcgctgtcggcgcagaagctcggggtgcgcgcggtgatcgtgatgccgacttcgacgccgcagatcaaggtcgacgcggtcagggcgcggggcggcgaggtggtgctcgccggtgactcctactcggacgcctacgcccactcgctggaactggaaaaggtggacaagctcactttcgtccatccttatgacgacccggacgtcatcgccggacagggcacgatcggcatggagatcctgcgcgcgcaccccgatccgatccacgcgattttctgcgccgttggcggcggcggactgatcgccggcgttgccgcctacgtgaagcggctgcggcccgaaatcaggatcgtcggcgtcgagacggtggacgccgacgcgatgacgcgctcgctcgcagcgggcgaacgggtcgttctcgaccaggtcggcctgttcgccgacggcaccgcggtcaagcagatcggcgaagagactttccggctgtgccgggagtatgtcgacgagatggtcctcgtcgacaacgacgcgatctgcgccgccctgaaagacgtcttcgaggacacgcgctcgatcctcgagccttccggcgcgctggcgatcgccggggcgaaggaatacgcgaagcgccacaatctgcatggcaagtgcctggtagcggtggcgtccggcgcgaacatgaatttcgatcgcctgcgtttcgttgccgaacgcgccgaagtgggcgagcaacgcgaggcggtgttcgccgtgacgatcccggaacgccccggctcgttccgcaaattctgcagcctcgtcggcgatcgccacatcaccgagttcaactatcgctacgccgacgccgaacaggcgcacatcttcgtcggcgtgtcggtgcacaaccgcgccgaggcgtcccgcctcatcgagatgctcgggcgccacgaactgccggcagtcgacctcaccgacgacgaaatggcgaagagccacgtccgctacatggtcggcggacacgcgccgcacatcgacaacgagctggtgtaccgcttcgaattccccgagcgccccggtgccctgatgaatttcctcacgaatctgcactcggactggaacatcagcctgttccactaccgcaaccacggctcggattcgggtcgcgtgctggtcggcatgcaggtgcctcccggcgacaagacggcattcagcgcgtttctcgaccggctcggctatgaatccgccgatgagtccgggaacccggcataccgcatgttcctcggctga

SEQ ID NO: 31604 - protein, 506 aa, Azoarcus sp. EbN1
MTAAIPDYLEKTLNARVYDVAEETPLDLAPNLSARIHNRIYLKREDMQPVFSFKLRGAYNKMAHLPPQALKRGVICASAGNHAQGVALSAQKLGVRAVIVMPTSTPQIKVDAVRARGGEVVLAGDSYSDAYAHSLELEKVDKLTFVHPYDDPDVIAGQGTIGMEILRAHPDPIHAIFCAVGGGGLIAGVAAYVKRLRPEIRIVGVETVDADAMTRSLAAGERVVLDQVGLFADGTAVKQIGEETFRLCREYVDEMVLVDNDAICAALKDVFEDTRSILEPSGALAIAGAKEYAKRHNLHGKCLVAVASGANMNFDRLRFVAERAEVGEQREAVFAVTIPERPGSFRKFCSLVGDRHITEFNYRYADAEQAHIFVGVSVHNRAEASRLIEMLGRHELPAVDLTDDEMAKSHVRYMVGGHAPHIDNELVYRFEFPERPGALMNFLTNLHSDWNISLFHYRNHGSDSGRVLVGMQVPPGDKTAFSAFLDRLGYESADESGNPAYRMFLG

SEQ ID NO: 31605 - DNA, 1242 bp, Azoarcus sp. EbN1
  CDS (1)..(1242): transl_table=11
atgtcgtccatcccggtgccgctcacattgcccgatctcgtcgccgcgcgcgaacgcatccgcgatgcggtcgtccgtaccggccagtggcagaatgacgcgctgtccgacgaactcggcgtgccgctgcaactgaagctcgaaaacatgcagcgcaccggctcgttcaagctgcgcggcgcgacgcacaagatcggccgcctgctggaagccggtgctcggcccgccggcgtcgtcgcggcgtcggccggcaaccacgcgcagggcgttgcgcgcgcggctgcgcgggtcggcctcggggcggtcgtcgtgatgccggcgaacgcgccgctgacgaagatccaggcgtgtcgcaagctcggtgccgacgtgcgcctcgtcggcgacacgctcgaagccgccagcgacgaagcgcgccggctggccgacggcgaagggctcgcgctgatccatccctacgacgactgggacgtgatcgccggccaggcgagctgcggcctggagatgctcgaagacgcgccggacatgaccgtcgcgatcgtgccgctcggcggcggcgggctgctctccggcgtcgcgctggcgctgaagctgcagaatccggcgatccgcgtcatcggcgtgcagaccgacgcggtcgcgccgtggcggcatttcttgcgcgacggcaccctcgaggcggtgcggccggacgcccacacgatcgccgacggcatcaaggtgaaacggccgggaatgctgacgcggcaggtgatcgcgcgccacgtcgacgacatcgtcaccgtcgacgacaacgcgatcgccgaggcgatcgtcacgctgctcgaacgcacgcgcacgatcggcgaaggtgcgggcgtggtcgggctcgcggcgctgctgcagcgcaaggtccgcctcgggcccgacgaccgcgcggtggtcgtgatttcgggcggcaacgtcgatatgacgctcgtcgggcgttcgatcgactacggcctcgcgtcgagcgggcggctgatgagcgtcgcggtgatgatttccgatgcgccgggccagttgctcgcgctgctggcgacagtcgccgaactcggcatgaacgtgcgccatgtcgagcaccgccgcggcgaactgcacgtcgcggtcggcatgaccgaagtgatcctgcagatcgagacgcgcgatgccgagcaccagcacgcgctgctgacgcactttgccgcccagggccttgccgtgcgcaacctgctcgcgggatga

SEQ ID NO: 31606 - protein, 413 aa, Azoarcus sp. EbN1
MSSIPVPLTLPDLVAARERIRDAVVRTGQWQNDALSDELGVPLQLKLENMQRTGSFKLRGATHKIGRLLEAGARPAGVVAASAGNHAQGVARAAARVGLGAVVVMPANAPLTKIQACRKLGADVRLVGDTLEAASDEARRLADGEGLALIHPYDDWDVIAGQASCGLEMLEDAPDMTVAIVPLGGGGLLSGVALALKLQNPAIRVIGVQTDAVAPWRHFLRDGTLEAVRPDAHTIADGIKVKRPGMLTRQVIARHVDDIVTVDDNAIAEAIVTLLERTRTIGEGAGVVGLAALLQRKVRLGPDDRAVVVISGGNVDMTLVGRSIDYGLASSGRLMSVAVMISDAPGQLLALLATVAELGMNVRHVEHRRGELHVAVGMTEVILQIETRDAEHQHALLTHFAAQGLAVRNLLAG

SEQ ID NO: 31607 - DNA, 1239 bp, Zymomonas mobilis subsp. mobilis ZM4
  CDS (1)..(1239): transl_table=11
atggtaagcttggataatccagagactcttcccgtttcacttgatgatatcaaacaggcgcatcaacgcattaagaatgccattattagaaccccgaccctttacagtcggactttgtctgacttgattggtgccggtgtctggctgaaatttgaaaatttccagtttaccgccgcctataaagaacggggtgcgttaaataaattattgtcgctggacaaggttgcccgcgaaagaggggttattgccgcttcggccggaaatcatgcccaaggtctcgcctatcacgggaatcgtttggatattccggtcacgatcgtgatgcctgtccataccccgacggtaaaagtcgagcagacccgtggacatggtgcgaatatcgtcctttatggcgaacaattcgatgaatcccttgcccatgcgttagaattggctgaaaaagacaatctgacctttgtccatcctttcaatgatccagctattattgccggtcagggcacggttgcccttgaaatgttggaagatgccccagcgattgacactctggttgtgccagtgggtggcggcggcctgatttcaggctgtgctgtggttgccaaaaacgcagatcggcctttggatgttattggtgccgaagccgagctttatccttcgatgtatgattatatcaaagggaaaaatctgccttgcggtggggatactctggcagaagggatcgcggttcaggttcccgggcagttaactcgccgttttgttgaagccttggtcgatgatattttgctggtcagtgaaagcaatatcgaacatgctttgtctttgattgttcagattgaaaagacgattgttgaaggggctggcgcggctggtttgggggcgttgctatcgcatcccgaacgattccaaggcagacaggtaggcattatcttttctggcggtaatatcgacacccgcttgttagccaatgttctattgcgtgatttggcacgctctggtcgtctggcgcggttgcgggtcagaatgaaagatcaagcaggtcagctttacaaagtagcgcgtgttttccacgatcagcaggcgaatattgtcgaaatttcttatcagcgcatctttacaaccctgcccgctaagggattatgtgccgatattgaatgtgaaacgcgcgatcaggctcatttgcggcatttaatcgatgctttacgtgaagcgggttatggtgtgaccttgattgaaccggcctga

SEQ ID NO: 31608 - protein, 412 aa, Zymomonas mobilis subsp. mobilis ZM4
MVSLDNPETLPVSLDDIKQAHQRIKNAIIRTPTLYSRTLSDLIGAGVWLKFENFQFTAAYKERGALNKLLSLDKVARERGVIAASAGNHAQGLAYHGNRLDIPVTIVMPVHTPTVKVEQTRGHGANIVLYGEQFDESLAHALELAEKDNLTFVHPFNDPAIIAGQGTVALEMLEDAPAIDTLVVPVGGGGLISGCAVVAKNADRPLDVIGAEAELYPSMYDYIKGKNLPCGGDTLAEGIAVQVPGQLTRRFVEALVDDILLVSESNIEHALSLIVQIEKTIVEGAGAAGLGALLSHPERFQGRQVGIIFSGGNIDTRLLANVLLRDLARSGRLARLRVRMKDQAGQLYKVARVFHDQQANIVEISYQRIFTTLPAKGLCADIECETRDQAHLRHLIDALREAGYGVTLIEPA

SEQ ID NO: 31609 - DNA, 954 bp, Silicibacter pomeroyi DSS-3
  CDS (1)..(954): transl_table=11
atgtatataccgacctttgaggacatgcttgccgcgcatgcgcggatcgaaccccatatccgccgcacgccggttcgggtctcggattacctcaacgagctgaccggtgcgcagctgttcttcaaatgcgagaactttcaggagccgggcgcgttcaagatacgcggcgctaccaacgcggtgtttggcctggacgatgcccaggccgcaaagggggtcgccacgcattcatcgggcaatcatgcctcgtgtctgagctatgccgcgatgctgcgcggtatcccctgcaacgtggtgatgccaagcaccgcgccgcaggccaagaaggacacggtgcgccgttatggcggggtcatcaccgaatgcgccccctcgaccagcgcgcgcgaagagacctttgcccgggtgcaggcgcaaaccgggggcgatttcgtgcatccctataacgacccccgggtgatcgcggggcaggggacatgcgcgcgcgaactgatggaacagaccgatggtctggatatcgtggtggcaccgatcggcggtggcggcatgatctctggcacctgcctgaccctgtcgacactggcgcccgagacccgagtgatcgcggccgaaccggaacaggccgatgacgcctatcgcagcttcaaggcgggccatatcatcgccgatgacgcacccaagaccattgccgatggtctgctggtaccgctcaaggatctgacctggcatttcgtcagcaaccatgtggccgaaatctacacggcctccgagcaggagatcatcgaggcgatgaagctgacatggaaacacctgcgcgtggtgatggaaccctccagcgcggtgccgctggcgacgatcctgaagaaccgcaaggcatttgcgggcaagcgcgtgggcgtaatcattaccggcggcaacgtcgatctggacaaacttccttggatgaacgggtga

SEQ ID NO: 31610 - protein, 317 aa, Silicibacter pomeroyi DSS-3
MYIPTFEDMLAAHARIEPHIRRTPVRVSDYLNELTGAQLFFKCENFQEPGAFKIRGATNAVFGLDDAQAAKGVATHSSGNHASCLSYAAMLRGIPCNVVMPSTAPQAKKDTVRRYGGVITECAPSTSAREETFARVQAQTGGDFVHPYNDPRVIAGQGTCARELMEQTDGLDIVVAPIGGGGMISGTCLTLSTLAPETRVIAAEPEQADDAYRSFKAGHIIADDAPKTIADGLLVPLKDLTWHFVSNHVAEIYTASEQEIIEAMKLTWKHLRVVMEPSSAVPLATILKNRKAFAGKRVGVIITGGNVDLDKLPWMNG

SEQ ID NO: 31611 - DNA, 975 bp, Silicibacter pomeroyi DSS-3
  CDS (1)..(975): transl_table=11
atgagcacccttgaactgatcgaagccgctgccgagcggctgtcgggccatgtccgccgcacaccgctgctctcctcgccctttctggacgagatcgccgggcgccgggtactggtgaaacccgaatgcctgcaacataccggcagcttcaagtttcgcggcgcatggtcggccatttccgcgctggaccccgaggcgcgcgcgcgcggggtcatcgccttttcctcgggcaaccatgcgcaaggggtcgcccatgcggccacgctgcatggcatcgcctcggtcatcgtgatgccctcggacgcgccccggctcaagatcgacaacacaagagcgctgggggccgaggtggtgctgtatgaccggggccgcgaaagccgcgaagagatcggcaccgcgctggccggtgaacgcgggctgacgctgatccggccctatgacgaaccgcaggtgatcgccggtcaggccagcgtcgggctggaactggccgaacaggcgggcgaactgggggtcgagagcggcgatgtgctggtctgttgcggcggtggcgggttgacctcgggcgtggcactggcgctggaggcgcgggcgccgggcctgagggcgcgcccggtcgagcccgaggggtttgacgatgtgaaacgctcgcttgccggcgggaccatcagccgcaacaattcggaaaccggcaatatttgcgacgcgatcctgacgccggaaccgggcaggattacctttccgatcctcagccggctctgtggccccggcctggccgttaccgaggacgaagccctgcgcgccatggcgctagcctttctgcgcctcaagatcgtgctggaaccgggcggggcggtctcgctggcggcggccctgtttcacccggaccaggtcgaaggcgacaccgtgctggccgtggcctcgggcggcaatgtcgacgcggccctgttccgcaccgcgctggagctccacgcgtga

SEQ ID NO: 31612 - protein, 324 aa, Silicibacter pomeroyi DSS-3
MSTLELIEAAAERLSGHVRRTPLLSSPFLDEIAGRRVLVKPECLQHTGSFKFRGAWSAISALDPEARARGVIAFSSGNHAQGVAHAATLHGIASVIVMPSDAPRLKIDNTRALGAEVVLYDRGRESREEIGTALAGERGLTLIRPYDEPQVIAGQASVGLELAEQAGELGVESGDVLVCCGGGGLTSGVALALEARAPGLRARPVEPEGFDDVKRSLAGGTISRNNSETGNICDAILTPEPGRITFPILSRLCGPGLAVTEDEALRAMALAFLRLKIVLEPGGAVSLAAALFHPDQVEGDTVLAVASGGNVDAALFRTALELHA

SEQ ID NO: 31613 - DNA, 1227 bp, Silicibacter pomeroyi DSS-3
  CDS (1)..(1227): transl_table=11
atgagcgatttcatgacccgagcccgcgccgccgaacaggcgatgcgcgaagttttccccgccacgccgttgcagcgaaacgaccatctgtcggcgcgttatggcgccgatatctggcttaagcgcgaggatctgagcccggtccgctcctacaagatccgaggtgcgttcaacgcgatgcgcaagcagccggggcaggggctgttcgtctgtgcaagtgccggcaatcatgcccagggcgtggcctttatgtgtcggcacatgggggtacggggcgtgatcttcatgccggtgaccacgccgcagcagaagatccagaagacccgcatgttcggcggcgatcaggtcgaaattcacctgaccggcgactatttcgaccagacgctggccgccgcacaggcctggtgcgcgcaggagggtgggcatttcctgtcgcccttcgacgatgccgatgtgatcgaggggcaggcctcgctggccgtcgagatcgaggaacagctgggcggcgtgcccgatcatgtggtgctgccggtgggtggcggcggcatgtcggcgggggtggcgacctggttcggggatcgcagccattgcatctttgtcgaacccgagggcggcgcctgcctgcgcgcggcgctggcggcggggcatccggtaaagctggatcatgtggacaatttcgtcgatggcgcggcggtgggccggatcggggaaaagacattcgaactgctgaaatcgcggcacatgtccgatgtgctggtgatgcccgaagatcgcatctgcaccaccatcatcgagatgctgaatgtcgaggggatcgtgctggaacccgccggcgcgctgtcggtcgaggcggtggccgatgtgcaaagctttgtccggggcaagacggtggtctgcgtcacctcgggcggcaatttcgatttcgaacgcctgcccgaggtcaaggagcgcgcgcagcgctatttgggggtcaagaaatacttcctgctgcgcctgccacagcgaccgggcgcgctgaaggaatttctgaacattctggggcccgatgacgatatcgcccggttcgaatacatgaagaaatcggcgcgcaatttcggctcggtcctgatcgggatcgaaaccgcgaggcccgagaacttcgaacgcctttacgcccgtctggacgaggccgggtttacctataccgatatcacccgcaacgagacgctggcgcaattcgtgatctga

SEQ ID NO: 31614 - protein, 408 aa, Silicibacter pomeroyi DSS-3
MSDFMTRARAAEQAMREVFPATPLQRNDHLSARYGADIWLKREDLSPVRSYKIRGAFNAMRKQPGQGLFVCASAGNHAQGVAFMCRHMGVRGVIFMPVTTPQQKIQKTRMFGGDQVEIHLTGDYFDQTLAAAQAWCAQEGGHFLSPFDDADVIEGQASLAVEIEEQLGGVPDHVVLPVGGGGMSAGVATWFGDRSHCIFVEPEGGACLRAALAAGHPVKLDHVDNFVDGAAVGRIGEKTFELLKSRHMSDVLVMPEDRICTTIIEMLNVEGIVLEPAGALSVEAVADVQSFVRGKTVVCVTSGGNFDFERLPEVKERAQRYLGVKKYFLLRLPQRPGALKEFLNILGPDDDIARFEYMKKSARNFGSVLIGIETARPENFERLYARLDEAGFTYTDITRNETLAQFVI

SEQ ID NO: 31615 - DNA, 1008 bp, Silicibacter pomeroyi DSS-3
  CDS (1)..(1008): transl_table=11
atgacgacgaaaatcactcttcaggacagcatcagggcgcgggcgcggattgccgggcgtatccgcgaaacccctttggtggaatcgccctctctcagcagtctgagcggcaggcaagtcctgctaaagctggaaagcaggcagatcaccggcagcttcaagctgcgcggcgccaccaatgcggtcttgtcgctgacggatacgcagcgcgcggcgggcgtggttggggtatctaccggcaaccacgggcgcggactggcctatgcggcggcagaggccgaggtgcgttgcatcatctgcatgtcggaactggtgccgcagaacaaggttgacggcatcagatcccatggcgccgaggtgcgtatcctgggccggtctcaggacgatgcgcagcaggaagtcgaccggctggtcagagatggcatgaccatgctgcccccctttgaccatccggatatcattgccggccagggcaccgtcgcgctggaaatgctggatcaggcgccagaccttgaaaccgtgttggttcccctgtcgggtggcgggctgatttccggtgtcggcatggttctgaaagcggcgaacccggatatccgggtgatcggcgtcagcatggaacgcggcgccgcgatgtatgaatgcctgcaggcgggcaggcccgttcaggttgcggaactgcccacattggccgactctctgggcggggggatcgggctggacaatgcctatacattcgaaatgaccaaggcgtttgtcgatgaggtggtgctggtgtccgaggctgaaatcgccgccgccatccgccatgcctatttcgaggaacgcgaggtgatcgaagggtccggcagcgtcggcatcgcggcgctgctggccggcaagatcggcaatcccggccgttgtgtgtcgctggtgagcggtcagaacatcgctatggacctgcacaaacgcatcatcgacggtgaagacgtggatgtggaagccgacatcaaaggaggcgcagatgcctga

SEQ ID NO: 31616 - protein, 335 aa, Silicibacter pomeroyi DSS-3
MTTKITLQDSIRARARIAGRIRETPLVESPSLSSLSGRQVLLKLESRQITGSFKLRGATNAVLSLTDTQRAAGVVGVSTGNHGRGLAYAAAEAEVRCIICMSELVPQNKVDGIRSHGAEVRILGRSQDDAQQEVDRLVRDGMTMLPPFDHPDIIAGQGTVALEMLDQAPDLETVLVPLSGGGLISGVGMVLKAANPDIRVIGVSMERGAAMYECLQAGRPVQVAELPTLADSLGGGIGLDNAYTFEMTKAFVDEVVLVSEAEIAAAIRHAYFEEREVIEGSGSVGIAALLAGKIGNPGRCVSLVSGQNIAMDLHKRIIDGEDVDVEADIKGGADA

SEQ ID NO: 31617 - DNA, 921 bp, Silicibacter pomeroyi DSS-3
  CDS (1)..(921): transl_table=11
atggattggaaagcggatatcgcggcggcggcggatcggatcgccgggcatgtgcaagtgaccccggtgatggagacgcgcggatttggcctgtccgacccgctttccctgaagctggaacagatgcagcataccggcagtttcaaggcgcgcggggcctttaataccctgctgtccagcgacgtgcccgctgcgggtgtggtggccgcatcgggtggcaatcatggtgcggcggtggcctatgcggcccgcgctctgggccatcgcgccaagatcttcgtgccggaaatggctggccccgccaagatcgcgctgatccgggataccggcgccgatcttgaggtggtgccgggcgaatatgccaatgcgctggccctggcgcaggcgcatgaggccgccaccggcgcgatgcagatccatgcctatgacgcgcccgcgaccgttgccgggcagggcacctgctttgccgaatgggatgcgcaggggctagaggccgatacggtggtgatcgcggtcggcggtggcggtctggtcgccggggcgctggcctggtggcagggtgcgcgcaaggtggtcgcggtcgagccggaaacctcctgcgcgctgaatgccgcgctgaccaacggtgggccggtcgatgtcgaggtgtcgggcatcgccgccaatgcgctgggcgcgcggcggatcggcgagatctgtttcggtctggcgcaggggggtgcccggtcggttctggttccggacgcggcgattgccgcggcccagcgcgcgctctgggccgagcgccgggttctggtcgagcccgcgggtgcaaccgcgctggcggcgctgatgtgcggcgcctatcgtcccgagccggacgagcgggtggcggtactggtttgcggtggcaatatcgccccggatccctttgccgggtga

SEQ ID NO: 31618 - protein, 306 aa, Silicibacter pomeroyi DSS-3
MDWKADIAAAADRIAGHVQVTPVMETRGFGLSDPLSLKLEQMQHTGSFKARGAFNTLLSSDVPAAGVVAASGGNHGAAVAYAARALGHRAKIFVPEMAGPAKIALIRDTGADLEVVPGEYANALALAQAHEAATGAMQIHAYDAPATVAGQGTCFAEWDAQGLEADTVVIAVGGGGLVAGALAWWQGARKVVAVEPETSCALNAALTNGGPVDVEVSGIAANALGARRIGEICFGLAQGGARSVLVPDAAIAAAQRALWAERRVLVEPAGATALAALMCGAYRPEPDERVAVLVCGGNIAPDPFAG

SEQ ID NO: 31619 - DNA, 969 bp, Bacillus clausii KSM-K16
  CDS (1)..(969): transl_table=11
atggacacgattcctgtcaaagcggtatggcaagcacgcaaacggctttttccttatctgccaaaaacgcccctcgtttatagcgctcccttatcgggtcatttccgaacgcctgtttggttgaaattagaaacattacagccgagcggctcatttaagctccgcggggcgatgaacgtgctcttgtctatgtcagctgagtcaagacaaaaaggcgttgctgctttttccacgggaaaccatggccttgcggtcgcctatgccgccaaacaggctaaaacgcaggcgacgatttttgtatcggaagcagtaccgactgctaagcaagctgcacttcaagccagcggggcaacgctaactgtgacagggcgcagccaagatgaagcaggagccgcctgtatccgccattgccagcaaacagggcagacgctcgtccctccatttgacgacgacaggattatcgctggccaaggcacactcgctttagagctgctagacgatttgcctgaacttgaaacggtgatcgctggattatcaggaggagggttgcttagcggtattgggctagtaatgaaacataccgatccgacgattcaagttgccggggcaagcatcgtcaacggagccgctatggaagccagtttggcagcgggccatccagtagaagtagccgaacagccgactgtggccgatagccttcttggcggaatcgctctggacaaccgttggacgtttaaggcggtgcaacgttatgtcgacacccgtgtacaagttccagaagaagacattgccaaggcgatggcgtatttatatgagcatcaccatttaatcgtggaaggagcagctgccataggagcagccgcactgttaaataatagcattcgccctaaagggcgtaccgctgttgtcattactggcgccagcattcacccaaaagagcatcaccgcattattcgcccttacctctag

SEQ ID NO: 31620 - protein, 322 aa, Bacillus clausii KSM-K16
MDTIPVKAVWQARKRLFPYLPKTPLVYSAPLSGHFRTPVWLKLETLQPSGSFKLRGAMNVLLSMSAESRQKGVAAFSTGNHGLAVAYAAKQAKTQATIFVSEAVPTAKQAALQASGATLTVTGRSQDEAGAACIRHCQQTGQTLVPPFDDDRIIAGQGTLALELLDDLPELETVIAGLSGGGLLSGIGLVMKHTDPTIQVAGASIVNGAAMEASLAAGHPVEVAEQPTVADSLLGGIALDNRWTFKAVQRYVDTRVQVPEEDIAKAMAYLYEHHHLIVEGAAAIGAAALLNNSIRPKGRTAVVITGASIHPKEHHRIIRPYL

SEQ ID NO: 31621 - DNA, 1245 bp, Bacillus clausii KSM-K16
  CDS (1)..(1245): transl_table=11
atgaccacgcatttacaggatattattcgagcaaatcaacaaattaaagatgtcgtgacgcatacacctttgcaaaaagatcaggttttgtctgaacgatatgattgcacagtttatttaaaacgagaagacatgcaagttgtcagatcttttaaaattcgcggcgcctattaccaaatttcttctctttcaaaagaagaacttgccgctggggttgtatgcgcaagcgctggaaaccatgcacaaggggttgcctactcatgccgcgctttaaaagtcaaaggtgttattttcatgccgactaccacgccaaagcaaaaagtcgcacaagtgaaattttttggcagggactatgtggacgttagattaattggcgatacgtttgatgattcttatgcggacgccattcaatactgcgaagagcaggaaatgacgttcatccacccatttaaccaagacaaagtgattgctgggcaaggaacagtcgggcttgaaattatgaatgacattgaggaaacgccagactttgtgttttcatcaatcggcggtggtgggcttattagtgggatggcaacgtatataaaaagcgttagcccgtctacgaaaatgattggctgtgaaccagccggtgctgcatcgatgacagaatcaattaagcaaggcaacgttgttgagttagacgaaatcgataaatttgtcgatggggcagctgtgaagaaagtcggcgacaaaacatttgaaatttgcaaagagctgctagatgacattattgttgttccagaaggaaaaatttgcacaacgattttaaacctttacaatgagaatgcgctagtcgctgaaccggcaggggctatgcctattgctgctcttgatttgtatacggaacaaattaagggaaaagtcgttgtctgtattgttagtggcggcaacaacgacatcgggcgcatggaggaaatccgggaacgttcgctcatttatgaaggattgcagcattactttatcgttgaatttccacagcgagctggggcgctacgtgagtttattaccgatgtgctcggcccggaagacgacattactcgctttgaatatacaaagaaaaacaataaatcgaacggtccagtattaattgggattgaactgaaatgcagcaaagattatgatgggttaatcgaaagaatggaaaagattggatttgcctataatgaagtcaacaaggatgaaaatttgttttctttgctgatttga

SEQ ID NO: 31622 - protein, 414 aa, Bacillus clausii KSM-K16
MTTHLQDIIRANQQIKDVVTHTPLQKDQVLSERYDCTVYLKREDMQVVRSFKIRGAYYQISSLSKEELAAGVVCASAGNHAQGVAYSCRALKVKGVIFMPTTTPKQKVAQVKFFGRDYVDVRLIGDTFDDSYADAIQYCEEQEMTFIHPFNQDKVIAGQGTVGLEIMNDIEETPDFVFSSIGGGGLISGMATYIKSVSPSTKMIGCEPAGAASMTESIKQGNVVELDEIDKFVDGAAVKKVGDKTFEICKELLDDIIVVPEGKICTTILNLYNENALVAEPAGAMPIAALDLYTEQIKGKVVVCIVSGGNNDIGRMEEIRERSLIYEGLQHYFIVEFPQRAGALREFITDVLGPEDDITRFEYTKKNNKSNGPVLIGIELKCSKDYDGLIERMEKIGFAYNEVNKDENLFSLLI

SEQ ID NO: 31623 - DNA, 1071 bp, Bacillus clausii KSM-K16
  CDS (1)..(1071): transl_table=11
atggctgcttgggcaggacttttaaaagaatacggctcgtatttgccgattacggaaaacacgccggcattgacgcttggcgagggcaatacgcctttaattaaactcgaacatttatcagaagagtggggcgtagagctttatgtgaagtatgaaggggcaaacccgactggctcgtttaaagacagaggaatggttgttgctgtcgcaaaagcaaaagaagaaggggcgcaggcgcttatttgcgcctcaacaggcaatacgtctgcggcagcttccgcctacggggcccgcgcggggcttcgttcaattgtcgtcattccaaaaggcaaaacggcacttgggaaagtagcccaagcggcgatgtacggagcagaaatcattgaaattgaaggaaactttgaccgcgctcttgcgctcgtaagagaattatgtgaaacggagccaattgcccttgtcaactcggtcaacccatataggctccacggccaaaagacagcagcttttgaaatttgtgatgcgctaggggctgctccagatgtattggcgatccctgtcggaaatgccggaaacatctctgcttattggatgggctttaaagaatacgatgagttgcaccaaacgggccggccgcgtatgcatggatttgaagcggaaggggcggcagcgattgtgaagcaacatgtcattgagcacccagagacgattgccactgccattcgcatcggcaatccggcgagttggaaattggctgtacaagctgcgaatgagtcaaaaggcgaaatcgacttagtgacggacgaagaaattgtcgaggcgtaccgggaaatagcgaaaaaagaaggcatatttgctgaaccaggttcatgtgcatcattggctggcttaaaaaaacacattcaagcagggaaagtagcaaagggctccaaaattgtcgccgttctaactggcaatggcttgaaggacccgacaacagctatagatctttccaatgtgcaaacgacaacggttgaagattcaaaaacagcgttggccgattacttaatggccacaaagccggcggtcaagtaa

SEQ ID NO: 31624 - protein, 356 aa, Bacillus clausii KSM-K16
MAAWAGLLKEYGSYLPITENTPALTLGEGNTPLIKLEHLSEEWGVELYVKYEGANPTGSFKDRGMVVAVAKAKEEGAQALICASTGNTSAAASAYGARAGLRSIVVIPKGKTALGKVAQAAMYGAEIIEIEGNFDRALALVRELCETEPIALVNSVNPYRLHGQKTAAFEICDALGAAPDVLAIPVGNAGNISAYWMGFKEYDELHQTGRPRMHGFEAEGAAAIVKQHVIEHPETIATAIRIGNPASWKLAVQAANESKGEIDLVTDEEIVEAYREIAKKEGIFAEPGSCASLAGLKKHIQAGKVAKGSKIVAVLTGNGLKDPTTAIDLSNVQTTTVEDSKTALADYLMATKPAVK

SEQ ID NO: 31625 - DNA, 978 bp, Rhodobacter sphaeroides 2.4.1
  CDS (1)..(978)
atgagcgacatcgcgatgatcgaggctgcagcggcccggcttgcgggccatgcccggcggacgccgcttctctcctcgccctttctcgacgagatcgcggggcggcgggtgctggtgaaggccgagtgcctgcagcacacgggctcgttcaagttccgcggcggctggtcggcgctctcggcgctggagccggcccggcgcgcgcagggcgtgatggcctattcctcgggcaaccatgcgcagggcgtggcgctggccgcggcccgccacggcgcgcccgccgtgatcgtcatgcccgccgatgcgccgcagctgaagatcgagaacacccgcgcgctcggcgccgaggtggtgctctacgaccgcgcgaccgaggaccgcgatgcgatcggcgcgcggctggccgacgagcggggtctcaccctgatccgccccttcgacgagcccctcgtgatcgccggtcagggcacgaccgggctcgagatcgccgagcaggcggccgaggagggcgtgacctctgccgatgtcctcacctgctgcggcggcggcgggctcaccgcgggcatcgcgctggcgctcgaggcgcgcgcgcccggcctccgggtccgcccggtcgagccggtggggttcgacgatacggcacgcagcctcgccgccggcgagatccggtcgaacgcggcgctctcgggctcgatctgcgatgcgatcgtgacgccccagccgggccggatcacctttccgatcctcgcgcggctctgcgggccgggcctcgccgtcaccgacgcggaggcgctccgcgccatggcgctggccttcctgcggctcaagatcgtgctcgagcccggcggggcggtggcgctggccgcggcgctcttccggcccgacgcgctcgagggcgacgccgtgatctgcaccgcctcgggcggcaatgtggatccgcccctctttgcccgcgccctcgcggaggccgccgactga

SEQ ID NO: 31626 - protein, 325 aa, Rhodobacter sphaeroides 2.4.1
MSDIAMIEAAAARLAGHARRTPLLSSPFLDEIAGRRVLVKAECLQHTGSFKFRGGWSALSALEPARRAQGVMAYSSGNHAQGVALAAARHGAPAVIVMPADAPQLKIENTRALGAEVVLYDRATEDRDAIGARLADERGLTLIRPFDEPLVIAGQGTTGLEIAEQAAEEGVTSADVLTCCGGGGLTAGIALALEARAPGLRVRPVEPVGFDDTARSLAAGEIRSNAALSGSICDAIVTPQPGRITFPILARLCGPGLAVTDAEALRAMALAFLRLKIVLEPGGAVALAAALFRPDALEGDAVICTASGGNVDPPLFARALAEAAD

SEQ ID NO: 31627 - DNA, 1053 bp, Xylella fastidiosa Dixon
  CDS (1)..(1053)
atggatatacctgatgtaggtcacaccgttgtcaagcaatccaatgcaagtaacgtcaataccgtgagtgtggccgatgtgttggctgcacaagcccgcttacgtcgttatctaatgcctaccccaattcactatgccgagcgtttcggagtgatgctgaagttagaaaatctgcaacgcaccggatcctataaagtgcgcggcgcactgaacgcaatgttagttgcgctggaacgcggcgataaccgcccagtcatttgcgcatcagccggtaaccacgcccaaggcgtagcttggtcagcttaccggctgggtatacaagcaatcactgtcatgcctcacggtgctccggccacaaaggttgcaggtgtttcacattggggggcaacggtacgccaacacggccaaagctatgacgaggcctatacgttcgcatgtgagttggctgagcaaaacgattaccgctttctatcagcattcgatgatccggatgtgattgccggtcagggaactgttggcatagagatcaccgcgcatgaaccggatgtagtcattgtgccgatcggcggcggcggccttgcttcaggcattgctttggtgctgcgctcacagggagtacgtgtcattggcgctcaggtcgagggcgtggatgcgatggcgcgtgcaatccgtggcgacacacgcgagatcgctccagtttcgaccttagctgacggggtgaaagtcaagattcctggtttcattacccgccatctgtgtgccaacttgttagacgatgtagtaatcgtgcgtgaggctgaactgcgcgaaacattggtgcgtttactattggaagaacacctgatcgccgaaggggcaggcgcactggcattggccgctggccgccgcgtttcaggtaagcgcaagtgtgcagtggtctccggaggtaatattgacgctgcagtactggccaaactgttgtcagaagtaagaccacggccaccacgcaaaccacgcagacgtagtgcagatcgccccaacaattccggcaatttaccgctcccttttaactga

SEQ ID NO: 31628 - protein, 350 aa, Xylella fastidiosa Dixon
MDIPDVGHTVVKQSNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPATKVAGVSHWGATVRQHGQSYDEAYTFACELAEQNDYRFLSAFDDPDVIAGQGTVGIEITAHEPDVVIVPIGGGGLASGIALVLRSQGVRVIGAQVEGVDAMARAIRGDTREIAPVSTLADGVKVKIPGFITRHLCANLLDDVVIVREAELRETLVRLLLEEHLIAEGAGALALAAGRRVSGKRKCAVVSGGNIDAAVLAKLLSEVRPRPPRKPRRRSADRPNNSGNLPLPFN

SEQ ID NO: 31629 - DNA, 1266 bp, Leuconostoc mesenteroides subsp. mesenteroides ATCC 8293
  CDS (1)..(1266)
atgacgactgagggaaagctaacggctgaagaaatagatgaggcgcatcgagtcttgtcaaaggtagtaacgcatacgccattggcatatgatgactatctatcaaaaaaatatagagctaatgtgtatcttaaacgagaagatatgcaacgggttcgttcgttcaaaattcgtggtgcctactacaatatcattaaggcagagaaagaaaaactcaataatggggttgttgctgcttcagctggaaaccacgcgcaaggcgtagccgatacatgtcataatttaaagatacaagcaactatttttatgccagtcattacaccaaatcaaaaagtagaagcggttaaacgttttggtggtcaatatgttacggtaatcctagtcggtgatacctttgacgaagcacaaagtgcagcgtttgaatacactgaaaaacataatatgttctttgtagcaccatttgatgatcggcgtaccatggctgggcaaggcacggtggcggttgaggtatttgaagatgctgtagagcaaaatattaatgttgattatttgattgcttctgttggtggtggcggtttaatcggtggtctgtcgacctattctaaaaaggtatcaccacaaaccacagtagtaggtgtcgaaccagaaacggcacagtcaatgaaagcggcttttcaagctcaaaaacctaccaccgtcgagaatatcgatcactttgttgatggtgctgccgttgcgcgtgtcagtcagtttacctataatcaagcacagcagtatgttgacaaactgctggctatccctgaaggaaaggttgctcaagcagtattagacttgtacacttatgaggcgatagttgccgaaccagctggagcgatgcctatcgctagtttggattttatggccagtgatatcgtagggaaaaacgtcgttctagttgtttctggtggaaacaatgatatcggccgtatgcaagaaatggaacaaaaggcattaatgtataagggtcgccaacagttttacttagttgagtttccgcaacgacccggggcattacggcaatttgtaaatgatgttttaggaccaaacgacgatattactcgttttgaatatactaaaaaaataaactctgaaacaggctctgtcatggttggtattctgctggatcctgttacgaaagtagatgacttaacagcccgtttagcagctttttttccaaaatatatcaatttgcaagaaaatactgtgcttttcaatatgttagtttag

SEQ ID NO: 31630 - protein, 421 aa, Leuconostoc mesenteroides subsp. mesenteroides ATCC 8293
MTTEGKLTAEEIDEAHRVLSKVVTHTPLAYDDYLSKKYRANVYLKREDMQRVRSFKIRGAYYNIIKAEKEKLNNGVVAASAGNHAQGVADTCHNLKIQATIFMPVITPNQKVEAVKRFGGQYVTVILVGDTFDEAQSAAFEYTEKHNMFFVAPFDDRRTMAGQGTVAVEVFEDAVEQNINVDYLIASVGGGGLIGGLSTYSKKVSPQTTVVGVEPETAQSMKAAFQAQKPTTVENIDHFVDGAAVARVSQFTYNQAQQYVDKLLAIPEGKVAQAVLDLYTYEAIVAEPAGAMPIASLDFMASDIVGKNVVLVVSGGNNDIGRMQEMEQKALMYKGRQQFYLVEFPQRPGALRQFVNDVLGPNDDITRFEYTKKINSETGSVMVGILLDPVTKVDDLTARLAAFFPKYINLQENTVLFNMLV

SEQ ID NO: 31631 - DNA, 1515 bp, Azotobacter vinelandii
  CDS (1)..(1515)
atgctcgaacagtacgtcaagaagatccttacctcgcgcgtctacgacgtcgccgtcgaaactcccctgcagcctgcccgccagctctccgaacgtctcggcaaccagatcctgctcaagcgcgaggatctgcagccggtgttctccttcaagatccgcggcgcctacaacaaggcggcccggctgagcgaggccgagctggcgcgcggcgtggtcaccgcctcggccggcaaccatgcccagggcgtggccctggcggccaggcacctgggcatcaaggcggtcatcgtgatgccgaggaccaccccggagatcaaggtccaggcggtgcgcgcgcgcggcgccaaggtggtgctgcatggcgacgcctttcccgatgcgctggcccattcgctgaagctggtcgaggagaagggctacgtctacatccacccctacgacgatcccgacgtgatcgccgggcagggcacggtggccatggagattctccgccagcagccgggccggctggacgccgtgttcgtgccggtcggcggcggcggactgatcgcgggtatcgccgcctatgtgaaatacctgcgtcccgaggtccgggtgatcggtgtcgaaccggaggactccaactgcctgcagatggccatggccgccggcgagcgggtggtgctgccgcaggtcgggctgttcgccgacggggtggcggtggcgcagatcggcgcctgcaccttcgacatctgccgccatcacgtggacgaggtggtcactgtcagtaccgacgagatctgcgcggcgatcaaggacatctacgacgacacccgctcgatcaccgagccggccggtgccctggcggtggccgggatcaagcgctacgtcgagcgcgaaggggcgagcgggcagaccctggtggccatcgattccggtgccaacatcaacttcgaccgcctgcgccatgtggccgagcgctccgaactgggcgagaagcgcgaggcgatcatcgccgtgaccatccccgagcagccgggcagcttcaaggcgttctgccaggccatcggcaagcggcagatcaccgagttcaactaccgctacaaccgcccggaccatgcgcacatcttcgtcggcgtgcaaacccacccggagaacgatccgcgcgagcaactggtggccagcctgcgcgagcagggctttcccgtactcgacctgaccgacgacgagatggccaagctgcatatccgccacatggtcggcggccatgcggcgggcgtcagcgacgaggtggtgttgcgcttcgagtttcccgagcggcccggcgcgttgttcaacttcctcagcaagctcggcggacgctggaacatctcgatgttccactaccgcaaccatggcgccgccgacggccgcgtggtggccggcctgcaggtgccggcgggcgagcgccacctgttgccggcggctttggacgccatcggctatccgtactgggacgaaaccgacaacccggcctaccggttgttcctcggctga

SEQ ID NO: 31632 - protein, 504 aa, Azotobacter vinelandii
MLEQYVKKILTSRVYDVAVETPLQPARQLSERLGNQILLKREDLQPVFSFKIRGAYNKAARLSEAELARGVVTASAGNHAQGVALAARHLGIKAVIVMPRTTPEIKVQAVRARGAKVVLHGDAFPDALAHSLKLVEEKGYVYIHPYDDPDVIAGQGTVAMEILRQQPGRLDAVFVPVGGGGLIAGIAAYVKYLRPEVRVIGVEPEDSNCLQMAMAAGERVVLPQVGLFADGVAVAQIGACTFDICRHHVDEVVTVSTDEICAAIKDIYDDTRSITEPAGALAVAGIKRYVEREGASGQTLVAIDSGANINFDRLRHVAERSELGEKREAIIAVTIPEQPGSFKAFCQAIGKRQITEFNYRYNRPDHAHIFVGVQTHPENDPREQLVASLREQGFPVLDLTDDEMAKLHIRHMVGGHAAGVSDEVVLRFEFPERPGALFNFLSKLGGRWNISMFHYRNHGAADGRVVAGLQVPAGERHLLPAALDAIGYPYWDETDNPAYRLFLG

SEQ ID NO: 31633 - DNA, 1110 bp, Desulfitobacterium hafniense DCB-2
  CDS (1)..(1110)
ctggctgggacggagatctacctcaagctggaaaatctgcagaagaccggttcctttaaagttcggggggctatgaataaagccttgaagctttctgaagaggagaagaaaaaaggaatcctggccgcttccgccggcaatcatgcccaaggggtagccatggcggctgcccgtatcggtattcccgccacgattgtcatgccggaaaatgcccccctagccaaagtgtccgctacggaagggtacggagcccaggtcattctgtccggagcggtttttgatgatgcttatcagaaggcagtagagatccaaaaggaaacaggagccacgtttatccatgcttttgatgatctggaagttatggccgggcagggaaccatcggcttggaagtttttgaggagctgcctgaagtggatacggttcttgtccctatcgggggaggagggctgatcgcagggattgctgtggctttgaaatccctgaagccttccgtgcgcgtgatcggtgtccaagcggccggagcggcaagcatggctcacgcgctgagcataggcaggcccgagccattagggcaggccagtactttggcagatggcattgcggtgaaaagggcaggtgatctaaccttcgcagcagtccgccattatgtggatgagatggtgacggttgaagaagaagagattagtcaagctattctcctgttgatggagcgcaccaaaacccttgctgaaggagccggggcggttgccgtagcggcggcgcttcagggtaagctggatcttaaggagcagaaaacggttctcatcctgagcgggggaaatattgacgtgaatttcctggcccagattatcgaacggggactgaggcgttccgggcgtaccatggcctgccagcttcttttgccggatcaacccggcaacttagaaaaggtgatcgagcttatagcccaggaacgggccaatatcatcaacgtcgaacactcccgctatgatttagccgttcctctgcgttcagcccgtgttcatatgctgctggaaacccaaagttttgaacatcaaaagcgcattattcagcgtttagaaggtgccggatatcccctgacccgttaa

SEQ ID NO: 31634 - protein, 369 aa, Desulfitobacterium hafniense DCB-2
MAGTEIYLKLENLQKTGSFKVRGAMNKALKLSEEEKKKGILAASAGNHAQGVAMAAARIGIPATIVMPENAPLAKVSATEGYGAQVILSGAVFDDAYQKAVEIQKETGATFIHAFDDLEVMAGQGTIGLEVFEELPEVDTVLVPIGGGGLIAGIAVALKSLKPSVRVIGVQAAGAASMAHALSIGRPEPLGQASTLADGIAVKRAGDLTFAAVRHYVDEMVTVEEEEISQAILLLMERTKTLAEGAGAVAVAAALQGKLDLKEQKTVLILSGGNIDVNFLAQIIERGLRRSGRTMACQLLLPDQPGNLEKVIELIAQERANIINVEHSRYDLAVPLRSARVHMLLETQSFEHQKRIIQRLEGAGYPLTR

SEQ ID NO: 31635 - DNA, 975 bp, Nostoc punctiforme PCC 73102
  CDS (1)..(975)
atgtcacaaactaattccgttactataactgatgtgcaagcagcacaagagcgaattttgggaattgcccatcgcacgccggtgctaacttctagaatggttaacgatcgcaccaatagccaagtattctttaaatgcgagaactttcaacgcaccggggcatttaaatttagaggggcgtataatgccttagcgcaactatcggtagcccaaaaacaaacaggcgttatcacctattcatcaggaaatcatgctcaagcgatcgctctagctggtaaactcctcaatatccctaccactattgtcatgcctgatgatgcacccactgtcaaacaaactgcgactcgtggttatggtgcagagataattttatacaatcgccaggaggcaaaccgagaagaattagcccaaagtttagcaagcgatcgctctttgacactcatccctccttacgatcatccccatgtagtcgccggacagggaacaactgctttagaactgattcaagaagttggtgaattggacttgctattagtttgttgtggcggtggcggattactttcaggatgtgcgatcgcagctaaagcacttttacccaattgtaaagtaatcggggtagaaccagcacttgccgacgatgctacccgctcttttcacaccaaaaccctgcaaactgtcaagaatcctgataccatcgccgatggtgcgcggactcctagccttggtaaaattactttccccttagtgctgcattacgtcgatgatatggtgacggtatctgaagaagcaattcttcgcaccatgtttttcttgtgggaacgtctgaaaattgtagttgaacccaccggagtacttgcagccgcagccttactcgaaggtgtggtgacagcaccagagtcgaggattggtgtgatcatcagtggtggaaatgtcgatttggcgcaagttggtaaattgttttctggtggattttga

SEQ ID NO: 31636 - protein, 324 aa, Nostoc punctiforme PCC 73102
MSQTNSVTITDVQAAQERILGIAHRTPVLTSRMVNDRTNSQVFFKCENFQRTGAFKFRGAYNALAQLSVAQKQTGVITYSSGNHAQAIALAGKLLNIPTTIVMPDDAPTVKQTATRGYGAEIILYNRQEANREELAQSLASDRSLTLIPPYDHPHVVAGQGTTALELIQEVGELDLLLVCCGGGGLLSGCAIAAKALLPNCKVIGVEPALADDATRSFHTKTLQTVKNPDTIADGARTPSLGKITFPLVLHYVDDMVTVSEEAILRTMFFLWERLKIVVEPTGVLAAAALLEGVVTAPESRIGVIISGGNVDLAQVGKLFSGGF

SEQ ID NO: 31637 - DNA, 1338 bp, Nostoc punctiforme PCC 73102
  CDS (1)..(1338)
atggtgcaactaccaccagatatcttggcacagggtgtaattgcagcgtctgcgggcaaccatgctcaaggagtcgcccttgcagccaatcgtttgggaaccaaagcaattatcgtcatgccaataaccacacctcaagtcaaggtggacgcagtgagaatgaggggcggagcagtcgtgttacatggaaacacctacgacgatgcttatagctatgcccgtgaattagaagtggaaaaaggtttgacctttattcatccctttgacgatcctcatgtaattgctggacagggaaccattgggatggaaattttacggcaatatcagcaacccatccatgcaatttttgttgcaattggaggtggtggattgatttctgggattggggcttatgtaaaacgattgcgtcctgaaatcaagattattggagttgaaccagtagatgctgatgcgatgtctcaatcgctcaaagccgggcatcgggtgcgtttgtctcaagtggggttatttgctgatggtgtggcggtgcgagaagtaggtgaagaaaccttccgtttatgtcagcagtatgtagatgaaatcattttggtggatactgatgatacttgtgctgcgattaaagacgtgtttgaggatacgcgatcaattttagagccagccggtgcattagcgatcgcagctgccaaagcctacgcagaacgagaacaaattgagggacaaaccttaattgccgtagcctgtggtgcaaacatgaattttgatcgtctccgattcgtggcagaacgggcccagttaggcgaacgtcgggaagcaatctttgcagtcacaattcctgaagaacggggaagtattcgccagttttgtgaatgtattggcaaccgtaatcttactgagtttaattatcgcattgctgatgaaaaaacagcccatatttttgtaggtgtgcaaattcaaaaccgtgctgatgctgcaaagatggtagaaacctttgaagctcaaggatttgaaactcttgatttaacagacgacgaactaactaaattacatctgcggcacatggtgggtgggcactctcccctggctcaaaatgaattactctaccgttttgagtttcccgaacgtcccggcgcattgatgaaatttgtgacttctatgagtccagcctggaatattagtctttttcactaccgtaacaacggtgcagactacggacgaattgtagttggtatccaagttcctcctcacgagatggaagagtggcaagcttttctcgataacttgggctatcgctattgggatgaaaacaagaatcccgcatacaagctgtttttgggatag

SEQ ID NO: 31638 - protein, 445 aa, Nostoc punctiforme PCC 73102
MVQLPPDILAQGVIAASAGNHAQGVALAANRLGTKAIIVMPITTPQVKVDAVRMRGGAVVLHGNTYDDAYSYARELEVEKGLTFIHPFDDPHVIAGQGTIGMEILRQYQQPIHAIFVAIGGGGLISGIGAYVKRLRPEIKIIGVEPVDADAMSQSLKAGHRVRLSQVGLFADGVAVREVGEETFRLCQQYVDEIILVDTDDTCAAIKDVFEDTRSILEPAGALAIAAAKAYAEREQIEGQTLIAVACGANMNFDRLRFVAERAQLGERREAIFAVTIPEERGSIRQFCECIGNRNLTEFNYRIADEKTAHIFVGVQIQNRADAAKMVETFEAQGFETLDLTDDELTKLHLRHMVGGHSPLAQNELLYRFEFPERPGALMKFVTSMSPAWNISLFHYRNNGADYGRIVVGIQVPPHEMEEWQAFLDNLGYRYWDENKNPAYKLFLG

SEQ ID NO: 31639 - DNA, 1266 bp, Bifidobacterium longum DJO10A
  CDS (1)..(1266)
atggaacaaaaggatgttttgaaggcgctgcaacgtgatcatgcagccgaactgaagctggccgccgaacgactcaaaggcactgcccgccacacggagatcattccttctccggtgctgagcgagatgaccggccatgagattctcctgaagccggaaaacctgcaggtcaccggatccttcaagatccgcggtgcctataacaagattgcttcgctcaccgaagagcagatcgctcacggcatcgtcaccgcgtctgccggcaaccatgcccagggtgtggcctatgcggcccgcgagcgtggagccaaggccaccatctgcatgccgcagatcaccccgccgctgaaggtcgatgccaccaaggcctacggtgccgacgtggtgctgtacggcgatgtgttcgatgaatccgccgcccacgctgctgagctcgccgacaaggaaggcatgatttacgtgccgccattcgacgattacgaagtcatctgcggccaaggcaccatcggtctggagatccttgaagacgtgccgaacgtcactgacgtggtcgtgccgctcggtggtggtggcctgggtgccggcgtggcgctcgccatcaagacattcaagcctgaagtgcgcgtaatcggtgcgattccggagggctcaccggcctggaaggactcgctggccgcgggtcgtgtgtctccggctgaccatgtggttacctccgccgaaggtgttgcggtcaagcaccccggcgacctgcccttcgctctgattaacgagttcctggacgatctggtcaccgtcaccgagcgcgacatcaacgaaatgattctgctcatgctcgagaagcataagctggtggtcgaggcggccggcgccgtttcgctggctgcgctggaacacctgaacctgcgttcgcgcaagttcgccgccgccaccggcccgcacgtggtggttccgattatgtccggcggcaatatcgacaccgtgaccatgggtgcggtgattcagaaaggtatgatcgcccgcggccgcatcatgaacttcgaggtcgagctgccggatactccgggccagctcgtcaaggtggccaccctgcttgccgagcagcgcgccaacgtcattcagcttgatcacgaccagttcaaggcatccggccactacaccaacgcggtgtctctcggcgtcacggtcgagaccaacggccccgagcacatcgaccgcatcctcgcggcactcagggaagccggattccagcccaagcgcatctactga

SEQ ID NO: 31640 - protein, 421 aa, Bifidobacterium longum DJO10A
MEQKDVLKALQRDHAAELKLAAERLKGTARHTEIIPSPVLSEMTGHEILLKPENLQVTGSFKIRGAYNKIASLTEEQIAHGIVTASAGNHAQGVAYAARERGAKATICMPQITPPLKVDATKAYGADVVLYGDVFDESAAHAAELADKEGMIYVPPFDDYEVICGQGTIGLEILEDVPNVTDVVVPLGGGGLGAGVALAIKTFKPEVRVIGAIPEGSPAWKDSLAAGRVSPADHVVTSAEGVAVKHPGDLPFALINEFLDDLVTVTERDINEMILLMLEKHKLVVEAAGAVSLAALEHLNLRSRKFAAATGPHVVVPIMSGGNIDTVTMGAVIQKGMIARGRIMNFEVELPDTPGQLVKVATLLAEQRANVIQLDHDQFKASGHYTNAVSLGVTVETNGPEHIDRILAALREAGFQPKRIY

SEQ ID NO: 31641 - DNA, 1548 bp, Haemophilus somnus 2336
  CDS (1)..(1548)
atggtgaagaatatgataagtaatttaaccgaacagccttctggtgctgagtaccttaaagcaattttaagttcaaaaatttacgaacttgcacaggttacacccttacaacctatgctcaaactttctgagcgtttaagtaataccgttttagttaaacgtgaagatcgccaattagttcatagctttaaattgcgtggtgcttatgccatgattgccggtcttagccaaccgcaaaaaaatgccggtgtgattaccgcttccgcaggaaatcatgctcaaggtgtcgcactgtcagcgaaaaatctgggattaaacgcattgattgttatgccgcaaaataccccccgcattaaagtagatgcagtgcgtggttatggtggcgaagtgcttttatatggtgcaaactttgatgaggcaaaagcaaaagcgatagagctttctgaaagtaaaagtatgacatttattccgccttttgatcacccggcagttattgcaggtcaaggttctttagccatggaattattgcagcaaaacagtcatattgatcgtatttttgttcctgttggcggcggcggattagcagctggcgtggctgttttaattaaacaattaatgcctgacattaaagtgattgcggtagaaagtaaagattcagcttgtttacacgccgctttgaaagttggtcaaccggtagatttagagcgtgtcgggttgtttgctgacggtgtggcggtaaaacgtatcggtaatgaaactttccgtgtatgtcaacaatatattgatgatgttgtacttgttgacagcgatgaagtgtgtgcggcaatgaaagatatgtttgaaaatgtgcgtgctattgcagagccatccggtgccgtatcattagccggcttaaaaaaatatgtgaaagaacataatattcaaggtgaaacgttggttaatattttgtccggtgcaaatttaaattttcatacattgcgttatgtgtcagaacgctgtgaaatcggtgaaaaacacgaagcaatttttgctgtaactatccctgaagaaaaaggtagtttcctacgtttttgccatctgttaggtgatcgtcctgttaccgaatttaactatcgttatgctgataaagaacaagcctgtatttttgttggggttcgtattagtagtgaaaaagaaaaattagaaattattcaacaacttgaacaaaatgattataaagttatggatctctctgatgatgaaatagcgaaaacccatattcgctatatgattggaggacgaacaaccagcaatagcaaagagcggttatatagcttcgagtttcccgagcaaaaaggcgcattattaaaattcttgatgatgttaggtacgcattggaatatttctcttttccattatcgtgcttatggtgcagactatggtaacgttttggcaggctttcagttagatgaacatgatgaaattcggttcaatggtcatttagaagaacttgcttatacttatcaagatgtaacggacagccccgcttacaaatatttcttagcttga

SEQ ID NO: 31642 - protein, 515 aa, Haemophilus somnus 2336
MVKNMISNLTEQPSGAEYLKAILSSKIYELAQVTPLQPMLKLSERLSNTVLVKREDRQLVHSFKLRGAYAMIAGLSQPQKNAGVITASAGNHAQGVALSAKNLGLNALIVMPQNTPRIKVDAVRGYGGEVLLYGANFDEAKAKAIELSESKSMTFIPPFDHPAVIAGQGSLAMELLQQNSHIDRIFVPVGGGGLAAGVAVLIKQLMPDIKVIAVESKDSACLHAALKVGQPVDLERVGLFADGVAVKRIGNETFRVCQQYIDDVVLVDSDEVCAAMKDMFENVRAIAEPSGAVSLAGLKKYVKEHNIQGETLVNILSGANLNFHTLRYVSERCEIGEKHEAIFAVTIPEEKGSFLRFCHLLGDRPVTEFNYRYADKEQACIFVGVRISSEKEKLEIIQQLEQNDYKVMDLSDDEIAKTHIRYMIGGRTTSNSKERLYSFEFPEQKGALLKFLMMLGTHWNISLFHYRAYGADYGNVLAGFQLDEHDEIRFNGHLEELAYTYQDVTDSPAYKYFLA

SEQ ID NO: 31643 - DNA, 1527 bp, Actinobacillus pleuropneumoniae serovar 1 str. 4074
  CDS (1)..(1527)
atgagcaatccgacaattcaatccggcaccgattatctgcgtgtaatcctcagttcaaatatctacgacctagcgcaagttaccccgcttcaaaaaatggaaaaactctccgagcgtttaggcaaccaaattcttatcaaacgtgaagatcgccaaccggtacatagtttcaaactgcgtggtgcatttgccatgatttccaatctctcggcaagccaaaaagccgccggtgtgattaccgcttcggcaggaaaccacgctcaaggcgtggcgctttcatcaaaacacttaggacttcgtgcattaatcgttatgccgcaaaatacgccggcaattaaagtcgatgcggtgcgagggttcggtggagaagtcttactattcggtgccaattttgatgaggcgaaagccaaagcattagaactttctacagagttggggatgactttcgtaccaccgttcgatcacccgatggtgattgccggacaaggtacgatcggtatggaattagtacagcaaagatcagatttagattatgtattcgtaccggtcggtggcggcggtttagccgccggtattgcggtattaattaagcaaattctaccgaatgtaaaagtgattggcgttgaatcaaaagattccgcttgtttgcaacatgccttaaaagtcggcaaaccggataacttggaacgtgtcggcttattcgcagacggtattgcggtaaaaagaatcggtgacgaaactttccgtttatgccagaaatatatcgatgaagtggtactggtcgataacgatcagatttgtgcggcaatgaaagatatttttgaaaacgtacgtgcgattgcagaaccttccggtgcgacttcattagccggcttaaaaaaatatgtgaaagaacaccaacttgaaggcaaaaacttagcttgtgtgctttccggtgcgaacttgaatttccatacgttacgttatgtttcggaacgttgtgaaatcggcgaaaaacatgaagccttattagcggtaaccattccggaacaaaaaggcagttttttaaaattctgtgagattttaggcaatagagcggtcaccgaatttaactatcgacacgcagatgacaataaagcgtgtattttcgttggggttcgtattaccggcaatgcggaaaaagcggatatcattcgcgatctacaacagcacaattataacgtagtggatctttcggatgatgacattgctaaaacgcatattcgttatatggtcggcggtcgtcctaacagcattagcagcgagcaactttatagcttcgaattccctgagcaaaaaggcgcattattaaaattcctccaaacactgaccgattgggatatttcattattccattatcgtgcgcacggggcggattacggcgatattctcgctgcgtttactttagatgaaagcgataagcatcgccttaatcagcatttggatcaacttggttatcgttatcaaaacgtaacggatagccttgcatatcaatactttttaaaataa

SEQ ID NO: 31644 - protein, 508 aa, Actinobacillus pleuropneumoniae serovar 1 str. 4074
MSNPTIQSGTDYLRVILSSNIYDLAQVTPLQKMEKLSERLGNQILIKREDRQPVHSFKLRGAFAMISNLSASQKAAGVITASAGNHAQGVALSSKHLGLRALIVMPQNTPAIKVDAVRGFGGEVLLFGANFDEAKAKALELSTELGMTFVPPFDHPMVIAGQGTIGMELVQQRSDLDYVFVPVGGGGLAAGIAVLIKQILPNVKVIGVESKDSACLQHALKVGKPDNLERVGLFADGIAVKRIGDETFRLCQKYIDEVVLVDNDQICAAMKDIFENVRAIAEPSGATSLAGLKKYVKEHQLEGKNLACVLSGANLNFHTLRYVSERCEIGEKHEALLAVTIPEQKGSFLKFCEILGNRAVTEFNYRHADDNKACIFVGVRITGNAEKADIIRDLQQHNYNVVDLSDDDIAKTHIRYMVGGRPNSISSEQLYSFEFPEQKGALLKFLQTLTDWDISLFHYRAHGADYGDILAAFTLDESDKHRLNQHLDQLGYRYQNVTDSLAYQYFLK

SEQ ID NO: 31645 - DNA, 846 bp, Pseudomonas aeruginosa UCBPP-PA14
  CDS (1)..(846)
atgaagcacgagaaccacctgccggtgggggccttcaagctgcgcggcggcctggtgtatttccaccacctggcgcaccagggtgagcggccggccggcgtgatcagcgccacccgcggcaaccacggccagtcggtggccttctcggcgagccgctacggcatccagccgatcatcgtcgtgccgcacggcaacagccgcgagaagaacgcggcgatgcgcagcctcggcgcggagctgatcgagcatggcgaggacttccaggcctcccgcgaatacgccgccgagcgcgcccggcacgaaggcctgcacctgattccggcgttccatccctggctggtggccggggtcgccagctacagcctggagttgttcgccgcgctggccgaccttgacgaagtctacgtgccgatcggtatgggttcgggcatctgcggcctgatcgccgcgcgcgacgcgctgggcctgaagacccgcatcgtcggcgtggtgtccgcccatgcgccggcctacgccctgtcgttcgaggccggcacggcgatcagccacccggtcgacacccgcctggccgacggcatggcgtgcagtacgccggacccgagcgcgctggaaatgatcctggccggcgccgatcgcctggtgcgggtcagcgacagggagatcggcgcggccatgcgcctgtgcttcaccagcacccacaacgtcgccgagggcgccggggtggcggcgctggccgccgcctggcaggagcgcgagcgcctgaaggggctgaaggtaggcctgatcctcagcggagcgaacgtcgaccgcgaggtattcgccgagcaactggccgccggcgactga

SEQ ID NO: 31646 - protein, 281 aa, Pseudomonas aeruginosa UCBPP-PA14
MKHENHLPVGAFKLRGGLVYFHHLAHQGERPAGVISATRGNHGQSVAFSASRYGIQPIIVVPHGNSREKNAAMRSLGAELIEHGEDFQASREYAAERARHEGLHLIPAFHPWLVAGVASYSLELFAALADLDEVYVPIGMGSGICGLIAARDALGLKTRIVGVVSAHAPAYALSFEAGTAISHPVDTRLADGMACSTPDPSALEMILAGADRLVRVSDREIGAAMRLCFTSTHNVAEGAGVAALAAAWQERERLKGLKVGLILSGANVDREVFAEQLAAGD

SEQ ID NO: 31647 - DNA, 1515 bp, Pseudomonas aeruginosa UCBPP-PA14
  CDS (1)..(1515)
atgctcgaacaatacgtcaagaagatcctcacctcgcgcgtctatgacgtcgcggtggaaacgcccctgcaacccgcccgccagttgtccgaacgcctcggcaaccaggtcctgctcaagcgcgaggacctgcagccggtgttttccttcaagatccgcggcgcctacaacaaggtcgcgcagctcaccgaggaggagaaggcccgcggggtgatcgccgcctcggccggcaaccacgcccagggcctggccctggcggccaagcggcaggggatcagggcggtcatcgtgatgcccaagaccacccccgagatcaaggtccaggcggtgcgcgcccacggcgccaaggcggtgctgcacggcgacgccttccccgaggcgctggcccacgcgctgaagctggtcgacgagaagggctacaccttcgtccatccctacgacgatccggacaccatcgccggccagggcaccgtggccatggagatcctccgccagcagcccggccgcctcgatgcgatcttcgtcccggtgggcggtggcggattggtcgccggcatcgccgcctacgtcaagtacctgcgtccggagatcaaggtgatcggcgtcgagccggacgagtcgaactgcctgcaggcggccatggccgccggcgagcgggtgatgctgggccaggtcgggctgttcgccgacggcgtggcggtggcgcagatcggccagcacaccttcgacatctgcaaggaccacgtcgacgaagtgatcaccgtcagcaccgacgagatctgtgcggcgatcaaggacatctacgacgacacccgctcgatcaccgagccggccggcgcgctggcggtggccgggatcaagaagtacgttgagcgcgagcgcgccgaggggcagaccctggtggcgatcgactccggcgccaacgtcaacttcgatcgcctgcggcatgtcgccgaacgcgccgaactgggcgagcgccgcgaagcgatcatcgcggtgaccattcccgagcggccgggcagcttcaaggccttctgcgaggcggtcggcaagcgccagatcaccgagttcaactatcgctaccacagcggcagcgaggcgcacatcttcgtcggcgtgcagacccacccggagaacgacccgcgcgaggcgctggtggcctatctgcgcgagaagggcttcccggtcctcgacctgaccgacaacgaactggccaagctgcacatccgccacatggttggcggccatgcagtgaaagtcagcgacgagatggtgttccgcttcgaattccccgagcggcccggcgcgctgttcaacttcctcaccaagctcggcgggcgctggaacatctcgatgttccactaccgcaaccatggcgcggccgacggccgggtggtggccgggttgcaggtgccggaagacgagcgccacctgatcccgcagaccctggaggcgatcggctatccgtactgggacgagaccgccaacccggcctaccagctgttcctcggctga

SEQ ID NO: 31648 - protein, 504 aa, Pseudomonas aeruginosa UCBPP-PA14
MLEQYVKKILTSRVYDVAVETPLQPARQLSERLGNQVLLKREDLQPVFSFKIRGAYNKVAQLTEEEKARGVIAASAGNHAQGLALAAKRQGIRAVIVMPKTTPEIKVQAVRAHGAKAVLHGDAFPEALAHALKLVDEKGYTFVHPYDDPDTIAGQGTVAMEILRQQPGRLDAIFVPVGGGGLVAGIAAYVKYLRPEIKVIGVEPDESNCLQAAMAAGERVMLGQVGLFADGVAVAQIGQHTFDICKDHVDEVITVSTDEICAAIKDIYDDTRSITEPAGALAVAGIKKYVERERAEGQTLVAIDSGANVNFDRLRHVAERAELGERREAIIAVTIPERPGSFKAFCEAVGKRQITEFNYRYHSGSEAHIFVGVQTHPENDPREALVAYLREKGFPVLDLTDNELAKLHIRHMVGGHAVKVSDEMVFRFEFPERPGALFNFLTKLGGRWNISMFHYRNHGAADGRVVAGLQVPEDERHLIPQTLEAIGYPYWDETANPAYQLFLG

SEQ ID NO: 31649 - DNA, 981 bp, Psychrobacter sp. 273-4
  CDS (1)..(981)
atgatcacaaatgatgatggattagtgattccaacccttgatgatatgctagaggcgcatgagcgcattaagccatatatccatcgcactcctgttttgacctctcgctttttaaacgaaatggcaggctgtgagatgttctttaaatgtgagaactttcaaaaagcgggtgcctttaaagtacgcggcgcatcaaacgcggtgtttggtctgtctgacgaagccgcaaaaaatggcgtctgtacacacagctcaggcaaccatgccctgtctttatcttatgcagcgggtcgacgcggcgtaccgtgtcatgtggtgatgccgcatagtgcaccagaagctaaaaaagcggcagtccgtggctatggtggtatcattactgagtgtgagccatcaaccacttcacgcgaagaagtgtttgccagagttcaagcagaaacaggcggcgactttgtccatccgtacaatgatccacgcgtaatcgccggacaagcgacttgctcacgtgaatttctagagcaaatggaagagatcggtcaaaaacctgacatggttgtggcacctattggtggtggtggcatgatttcaggcacttgcttaacgctatcgaacctagcccctgatgtcaaaatttatgctgcagagccagtaaatgctgatgatgctgcacgctcatttaaagccggttatattatcgctgatgatgcacccgatactatcgctgatggcttaaaagtaccgcttaaagatttgacctggcattttgtcagtaattatgtgactgacattttgactgcgactgaagaagaaatcgttgaagcgatgaagctgacttggactcatatgaaaattatcatcgagccaagttgtgcagtaccgcttgctgtcatcttgaagaacaaagacgtttttgcaggtaaaaaggttggcgtcatcatcactggtggtaacgttgatctagacaaattgccttggaactaa

SEQ ID NO: 31650 - protein, 326 aa, Psychrobacter sp. 273-4
MITNDDGLVIPTLDDMLEAHERIKPYIHRTPVLTSRFLNEMAGCEMFFKCENFQKAGAFKVRGASNAVFGLSDEAAKNGVCTHSSGNHALSLSYAAGRRGVPCHVVMPHSAPEAKKAAVRGYGGIITECEPSTTSREEVFARVQAETGGDFVHPYNDPRVIAGQATCSREFLEQMEEIGQKPDMVVAPIGGGGMISGTCLTLSNLAPDVKIYAAEPVNADDAARSFKAGYIIADDAPDTIADGLKVPLKDLTWHFVSNYVTDILTATEEEIVEAMKLTWTHMKIIIEPSCAVPLAVILKNKDVFAGKKVGVIITGGNVDLDKLPWN

SEQ ID NO: 31651 - DNA, 1554 bp, Psychrobacter sp. 273-4
  CDS (1)..(1554)
atgctgtcacattgggtacgagccatcttacaagccaccgtctatgacgttgctattcaaacaccacttgaagcggcacccaagctgacccaacgttttgctaatgacattcgttttaaacgtgaagacctgcaaccggtaaaatcctttaaattgcgcggcgcttataaccgcatcagccaattgaatgatgagcaaaaagcacgcggcgtgatttgcgcatcggcgggtaaccatgcccaaggcgttgcctactctgcccgtaaacttgcactgaacaatattattgttatgccaaccactacccctgatatcaaagtagatgccgtcagagcgcttggcggcaatgtcgacttgtatggtgacagttttgatgaagccaatcgctatgccattgatcgcgctgagcgtgaaggtctgacttttataccaccatacgatgacgagctggtaattgccggacaaggtacgattggacttgagctcacccagcaatggcgtaatatggattacgtttttgtagcagttggtggtggcggtctgatttctggtgtcgctgcatttttgggtgaagttgccccgcatgtcaaagtcatcgctgtagaagccgaccaatcagcatcactaaaagccgcgcttgaagccaatgagcgagtcaaacttgagcaagtaggactgttcgtcgatggtgtggcagttgcccaaatcggtgaattgccttttgatattgtccgtatgcagaagagcgataaatccggtcctgtcgtcgaacctcaagtcgttacttgtaccaatgatgaagtctgcgctgccatcaaagatatttttgaagagaaccgcagtatcgttgagcctgcaggggcgcttcctgtcgctggtatgaaaaaataccttgaggctcatgacctacaaggcaaaaactgcgtcgccattatctgcggtgccaatatgaattttgatcgcttgcgctacatcgctgagcgtactgagattggtgagaaaaaagaagctgtctttggcgtgaccatccctgaacagactggcgctttcttaagcttctgccgtagtctgcacggtcgtaatatcactgagttcaattaccgtgctgatagtaaaaaatcaccggactctatggaacctgcagcaatcttcgtcggtattgcattaaaagaaggcgataaagagcgtcaaactattcgtacacaattggcagctgatggctatacagcacatgacttgaccgatgacgatgtcgccaaatcacatatccgctatctaattggtggtcatgcgcatgttgaaaatgaacagttattgcaagtcactttcccagaacgtcccggcgctttattgacctttttagaaaaattgggtaacgattttaatatcacacttttccattatcgcaatcatggcgctgctgaaggtcgcgtattggtcggtttgcaagcttctgaaagcaactcgcgccaactacaagatgccttgctggatatcggttacgactgcaccatgctcaatgacaatattggttatcagttatttttaaagtag

SEQ ID NO: 31652 - protein, 517 aa, Psychrobacter sp. 273-4
MLSHWVRAILQATVYDVAIQTPLEAAPKLTQRFANDIRFKREDLQPVKSFKLRGAYNRISQLNDEQKARGVICASAGNHAQGVAYSARKLALNNIIVMPTTTPDIKVDAVRALGGNVDLYGDSFDEANRYAIDRAEREGLTFIPPYDDELVIAGQGTIGLELTQQWRNMDYVFVAVGGGGLISGVAAFLGEVAPHVKVIAVEADQSASLKAALEANERVKLEQVGLFVDGVAVAQIGELPFDIVRMQKSDKSGPVVEPQVVTCTNDEVCAAIKDIFEENRSIVEPAGALPVAGMKKYLEAHDLQGKNCVAIICGANMNFDRLRYIAERTEIGEKKEAVFGVTIPEQTGAFLSFCRSLHGRNITEFNYRADSKKSPDSMEPAAIFVGIALKEGDKERQTIRTQLAADGYTAHDLTDDDVAKSHIRYLIGGHAHVENEQLLQVTFPERPGALLTFLEKLGNDFNITLFHYRNHGAAEGRVLVGLQASESNSRQLQDALLDIGYDCTMLNDNIGYQLFLK

SEQ ID NO: 31653 - DNA, 1533 bp, Dechloromonas aromatica RCB
  CDS (1)..(1533)
atgcacccggattatctcgaaaaagttctcaacgcacaggtttacgacgtggcgatcgaaacgccgctcgacctggccagcaacctttccgcccgggtcggcaacaagattatcctgaagcgcgaagacatgcagcctgtcttttccttcaagctgcgtggcgcctacaacaagattgccagcctgtcggccgaaaagctgaagcgcggtgtcatctgtgcctcggccggcaaccacgcccaaggggtcgccctgtcggccagcaaactgggttgccgggcggtcatcgtcatgccgacctcgacgccgggcatcaagattaacgccgttaaatcgcggggcggcgaagtggtgctgcatggcgactccttcgacgaagcatacgcccatgcggtcgaactggaaaaaaccgaaaagctgaccttcgttcatcccttcgacgatccggaggtgatcgccggacagggcacggtcgccatggaaatcctgcgccagcattcgcgccacaacggcccgatcaccgccgtcttctgtgccatcggcggcggcgggctggctgctggcgtggccgcctacatcaagcgcctgcgtccggaaatcaaggtgatcggtgtcgaaaccttcgacgccgacgccatgaagcagtcgctggccgccggcaagcgcgttcgcgtcgatcaggtcgggttgttctccgacggcaccgccgtcaagctggtcggcgaagaaaccttccggctgtgcaaggaatacctggacgaggtcatcctggtcgacaccgatgccatctgtgccgccatcaaggatgttttcgaggatacccgctcgattctggaaccggccggggcgctggccgtcgccggcgccaaggaatatgcccgtcagcacaaactgaaggacaagaacctgatcgccatcacctccggcgccaacatgaatttcgaccgcctgcgcttcgttgccgagcgggccgaattcggcgaacagcgtgaagccgtcttcgcggtcacgctgcccgagaagccgggtgcctacaagaaattccttgggctgatcggtcaccgcaatgtgaccgaattcaactaccgcttccacaccgccagcgaagctcacgtcttcgtcggcgttcaggtggccgaccgcaaggaatcgctgaagctggtcgacagcctgcagaaacacggttacccgacgctcgacctgaccgatgacgaaatggccaagaaccatatccgtcacatggtcggcggccatgccccggcggtttgcgaaaagggcatgcgcgagttgctctatcgcttcgaattcccggaaaagccgggcgccctgatgaacttcctgacccagatgagcgccggctggaacatcagcctgttccactaccgcaaccatggcgccgactacggtcgcgtcctggtcggcatgcaggtaccgccggacgacatggggaaattcaaggaattcctgaccaatctcggctacgcccactgggacgagagccaaaacccggcatacaagctgttcctgggttaa

SEQ ID NO: 31654 - protein, 510 aa, Dechloromonas aromatica RCB
MHPDYLEKVLNAQVYDVAIETPLDLASNLSARVGNKIILKREDMQPVFSFKLRGAYNKIASLSAEKLKRGVICASAGNHAQGVALSASKLGCRAVIVMPTSTPGIKINAVKSRGGEVVLHGDSFDEAYAHAVELEKTEKLTFVHPFDDPEVIAGQGTVAMEILRQHSRHNGPITAVFCAIGGGGLAAGVAAYIKRLRPEIKVIGVETFDADAMKQSLAAGKRVRVDQVGLFSDGTAVKLVGEETFRLCKEYLDEVILVDTDAICAAIKDVFEDTRSILEPAGALAVAGAKEYARQHKLKDKNLIAITSGANMNFDRLRFVAERAEFGEQREAVFAVTLPEKPGAYKKFLGLIGHRNVTEFNYRFHTASEAHVFVGVQVADRKESLKLVDSLQKHGYPTLDLTDDEMAKNHIRHMVGGHAPAVCEKGMRELLYRFEFPEKPGALMNFLTQMSAGWNISLFHYRNHGADYGRVLVGMQVPPDDMGKFKEFLTNLGYAHWDESQNPAYKLFLG

SEQ ID NO: 31655 - DNA, 1542 bp, Haemophilus influenzae R2866
  CDS (1)..(1542)
atgaaaaacttactcaccaatcctcaaccttctcaatcagattatatcaatgccattgttaaacttggttcgcgcgtatatgaagctgcgcaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcggcgaaacaattaggcttaaaagcactgatcgtcatgccacaaaacaccccaagcattaaagtggatgcagtgcgtggttttggtggcgaggtgttgttgcacggtgctaatttcgatgaagccaaagcaaaagccatcgagctttcaaaagaaaaaaacatgacatttattccaccattcgatcatccattagtgatcgctggacaaggcacgttagcgatggaaatgttacaacaagtggcagatttggattatgtgtttgtacaagttggcggtggcggtttagctgcaggtgtagcaatgttgcttaagcaatttatgccagaaattaaaatcatcggtgtagaatcaaaggattctgcatgcttaaaagcggctcttgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccatattgaaggcaaaaatatggcggcaattttgtctggcgcgaacttgaatttccatacattacgttatgtatctgaacgttgtgaaattggtgaaaatcgagaggctttattagccgtgaccatgcctgaacaaccaggtagtttcttaaaatttgcttatgtattaggtaacagagctgtaaccgaattcagttatcgttatgcagatgataaacgagcttgcgtgtttgttggagtaagaacgacaaatgagcaagaaaaagcagatattattgcagacctcactaaaaatggttttgatgttgaggatatgtctgatgatgatattgcgaaaacgcacgttcgctatttaatgggaggtcgagcagccaatgataatgaacgcttatatacgttcgaattcccagagcaaaaaggtgcgttattgaaatttttagaaaccttgcaaaatcgttggaatatttcattattccattatcgtgcccacggtgcggactatggaaatatccttgctggtttccaaattgaagaacacgaacaagcagaatttgaacagacacttgcccaactcaattatgtttttgaagatgtaacagaaagcaaatcttatcgttatttcttacgttaa

SEQ ID NO: 31656 - protein, 513 aa, Haemophilus influenzae R2866
MKNLLTNPQPSQSDYINAIVKLGSRVYEAAQVTPLQKMGKLSERLHNNIWIKREDRQPVNSFKLRGAYAMISSLSEEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAMLLKQFMPEIKIIGVESKDSACLKAALDKGEPTDLTHVGLFADGVAVKRIGDETFRLCQQYLDDMVLVDSDEVCAAMKDLFENVRAVAEPSGALGLAGLKKYAKQNHIEGKNMAAILSGANLNFHTLRYVSERCEIGENREALLAVTMPEQPGSFLKFAYVLGNRAVTEFSYRYADDKRACVFVGVRTTNEQEKADIIADLTKNGFDVEDMSDDDIAKTHVRYLMGGRAANDNERLYTFEFPEQKGALLKFLETLQNRWNISLFHYRAHGADYGNILAGFQIEEHEQAEFEQTLAQLNYVFEDVTESKSYRYFLR

SEQ ID NO: 31657 - DNA, 1512 bp, Anabaena variabilis ATCC 29413
  CDS (1)..(1512)
atgctttgcgactacctggtacaaattctgactgctcgtgtgtatgatgttgcccaggaatcacctctggagtatgcccccaatctttcagccagactgaataataaactattgctgaagcgggaagatatgcagtctgtgttttcctttaagctgcggggtgcttacaacaagatggtgaatctaacacccgatttactagcacagggtgtaattgctgcttctgcggggaatcatgcccaaggtgtggcactaggtgcaaaacagctagggacaagagcaattattgttatgccggttactactccccaggtgaaagtagatgcagttaaagcacgagggggagaggtggtattgcatggggatacctatgatgatgcctatgcctacgcgcggcagttggaggcagagaaaggtttaacatttattcacccctttgatgatcctcatgtaattgcgggacagggaactattgggatggaaattctcagacaatatcagcaacctattcatgcgatttttgttgctattggcgggggcggtttgatttcggggattgcggcttatgtaaaacggttacgtccagaaattaaaattattggggttgagccggttgatgctgatgcaatgaaccaatccttgcaagctggtaaacgggtgcgattgtcacaggtgggtttatttgctgatggggtggcagtgcgggaggtgggagaagaaactttccgactgtgtcaggaatatgtagacgaaattattttggtggatacagatgacacctgtgcagccattaaggatgtatttgaagatacccgatctattttagaaccagcaggggcattggcgatcgctggcgctaaggcttatgtagaacgagaacaaatccaaggacaaactttagtcgctgtcgcctgcggtgcaaatatgaattttgaccgtttgcgctttgttgcagaacgggcagaatttggtgaacgccgcgaagctatctttgcagtgacaattcctgaaacacctgggagtctgcggaagttttgcgaatgtattggtagacgcaatttgacagagtttaactatcgcattgctgatgaaaaaattgcccatatttttattgggatgcagattcaaaaccgtgctgacaaaatccacatggtggagacttttgcagaatgtggttttgaaatccttgatttaacagatgatgaactgacaaaactgcatttgcgccacatggtgggcggacactctcccctagcccataatgaattactctaccgttttgaatttccggaacgtcctggagcgttaatgaaattcgttgcttccatgagtcccaattggaatatcagtatgttccactaccgcaacaatggctcagactacgggcgcatcgtggtaggaatgcaggttccaccgcaggaaatggaagaatggcaagcatttcttgattccctcggctaccagtattgggatgaaagccagaacccagcctataagttatttttgggataa

SEQ ID NO: 31658 - protein, 503 aa, Anabaena variabilis ATCC 29413
MLCDYLVQILTARVYDVAQESPLEYAPNLSARLNNKLLLKREDMQSVFSFKLRGAYNKMVNLTPDLLAQGVIAASAGNHAQGVALGAKQLGTRAIIVMPVTTPQVKVDAVKARGGEVVLHGDTYDDAYAYARQLEAEKGLTFIHPFDDPHVIAGQGTIGMEILRQYQQPIHAIFVAIGGGGLISGIAAYVKRLRPEIKIIGVEPVDADAMNQSLQAGKRVRLSQVGLFADGVAVREVGEETFRLCQEYVDEIILVDTDDTCAAIKDVFEDTRSILEPAGALAIAGAKAYVEREQIQGQTLVAVACGANMNFDRLRFVAERAEFGERREAIFAVTIPETPGSLRKFCECIGRRNLTEFNYRIADEKIAHIFIGMQIQNRADKIHMVETFAECGFEILDLTDDELTKLHLRHMVGGHSPLAHNELLYRFEFPERPGALMKFVASMSPNWNISMFHYRNNGSDYGRIVVGMQVPPQEMEEWQAFLDSLGYQYWDESQNPAYKLFLG

SEQ ID NO: 31659 - DNA, 969 bp, Ralstonia eutropha JMP134
  CDS (1)..(969)
atgaccgaactgaagctaccaacgtacgcagacgtccaggaagccgcgaagcgccttgatggcgttgccaaccgcacgccggtcaatacgtcgcgcacgctcaatgacatgctcggcgccgaagtcttcttcaaatgcgagaatttccagcgcatgggagcgttcaagttccgcggcgcgtacaacgcgctggcgaagttcagccccgcgcaacgccgagcgggtgtggtggcgttctcgtcgggcaaccatgcgcagggcatcgcgctgtcggcaaagctgcttggcattcccgccaccatcgtgatgccgcacgacgcaccggcggccaaggtcgcggccaccaaaggctacggcgccaatgtcgtgatctacgaccgctacaccgaggaccgcgaagccatcgggcgccgcctggccgacgaacacggcttcacgctgattccgccctatgaccatccggacgtcctgtccggccagggcacggcagcaaaggaactgttcgaggcggtcggcgcactggacgtcgtgctgacgccgctcggcggcggtggattgctatccggcaccgcactgaccacacgcgcgctgtcgccgcaatgcaagctctttggcgtcgaacctgaagccggcaacgatggacagcagtcgttccgcagcggcgccatcgtgcacatcgataccccgaagaccattgcggacggcgcccagacgcagcatctcgggcagtacacgttcagcatcatcaagcgggacgtcgacgatatcctgacggcgtccgatgcccaactggtggaagcgatgaagttctacgccacacgcatgaagatgatcgtcgagcccacgggctgcctaggcctggccgccgccatgcatatgaaggatgcgctgaagggcaagcgcatcggcatcatcatcagcggcggcaatatcgacctggagcggttctgcgaactggtgtcggcgtaa

SEQ ID NO: 31660 - protein, 322 aa, Ralstonia eutropha JMP134
MTELKLPTYADVQEAAKRLDGVANRTPVNTSRTLNDMLGAEVFFKCENFQRMGAFKFRGAYNALAKFSPAQRRAGVVAFSSGNHAQGIALSAKLLGIPATIVMPHDAPAAKVAATKGYGANVVIYDRYTEDREAIGRRLADEHGFTLIPPYDHPDVLSGQGTAAKELFEAVGALDVVLTPLGGGGLLSGTALTTRALSPQCKLFGVEPEAGNDGQQSFRSGAIVHIDTPKTIADGAQTQHLGQYTFSIIKRDVDDILTASDAQLVEAMKFYATRMKMIVEPTGCLGLAAAMHMKDALKGKRIGIIISGGNIDLERFCELVSA

SEQ ID NO: 31661 - DNA, 1512 bp, Methylobacillus flagellatus KT
  CDS (1)..(1512)
atgaaaatcgactacctgcagaaaatcaaatccgcccgcgtctacgacgtggcaagcaagaccccgctggacctgcttcccaacctttcccgacgcattcacaaccaggtgctgctcaaacgcgaggatatgcagcctgtattttcattcaagcttcgcggtgcttacaacaagatggcgcagctttccgccgaggcactgtcgcgcggggtcattaccgcatccgccggcaatcatgcacagggtgtagccctggccgccaagaacgcaggctgtcgcgcagtcatcgtcatgcccgtcaccacccctgacatcaaggtggatgcggtacgtcaccgcggcgctgaggtagtgttggctggagagtcctacacggactcctataaccacgccatgaagctcatggaagagcagcaacttacctttgttcatccgttcgacgatcccgacgtgatcgcgggacaaggcaccgtggcaatggaaatactgcaggacaaccccggcccaatcgaggcaattttctgccctgtcggcggcggcggcttgatcgcgggcgtggccgcctacatcaaggcagtacgtccggagatcaaggtcatcggtgtcgaggtcaatgatgccaacgcgatgacggtttcgctgcaacagggcgcgcgcgtcaccttggaccaggtcggcctgtttgcagacggcaaggccgtcaaattggtcggagaagagactttccgcctgtgccaacaatacgtcgacgagatgatcctggtcgacaacgacgccatctgcgcagctatcaaggatgtcttcgaggatacgcgcgccatcctcgagccgacgggcgcgctctccctggctggactcaaggcctatgcccagcagcacaatctgcaaggcaaaaccctgatagcggtcgcctcgggcgccaacatgagcttcgaccgcctgcgctttgtcgccgagcgcgcagaaattggcgaaaagcgcgaagctgtgctggccgtgaccatcccggaaaccccgggctcattcaagaagttctgccggctgatcggccaccgcaacattaccgagttcaattaccgctatgctgacgccacggccgcacatatctacgtcgggatcgccatccaggaccccagtgaatccggcaagctagtcacccggctgcaggagcacggactgccggcgttggacctgagtgagaatgaagtagcaaagctgcacctgcgccacctggttggcggccatgcgccgcaggcaaagcacgagcaggtctaccgcttcgaattcccggaaaaacccggtgcattgatgaattttctcgacaatatgcggcatgactggaacatcagcctgtttcattatcgtaaccatggtgcggatttcggcagggtcctggtcggcatgcaggtaccgcctggggaagagcaggagtttaccgatttcctgcagaatctgggctatccgtactgggacgaaagcaacaacccggcttataagctattcctcggctaa

SEQ ID NO: 31662 - protein, 503 aa, Methylobacillus flagellatus KT
MKIDYLQKIKSARVYDVASKTPLDLLPNLSRRIHNQVLLKREDMQPVFSFKLRGAYNKMAQLSAEALSRGVITASAGNHAQGVALAAKNAGCRAVIVMPVTTPDIKVDAVRHRGAEVVLAGESYTDSYNHAMKLMEEQQLTFVHPFDDPDVIAGQGTVAMEILQDNPGPIEAIFCPVGGGGLIAGVAAYIKAVRPEIKVIGVEVNDANAMTVSLQQGARVTLDQVGLFADGKAVKLVGEETFRLCQQYVDEMILVDNDAICAAIKDVFEDTRAILEPTGALSLAGLKAYAQQHNLQGKTLIAVASGANMSFDRLRFVAERAEIGEKREAVLAVTIPETPGSFKKFCRLIGHRNITEFNYRYADATAAHIYVGIAIQDPSESGKLVTRLQEHGLPALDLSENEVAKLHLRHLVGGHAPQAKHEQVYRFEFPEKPGALMNFLDNMRHDWNISLFHYRNHGADFGRVLVGMQVPPGEEQEFTDFLQNLGYPYWDESNNPAYKLFLG

SEQ ID NO: 31663 - DNA, 948 bp, Mesorhizobium sp. BNC1
  CDS (1)..(948)
atgtacattccgaatcttaccgacgtgcttgcagcacgagccttaatcgaaccccatattcatcgcacacccgttctcacatcgacattcatcaatggacttgctggcgccgaactcttcttcaagtgcgagaaccttcagaaggctggggccttcaaagcgcgcggcgcgtcgaacgcggtgtttggcctgaacgacgagcaggcgaagaagggtgttgcaacgcactcgtccggcaatcacggaacctgcctttcctatgcagctggtcggcgcggcattccctgcaccgtagtgatgccgcgcaccgcgccgcaggctaagaaggatgcggtccggggctacggcggtcgtgtcgtcgaatgcgagccgtcaacctcgtcgcgtgaggccgtctttgccgaggttgttgccgagaccggcgcggaattcgtgcatccctataacgaccatcgtgtcatcgccgggcaggcgacctgctctgccgagttgatcgagcaggtcgacggtctcgacgccgtggtcgcgccgattggcggcggcggcatggtgtcgggaagctgcctgacgctctccaatctcgcgcccggcgtaaagatctacgccgccgagcccgagcaggccaacgacgcctaccgtagcttcaaggccggccgcatcatcgccgacgacgcgccagaaacggtcgccgacggcctgaaagtgccgctgaaggaactgacctggcatttcgtgaagaacaacgtcaccgacatcctgacggcttccgagcaggagatcgtcgacgcgatgaagctgatctggaagcgcatgaagatcgtgatggagccgtccagcgccgtgccgctggcgaccatcctgaagaaccctgatgtctttgccggcaagcgcgtcggcgtgatcgtgacgggcggcaatgtggatctcgacaaattaccgtggaactga

SEQ ID NO: 31664 - protein, 315 aa, Mesorhizobium sp. BNC1
MYIPNLTDVLAARALIEPHIHRTPVLTSTFINGLAGAELFFKCENLQKAGAFKARGASNAVFGLNDEQAKKGVATHSSGNHGTCLSYAAGRRGIPCTVVMPRTAPQAKKDAVRGYGGRVVECEPSTSSREAVFAEVVAETGAEFVHPYNDHRVIAGQATCSAELIEQVDGLDAVVAPIGGGGMVSGSCLTLSNLAPGVKIYAAEPEQANDAYRSFKAGRIIADDAPETVADGLKVPLKELTWHFVKNNVTDILTASEQEIVDAMKLIWKRMKIVMEPSSAVPLATILKNPDVFAGKRVGVIVTGGNVDLDKLPWN

SEQ ID NO: 31665 - DNA, 975 bp, Mesorhizobium sp. BNC1
  CDS (1)..(975)
atgaccgacattgccatgatcgaagccgcgcggagccgcattgcgggccatgtgcgccgcacaccgctccttttctcgccgtttttcgatgaaatcgcaggccggcgtgttcttgtgaagaccgagtccctccagcttaccggctctttcaagttccgcggtgcctggtcggcgatatcggcgctggacccggacgttcgggcgaaaggcgtgctcgccttttcctcgggcaatcatgcgcaggccgtggcgctcgccgcgcgaatgcacggcatttcttccaccatagtcatgccatccgacgcgccgaagctgaagatcgaaaacacgcgggcctatggcgccgaagtggtgctctatgatcgcgcgaaagaggaccgtgatgcgatcggtgtgaagctcgcggctgaaaggggacttacgctgatcaagcccttcgacgagccgctggtcattgccggccagggcactacgggccttgagctcgcggagcaggccaaggaaataggcgtggaaagggcggaagtgcttgtcccctgtggaggtggcggactcacctccggcatagcgctagcgcttgaagcgcgtgcaccccggctcaaggcgcgcccctgcgagcccgcgggcttcgacgatgtgacccgctccctcgcttccgggaagatcgagcgcaatgcggcgatgtcaggttcgatctgcgacgccattgtcacgccgtcgcccggcacgatcacctttccgatcctgaggcggctttgcggcgcgggaatcgtcgtaaccgacgaggaggcgctgcatgcaatggcgctggccttcacccggctcaagatcgtggtagagccgggcggcgcggtggcgctcgcggcagcactgttccatggcgaggagatggcggctgacacggttatcgcggttgcctccggcggcaatgtggatgccgccttgtttcggcaggctctggaacggtttgcttag

SEQ ID NO: 31666 - protein, 324 aa, Mesorhizobium sp. BNC1
MTDIAMIEAARSRIAGHVRRTPLLFSPFFDEIAGRRVLVKTESLQLTGSFKFRGAWSAISALDPDVRAKGVLAFSSGNHAQAVALAARMHGISSTIVMPSDAPKLKIENTRAYGAEVVLYDRAKEDRDAIGVKLAAERGLTLIKPFDEPLVIAGQGTTGLELAEQAKEIGVERAEVLVPCGGGGLTSGIALALEARAPRLKARPCEPAGFDDVTRSLASGKIERNAAMSGSICDAIVTPSPGTITFPILRRLCGAGIVVTDEEALHAMALAFTRLKIVVEPGGAVALAAALFHGEEMAADTVIAVASGGNVDAALFRQALERFA

SEQ ID NO: 31667 - DNA, 1560 bp, Ralstonia eutropha JMP134
  CDS (1)..(1560)
atgaaccgcaagcccgcctcctccaaacccgactatctcaggaagatcctgaccgccaaagtgtatgacgtggcgcaggagaccgagctgacctttgcgcacaacctgtcggcgcgcaccggcaactcggtgtggttcaagcgcgaggacacgcagccggtgttctcgttcaagctgcgcggcgcatacaacaagatggcgtcgctgacgcaggaagaactcaggcgcggcgtgatcgcggcgtcggccggcaaccacgcgcagggcgtggcgctgtccgcggcgcgcctgcagtgccgcgcaatcatcgccatgccggtgaccacgccgcaggtgaagatcgacgcggtgcgcgagcgcggcggcaagtgggtggagatcgtgctgcacggcgattcgtacagcgacgcctacaaccatgcggcaatcctggagaagaagcacaagctgaccttcatccacccgttcgacgatccggaagtgatcgccggccagggcaccatcgcaatggaaatcctgcgccagcatccgggcccgatccacgcgatcttcgtcgcgatcggtggcggcgggctgatttcaggcatcgcgtcttacatcaaggccgtgcgccccgagatcaaggtgatcggcgtgcagaccgtggattccgacgcgatgaagcgctcggtcgaagcgggcaagcgcattgaactcaaggacgtgggcctgttctctgacggcaccgcggtgaagctggtcggcaaggaaacattccgcatcacgcgcgaactcgtcgatgagatcgtgctggtggacaccgatgcgatctgcgcgggagtgaaggatgtgttccaggacacgcgcagcattcttgaacccgcgggcgcgctggccgtcgccggcctcaagctgtatgccgagcgcgagaagctcaagggcgagcatctggtcgcgatcgcctgcggcgccaacatgaacttcgaccgcctgcgcttcgtcgccgagcgcgccgaagtgggcgaggcacgcgaaggcgtgttcgccgtcactattcccgaagagcgcggtagcttcaagcgcttctgcgaactggtgggcacgcgcagcgtcactgaattcaactaccgcattgccgaccggaacatcgcgcatatcttcgtcggcgtacagatcgccagccgcgccgagaacgacaagatcgccgcgaacttccgccgccatggcttcgacacgctggacctgtccaacgacgaactcgccaagcagcacatccgctacatggttggcggcgtctcgccgctcgcgcacgacgaactgctgtatcgcttcgaattccccgagcgcccgggcgcgctgatgaagttcctgtcgagcatgagcccgaactggaacatcagcctgttccattaccgcaaccagggtggcgacacgtccaacatcctggtcggcatccaggtgccgaagaacgaaaagcgcgctttccgcgcattcctttcgacgctgggttacgtacactgggacgagaccgagaacccggtctacaagctgttcctctccgaccgcggaaatcaagcatga

SEQ ID NO: 31668 - protein, 519 aa, Ralstonia eutropha JMP134
MNRKPASSKPDYLRKILTAKVYDVAQETELTFAHNLSARTGNSVWFKREDTQPVFSFKLRGAYNKMASLTQEELRRGVIAASAGNHAQGVALSAARLQCRAIIAMPVTTPQVKIDAVRERGGKWVEIVLHGDSYSDAYNHAAILEKKHKLTFIHPFDDPEVIAGQGTIAMEILRQHPGPIHAIFVAIGGGGLISGIASYIKAVRPEIKVIGVQTVDSDAMKRSVEAGKRIELKDVGLFSDGTAVKLVGKETFRITRELVDEIVLVDTDAICAGVKDVFQDTRSILEPAGALAVAGLKLYAEREKLKGEHLVAIACGANMNFDRLRFVAERAEVGEAREGVFAVTIPEERGSFKRFCELVGTRSVTEFNYRIADRNIAHIFVGVQIASRAENDKIAANFRRHGFDTLDLSNDELAKQHIRYMVGGVSPLAHDELLYRFEFPERPGALMKFLSSMSPNWNISLFHYRNQGGDTSNILVGIQVPKNEKRAFRAFLSTLGYVHWDETENPVYKLFLSDRGNQA

SEQ ID NO: 31669 - DNA, 990 bp, Anabaena variabilis ATCC 29413
  CDS (1)..(990)
atgtcacagcttaactctgtaaccataactgatgtgcaagcagcacagcagcgtcttgctggtattgcccatcgcacacctgtgttaacttccacaactgtcaacgatcgcactcataatcaagtctttttcaagtgcgaaaattttcaacgcacaggtgcttttaaatttaggggtgcttataatgccttagcacagctatcaccaacacaaaaacacaaaggtgtgttgactttttcttcggggaatcatggacaagcgatcgcccttgcaggtaagttactcaacatccccacaactattgtcatgcctgatgatgcacctgtcatcaagcaaacagctaccaaaagttacggtgcagaggtaattttatataatcgccaagaaacgaatcgggaagaattggcgcaaaatctcgcaagcgatcgcggtttaaccctaattcctccatacgatcatccccatgtgatcgctggacaaggtacagccgcattagaactggtgcaagaaattggtgaactggatttgctgttagtttgttgtggcggtgggggattaatttccggttgtgcgatcgccgctaaagctcttttacctaatttgcgcgtaattggtgtagaaccaacactcgctgatgatgctactcgttccttttacaccaaaaccctacaaaccgtcacaaatccccatactatcgctgatggtgcgcggactcctagcctgggacagatgacatttcccctagttttacaatacgttgatgatatggtgacggtatcagaggaagcaattattcgcaccatgtttttcctctgggaacggctgaaaatagtcgttgaacccacaggcgtattagccgcagccgctttacttgaaaatgtagtcaaagcacaaggaaagagaattggtgtgattatcagtggtggaaatgtagatttaaccaaagttgctagttatgtcaacttagtcactgaatttggtaatgggtga

SEQ ID NO: 31670 - protein, 329 aa, Anabaena variabilis ATCC 29413
MSQLNSVTITDVQAAQQRLAGIAHRTPVLTSTTVNDRTHNQVFFKCENFQRTGAFKFRGAYNALAQLSPTQKHKGVLTFSSGNHGQAIALAGKLLNIPTTIVMPDDAPVIKQTATKSYGAEVILYNRQETNREELAQNLASDRGLTLIPPYDHPHVIAGQGTAALELVQEIGELDLLLVCCGGGGLISGCAIAAKALLPNLRVIGVEPTLADDATRSFYTKTLQTVTNPHTIADGARTPSLGQMTFPLVLQYVDDMVTVSEEAIIRTMFFLWERLKIVVEPTGVLAAAALLENVVKAQGKRIGVIISGGNVDLTKVASYVNLVTEFGNG

SEQ ID NO: 31671 - DNA, 1524 bp, Burkholderia cepacia R18194
  CDS (1)..(1524)
atggcatcccacgattacctgaagaaaatcctcaccgcgcgcgtctacgacgtcgcgatcgagacggaactcgaatccgcccgcatcctgtcggcccggctgcgcaatgcggtctacctgaagcgcgaggacaaccagccggtgttctcgttcaagctgcgcggcgcatacaacaagatggcgcacattccggcggacgcgctcgcgcgcggcgtgattacggcatcggccggcaaccacgcgcagggtgtcgcgttctcggcggcccggatgggcgtgaaggccgtgatcgtcgtgcccgtcacgacgccgcaggtgaaggtcgatgcggtgcgtgcgcacggcggcccgagcgtcgaggtgatccaggccggcgagtcgtacagcgatgcgtatgcacacgcggtcaaggtgcaggaagagcgcggcctcacgttcgtccacccgttcgacgatccgtacgtgatcgccggccagggcacgatcgcgatggaaatcctgcgccagcaccagggcccgatccatgcgatcttcgtgccgatcggcggcggcgggctcgcgtccggcgtcgcggcctacgtgaaggcggtgcgcccggagatcaaggtgatcggcgtgcaagccgaagattcgtgcgcgatggcgcagtcgctggaagccggcaggcgtgtcgagctgagcgaggtcggcctgttcgcggacggtaccgccgtgaagctggtcggcgaggaaaccttccgcctctgcagcgaatacctcgacggcgtcgtgacggtgaacaccgacgcgctgtgcgcggcgatcaaggacgtcttccaggacacgcgcagcgtgctcgagccgtccggcgcgctcgcggtcgcgggcgcgaagctctacgcggaacgcgaaggcatcgagaaccagacgctcgtcgcggtcacgtccggcgcgaacatgaacttcgaccggatgcgcttcgtcgccgagcgcgcggaagtgggtgaagcgcgcgaagccgtgttcgcggtcacgatccccgaagagcgcggcagcttcaagcgcttctgctcgctcgtcggcgatcgcaacgtcaccgagttcaactaccggatcgccgatgcgcaggccgcgcacatcttcgtcggcgtgcagatcaagcgtcgcggcgaatcggccgagatcgccgcgaacttcgaatcgcacggcttcaagagcgtcgacctgacgcacgacgagctgtcgaaggaacacatccgctacatggtgggcggccgctcgccgctcgcgctcgacgagcgcctgttccgcttcgaattcccggagcggccgggcgcgctgatgaagttcctgtcgtcgatggcgccggactggaacatcagcctgttccactaccgcaaccagggcgcggactacagctcgatcctcgtcgggctgcaggtgccgcaggccgatcgcgccgaattcgaacgcttcctcgcggcactcggctatccgtatgtcgaggagagcgccaacccggcttaccgcctcttcctgtcgtaa

SEQ ID NO: 31672 - protein, 507 aa, Burkholderia cepacia R18194
MASHDYLKKILTARVYDVAIETELESARILSARLRNAVYLKREDNQPVFSFKLRGAYNKMAHIPADALARGVITASAGNHAQGVAFSAARMGVKAVIVVPVTTPQVKVDAVRAHGGPSVEVIQAGESYSDAYAHAVKVQEERGLTFVHPFDDPYVIAGQGTIAMEILRQHQGPIHAIFVPIGGGGLASGVAAYVKAVRPEIKVIGVQAEDSCAMAQSLEAGRRVELSEVGLFADGTAVKLVGEETFRLCSEYLDGVVTVNTDALCAAIKDVFQDTRSVLEPSGALAVAGAKLYAEREGIENQTLVAVTSGANMNFDRMRFVAERAEVGEAREAVFAVTIPEERGSFKRFCSLVGDRNVTEFNYRIADAQAAHIFVGVQIKRRGESAEIAANFESHGFKSVDLTHDELSKEHIRYMVGGRSPLALDERLFRFEFPERPGALMKFLSSMAPDWNISLFHYRNQGADYSSILVGLQVPQADRAEFERFLAALGYPYVEESANPAYRLFLS

SEQ ID NO: 31673 - DNA, 921 bp, Burkholderia cepacia R18194
  CDS (1)..(921)
atgccgcttcatatcccgaccccttatatccgctcgcaaattgcgtcccgccggctcggcaggaccatccggctgaagctcgatgcgctgcagccgtcgggctcgttcaagctgcgcggcatcggcgccgtttgtgaagcgcggcatgcggccggcgcgcggcgcttcgtgtcgtcgtcgggcggcaatgcgggcatcgcggtcgcgtattgcggccgcgaactcggcgtgccggtgctcgtcgtcgtgccggagagcgcgtcggcccgcgcccgcgagctgatccgcgtcgagggcgcggaggtggtcgtgcacggcgcgagctgggccgaggcgaacgcgtacgcgcagtcggcactcggcgagcacgatgcgttcgtgcatccgttcgacgaccgtgtgctgtggcagggccacgcgacgatgatcgacgagatggcggcggccggcccgaagcccggcgcggtcgtgctcgcggtcggcggcggcgggctgctgtgcggcgtgctcgaagggctggcgcgcaacggctggcacgacgtgccggtagtcgccgccgaaacggagggcgccgactgctatgcgcgctcgctggcgcaggggcgtgtggtcgagttgtcggcgatcacgagcatcgcgacgtcgctcggcgcgaagcggccatgcgatgcggcggtcgaatgggccgcgcgacacgagatccatccggtcgtcgtgtccgatgccgacgcggtggccgcgtcgctgcgcttcctcgatgaacaccggatcgttgtcgagcccgcatgcggtgctgcgctggccgcactcgagcgaccggtgcccgtgcttgcatcggcgacggatatcgccgtgatcgtctgcggcggcgtgacggcaaccgtcgagcagatgcagacgttgcgcgcgacgttgcggtag

SEQ ID NO: 31674 - protein, 306 aa, Burkholderia cepacia R18194
MPLHIPTPYIRSQIASRRLGRTIRLKLDALQPSGSFKLRGIGAVCEARHAAGARRFVSSSGGNAGIAVAYCGRELGVPVLVVVPESASARARELIRVEGAEVVVHGASWAEANAYAQSALGEHDAFVHPFDDRVLWQGHATMIDEMAAAGPKPGAVVLAVGGGGLLCGVLEGLARNGWHDVPVVAAETEGADCYARSLAQGRVVELSAITSIATSLGAKRPCDAAVEWAARHEIHPVVVSDADAVAASLRFLDEHRIVVEPACGAALAALERPVPVLASATDIAVIVCGGVTATVEQMQTLRATLR

SEQ ID NO: 31675 - DNA, 1044 bp, Burkholderia cepacia R1808
  CDS (1)..(1044): n means a or g or c or t/u, s means g or c
atgtcgactgaatcaacgggcccggcccatacgacgatcgacggcgagccgattccgacgctcgacgaaatcgccgcgcagcatttcgcgttgtcgccctgggtcgcgcgcacgccggtattcgaacgcgccgatctgccgacgctcgaaggtacgcacgtcaacttcaagttcgagctgctgcaggcgagcggcagcttcaaggcgcgcggcgcgttcacgcacgtgctcgcgctcgacgaagcgcgcaagaacgccggcgtcacctgcgtgtcggccggcaatcatgcggcggccgtcgcatatgcggcgatgcggctcggcagcagcgccaaggtcgtgatgccccataccgcgagcccggtgcgcatcgcgcagtgccgcgcgtatcgcgcggaagtcgtgctggccggcagcgcgtcgcaggcattcgacctcgtgcggcgcgtcgaggccgaggaaggccgcttcttcatccatccgttcaacggctatcgcacgattctcggcacggcgacgctcggctacgaatgggcgacgcagacgcccgacctcgatgcggtgatcgtgccgatcggcggcggcggcctcgcggccggcatggccaccgcattgcgcctcgcgaatccgcgcgtgcacgtgtacggcgtcgagcccgaaggcgccgacgcgatgtgccgcagcttcgcggcgaaccacacgatcaagatgggcgcgatgcagagcatcgccgattcgctgatggcgccgcacaccgaggaatacagctatcagctgtgccggcgtcacgtcgaccggatcgtcacggtgtcggacgacgcgctgcgcgcggcgatgctgttcctgttctcgcatctgaagctagcggtcgagccccgcgtgcgcggccgcgctcgcggggctgctcggcccgctgcgcgaaacgctgcagggcaagcgggtcggcgtgctgctgccgggcacgaacaccgatccgnccacgctcggcatgcatctcgcgcacgcgcagatgcagcgctgaacccgctcgcgacgctcaggtag

SEQ ID NO: 31676 - protein, 347 aa, Burkholderia cepacia R1808
  Xaa in position 326 is unknown
MSTESTGPAHTTIDGEPIPTLDEIAAQHFALSPWVARTPVFERADLPTLEGTHVNFKFELLQASGSFKARGAFTHVLALDEARKNAGVTCVSAGNHAAAVAYAAMRLGSSAKVVMPHTASPVRIAQCRAYRAEVVLAGSASQAFDLVRRVEAEEGRFFIHPFNGYRTILGTATLGYEWATQTPDLDAVIVPIGGGGLAAGMATALRLANPRVHVYGVEPEGADAMCRSFAANHTIKMGAMQSIADSLMAPHTEEYSYQLCRRHVDRIVTVSDDALRAAMLFLFSHLKLAVEPRVRGRARGAARPAARNAAGQAGRRAAAGHEHRSXHARHASRARADAALNPLATLR

SEQ ID NO: 31677 - DNA, 921 bp, Burkholderia cepacia R1808
  CDS (1)..(921)
atgccgctccatattcagacgccgtacctccgctcgcacaccgcctcccgccggctcggcgccgacgtctggttgaagctcgatgcgcttcagccatccggttcgttcaaattgcgcgggatcggcgcggtgtgcgcggcgcgacaggcggccggcgcgcgtcgcttcgtgtcgtcgtcgggcggcaatgcgggcatcgcggtcgcgtattgcgggcgcgaactcggcgtgccggtgctggtggtggtgcccgagaccgcgtccgtgcgcgcacgcgaactgattcgcggcgaaggggccgaggtcatcgtgcatggcgcgagctgggtcgaggccaacgcgttcgcgctggcggccgtcggcgagcacgacgcgttcgtgcacccgttcgacgatccggtgttgtggggcggccacgcgacgatcgtcgacgagatcgcggtcgccggcccgaaacccgacgcgatcgtgctcgcggtcggtggcggcgggctgctgtgcggcgtgctggaggggctctcgcgcaacggctggcacgacgtgccggtcgtcgcggtggagacggcgggcgccgactgctatgcgcgctcggtcgcgcagcggcgtccggtggaactgccggcgatcgagagcatcgcgacgtcgctcggcgcgaagcggccgtgcgacgcggcgctcgagtgggcgagccggcatccgattcatccggtcgtcgtatcggatgcgcaggcggtggccgcctcgttgcggctggtggacgagcaccggctcgtcgtcgagcccgcgtgcggcgccgcgctggctgcgctcgaacggccggtgccggtgctggccgcggcgtcgaacatcgcggtgatcgtctgcggcggcgtgacggcgaccatcgagcaactgcagtcgtggagcgctacgttgcggtga

SEQ ID NO: 31678 - protein, 306 aa, Burkholderia cepacia R1808
MPLHIQTPYLRSHTASRRLGADVWLKLDALQPSGSFKLRGIGAVCAARQAAGARRFVSSSGGNAGIAVAYCGRELGVPVLVVVPETASVRARELIRGEGAEVIVHGASWVEANAFALAAVGEHDAFVHPFDDPVLWGGHATIVDEIAVAGPKPDAIVLAVGGGGLLCGVLEGLSRNGWHDVPVVAVETAGADCYARSVAQRRPVELPAIESIATSLGAKRPCDAALEWASRHPIHPVVVSDAQAVAASLRLVDEHRLVVEPACGAALAALERPVPVLAAASNIAVIVCGGVTATIEQLQSWSATLR

SEQ ID NO: 31679 - DNA, 978 bp, Burkholderia cepacia R1808
  CDS (1)..(978)
atgaccaacccgacccttcccacctacgacgacgtcgcggccgccgccgcgcgcctgcagggccacgcgcaccgcacgcccgtgatgacgtcgagcacgctcgacgacgcgctcggcgcgcaagtgttcttcaagtgcgagaacctgcagcgcatgggtgcgttcaagttccgcggcgcgttcaacgcgctgtcgcgcttcgacgccacgcagcgccgcaacggcgtggtcaccttctcgtcgggtaaccacgcgcaggcgatcgcgctgtcggcgcgcatgctcggcatcccggcgacgatcgtgatgccgcaggacgcgccggccgcgaagatggccgccacgcgcggctacggcggcaacgtcgtgacctacgaccgctatacggaagaccgcgagcagatcggccgcgagctggcggagaagcacgggctcacgctgatcccgccgtacgaccatgcggacgtgatcgccggccagggcacggcggcgaaggagctgttcgacgaagtcgggccgctggacgcggtgttcgcgccgctcggcggcggcggcctgctgtccggcaccgcgctcgcgacgcgggcgctgtcgccgcaagcgaagctgtacggcgtcgagcccgaagccggcaacgacggccagcaatcgttccgcagcggcgcgatcgtgcacatcgacacgccgcgcacgatcgccgacggcgcgcagacgcagcatctgggcaacctcacgttccagatcctgcgacgcgacgtcgacgacatcctgacagcgaccgacgccgaactggtcgacagcatgcggttcttcgcaacccggatgaagctcatcgtcgagccgaccggctgcctgtcgctcgcggccgcacgcaagatgaaggacgaactcgcgggcaagcgcgtcggcatcgtgatcagcggcggcaacgtcgacctcgcgaacttcgccgcactggtttccagtcccgccgcatga

SEQ ID NO: 31680 - protein, 325 aa, Burkholderia cepacia R1808
MTNPTLPTYDDVAAAAARLQGHAHRTPVMTSSTLDDALGAQVFFKCENLQRMGAFKFRGAFNALSRFDATQRRNGVVTFSSGNHAQAIALSARMLGIPATIVMPQDAPAAKMAATRGYGGNVVTYDRYTEDREQIGRELAEKHGLTLIPPYDHADVIAGQGTAAKELFDEVGPLDAVFAPLGGGGLLSGTALATRALSPQAKLYGVEPEAGNDGQQSFRSGAIVHIDTPRTIADGAQTQHLGNLTFQILRRDVDDILTATDAELVDSMRFFATRMKLIVEPTGCLSLAAARKMKDELAGKRVGIVISGGNVDLANFAALVSSPAA

SEQ ID NO: 31681 - DNA, 1056 bp, Listeria monocytogenes str. 1/2a F6854
  CDS (1)..(1056): transl_table=11
atgtataaaggtttactagaaaaatataaagaatatctaccagtaactgataaaacgccaatgatctcacttgcggaaggaaatacaccacttattccattaccgaatttgtccaaagaacttggggttactttatacggaaaatacgaaggcttaaatccaaccggttcttttaaagatcgtggaatggttatggctgttgcaaaagcgaaagaagaaggtgccgaagcggttatttgtgcatccactgggaatacttctgctgcggctgcggcatacgcaacacgtgcgggattaaaagcgtacattgttattccagaaggcaaagtcgctctaggaaaattagcgcaagcagttatgtatggcgcagatattatctcgattcaaggtaattttgatgaagcattaaaatcggttcgtgaattagctgaaacagaagcagtaacacttgtaaattccgtgaatccatatcgtttagaaggtcaaaaaacagctgcattcgaaatctgtgagcaattaggttccgcgccagatgtacttgcaattccagtcggtaatgccgggaatatttctgcatactggaaggggtttaaagaatggaatgaggctaaagcttctggactgccgcggatgcatggttttgaagcagaaggagctgcggcgattgttcaagggaaaccaattgataacccggaaacaattgcaacagcgattcgtatcggaaacccagctagttggcggcttgcagaagcagctcgcgatgaatctggcggatacatccattctgtaacagacgacgaaattgtgaatgcgtataaaaaaattgcagcacaagatggtgtctttatcgagccgggttctgccgcttcattagctggtgtcattcaacatgtagcaaatggaacaattaaaaaaggggaaacagttgtttgtgtctttactggaaatggcttaaaagatccagatactgcgatgagtgtgcatgaaattccaatttcccatgtggatgatatcgaagcaatgcgcacacatttacgttcaggagtgaaagcttaa

SEQ ID NO: 31682 - protein, 351 aa, Listeria monocytogenes str. 1/2a F6854
MYKGLLEKYKEYLPVTDKTPMISLAEGNTPLIPLPNLSKELGVTLYGKYEGLNPTGSFKDRGMVMAVAKAKEEGAEAVICASTGNTSAAAAAYATRAGLKAYIVIPEGKVALGKLAQAVMYGADIISIQGNFDEALKSVRELAETEAVTLVNSVNPYRLEGQKTAAFEICEQLGSAPDVLAIPVGNAGNISAYWKGFKEWNEAKASGLPRMHGFEAEGAAAIVQGKPIDNPETIATAIRIGNPASWRLAEAARDESGGYIHSVTDDEIVNAYKKIAAQDGVFIEPGSAASLAGVIQHVANGTIKKGETVVCVFTGNGLKDPDTAMSVHEIPISHVDDIEAMRTHLRSGVKA

SEQ ID NO: 31683 - DNA, 1581 bp, Rubrivivax gelatinosus PM1
  CDS (1)..(1581)
atggcccgcgccgcgccgcgccccgccccccgcacttccgtcgccaaacccgctctccgcaaggctggggccaagcccgactacctgcagcgcatcctgaccgcgcgggtctacgacgtggccatcgaatcggcactgcagttcgcaccgcaactgtcggagcggatgggcaaccaggtctggctcaagcgcgaggatgaacaggcggtcttcagcttcaagctgcgcggcgcctacaacaagatggcgcacctgagcccgcagcagctggggcgcggcgtgatctgcgcttccgccggcaaccacgctcagggggttgccctgtcggcccgcaagctccgctgccaagcgacggtcgtgatgccggtcaccacgccgcaactcaagatcgaggctgtgcgggcgctcggcggcaaggtcgtgttgcacggcgagagctattccgatgcctatgcccatgcactgaaactcgaacgggagcacgggcagaccttcgtgcatcctttcgacgatcccgacgtgatcgccggtcagggcaccatcgccatggagatcctgcgccagcaccaggggccgatcgacgccgtgttcgtggcagtgggcggtggcgggctgatctcgggcatcgctgcatacatcaaggcggtccggccggagatccaggtgatcggcgtccagaccaccgattccgatgcgatgctgcgttcggtgcgcgctggcaagcgcgtgacgctgcacgacgtggggctgttctccgacggcaccgccgtcaagctggtgggcgaagagacctttcgcctgacgaagcagtgggtcgacgatttcgaagtggtcgacaccgacgcggtctgcgcggcgatcaaggatgtgttccaggacacccgctcgatcctggagccggccggcgcgctgggcgtggcggccatcaaacagtacacggcacgcaccggctgcaagggcaagaccttcgtggcgatcacctgcggcgccaacatgaacttcgaccgattgcgcttcgttgccgagcgggccgaggtgggcgaggagcgcgaggcgctgttcgccgtcactatcccggaggaacggggttccttcaagcgcttctgcgagttgctcggcccgcgcagcgtcacggagttcaactaccgcatctcggacgcgcagaccgcgcaggtgttcgtgggcctgtccacgcgggaacacggcgaatcggctcgcattgccgagcggttcgagaagcagggcttcgcgacggtcgacctgacacacgacgaactggccaagacccatatccgccacatggtcggcggccgctccgagctggcccgcgaggagcgactgttccggttcgtcttcccggagcgtccgggagcgctgatgcgcttcctgacccgcatgcaccccgactggaacatcagcctgttccattaccggaatcagggtgccgattacggtcgcatccttgtcggcctgcagattccccgcggcgcgcagcgcgcactgcgagagttcctgtccacactggattacccctgcgtcgaggagaccgacaacccggtctaccagctcttcctgcgctga

SEQ ID NO: 31684 - protein, 526 aa, Rubrivivax gelatinosus PM1
MARAAPRPAPRTSVAKPALRKAGAKPDYLQRILTARVYDVAIESALQFAPQLSERMGNQVWLKREDEQAVFSFKLRGAYNKMAHLSPQQLGRGVICASAGNHAQGVALSARKLRCQATVVMPVTTPQLKIEAVRALGGKVVLHGESYSDAYAHALKLEREHGQTFVHPFDDPDVIAGQGTIAMEILRQHQGPIDAVFVAVGGGGLISGIAAYIKAVRPEIQVIGVQTTDSDAMLRSVRAGKRVTLHDVGLFSDGTAVKLVGEETFRLTKQWVDDFEVVDTDAVCAAIKDVFQDTRSILEPAGALGVAAIKQYTARTGCKGKTFVAITCGANMNFDRLRFVAERAEVGEEREALFAVTIPEERGSFKRFCELLGPRSVTEFNYRISDAQTAQVFVGLSTREHGESARIAERFEKQGFATVDLTHDELAKTHIRHMVGGRSELAREERLFRFVFPERPGALMRFLTRMHPDWNISLFHYRNQGADYGRILVGLQIPRGAQRALREFLSTLDYPCVEETDNPVYQLFLR

SEQ ID NO: 31685 - DNA, 1239 bp, Rubrivivax gelatinosus PM1
  CDS (1)..(1239)
ttgacctcagccgagtcgccggcgacggtgaccctggcggacgtcgaggccgctgcacgccggctggccggacaggtgctcgacacaccgtgtgtcgagtcgaagacgctgtccgagatcaccggcgcgcaggtcttcctgaagttcgagaacctgcagttcaccgcttccttcaaggagcgcggcgcgttgaacaagctgctggcgctggtcgccgcgcgcgacgacggcaccgccgcgttgaagggcgtgatcgccgcctccgccggcaaccatgcgcagggcgtggcgcatcacgcgcagcggctgggcctgcgcgcggtcatcgtgatgccccggcacacgccgacggtgaaggtcgagcgcacgcgcggcttcggtgccgaggtgctgctgcacggcgagagcttcgacgaggctcgcgcgcacgcgctggaggtggccgcggcgcagggcctgagcttcgtgcaccccttcgacgatccgctggtgatcgccggccagggcacgatcggcctggagatgctgcgcgcgcaaccgacgctcgacactctggtcatcgccgtcggcggcggcgggctgatctccggcatcgcgaccgtcgcccgggcgctgaagcccgggctggagatcgtcggggtgcagacggcgcgctttccggcgatggtgaacctcgtcaagggccgcacccatccgcaaggcaccagcacgatcgccgagggcattgccgtcggtgagccggggcggatcacgcgggcgatcgttcgcgacctcgtcgacgacatggtgctggtggacgaagcggacatcgagcatgccctggtgatgctgctggagatcgagaagacgctggtcgagggggccggcgccgcgggtctggctgcgctgctgaaggcgcccgggcgctacgccgggcgacgcgtgggcctggtgctgtgcggcggcaacatcgatccgctgctgctgtcggcgatcatcgagcgcggcatggtgcgggcggggcggctggcacgcatccgcgtcgacgcgcgcgacgcccccggcgcgctggcgcgcatcaccgccaccgtggccgaggccggcgcgaacatcgaggaagtgcatcaccagcgggccttcaccacgctgtcggcgcagaacgccgaggtggagttggtgttgcagacgcgcaatcacgcccatatcggcgcagtgatcgcgtccctggtggctcaggggttcgaggccaaggcctactga

SEQ ID NO: 31686 - protein, 412 aa, Rubrivivax gelatinosus PM1
MTSAESPATVTLADVEAAARRLAGQVLDTPCVESKTLSEITGAQVFLKFENLQFTASFKERGALNKLLALVAARDDGTAALKGVIAASAGNHAQGVAHHAQRLGLRAVIVMPRHTPTVKVERTRGFGAEVLLHGESFDEARAHALEVAAAQGLSFVHPFDDPLVIAGQGTIGLEMLRAQPTLDTLVIAVGGGGLISGIATVARALKPGLEIVGVQTARFPAMVNLVKGRTHPQGTSTIAEGIAVGEPGRITRAIVRDLVDDMVLVDEADIEHALVMLLEIEKTLVEGAGAAGLAALLKAPGRYAGRRVGLVLCGGNIDPLLLSAIIERGMVRAGRLARIRVDARDAPGALARITATVAEAGANIEEVHHQRAFTTLSAQNAEVELVLQTRNHAHIGAVIASLVAQGFEAKAY

SEQ ID NO: 31687 - DNA, 1515 bp, Pseudomonas fluorescens PfO-1
  CDS (1)..(1515)
atgctcgaacagtacgtcaagaagatcctcacctcgcgcgtttatgacgttgccgtagaaaccccgctgcagaacgcccgccagctctccgagcggctgggcaacgacatctggctcaagcgcgaagacttgcagccggtgttctcgttcaagattcgcggtgcctacaacaagctgacccagttgagcgacgaagagcgcgctcgcggcgtggtcaccgcgtcggcgggcaaccatgcacagggcctggccctggcggcgaaagtgttgggcgtgaaagcgaccatcgtgatgcccaagaccaccccggagatcaaggtcgaaggcgtgcgctcgcgcggtggcaaagtggtgctgcacggcgattccttcccggaagcgctggcctactcgctgaagctggtcgacgaaaaaggctacgtctacatccacccgtacgacgatccgcacaccattgccgggcagggcaccgtggcgatggaaattctgcgccagcacccgcagccgctggatgcgattttcgttccggtgggcggcggcggtctgatcgccggcatcgcggcctacgtgaaatacctgcgtccggacatcaaggtcatcggcgtcgagcccgacgactccaactgcctgcaagcggcgatggcggcaggcgaacgcgtggtgctgccgactgtaggcatcttcgccgacggcgtggcggtggcgcagatcggccagcacaccttcgatatctgcaaggattacgtcgacgaggtgatcaccgtcagcaccgacgagatttgcgcggcgatcaaggacatctacgacgacacccgttcgatcaccgaaccggccggcgccctgggcgtggccgggatcaagaagtatgtcgagcagcgcggcgtcagcggccagaccttcgtcgccatcgactccggggccaacgtcaacttcgaccgcttgcgccacgtcgccgagcgcgccgaactgggtgaaggccgcgaagcgatcatcgccgtgaccatcccggagaaggccggcagcttcaaggccttctgcgaggccatcggcaagcgccagatcaccgaattcaactaccgctataacaatggcagcgaagcgcacatcttcgtcggcgtgcagacccacccggacaacgacccgcgcagtgctttgctggcgagcctgaccgaacagggtttcccggtgctcgacctgaccgacaacgaactggccaaactgcacatccgccacatggtcggcggtcgcgccgcgcacgtggtcgatgaagtggtgctgcgcttcgagttcccggagcgtccgggcgcgctgttcaacttcctcaacaagctcggcgggcgctggaacatctcgatgttccactaccgcaaccacggtgcagcggacggtcgtgtggtggcgggtctgcaagtgccccacgacgagcgtcatctggtgcccgcagcccttgaggaaatcggctacccatactgggacgaaagcgacaacccggcctatcagctgtttcttggctga

SEQ ID NO: 31688 - protein, 504 aa, Pseudomonas fluorescens PfO-1
MLEQYVKKILTSRVYDVAVETPLQNARQLSERLGNDIWLKREDLQPVFSFKIRGAYNKLTQLSDEERARGVVTASAGNHAQGLALAAKVLGVKATIVMPKTTPEIKVEGVRSRGGKVVLHGDSFPEALAYSLKLVDEKGYVYIHPYDDPHTIAGQGTVAMEILRQHPQPLDAIFVPVGGGGLIAGIAAYVKYLRPDIKVIGVEPDDSNCLQAAMAAGERVVLPTVGIFADGVAVAQIGQHTFDICKDYVDEVITVSTDEICAAIKDIYDDTRSITEPAGALGVAGIKKYVEQRGVSGQTFVAIDSGANVNFDRLRHVAERAELGEGREAIIAVTIPEKAGSFKAFCEAIGKRQITEFNYRYNNGSEAHIFVGVQTHPDNDPRSALLASLTEQGFPVLDLTDNELAKLHIRHMVGGRAAHVVDEVVLRFEFPERPGALFNFLNKLGGRWNISMFHYRNHGAADGRVVAGLQVPHDERHLVPAALEEIGYPYWDESDNPAYQLFLG

SEQ ID NO: 31689 - DNA, 957 bp, Pseudomonas fluorescens PfO-1
  CDS (1)..(957)
atgcacgtattcactcgcgacgacatcgaaaacgccgcccgccaggtttatcaggtgatgtcggccaccgcccaataccgttggccattgctcgccgagcggttgggctgcaccgtttgggtcaagcatgaaaaccacacgccgaccggcgccttcaaagtgcgtggcggtattacctttatgcactggctgcgtcgtgagcatccgactgtcaaaggcatcgtttctgcgacacgtggcaatcacggtcagagtctggcgctggcggcgcgggccgtgggactgaaagcgttgatcgtggtgccgcagggcaactcgctggagaagaacaacgccatgcgtggctttggtggtgaagtggtcgaatacgggcgcgattttgacgaggctcgtgaagaggcggcgcgcctggcacagaagcacgacctttttctggtgccaccgtttcacgttgaactggtcaagggcgtagcgacctatgcgctggagctgttcggtgcggcgccggatctggatacggtttacgtgcccattggttgcggatcggggatctgtggtgtgatcgctgcccgcgacgccctaggactgaataccgaagtggtgggggtggtgtcgacagaggccgcggccgccaagctgtcgtttgaagcgaacgcgatttgcgaaaccgcttcggcgaatacgttcgcggatggtttggctgttcgcaagccgattgcgcaggcgttcgatatctataaagaaggggcggcgaggattctctcggtcagcgaagttgagattgccgaagccatgcgcgtgtattacaccgacacccacaatcttgcggagggcgcgggtgccgcagcgttggcggcgttgatgcaggatcgggggaggatggaggggaaaaaggtcggggtggttctgtccggagggaatattgaccgatcggtgtatgcaaaggtgattggttga

SEQ ID NO: 31690 - protein, 318 aa, Pseudomonas fluorescens PfO-1
MHVFTRDDIENAARQVYQVMSATAQYRWPLLAERLGCTVWVKHENHTPTGAFKVRGGITFMHWLRREHPTVKGIVSATRGNHGQSLALAARAVGLKALIVVPQGNSLEKNNAMRGFGGEVVEYGRDFDEAREEAARLAQKHDLFLVPPFHVELVKGVATYALELFGAAPDLDTVYVPIGCGSGICGVIAARDALGLNTEVVGVVSTEAAAAKLSFEANAICETASANTFADGLAVRKPIAQAFDIYKEGAARILSVSEVEIAEAMRVYYTDTHNLAEGAGAAALAALMQDRGRMEGKKVGVVLSGGNIDRSVYAKVIG

SEQ ID NO: 31691 - DNA, 918 bp, Pseudomonas fluorescens PfO-1
  CDS (1)..(918)
atgttgcacatccgcacgccgctgatcctccatccgaccctgtcgactgcgtcccggcgcatgtggctgaagctggaaaacctgcaaccctgtggctcgttcaagctgcgcgggatgggcttgttgtgcagtcaggcagcggcgcagggcaagcgcaaggtcgtatgcccgtccggcggcaatgccgggctggccacggcggtggcagcggtcagcctgggtttgcaagcctgcatcgtggtgccgcacaccacgcctgaagcgacccgcgcgcgtattcgccgcaccggcgcggacgtcatcgtccacggcaaagtctgggacgaggccaatcagcgagcgcgagaactggccagcgcggcggacaccgaatacgtgccggccttcgatcacccggtgttgtgggaagggcacagctcgatggtcgacgaaatcctcgacgactgcccgcaggtcgataccgtggtcacgtcggtcggcggcggtggtttgctggcgggcatcctcaccgggctgctgcgccatgaccgccgagactgccgcatcatcacctgcgaaaccacaggcgccgcctcgttcgctgcggccgtccaggctggccatccggtgcgcctgagtcggatcgacagtgtcgccacctccctcggcgccgcccaggtggcggcttggccggtagagcatatcggcgagttcgatcatgagtgtctggtgctgtcagatgacgacgcgatcatgggcgtggtgcgttatgccagtgatctgcggcaattggtggagcctgcgtgcggggtttcgctggcggtggcgtacctcgatcatccggcgttggcgggggcgaatgatgtggtggtcattgtttgcggcggggtgagtatcagtgcgcaactggtggcggggtgggcgcggttgggatcttga

SEQ ID NO: 31692 - protein, 305 aa, Pseudomonas fluorescens PfO-1
MLHIRTPLILHPTLSTASRRMWLKLENLQPCGSFKLRGMGLLCSQAAAQGKRKVVCPSGGNAGLATAVAAVSLGLQACIVVPHTTPEATRARIRRTGADVIVHGKVWDEANQRARELASAADTEYVPAFDHPVLWEGHSSMVDEILDDCPQVDTVVTSVGGGGLLAGILTGLLRHDRRDCRIITCETTGAASFAAAVQAGHPVRLSRIDSVATSLGAAQVAAWPVEHIGEFDHECLVLSDDDAIMGVVRYASDLRQLVEPACGVSLAVAYLDHPALAGANDVVVIVCGGVSISAQLVAGWARLGS

SEQ ID NO: 31693 - DNA, 993 bp, Rhodospirillum rubrum
  CDS (1)..(993)
atgacccggcccttgcccgagactcccggggtcggcgcccaggacgtggtcgatgccggccaccgcctgaagggtcttgtcgtcaccacgccgcttgtcgaaagcccggtgctcaacgccagcatcggtggccggctgctggtcaaggccgaatgcctgcagcggacgggatcgttcaagatgcgcggggcgaccaacgccctggcccagatggacgacgcggcgcgggcgcgcggcgtcatcacccattcgtcgggcaatcatggtcaggccttggcctcggccgcccgggccttcggcctgcgggcgaccgtggtgatgcccgatgacgcgcccgccctcaagatcgagctgacccgggcccatggcgccgaggtggtcttctgtccgcgccacgcccgcgagcagacggtggcccggctagccggcgaaagcggcgccgtggtgatccatccctatgagacccccgccgtcatcgccggccaggggacggtgggcctggaaatcgtcgagcaatgcgccgccatcggcgtggtgcccgatcaggtgctggtctgctgtggcggcggcggtctgaccgccggggtggccctggccatcgaccggctgctgcccggcgtgccggtgatcgccgtcgagcccgagggctgggacgataccaagcgctccctggccgccggtgctatcgtcgccaatgacggtctgacggccacggcctgcgacgccttgcaggcgatgtgtccgggcaccctcagcttctcgctcaatcgccatctgctggccggggcggtgagcgtggacgaggcgatggtgcgccacgccatgcgccaagccttcgttcatctcaagctggtggccgaacccggcggcgccgtggccctggccgccgccctggccggcaaggtcgagaccgccgatcgcctcagcgtcgtcgtgctctcgggcggcaatgtcgatcccggccgcttcgcgagcgtgctggccggggattag

SEQ ID NO: 31694 - protein, 330 aa, Rhodospirillum rubrum
MTRPLPETPGVGAQDVVDAGHRLKGLVVTTPLVESPVLNASIGGRLLVKAECLQRTGSFKMRGATNALAQMDDAARARGVITHSSGNHGQALASAARAFGLRATVVMPDDAPALKIELTRAHGAEVVFCPRHAREQTVARLAGESGAVVIHPYETPAVIAGQGTVGLEIVEQCAAIGVVPDQVLVCCGGGGLTAGVALAIDRLLPGVPVIAVEPEGWDDTKRSLAAGAIVANDGLTATACDALQAMCPGTLSFSLNRHLLAGAVSVDEAMVRHAMRQAFVHLKLVAEPGGAVALAAALAGKVETADRLSVVVLSGGNVDPGRFASVLAGD

SEQ ID NO: 31695 - DNA, 1269 bp, Rhodospirillum rubrum
  CDS (1)..(1269)
atgtcgcccttccccccgtttccggccgcttcggccgtccccgccgtcaccctggccgatgtggaagccgcggcccggctgatcgcccatgccgtgccccataccccgctgctcccctcgcgcaccctgtcgcggctgaccggggccgaggttttcatcaaattcgagaaccaccagttcaccgcctcgttcaaggagcgcggcgcgctcaaccggttgagcgcgctgagcgagaccgagcgggcgcgcggcgtcatcgccatgagcgcgggcaatcacgcccagggcgtggcctatcacgcccagcgcctgggcattcccgccgttatcgtcatgcccgctgacacgcccttcgtaaaggtcaagcacacccgtgatttcggcgcccgcgtggtgctggaaggcgagaccgtggccgaatcgcggctggtggccgagcgcatccgcgaggaggagggactgaccttcgttcatccctataatgatccctgggtgatcgccggccaggggacggtggccttggaaatgcttgccgatcagcccgacctcgacatcctggtcgccccgatcggcggcggcggcctgctgggcggcatggcggtggcggccaaggcggtcaaaccggccattgagatgatcggcgttcaggtcgggctttatccttcggcctataacgccctccacggcctgccgccttgcaccggcggcgccacggtggccgagggcatcgccgtcaaggaaccgggcgatctgaccttgccgctgctgcgcgctttggtctcgcgcatcatcctggtcgatgagacggcggtcgaggaagccatctcgctctatctctcggtcgaaaagaccgtggccgagggggcgggggcggcgtcgctcgccgccctgttgaccgagccccagcgctttcgcggcaaaaaggtcggtctggtgctgagcggcggcaatatcgatccgcggatcatggcctcggtcatcatgcgcagccttgtgcgcgagggccgaatcgcccatctctcgatcaggatcggcgacaagccggggcaactcgcccgggtggcgacggtgatcggcgaaaccggcggcaatatcgtcgaggtccgccatgaacgcctgacctcggatatttcggtcaaatccaccgatctgcgggtgatcctggagacccgcgaccatacccatctggccgagatccttgaacgcctcgccgccgccggttttccggccaacgaacgctcgttcagcggcccggccgccggcgattaa

SEQ ID NO: 31696 - protein, 422 aa, Rhodospirillum rubrum
MSPFPPFPAASAVPAVTLADVEAAARLIAHAVPHTPLLPSRTLSRLTGAEVFIKFENHQFTASFKERGALNRLSALSETERARGVIAMSAGNHAQGVAYHAQRLGIPAVIVMPADTPFVKVKHTRDFGARVVLEGETVAESRLVAERIREEEGLTFVHPYNDPWVIAGQGTVALEMLADQPDLDILVAPIGGGGLLGGMAVAAKAVKPAIEMIGVQVGLYPSAYNALHGLPPCTGGATVAEGIAVKEPGDLTLPLLRALVSRIILVDETAVEEAISLYLSVEKTVAEGAGAASLAALLTEPQRFRGKKVGLVLSGGNIDPRIMASVIMRSLVREGRIAHLSIRIGDKPGQLARVATVIGETGGNIVEVRHERLTSDISVKSTDLRVILETRDHTHLAEILERLAAAGFPANERSFSGPAAGD

SEQ ID NO: 31697 - DNA, 1536 bp, Ralstonia metallidurans CH34
  CDS (1)..(1536)
atgacccgcacgcccgccaagcccgactatctgaaaaaaatcctgaccgccaaggtctatgacgtggcccaggagaccgaattgacctatgcgcccgcgctgtcggcacgcaccggcaatgcggtctggttcaagcgcgaggacacccagccggtgttctcgttcaagttgcggggggcgtacaacaagatggcgtccctcacgcccgaggaactcaagcgcggcgtgatcgctgcttcggcaggcaaccacgcccagggcgtggcgctggcggcggcccgcatgcagtgcaaggcgatcatcgccatgccgaccaccacgccgcaggtgaagatcgacgccgtgcgcgagcgcggcggcgagtgggtgcagatcgttctgcacggtgagtcgtacagcgatgcctacctgcacgcggccgaactcgagaagaagcacaagctcgcgttcatccacccgtttgacgaccccgaggtcatcgccggccagggcaccatcgcgatggagatcctgcgccagcaccctggcccgatccacgcgatctttgtcgccatcggcggcggcggcctgatctccggcatcgccgcctacgtcaaggcggtgcgccccgagatcaaggtgatcggcgtgcagaccttcgattccgatgccatgaagcgctcggtggacgccggcaagcgcgtggaactgaaggatgtgggcctgttctcggacggtaccgccgtcaagctggtgggcaaggaaacgttccgcatcacgcgtgaactggtcgacgacatcatcctggtcgataccgatgcgatctgcgcgggcctgaaggatgtgttccaggacacccgcagcatcctcgagccggccggcgcgctggccgtggccggcctcaaggcgtacgccgagcgcgagaagctcaagcaccagcacctggtggcgatcgcctgcggcgccaatatgaacttcgaccgcctgcgctttgtggccgagcgcgccgaagtgggtgaagcgcgcgaagcggtcttcgccgtgacgatccccgaggaacgcggcagcttcaagcgcttctgcgaacaggtcggcacgcgcagcgtgaccgagttcaactaccgcatcgccgacaagggcgtggcgcatatcttcgtcggcgtgcagatcgccagccgcgcggagagcgacaagatcgccgccaacttccgccgccatggctttgacacgctcgacctgtcgaacgacgaactggccaagcagcacatccgctacatggtcggcggccattcgccgctggcgcatgacgaactgctgtatcgcttcgagttcccggagcgcccgggcgcgctgatgaagttcctgtccagcatgagcccgaactggaacatcagcctgttccactaccggaaccagggcgcggatacgtcgaacatcctggtcggcatccaggtgccgaagaacgagaagcgcgcgttccgcagcttcctttcgacgctcggttacgtacactgggatgagaccgacaaccccgtctacaagctgttcctttcctga

SEQ ID NO: 31698 - protein, 511 aa, Ralstonia metallidurans CH34
MTRTPAKPDYLKKILTAKVYDVAQETELTYAPALSARTGNAVWFKREDTQPVFSFKLRGAYNKMASLTPEELKRGVIAASAGNHAQGVALAAARMQCKAIIAMPTTTPQVKIDAVRERGGEWVQIVLHGESYSDAYLHAAELEKKHKLAFIHPFDDPEVIAGQGTIAMEILRQHPGPIHAIFVAIGGGGLISGIAAYVKAVRPEIKVIGVQTFDSDAMKRSVDAGKRVELKDVGLFSDGTAVKLVGKETFRITRELVDDIILVDTDAICAGLKDVFQDTRSILEPAGALAVAGLKAYAEREKLKHQHLVAIACGANMNFDRLRFVAERAEVGEAREAVFAVTIPEERGSFKRFCEQVGTRSVTEFNYRIADKGVAHIFVGVQIASRAESDKIAANFRRHGFDTLDLSNDELAKQHIRYMVGGHSPLAHDELLYRFEFPERPGALMKFLSSMSPNWNISLFHYRNQGADTSNILVGIQVPKNEKRAFRSFLSTLGYVHWDETDNPVYKLFLS

SEQ ID NO: 31699 - DNA, 969 bp, Ralstonia metallidurans CH34
  CDS (1)..(969)
atgacgaccctgcaactgcccacctacgccgacgtcgaagccgccgccaaacggatcgaaggctttgccaaccgcacgccggtcaacacgtcgcgcacgctcaacgaaatgctcggcgcggaagtcttcttcaagtgcgagaacttccagcgcatgggcgccttcaagttccgaggcgcgttcaacgcgctggcgaagttcaccgccgagcaacgccgtggcggcgtggtcgcgttctcgtccggcaatcacgcgcagggcatcgcgctgtccgcgaagctgctgaacatgcccgccacgatcgtgatgccccacgacgctccggccttgaaggtagcggcgacgcgggggtatggcgcgaccgtggtgagctatgaccgctacaaggaagaccgtgaagccatcggccgcgatctggccgaaaagcacggcatgacgctgatcccgccgtatgaccatccggatgtgctgacgggccagggcaccgccgccaaggaactgttcgaggaagtgggcgcgctcgacgccatcttcaccccgctgggcggcggcggactgctctccggcaccgcattgaccacgcgcgcgctggcgccacagtgccagatctacggcgtggagcccgaggcgggcaacgacggccagcaatcgttccgcagtggttcgatcgtccatatcgacaccccgcagaccattgccgatggcgctcagacgcagcacctgggtcagtacacgttcagcatcatcaagcgtgacgtgactgatatcctgaccgcaacagacgcgcaactggtcgaggccatgcgcttctacgccgaacggatgaagatgattgtcgagccgaccggctgcctgggcctggcggcggtcatgcagatgaaggacgcgctcaagggcaagcgcgtgggcgtagtgatcagcggcggcaacgtcgacctggagcgattctgctcgctgctgtcagcctga

SEQ ID NO: 31700 - protein, 322 aa, Ralstonia metallidurans CH34
MTTLQLPTYADVEAAAKRIEGFANRTPVNTSRTLNEMLGAEVFFKCENFQRMGAFKFRGAFNALAKFTAEQRRGGVVAFSSGNHAQGIALSAKLLNMPATIVMPHDAPALKVAATRGYGATVVSYDRYKEDREAIGRDLAEKHGMTLIPPYDHPDVLTGQGTAAKELFEEVGALDAIFTPLGGGGLLSGTALTTRALAPQCQIYGVEPEAGNDGQQSFRSGSIVHIDTPQTIADGAQTQHLGQYTFSIIKRDVTDILTATDAQLVEAMRFYAERMKMIVEPTGCLGLAAVMQMKDALKGKRVGVVISGGNVDLERFCSLLSA

SEQ ID NO: 31701 - DNA, 966 bp, Burkholderia fungorum LB400
  CDS (1)..(966)
atgcaagcgcttcccgctcccactttcgacgacgtactcgacgccgctgcgcgtcttgaaggcgtcgcccaccgcactcccgtgctgacctcgagcacgtttgacgaacgaacgggcgcgtcggtgttcttcaagtgcgagaattttcagcgcatgggcgccttcaagtttcgcggtgcctataacgcgatctcgcatttcgacgcggagcaacgcaaagccggcgtgctgacgtattcgtcgggtaaccacgcgcaggcaattgcattgtcggcgcggcttgccggcattcgcgcgacgatcatcatgccgcacgacgcaccggccgccaaagtcgcggcaaccaaaggctacggcggcgaagtgatcacctacgaccgctacaccgagaaccgcgaagagatcggccggcgtctcgccggagagcgtggcatgacgctgattccaccatacgatcatccacatgtgatcgccgggcagggcacggcggtgaaagaactgatcgaggaaaccggcccgctcgacatgctgttcgtgtgcctcggcggcggcgggctgatcagcggcagcgcgttgtccgccgcggcgttgagcccggcgtgcacggtgatcggcgtcgagccggaggcgggtaacgacggccagcagtcgctggcgcgcggcgagatcgtgcatatcgacacgccgcgcacgatcgccgacggcgccgcctccacgcatctgggcgactacacgtttgcgatcatccgcaagctggttgcgcggatcgaaacggtcagcgacgggcaactgatcgacacgatgcgctttttcgcgcagcgcatgaagatcgtggtcgagccgacgggttgtctcgccgcggcggcggtgctcaacggcatcgtgccggtgaagggcaagcgtgtcggcgtggtggtcagcggcggcaacgtcgatctggaaaagctcgcgcagtatctcgcctga

SEQ ID NO: 31702 - protein, 321 aa, Burkholderia fungorum LB400
MQALPAPTFDDVLDAAARLEGVAHRTPVLTSSTFDERTGASVFFKCENFQRMGAFKFRGAYNAISHFDAEQRKAGVLTYSSGNHAQAIALSARLAGIRATIIMPHDAPAAKVAATKGYGGEVITYDRYTENREEIGRRLAGERGMTLIPPYDHPHVIAGQGTAVKELIEETGPLDMLFVCLGGGGLISGSALSAAALSPACTVIGVEPEAGNDGQQSLARGEIVHIDTPRTIADGAASTHLGDYTFAIIRKLVARIETVSDGQLIDTMRFFAQRMKIVVEPTGCLAAAAVLNGIVPVKGKRVGVVVSGGNVDLEKLAQYLA

SEQ ID NO: 31703 - DNA, 1035 bp, Burkholderia fungorum LB400
  CDS (1)..(1035)
atgtccgttccttcgctggccgatctatcgttagccgatgtctaccgcgcacgccgccgtatcgaggggcgtgtgcgccatgcgccgctcgtcgaatcgcagagcctgtcggcgctcgcgggcgtgccggtgtttctcaaactcgaaaccgtgcagccgactggcagcttcaaggtgcgcggcgcgacaaacgcgctcggtcatctcgccgaacagggctgccggaaagtcgtgaccgcgtcgacgggcaatcacgggcgcgcggttgcgcatgcggcccgcacgctcggtatcgacgcgacggtctgcatgtcggcgctcgtgccggccaataaggtcgacgcggtgcgcgcgctcggcgcgcacgtgcggattgtcggcaaaagccaggacgaggccgagcacgatgcgttgagactggtacgcgaagaaggcttcgcttatgttccgccgttcgacgatccccatgtgatcgccggtcaggcgacgatcggtctggaaatcgtcgaggcgttgccggatgtagccaacatcgtcgtgccgctatcgggcggcggcctgttcgcgggcgtcgcgttcgccgccagaagcgcgaatcgcgcgatcggcctgaccggcgtgacgatggcgcgcggtgcggcgatgcatgccagtctggtggccggccagccggtgctggtcgaagaagtggcaacgctcgccgattcgctcggcggcggcatcgggctggaaaaccgctacacgtatgcgctcacgcgcgatctgatcgaccagaccgtgctgctcgatgaggcctcgatcgcgcgcggcatcgcgcatgcgtaccggcatgaacggctcgtcgtggaaggcgcggcggcggtgggcattgccgcgttgctcgatggcgtgctgcccgccggacgtatcgggcgcgggccgctcgtgctcatcgtgaccggcgccaacatcgatatggacctgcatcggcggatcgtcgatgcggattccatgcaacccgactcgacgcaatccggtttacatcccatctcatga

SEQ ID NO: 31704 - protein, 344 aa, Burkholderia fungorum LB400
MSVPSLADLSLADVYRARRRIEGRVRHAPLVESQSLSALAGVPVFLKLETVQPTGSFKVRGATNALGHLAEQGCRKVVTASTGNHGRAVAHAARTLGIDATVCMSALVPANKVDAVRALGAHVRIVGKSQDEAEHDALRLVREEGFAYVPPFDDPHVIAGQATIGLEIVEALPDVANIVVPLSGGGLFAGVAFAARSANRAIGLTGVTMARGAAMHASLVAGQPVLVEEVATLADSLGGGIGLENRYTYALTRDLIDQTVLLDEASIARGIAHAYRHERLVVEGAAAVGIAALLDGVLPAGRIGRGPLVLIVTGANIDMDLHRRIVDADSMQPDSTQSGLHPIS

SEQ ID NO: 31705 - DNA, 1512 bp, Magnetococcus sp. MC-1
  CDS (1)..(1512)
atgtccgaacaactgtttcgccacattcttacttcccgcgtctacgaggctgcggtggagacccctttggaacagtcggcttggctttcggcgcagctacgcaaccaagtttttattaaacgcgaggatctacagcctgtcttttcgtttaaattacgcggggcctacaacaaaatggcgcagcttacccctgagcagcgggcccggggcattattgcggcctctgcgggcaaccatgcgcaaggggtggcctttagcgcccgtcagttggggttatctgccaccattgtgatgccctgcaccaccccagagatcaaggtgggggcggtcaaacagtttggtgcccaggtggtgctgcatggggataactactccatcgccgccgaccactgtaaagagctggctcagcacaacggcatgacctttattcacccctttgacgatgagctggtgatcgccggacagggtaccgtggggctggagattatgcgccagagcggtaatcaactggacgccatttttgttccggtcggcggcggggggttgattgcgggcattgccacctatgtaaaaaatctgctaccgcagatccgtattattggcgtagaacccaccgatagcgatgccatggcccgcgccctagaggcgggcaagattgtctctttagaccaagtgggcatctttgccgatggggtggcggtgcgtgaggttggtacacgcaccctggcgctgtgtgaacagtatgtggatgagatggtgcgggtcaatgtggatgagatctgtaccgccatcaagtggacctatcaagccacccgtgccattgtagagcccgcaggggccttagcgctggctggtttacgccgctatgtggcggaaaaaggcataaccggtcaacgcttggtggtcatcaatagcggggccaatatgaactttgagcggctccgttatgtaaccgaacgcaccatggttggggagcaacgcgaggcgctgtttgccatcaccatacctgaacagcccggtgctctacgccacttttgccaagaggtggtgggggaccataatattaccgaatttaactaccgtctatcggggcgcgatgccgcccatatctttgtgggcattgatctgcgtgaaccagccgaacgacaactgctcgcccatcggttacagagtttccactatcaatttgtggatcttaccgaaaacgatctggccaagacccacctgcgtcatatggttggcgggcgttcccatgtggtgcagcatgagcgtcttttgcgttttcgtttccccgaacggcccggtgccttggcccactttcttaccaccatgcaggcggattggaacatctcactgtttcaataccgactacacggcggggagtatggtcgggtgttgattggtctggaggtgccccctgagcaacacgatcaattgcaaagctgcctagataagctgggttttcgctatgtagatgagagtgagaatcctgcctataagctgtttctctag

SEQ ID NO: 31706 - protein, 503 aa, Magnetococcus sp. MC-1
MSEQLFRHILTSRVYEAAVETPLEQSAWLSAQLRNQVFIKREDLQPVFSFKLRGAYNKMAQLTPEQRARGIIAASAGNHAQGVAFSARQLGLSATIVMPCTTPEIKVGAVKQFGAQVVLHGDNYSIAADHCKELAQHNGMTFIHPFDDELVIAGQGTVGLEIMRQSGNQLDAIFVPVGGGGLIAGIATYVKNLLPQIRIIGVEPTDSDAMARALEAGKIVSLDQVGIFADGVAVREVGTRTLALCEQYVDEMVRVNVDEICTAIKWTYQATRAIVEPAGALALAGLRRYVAEKGITGQRLVVINSGANMNFERLRYVTERTMVGEQREALFAITIPEQPGALRHFCQEVVGDHNITEFNYRLSGRDAAHIFVGIDLREPAERQLLAHRLQSFHYQFVDLTENDLAKTHLRHMVGGRSHVVQHERLLRFRFPERPGALAHFLTTMQADWNISLFQYRLHGGEYGRVLIGLEVPPEQHDQLQSCLDKLGFRYVDESENPAYKLFL

SEQ ID NO: 31707 - DNA, 933 bp, Thermobifida fusca
  CDS (1)..(933)
atgacgtcacgcatcactgtgtcccgtcaggtccccacgaccttcgacgtgcacctcgctgtccaacgcaccgctccctatctgcgtcgcaccccgctcctgcgcactcgtctgcggggccgccccctgctgctgaagctggagcatttgcagctcaccggtgcgtttaaactacgcggcgccttgaatgcgctactcaccggggacaggggtgaacgggtggttaccgcctcgggtggcaaccacggcctcggagtggccaccgccgcgcacctgctcggcggtacggccaccgtgtacgtacccgagaccgttcccgcggtcaaggagcggcggttgcgggacgccggtgccgacgtggttcgggccggcaccgagtacgcggcagcggaagccgcagcccgcgcctacgcggacaccgaagggctccgctacatccacgcctacaacgacccggacgtggtcgcaggccaaggcacgctcggccacgagatcgtcgccgacgcacccgactgcgatgcagtcgccgtggccgtaggcggcggcggtctcgccgcaggcgtgagcctgggcatcggcgacgaacggctcaccgtcgcggtagagccgcgcggctgcgccagcctgcacgccgcattcgccgccggcgagcccgtggacaccccggtcgattcagtagcggcctcggccttgggcgcctcccgggtgggcgacatcccgttcgcggtactgcgcgaccgcaacgtgacctccaccctcgtctcggaccccgagatccttgccgcccgcgacctgctgtgggaggaattccggatcgcggtggagcccgccgcggctactcccatggctgcctggctggccgggcacgtccccggcgaactgccgtgcgtggtgatctgcggcgccaacgccgactggcgtcccctggactga

SEQ ID NO: 31708 - protein, 310 aa, Thermobifida fusca
MTSRITVSRQVPTTFDVHLAVQRTAPYLRRTPLLRTRLRGRPLLLKLEHLQLTGAFKLRGALNALLTGDRGERVVTASGGNHGLGVATAAHLLGGTATVYVPETVPAVKERRLRDAGADVVRAGTEYAAAEAAARAYADTEGLRYIHAYNDPDVVAGQGTLGHEIVADAPDCDAVAVAVGGGGLAAGVSLGIGDERLTVAVEPRGCASLHAAFAAGEPVDTPVDSVAASALGASRVGDIPFAVLRDRNVTSTLVSDPEILAARDLLWEEFRIAVEPAAATPMAAWLAGHVPGELPCVVICGANADWRPLD

SEQ ID NO: 31709 - DNA, 1266 bp, Novosphingobium aromaticivorans DSM 12444
  CDS (1)..(1266)
atggaaaatgcagcgctcacgcccgtagtgcagggggccgccgacgacgcggacgccctgctgactctcgccgacgttcgtgcggcggcggagcgcattgccggccaggtggtgcgcaccccgaccctgcacagcaagacgctgagcgcgattaccggcgcgaacatctggatcaagttcgagaacctgcagttcaccgccgcctacaaggagcgaggtgcgctcaatgccctgctgctcctttcgcaggaacagcgcgcgcggggcgtgatcgccgcgtcggcgggaaaccacgcgcaggggctttcctaccacggaacccgcctgggcgttcccgtgaccatcgtcatgccgcgcacgacgccgacggtgaagatcatgcagaccgaggccgtgggcggcaaggtcgtgctcgagggcgagaccttcgacgaggcctatgcccatgcgcgcaagctggagcgcgaactgggactgacgttcgtccacccgttcgacgagcgcaatgtcgcggccggacagggtacggtcgcgctcgagatgctcgaggatgcgcccgagatcgacatgctggccgttcccatcggtggcggtggcctgctttcgggcatgggcacggcggcgcgcgggatcaagccggagatcggcctgatcggcgtgcaggcacagctcttcccgtcgatgttcgcgcggctcaagcacctcgatttgccatgcggcggcgatacgctggccgagggcatcgcggtgaaggagccgggggcgttcacctccgccgtgctgcgcgatctggtcgacgatgtggtgctggtgaacgaagccgcgctggaatcggccgtggcgctgctgctccagatcgagaagaccgtggtcgaaggcgcgggcgccgcggggctggcggcggtgatgcagaaccgggagctgttcgcgggccgcaacgtgggcgtcgtgctgacgggcgcgaacatcgatacgcgcctgctggccaacgtgctgctgcgcgatcttgcacggtcggggcgcctcggccgcctgcgcatcacattgcaggaccgtcctggcgcgctgttcaaggtggtcgaggagttcaaccgtcaccaggtgaacatccttgaagtttggcaccagcgcatcttcacttcgctgccggccaagggcctgaccgccgagatcgagtgcgaggcgcgcgatcgcgagcagatcgaccggctcgtcgccgggctgcgcggcaagggctacgacgtcgagcaggtcgaactggggtag

SEQ ID NO: 31710 - protein, 421 aa, Novosphingobium aromaticivorans DSM 12444
MENAALTPVVQGAADDADALLTLADVRAAAERIAGQVVRTPTLHSKTLSAITGANIWIKFENLQFTAAYKERGALNALLLLSQEQRARGVIAASAGNHAQGLSYHGTRLGVPVTIVMPRTTPTVKIMQTEAVGGKVVLEGETFDEAYAHARKLERELGLTFVHPFDERNVAAGQGTVALEMLEDAPEIDMLAVPIGGGGLLSGMGTAARGIKPEIGLIGVQAQLFPSMFARLKHLDLPCGGDTLAEGIAVKEPGAFTSAVLRDLVDDVVLVNEAALESAVALLLQIEKTVVEGAGAAGLAAVMQNRELFAGRNVGVVLTGANIDTRLLANVLLRDLARSGRLGRLRITLQDRPGALFKVVEEFNRHQVNILEVWHQRIFTSLPAKGLTAEIECEARDREQIDRLVAGLRGKGYDVEQVELG

SEQ ID NO: 31711 - DNA, 1206 bp, Ferroplasma acidarmanus
  CDS (1)..(1206)
atgttaagttatgatagaatagtcagagcaggaaatgagataaaggggaagatacatagaacgccattattccattcaacaacattcagcaatatgttttcatgtgacgtttactttaaaatggagaattttcagaagacggggtctttcaaatccagaggagctatggtaaaattttcaacgttgaccgctgaacagaaaaaaaatggagtaataaccgccagtgcaggaaatcacgcacagggagtggcttttgcggcttcctattatggcgttgatgcaaaaattgtcatgcctgaaacaacaccgcctgccaaggtaaacgctgtccaatcctatggcggcacagttatactaaagggcaatagctacgacgaagcacatgaatatgcggtacaggtttcagtggacgagaaaagggaatttattgaagcttataacgatgaggatgttattgccgggcaggggacaataggccttgaaattttagaagatgtgaaaccggacattgtaatagtgccaataggtggtggagggcttatttcagggatatcatttgcaattaaatcaaaaaacaaggatataaaaataataggggtagagtccgaaaaggcaaatgccatggaattatctataaaggaaggcaaaatagttccatacaccagcaacgatacaattgctgatggaatcgccgtaaaatatccgggaaatataacatttgaactggtaaagaaatatgtggatggagttgttacagtatcggatgagaatattgcatatgcactattcaagctgcttgaaagggaaaaagtgcttgtggagccttccggcgcagctggccttgcagcattatttgaaaataaaattgatgttaagggcaagaaagttgttattgtactttcaggagggaacgtaaacttcctactgctgtcaaacataatatacagggcgcttgaaatggaaaacaagttgcttcgccttgaattcaatctgcctgaccacccgggtataatggaaaaaatagtaaatgccatatcatcttccggagccaatatataccatgctgaggtggataatttaaacaaggatacgcctataggataccagtatctcctattcacaataaacatccttgacaaatcgagaatagatgaattgctcgggagcctcgataaacttggctataaataccggataataggatag

SEQ ID NO: 31712 - protein, 401 aa, Ferroplasma acidarmanus
MLSYDRIVRAGNEIKGKIHRTPLFHSTTFSNMFSCDVYFKMENFQKTGSFKSRGAMVKFSTLTAEQKKNGVITASAGNHAQGVAFAASYYGVDAKIVMPETTPPAKVNAVQSYGGTVILKGNSYDEAHEYAVQVSVDEKREFIEAYNDEDVIAGQGTIGLEILEDVKPDIVIVPIGGGGLISGISFAIKSKNKDIKIIGVESEKANAMELSIKEGKIVPYTSNDTIADGIAVKYPGNITFELVKKYVDGVVTVSDENIAYALFKLLEREKVLVEPSGAAGLAALFENKIDVKGKKVVIVLSGGNVNFLLLSNIIYRALEMENKLLRLEFNLPDHPGIMEKIVNAISSSGANIYHAEVDNLNKDTPIGYQYLLFTINILDKSRIDELLGSLDKLGYKYRIIG

SEQ ID NO: 31713 - DNA, 1254 bp, Cytophaga hutchinsonii
  CDS (1)..(1254)
atgaatagtaaagtgaaggttgaagacattgttgaagcggcaaaccgtttgaaaaatgttgtgacgcatacgccattaaccaaaaatgagcatctttctcaggaatataactgcaacctatggttaaaaagggaagatctgcaattggttcgttcctataaacttcgtggagcatataattttatgtgcagtcaaaaacgcgaagatatagaaaagggtgttgtatgtgccagtgccggaaaccatgctcagggcgttgcctattcctgccaggcgttgaaaattaaaggccggatctatatgccgagcacaacacccaaacaaaaagttacgcaggtaaaattttttggtaaagagtttgttgaagttgttctgaccggcgatacgtttgatgattcgtacaaagaggcaatgaattattgcacagagaataaattattatttgtacatccgttcgatgatcctaaagtaatagccgggcaaggtacagtaggttttgaaatattaaatgatattgttggaaccattgattatatctttgtgccgattggcggcggcgggcttgcagcaggactttgtacctacataaaagaattgagcccgcatacaaaaatcattggggtggagccgttaggtgcgccggcaatgaaacgctcactggaagaagggaaagttgttgtactggaagaaatcgataagtttgtggatggtgctgccgtgaagcgggtaggcgatctcaattttgatatctgttcagaatatctagatgatgtacagttggtaccggaagggaaaacatgcagcacgatcataaagctgtataatgaagaagccattgtagcagaacctgcaggggcattaagcattagtgtgctggattattataaagatgaaataaaagggaagaatgttgtgtgtgtgatcagcggcagtaacaacgatatcgaccgcatgcaggagatcaaggaacggtcgttgttgtatgaagggctgaaacattatttcataatccgctttaagcagcgtacaggagcactcagagagtttctggatgaggttttagggccaaatgatgatattacctattttgaatatacaaagaaaacaaaccgtgaaaatggcccggcaatggttggtattgaggttaaaatgaaagaagattttaatttactcatcgaccgtatgaacgcaaaaaatgtcgactatacgttagtaaattcagattcaaacttatttagttttctgatcatgtaa

SEQ ID NO: 31714 - protein, 417 aa, Cytophaga hutchinsonii
MNSKVKVEDIVEAANRLKNVVTHTPLTKNEHLSQEYNCNLWLKREDLQLVRSYKLRGAYNFMCSQKREDIEKGVVCASAGNHAQGVAYSCQALKIKGRIYMPSTTPKQKVTQVKFFGKEFVEVVLTGDTFDDSYKEAMNYCTENKLLFVHPFDDPKVIAGQGTVGFEILNDIVGTIDYIFVPIGGGGLAAGLCTYIKELSPHTKIIGVEPLGAPAMKRSLEEGKVVVLEEIDKFVDGAAVKRVGDLNFDICSEYLDDVQLVPEGKTCSTIIKLYNEEAIVAEPAGALSISVLDYYKDEIKGKNVVCVISGSNNDIDRMQEIKERSLLYEGLKHYFIIRFKQRTGALREFLDEVLGPNDDITYFEYTKKTNRENGPAMVGIEVKMKEDFNLLIDRMNAKNVDYTLVNSDSNLFSFLIM

SEQ ID NO: 31715 - DNA, 1512 bp, Microbulbifer degradans 2-40
  CDS (1)..(1512)
atgccccagacttaccttaaacgcatattagatgcgcgaatatacgatctagccatagaaaccccactagagtccgtgccgcttatttctattcgcacaggcaacaacgtgttgcttaaacgcgaagacttgcagccggtgttctcttttaaaattcgcggtgcctacaacaagttgcgcctattaagcgaagaggccagaaaggtcggtgtaattgctgcttctgcaggtaaccatgcacaaggtttggctttggctgctaagcatatgggggttgcggccactattgttatgccgcgcaccacgccagctattaaggtagatgcggtgcgccgtcgcggcgccaaagtggtgctaatgggcgacgcctacgacgaagctgcagcccatgctaaaaaactggtggaagagaaaggccttacctatatccacccgttcgatgacccagacgtgatcgcgggccaaggcacagtgggtatggagatattgcgccagcaccccggcgatatagatgtggtgtttgtacctgttggcggcggcggcttatgtgccggtgtagcggcttatatcaagcacgtgcgcccagaaaccaaggtcatagcggtggaggcagaagattctgcctgtttaaaattggcaatggataaaaaacgccgtgcggtgttgcccagtgtgggtatttttgccgagggcgtggctgtggcgcaaataggtaaagaaacctaccgcgtaattaaagagtgcatcgacgaagttataaccgttaacactgacgaaatgtgcgcggcaataaaagatatattcgaagatacccgctctattgccgagcctgcgggcgcgctttctcttgcgggcttaaaaaaatatgttgcgcgtacaggctgtgtagataaaacgctaatcgccattgatagcggcgccaacaccaactttgaccgtttacgctatatctctgaacgcactgagtttggcgaaaaacgcgaagctatattcgccgttaccctgccagaaaagcccggcgcctataaaaaattctgtaaagatttgggcaagcgcaatattaccgagtttaattatcgctacgccgataatcagcaggcacacatttttgtgggcttgcaaataacgcccgataaaaacgaccgtgaagacatcgtcaatacgcttacaaaaggcggttatgatgtagtggatatgaccgataacgaagtggccaagttgcacgttcgctatatggtgggcggccatgcaactgtgccagatgaaattgtgtatcggtttgagttccccgagcgcccaggtgcgctaatggaattcttaactaaaattgccgggcgctggaatatttctatgttccattaccgcaaccacggtgcggcgtttggcagagtgttggtgggcatgcaggtgcctaagggcgagcgcaaagacttaaaagatttgctcgacgaacttaattacacctattgggatgagacccaaaacgaagcctattcatttttcttggggtag

SEQ ID NO: 31716 - protein, 503 aa, Microbulbifer degradans 2-40
MPQTYLKRILDARIYDLAIETPLESVPLISIRTGNNVLLKREDLQPVFSFKIRGAYNKLRLLSEEARKVGVIAASAGNHAQGLALAAKHMGVAATIVMPRTTPAIKVDAVRRRGAKVVLMGDAYDEAAAHAKKLVEEKGLTYIHPFDDPDVIAGQGTVGMEILRQHPGDIDVVFVPVGGGGLCAGVAAYIKHVRPETKVIAVEAEDSACLKLAMDKKRRAVLPSVGIFAEGVAVAQIGKETYRVIKECIDEVITVNTDEMCAAIKDIFEDTRSIAEPAGALSLAGLKKYVARTGCVDKTLIAIDSGANTNFDRLRYISERTEFGEKREAIFAVTLPEKPGAYKKFCKDLGKRNITEFNYRYADNQQAHIFVGLQITPDKNDREDIVNTLTKGGYDVVDMTDNEVAKLHVRYMVGGHATVPDEIVYRFEFPERPGALMEFLTKIAGRWNISMFHYRNHGAAFGRVLVGMQVPKGERKDLKDLLDELNYTYWDETQNEAYSFFLG

SEQ ID NO: 31717 - DNA, 927 bp, Haemophilus influenzae 86-028NP
  CDS (1)..(927)
atgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcagcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaatatgacatttattccaccattcgatcatccattggtaatcgctggacaaggcacgttagcgatggaaatgctacaacaagtggcagatttggattatgtgtttgtacaagtcggtggtggtggcttagctgcgggtgtggcaattttgcttaagcaatttatgccagaaattaaaatcatcggtgtagaatcaaaggattctgcatgcttaaaagccgctctcgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccaggggattccctag

SEQ ID NO: 31718 - protein, 308 aa, Haemophilus influenzae 86-028NP
MKNLLTNPQPSQSDYINAIVKLGSRVYEAAQVTPLQKMGKLSERLHNNIWIKREDRQPVNSFKLRGAYAMISSLSEEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAILLKQFMPEIKIIGVESKDSACLKAALDKGEPTDLTHVGLFADGVAVKRIGDETFRLCQQYLDDMVLVDSDEVCAAMKDLFENVRAVAEPSGALGLAGLKKYAKQNQGIP

SEQ ID NO: 31719 - DNA, 1056 bp, Pediococcus pentosaceus ATCC 25745
  CDS (1)..(1056)
atgttagtagagaaagaacccagaaaccaagttgtagcagcaaccgataatttattaaatctaaaccagattgaagaagcccgcgaggttattaaaaaatatgcgcgtcggacaccattagttaagtccatgtttttgagcaacaacgttgtccatggggatgtctatttaaaattagagaatatgcaattaaccggttcttttaaatttagaggggcgaataacaaaattaaccacttgaatgaagaagaaaaacaacgaggcgtaattacagcttcagctggaaatcatgcacaaggagtagctttgaccggtaagttgctgggaattaaaactacggtagtgatgccggatgaggcgccccaaatgaagcgcgatgcaacccgaggatatggagcggaagtagatattcatggcgcaacttttgatgacgctcacgaatggatgcgagaaagagctgaaaaagaaggaaaaaccattgtagatccgtttaatgatgctttaatttgtgctggacaaggaactatcggtttggaaattctagaagatttagtggatgtagaaaccgttgtagttccagtcgggggcggtggtctaatttcaggaatcgccacggctttaaaatcaatcaatccttcaattcatatcgtcggagttcaatcggaaaatgtgcatggcatgaaggcgtctgttgatgcaggcaaaattgttaaacatcaccaagattttacgctagcagacggaactgatgtagcaaccccaggtaatattacatttgggattgtttccaaactagtggatgagattgtcttggttagtgaagaagaaatttcaaaagcgatgaaagatttaatgcagagaaccaaggtggttgctgaaggagcaggagcattgccaacggccgctttagaagcaggtaagattgatccaaaatggactaaagataagaaggttgtagctttagtttccggtggaaatgtggatctacagcgagtttcacagattattgatcacttctttactcctgttgatacgcataaaggtgccattgggtaa

SEQ ID NO: 31720 - protein, 351 aa, Pediococcus pentosaceus ATCC 25745
MLVEKEPRNQVVAATDNLLNLNQIEEAREVIKKYARRTPLVKSMFLSNNVVHGDVYLKLENMQLTGSFKFRGANNKINHLNEEEKQRGVITASAGNHAQGVALTGKLLGIKTTVVMPDEAPQMKRDATRGYGAEVDIHGATFDDAHEWMRERAEKEGKTIVDPFNDALICAGQGTIGLEILEDLVDVETVVVPVGGGGLISGIATALKSINPSIHIVGVQSENVHGMKASVDAGKIVKHHQDFTLADGTDVATPGNITFGIVSKLVDEIVLVSEEEISKAMKDLMQRTKVVAEGAGALPTAALEAGKIDPKWTKDKKVVALVSGGNVDLQRVSQIIDHFFTPVDTHKGAIG

SEQ ID NO: 31721 - DNA, 1245 bp, Moorella thermoacetica ATCC 39073
  CDS (1)..(1245)
atgagcaatataacccaactacgctgtataaactgcagccgtacctatcaaccccggcccggcttttatacctgccccatctgcgggtcgacggacggcatcctggatgtcgaatacgattacgattatataaacaaatccatctccaggcagagcctggccagcaaccgggaacattccctctggcgttaccgtcccttcttgccggtggcccaggagggaccgctgccccctctgcgggtgggttggagccccctgtaccgggcccggcgcctgggggacgaactggggttgaaagagctatatatcaaggacgatgggattaatcccacggggtctttaaaagacaggccttcggccgtggcggtggcccgagccctggccgaaggagctaaggtggtcgcctgctcttcaaccggcaacgctgcttcctccctggcgggggcagcagcttccgtgggcctgaaggcggtaatctttgtaccgggacgggcaccgcaagggaaggtagcccaactcttgattttcggggccaccgttatcagtgttcagggatcctatgaggatgccttcaagctttcggcggcggccatagccgagcacggctggtacaaccgcaatgccgccattaacccttatctggtagaaggcaaaaagacagtttgcctggaagtggcggaacagctaaactgggaggtacccgactgggtggtcctttccgtgggcgacggttgtaccatggccggtgcctggaaggcctgggtggacctgaaaaaggccggttggattgacaaactgccgcggatgctgggggtccaggccgagggttgctgccccattaccagggccttccgggagggaaccagggtaaaacccatgcccgaaaataccctggcggacagcatcgccgtcggcgtgccccgcaatccagaaaaggctctgcgggccgtaagggattccgggggtacgatgatcaacgtcagcgatgaagaaatccttgcagccatgcgcaccctggggcggaccagcggcatcttcggcgaacctgccggtgcagccgggaccgccggccttatcaaagccgtccaggaaggaataattaaatccggagataaggtggtcgtcctggtaacaggcaacggcctcaaggatgtggccaatgccatcaaagcggccggagagcctatccgggtggagccctccctggaggccttaaaggaagccctggctcggtacgggaaatga

SEQ ID NO: 31722 - protein, 414 aa, Moorella thermoacetica ATCC 39073
MSNITQLRCINCSRTYQPRPGFYTCPICGSTDGILDVEYDYDYINKSISRQSLASNREHSLWRYRPFLPVAQEGPLPPLRVGWSPLYRARRLGDELGLKELYIKDDGINPTGSLKDRPSAVAVARALAEGAKVVACSSTGNAASSLAGAAASVGLKAVIFVPGRAPQGKVAQLLIFGATVISVQGSYEDAFKLSAAAIAEHGWYNRNAAINPYLVEGKKTVCLEVAEQLNWEVPDWVVLSVGDGCTMAGAWKAWVDLKKAGWIDKLPRMLGVQAEGCCPITRAFREGTRVKPMPENTLADSIAVGVPRNPEKALRAVRDSGGTMINVSDEEILAAMRTLGRTSGIFGEPAGAAGTAGLIKAVQEGIIKSGDKVVVLVTGNGLKDVANAIKAAGEPIRVEPSLEALKEALARYGK

SEQ ID NO: 31723 - DNA, 1518 bp, Thiobacillus denitrificans ATCC 25259
  CDS (1)..(1518)
atgagccacccagacgactacctcgaacgcattctcacctcgcgcgtctatgacgtcgcgatcgaatcgccgctcgaggtcgcgcacaatctttcgcgtcgcctcgacaaccagatcctgctcaagcgcgaggacctgcagccggtgttctcgttcaagtgccgcggcgcgtacaacaagatggcgaagttgaccgccgcgcaactggcgcgcggcgtcgtcgcggcgtccgccggcaaccacgcgcagggcgtcgctttggcggccgaaaagctcggcgcgacggccaccatcgtcatgccggcgacgaccccgaggatcaaggtcgacgcggtcgcggcgcgcggcgcccgcgtgatcctgcacggcgacaactacgacgaagcctacgagcatgcgatgcagctggcgaaggaggcgaaggcgaccttcgtccatccctacgacgatcccgacgtgatcgcgggccagggcacggtcgcgatggagttgctgcgccagcacccgggcccgatccactccgtctacatcccggtcgggggcggcggtctgatcgcgggtatggccgcctacatcaagcggctgcggccgcagatcaagatcgtcggcgtcgagcccgaggacgccgacgcgatggcgcgttcgctgtgcaagaacacgcgcgtgacgctgccgcgcgtcggcatttttgccgacggcgtcgcggtaaaaaaggtcggcaaggaaaccttccggctggcgcagctctatgtcgacgaaatcatccgcgtgaacaacgacgcgatctgcgcagcgatcaaggacgtcttcgaggacacccgttcgatcctcgaacccgcgggcgcgctttcgatcgccggcatgaaagcggcgatcgccggtgacaggctgaaggggaagacgcttgccgccgtggcgtctggcgccaacatgaacttcgaccgcctgcgccatattgcggagcgcgcggaactgggcgagaagcgcgaagcgattctcgcggtgaccattcccgaaacgccgggcagcttcaagaccttctgcggcctgctcggcgcgcgcaacatcaccgaattcaactatcgctacgccgatccgcgtgtggcgcgggtgttcgtcggactgtccgtacccggtgagggcgagagcaagcgcgtcgtcgaactgctcgggcggcacggcctcgaagcgatcgatctgagcgacaacgaaatggccaagctccacatccgccacctggtcggcgggcgcgcgcccgacgcggtgaacgaggtgctgtaccgcttcgagtttcccgagcgcccgggcgcgctgatgcagttcctgcaaagcatgagccgcggctggaacatcagcctctttcattatcgcaaccacggcaccgactacgggcgcgtgctggtcggcatccaggtgccggacaaggaaaaaccggtctttcagaaattcctcgaaggcctcggctaccgctactgggacgagtcgcgcaacccggcgtacacgctcttcctgggctga

SEQ ID NO: 31724 - protein, 505 aa, Thiobacillus denitrificans ATCC 25259
MSHPDDYLERILTSRVYDVAIESPLEVAHNLSRRLDNQILLKREDLQPVFSFKCRGAYNKMAKLTAAQLARGVVAASAGNHAQGVALAAEKLGATATIVMPATTPRIKVDAVAARGARVILHGDNYDEAYEHAMQLAKEAKATFVHPYDDPDVIAGQGTVAMELLRQHPGPIHSVYIPVGGGGLIAGMAAYIKRLRPQIKIVGVEPEDADAMARSLCKNTRVTLPRVGIFADGVAVKKVGKETFRLAQLYVDEIIRVNNDAICAAIKDVFEDTRSILEPAGALSIAGMKAAIAGDRLKGKTLAAVASGANMNFDRLRHIAERAELGEKREAILAVTIPETPGSFKTFCGLLGARNITEFNYRYADPRVARVFVGLSVPGEGESKRVVELLGRHGLEAIDLSDNEMAKLHIRHLVGGRAPDAVNEVLYRFEFPERPGALMQFLQSMSRGWNISLFHYRNHGTDYGRVLVGIQVPDKEKPVFQKFLEGLGYRYWDESRNPAYTLFLG

SEQ ID NO: 31725 - DNA, 903 bp, Silicibacter sp. TM1040
  CDS (1)..(903)
atggtgaaaacgccaaccgtctcggttcagagctttggcctcgcatttccggtcgaattgaagctcgagcatctccagcatgcaggcagttttaaggcgcgcggtgcgtttaacacgctcctgtcgacccctgtccccgaagcaggtctggtggcggcctccggtggcaatcatggcgcggcggtggcctttgccgcccgcgctttgggtcacaacgccaagatctatgtccccgagattgcaggccagaccaagattgacctgatccgctcaaccggagcggagcttgaggtcgtgcccggcgcctatgccaatgcactcgaagcggcacaggattgggagctacaaacgggtgccatgcagatccatgcctatgacgcacccgcaacggtcgctggacagggcactttgtttgctgaatgggaggaacaggggctcgaggctgacaccattttgatcgcagtgggcggcggtggtctcatcggcggagcgctgggctggtttgagggccggcgcaaggtggtcgcagtagaacctgcaacctcttgcgcgctgaaaaccgcactgatgaatggcaaacctaccaatgttgacgttggcggcatcgctgccaatgccttgggggcgcgccgcattggagacatctgttttgaccttgcgcataacgcgcgcacgccaagcgtgattgtcccagatgctgccatcgaggccgcacaacacgcgctctggcgcgatcatcgcctcctggtggagcctgcaggggcaactgcgcttgcggctttgatgtgcggggcctatctgcctgcgcgtgatgaaaaggtttcggtgctcttgtgtggtggcaacattgacccagaaccgctgacggatcccgccacacgacttgatgtctcgttcaactaa

SEQ ID NO: 31726 - protein, 300 aa, Silicibacter sp. TM1040
MVKTPTVSVQSFGLAFPVELKLEHLQHAGSFKARGAFNTLLSTPVPEAGLVAASGGNHGAAVAFAARALGHNAKIYVPEIAGQTKIDLIRSTGAELEVVPGAYANALEAAQDWELQTGAMQIHAYDAPATVAGQGTLFAEWEEQGLEADTILIAVGGGGLIGGALGWFEGRRKVVAVEPATSCALKTALMNGKPTNVDVGGIAANALGARRIGDICFDLAHNARTPSVIVPDAAIEAAQHALWRDHRLLVEPAGATALAALMCGAYLPARDEKVSVLLCGGNIDPEPLTDPATRLDVSFN

SEQ ID NO: 31727 - DNA, 966 bp, Silicibacter sp. TM1040
  CDS (1)..(966)
atgaaggacaccgcaatgtatatcccaacctacgaggacatgctggcggcgcatcaacgtatcgcgccacacatccaccgcaccccggtgcgccagtccgcctacctcaacgaactgaccggcgcgcagctgtttttcaaatgcgaaaactttcaggagccgggggccttcaaggtgcgtggcgccaccaatgcagtctttggtctggacgcagcacaggcggccaagggcgtggcgacgcattccagcggcaaccatgcctcctgcctgtcctatgcggcgatgctgcgcggcattccctgcaacgtggtgatgccgcgcaccgcgccgcaggccaaaaaagacaccgtgcgccgctatggcgggaagatcaccgaatgtgagccctcgaccacctcgcgcgaggagacatttgcccgcgtacaggccgaaaccggtggcgattttgtgcatccctacaacgatcctcgggtgatcgctggccaaggcacctgcgccaaggagtttgtcgagcagaccgacgggcttgattgtgtgctcgcgccgattggcggcggcggcatgatttcgggcacctgtctgacgctgtcgacgctggcacccgaaacacggatcatcgccgccgagcccgagcaggctgatgacgcctaccgcagcttcaaggcgggctacatcattgccgatgatgcgcccaggaccatcgccgacgggctgctggtgccgctcaaggatctgacctggcattttgtgtcgaaccatgtgtccgacattctgaccgcatctgaccctgagatcatcgacgcgatgaagctcatctggaagcacctgcgcgtggtgatggagccctcctctgcggtgccgctcgccaccatcctgaaaaaccccgagacctttcgcggcaaacgcgttggcatcgttttgaccggtggcaatgtcgatctggatcgtctgccctggacgatttga

SEQ ID NO: 31728 - protein, 321 aa, Silicibacter sp. TM1040
MKDTAMYIPTYEDMLAAHQRIAPHIHRTPVRQSAYLNELTGAQLFFKCENFQEPGAFKVRGATNAVFGLDAAQAAKGVATHSSGNHASCLSYAAMLRGIPCNVVMPRTAPQAKKDTVRRYGGKITECEPSTTSREETFARVQAETGGDFVHPYNDPRVIAGQGTCAKEFVEQTDGLDCVLAPIGGGGMISGTCLTLSTLAPETRIIAAEPEQADDAYRSFKAGYIIADDAPRTIADGLLVPLKDLTWHFVSNHVSDILTASDPEIIDAMKLIWKHLRVVMEPSSAVPLATILKNPETFRGKRVGIVLTGGNVDLDRLPWTI

SEQ ID NO: 31729 - DNA, 1284 bp, Silicibacter sp. TM1040
  CDS (1)..(1284)
atgcgtgaaacgctgcgccctcttgccttgggcgtggctttgggtcacgaaatccatatgaccaacttcagaacccaggccaaagcggccgaggcggcgatgcgcgatgtcttcccgcccacgccgctgcaacgcaacgaactcctgtcgcagcgctttggtgcggagatttacctcaaacgcgaggatctcagcccggtgcgctcctacaagattcgcggcgcgctcaacgcgatgcgaaagcagaccagcaaggatctgtttgtctgtgcttcggcgggaaatcacgcgcagggcatggcttacatgtgtcggcaaatggacaaacggggtgtgatctttatgccggtgaccacacctcagcagaagatccagaagacccgcatgtttggcggtgacaacgtcgaggtgcatctgatcggggattacttcgacgatacattgtccgccgcgcaggcgtggtgcgcagaaaaaggagggtatttcctctctccttttgacgacgcggatgtcatcgaaggtcaggcatcaatcgcagtggaaatcgaggcgcaactcggcaaggcgccggatcatatcgttctaccggtgggcggcgggggtatgtcctctggcgtggttcggtattttggcgaggatgtgcatgcgcttcttgtggagcctgagggcggcgcctgcctgaaggcggcgcttgaggcaggtcatcccacaccgctcaaccgggtggatacctttgtggacggcgccgccgttggcaaaattggcgagcggccttttgatattttgcgcagcgtgccgttgccggatgtcctgactgtgtcagaggaccggatctgcaccaccatcctcgagatgctcaatgtcgaaggtatcgttctggaacctgcaggcgcgctcgccgtcgaggcgctgggcgacctgcgcacatggattaagggtaagaccgtggtttgtctgacttccggcgggaactttgatttcgagcgactgccagaggtcaaggaacgggcgcagcgctattccggggtgaagaaatacttcctgctgcgcctgccgcaacgtcccggcgcgctcaaggaattcctgaacattcttgggccggatgatgacatcgcacgttttgaatacatgaagaagtctgcgcgcaacttcggctcggtcctgatcgggatcgagaccaagcgcccagagaacttcgcgccgctgtttgcgcaactggatgcggcgggtttcacctacaccgacatcacaaatgacgagacactggcgcagttcgtgatctga

SEQ ID NO: 31730 - protein, 427 aa, Silicibacter sp. TM1040
MRETLRPLALGVALGHEIHMTNFRTQAKAAEAAMRDVFPPTPLQRNELLSQRFGAEIYLKREDLSPVRSYKIRGALNAMRKQTSKDLFVCASAGNHAQGMAYMCRQMDKRGVIFMPVTTPQQKIQKTRMFGGDNVEVHLIGDYFDDTLSAAQAWCAEKGGYFLSPFDDADVIEGQASIAVEIEAQLGKAPDHIVLPVGGGGMSSGVVRYFGEDVHALLVEPEGGACLKAALEAGHPTPLNRVDTFVDGAAVGKIGERPFDILRSVPLPDVLTVSEDRICTTILEMLNVEGIVLEPAGALAVEALGDLRTWIKGKTVVCLTSGGNFDFERLPEVKERAQRYSGVKKYFLLRLPQRPGALKEFLNILGPDDDIARFEYMKKSARNFGSVLIGIETKRPENFAPLFAQLDAAGFTYTDITNDETLAQFVI

SEQ ID NO: 31731 - DNA, 1002 bp, Rickettsia akari str. Hartford
  CDS (1)..(1002)
atgactttattactacaatcttctcaaaatgtagctactgcacatactagaataaaacaatatctacatttaactccaatcgttcactctgaaagcttaaatgagatgctcggtcatgagattttttttaaggttgaatcattacaaaaaaccggtgcattcaaagttagaggagtattaaatcatttattagaattaaaagagcaaggcaaattacctgataaaatagtctgttatagtacgggtaaccatggggttggtcttgcttatgcaagtaaattattcggtcttaaaacaaggatttatttaccgttaaatacttcaaaagtaaaacagcaagcagctctttattacggcggtgaagttatatatacatatactcgacaagaagcagaagaaaaagcaaaagaagatgaaaagcaaggattttactatatacatccttccgatagtgattctacaatagcaggagcaggcactttatgctatgaagcattacagcagctaggctttagtcctgatgctatttttgcctcttgcggcggcggcggtttaatttccggctcataccttgccaaggaattaatatcaccgataagcttgttaataggttcagaaccgcttactgctaatgatgcttatttatcggttaaaaataataagatatataaatttgataaggcaccgactaccatcgcagacggtcttaaaaccttaagtgtatcagcccgtacatttgaatatctgaaaaaacttgatcatttttatttagcagaagaatatgaaatatattactggacggcgtggcttactaatttacttaaagttatatgcgagccgtcaagtagtataaatatggtgtcagtggtgaattggttaaaaatacaatccaaacctcaaaaattactggtactaatctcaggcggtaatatagaccctattctttataacgaactatggaaagaggagtatttaaccgttccaccaagtattactaactaa

SEQ ID NO: 31732 - protein, 333 aa, Rickettsia akari str. Hartford
MTLLLQSSQNVATAHTRIKQYLHLTPIVHSESLNEMLGHEIFFKVESLQKTGAFKVRGVLNHLLELKEQGKLPDKIVCYSTGNHGVGLAYASKLFGLKTRIYLPLNTSKVKQQAALYYGGEVIYTYTRQEAEEKAKEDEKQGFYYIHPSDSDSTIAGAGTLCYEALQQLGFSPDAIFASCGGGGLISGSYLAKELISPISLLIGSEPLTANDAYLSVKNNKIYKFDKAPTTIADGLKTLSVSARTFEYLKKLDHFYLAEEYEIYYWTAWLTNLLKVICEPSSSINMVSVVNWLKIQSKPQKLLVLISGGNIDPILYNELWKEEYLTVPPSITN

SEQ ID NO: 31733 - DNA, 1236 bp, Chloroflexus aurantiacus
  CDS (1)..(1236)
atgagccgattcgcaattgaactggccgatattcagtctgcacggcgggcgttgcgggatattatcctacccacgccagtattgccggcaacccgcctgagtgctgaactgggtgggtcaattttttacaaggctgaaaatacccagcagagtggttcgttcaaaattcgtggtgcttacaacacgatcattcatctgtcacctgaagagaaacaacgcggcgtgattgcaccgtctgccgggaatcacgctcagggtgtcgcgcaggcagcccagttattgggggtaaaagcaacaattgtgatgcctgagcgcgctccattgaccaaagtggtggcaacccgccggttgggcgccgaggtcattctgcacggcgccaccttcgatgatgcgatggcctacgcacacgctctcaaagaagaacgtggcttaacctacgtccatgccttcgatcatccacgggtgattgcaggtcagggaacgattggcctggaactggttgaagccctgcccgatttaaaccaactggtcgtaccaatcggcggtggtggcctgatcagcgggattgccctggccgtgaagacattgttgccgcacgtgcgtatcatcggtgtgcaggctgccggctgtgcgccggtgccggcctcgctcgccgccggtcatccggtgacggcaccgactgcgcatacgattgcagatggtattgccgtgaagcgtcccggcgaactcaccctgccgatgatccaggccctggttgatgacgttgtcaccgttgatgacgaagagattgtgatggcaatcgcgcacgtgttgcaatacagtcgtctggtggtcgagggagccggcgccgcaggtgttgctgccctgctcagtggtaaggtgccggtacaaccacaccaggtgacggcgacgatcctttgcggtgggaatatcgatgcgaatctgctgatgcgggtgattgagtatgccctggttcgccagggacgctacctcttgctccgcaccagcgtcgatgatcgtccgggcggcctggccggcctggtcaatcacgttgcctcgaccggtgccagcgtcatggatctcttccatcgccgtgggatgtggcgagtgccaatcgaccgtgccggcgttgaactcatcctcgaagtccgtgatgaagaacacgctcagatggtcatcaattctctcgaacaggccggctaccattgcgagcgcgaaccgaactggccgatataa

SEQ ID NO: 31734 - protein, 411 aa, Chloroflexus aurantiacus
MSRFAIELADIQSARRALRDIILPTPVLPATRLSAELGGSIFYKAENTQQSGSFKIRGAYNTIIHLSPEEKQRGVIAPSAGNHAQGVAQAAQLLGVKATIVMPERAPLTKVVATRRLGAEVILHGATFDDAMAYAHALKEERGLTYVHAFDHPRVIAGQGTIGLELVEALPDLNQLVVPIGGGGLISGIALAVKTLLPHVRIIGVQAAGCAPVPASLAAGHPVTAPTAHTIADGIAVKRPGELTLPMIQALVDDVVTVDDEEIVMAIAHVLQYSRLVVEGAGAAGVAALLSGKVPVQPHQVTATILCGGNIDANLLMRVIEYALVRQGRYLLLRTSVDDRPGGLAGLVNHVASTGASVMDLFHRRGMWRVPIDRAGVELILEVRDEEHAQMVINSLEQAGYHCEREPNWPI

SEQ ID NO: 31735 - DNA, 993 bp, Chloroflexus aurantiacus
  CDS (1)..(993)
atgtctaccgagaaaaccattacccctgccgacatcctggctgctcgccgtcgcatcagcggtatcgttcaaccaactccgcttgaggtgagtcgccccttgagcgccctgaccggtgccgaggtctggttgaagctggaactggcacaggtgaccggcagttttaagctgcgtggtgcagccaatgctctgcgccagttaccacctgccacgcatgtcgtggcctgctcggcgggcaatcacgcgctcggtgttgcccataccgccgcgttgaccggtacgccggccaccctggtggtgccgacaaccgcctcgccggcgaaggtcaccgcattgcgacgctatccggttgaggtgatattgcacggtgccggctacgacgaggctgaaaccgaagcgctccggctggcagcccaccacggctggcattttgtgtcaccctacaacgacccggcagtgattgccgggcagggaacgctggcaattgaggtctgggacgcattgcccgacgtcgatatggtggtagtcgcggtcggtggcggtgggttagccagcggcgttggtatctgggccagagcgatgaacccgcgcgtccgcatcattggcgtacaggcagccgcttccgcggcaatggcggcggcgttgcgggccgggcgggtcgttccggcacctgatgaaccaacgctggccgacggtctggctggaggtatcgccagcgataccatcacgctcccgatcctgcaacaggttttagacgagatgatcctggtcgaagaggcagctattgcccgcgctatgcgctggttaatcgacgaacaccatctgattgtagaagggagtgctgcggtgacggtggcagccctgctcgaaggtcagatcacccatcttgtcggcaaacggatcgtggcactgctctgcgggcgtaatgttgccatttccaccttgcaccacattctcgcagttccgcccaaagacggagcatcatcccattga

SEQ ID NO: 31736 - protein, 330 aa, Chloroflexus aurantiacus
MSTEKTITPADILAARRRISGIVQPTPLEVSRPLSALTGAEVWLKLELAQVTGSFKLRGAANALRQLPPATHVVACSAGNHALGVAHTAALTGTPATLVVPTTASPAKVTALRRYPVEVILHGAGYDEAETEALRLAAHHGWHFVSPYNDPAVIAGQGTLAIEVWDALPDVDMVVVAVGGGGLASGVGIWARAMNPRVRIIGVQAAASAAMAAALRAGRVVPAPDEPTLADGLAGGIASDTITLPILQQVLDEMILVEEAAIARAMRWLIDEHHLIVEGSAAVTVAALLEGQITHLVGKRIVALLCGRNVAISTLHHILAVPPKDGASSH

SEQ ID NO: 31737 - DNA, 1518 bp, Chloroflexus aurantiacus
  CDS (1)..(1518)
atgcccaaccctgattttacctacgttcaacgcatcctgaccagtcgggtctatgatgttgtcaaagagaccccattgcaacatgcgcctcttctcagcgcccgcctgggagcacagatatttttcaaacgtgaggatctgttgcccatcttctcttttaagctccgtggtgcctataaccgcatggctcatctcagtcctgccgagaaagaacgcggcgtcatcacagcctctgccggcaatcacgcccagggagtcgccttttctggccagcagctcggcgtgcgcacgctgattgtcatgccggcaaccaccccagagatcaaggtggcagcctgtcggcgtcggaatgcagaagttgtcctgtacggcgacagctatagtgacgctgaagcgcacgcctaccgcttacagcaagaattgggcttaaccttcatccatccctacgacgatccgctggtgattgccggtcagggtacgattgggctggagatttcccaacagatgcgcgccgagcgataccgtgtcttcgtgccggtaggtggcggcggtctgattgccggcatcgcgatcttcttgaagagcatcaatcccaatattgagatcattgccgtcgagccagatgactctgatgcgatgtaccagagcgtccgggccggctatcgggtcacccttgatcaggtcggaatctttgttgatggcgtggcagttcggcgggttggcgaacacacctttgcgattgttcagcgctacgtcgatgattttgtgcgggtgacaaccgacgaggtctgtgcggcgatcaaagatgtctttgaggacacccgggccattatggagccagccggcgcgctggccgtcgccgggttaaagcgctatatcgccgaacacggggccgatctaccggcagtagccttaacgtgtggcgctaacatgaactttgaccgtctgcgccacgttgccgaacgggccgaaattggcgaacggcgtgaggcgttgtttgctgtgaccatccctgaacgacccggctcattcaagcaattttgtcgcgtgatcggaccacacaatatcaccgaattcaactaccgctatgcaccgcgccccgaagccaatgtctttgtgggtgtacaactgaccaatgccaatcagcgccacgagctggccgaacgtatgcgcaacgccggttatacggtgcttgacctgaccaacgacgagctggcaatcattcatctacgccacatggttggtggacgagcacccgaagcaaccgacgaacggctcttcaccttcgagttcccggagcgaccgggagcgctcttgcaatttctcgagtcgctcgatgcctcgtggaacatcagcctcttccactaccgcaaccatggcagcgcccatgggcgggtactggccggtattcaggtgcccgatgccgatctcgaccgtttctacgcctcactggctcgcctgggatacccgtatcaggagcagagtgataatccggcgtaccacctgtttttgaaatga

SEQ ID NO: 31738 - protein, 505 aa, Chloroflexus aurantiacus
MPNPDFTYVQRILTSRVYDVVKETPLQHAPLLSARLGAQIFFKREDLLPIFSFKLRGAYNRMAHLSPAEKERGVITASAGNHAQGVAFSGQQLGVRTLIVMPATTPEIKVAACRRRNAEVVLYGDSYSDAEAHAYRLQQELGLTFIHPYDDPLVIAGQGTIGLEISQQMRAERYRVFVPVGGGGLIAGIAIFLKSINPNIEIIAVEPDDSDAMYQSVRAGYRVTLDQVGIFVDGVAVRRVGEHTFAIVQRYVDDFVRVTTDEVCAAIKDVFEDTRAIMEPAGALAVAGLKRYIAEHGADLPAVALTCGANMNFDRLRHVAERAEIGERREALFAVTIPERPGSFKQFCRVIGPHNITEFNYRYAPRPEANVFVGVQLTNANQRHELAERMRNAGYTVLDLTNDELAIIHLRHMVGGRAPEATDERLFTFEFPERPGALLQFLESLDASWNISLFHYRNHGSAHGRVLAGIQVPDADLDRFYASLARLGYPYQEQSDNPAYHLFLK

SEQ ID NO: 31739 - DNA, 975 bp, Polaromonas sp. JS666
  CDS (1)..(975)
atgctgcaacttcccgtttacgacgacgtcctcgccgcagccgcgcggcttgagggccacgcgcaccgcacgccggtactgacctccgccacggccgatgcccgctggggttcccagtttttcttcaagtgcgaaaacttccagcgcatgggggcgtttaagttccgtggagcgttcaatgcgctgtcaaagttcgacgcgggccagcgccgggccggggcgatcgcgttttcgtcgggcaaccatgcacaggcggtggcgctgtcggcgcggctgctcggcatgcccgcgttgatcgtgatgccgcaggacgcaccggctgccaagctggccgcgacgcgtggctacggcgccgaggtggtgctgtacgaccgcttcagcgaagaccgcgaggcgctcacgcagcggctggcggccgagcggggtatgaccctgattccgccctatgaccatcccgacgtgattgccggccagggcacggccgccaaggaactgcttgaagagaccggtccgctcgaccgcctgtatgtctgcctgggcggtggcgggctgaccagcggctcggcgctggccgcgcgggccctggcgccgcaatgcaaggtgtatggcgtggagcccgaagccggcaacgatggccagcagtcgctgcgcgcgggccggattgttcatatcgaaacgcccaagaccattgccgacggtgcgcaaacccagcatctgggtcagtacaccttcggcatcattcgacgcgatgttgatgacatcctcacggtgagcgacgcgcagctggtcgaggccatgcgcttttttgccgagcgcatgaagatggtggttgagcctaccggttgcctggcgtttgccggggcctgcgcggcgcttgaagcggacgcggccctcaagggcaggcgtgttggcgtcatcgtgagcggcggcaatgtcgacctggcgcgctacgcggagctgctggctgcacgctga

SEQ ID NO: 31740 - protein, 324 aa, Polaromonas sp. JS666
MLQLPVYDDVLAAAARLEGHAHRTPVLTSATADARWGSQFFFKCENFQRMGAFKFRGAFNALSKFDAGQRRAGAIAFSSGNHAQAVALSARLLGMPALIVMPQDAPAAKLAATRGYGAEVVLYDRFSEDREALTQRLAAERGMTLIPPYDHPDVIAGQGTAAKELLEETGPLDRLYVCLGGGGLTSGSALAARALAPQCKVYGVEPEAGNDGQQSLRAGRIVHIETPKTIADGAQTQHLGQYTFGIIRRDVDDILTVSDAQLVEAMRFFAERMKMVVEPTGCLAFAGACAALEADAALKGRRVGVIVSGGNVDLARYAELLAAR

SEQ ID NO: 31741 - DNA, 1647 bp, Polaromonas sp. JS666
  CDS (1)..(1647)
atgatgttggactgcgagaaaaacatgccaacccacaccccccctgctgcctacccctcccctcaagcggccaaaaccgcacgcaaagtgtctgcgcaaggcctcacgcccgcggattacctgaagaaaatcctcaccgcgcgcgtctacgacgtcgcgctggaatcggccctggagcccgccaaaaacctgggccgccggctgaacaacaccgtgctgctcaagcgtgaagaccagcagcccgtcttcagcttcaagctgcgcggcgcctataacaagatggcgcacctcagcagcgcccagctcaagaaaggcgtgatttgcgcctcggccggcaaccatgcccagggcgtggccctgagcgcgcaaaaactcggcacccgcgccgtggtggtgatgccgacgaccacgccacaggtcaagatcgatgcggtcaagggctggggcgcagaagtggtactgcacggcgacagctactcggatgcctacgcccacgccgtgctgctggaaaaaaagcgtggattgacctttgtacatcctttcgacgacccggacgtgattgccggccagggcacgattgcgatggaaatcctgatgcagctgcaaagcctggggtcgcgccggctggacgccgtgtttgtcgccattggcggcggcggcctgattgccggggtggccaactacatcaaggcggtgcgacccgagatcaaagtcatcggcgtgcagatgaacgactccgacgcgatgatgcagtcggtgaccgcgaaaaagcgcgtcaccctgaatgacgtgggcctgttttcagacggcacggccgtcaagctggtgggcgaggaaacctttcgcatcagccgcgaactggtcgacgaattcatgaccgtggacaccgatgcggtgtgcgccgccatcaaggacgtgtttgtggacacgcgcagcatcgtggagcctgccggcgcgctggccgtggccgccatcaagcagtacgtggccacgcacaagaccaaaggggaaacctacgcagccattttgtgcggcgccaacatgaacttcgaccgcctgcgctttgtggccgagcgggctgaagtgggcgaggaacgcgaggcgctgtttgccgtgacgattcccgaagagcgcggcagcttccggcacttttgcgaactgattggcgagttgcccggcggcccgcgcagcgtgaccgaattcaactaccgcatcagcgacgacgagaaagcccatgtctttgtgggcctgaccacctcggccaagggcgagagcagcaagatcgcggccaacttctcccgccacggcttcaaggcgctcgacctcacgcatgacgagctcgccaaggaacatatccgccacatggtgggcgggcacagcgcactgtccaaggacgaacgcctgctgcgcttcatctttcccgagcggcccggcgcgctgatgaaatttttgtccagcatgcagccgggatggaacatcagcctctttcactaccgcaaccagggcgccgactacggccgcatcctggtgggcctgcaggtgcccaaggccgacaacaaggccttcaaggccttcctggacaccctgggctacccccacgtggaagaaaccgacaaccccgtctaccggctgtttctgcagagctga

SEQ ID NO: 31742 - protein, 548 aa, Polaromonas sp. JS666
MMLDCEKNMPTHTPPAAYPSPQAAKTARKVSAQGLTPADYLKKILTARVYDVALESALEPAKNLGRRLNNTVLLKREDQQPVFSFKLRGAYNKMAHLSSAQLKKGVICASAGNHAQGVALSAQKLGTRAVVVMPTTTPQVKIDAVKGWGAEVVLHGDSYSDAYAHAVLLEKKRGLTFVHPFDDPDVIAGQGTIAMEILMQLQSLGSRRLDAVFVAIGGGGLIAGVANYIKAVRPEIKVIGVQMNDSDAMMQSVTAKKRVTLNDVGLFSDGTAVKLVGEETFRISRELVDEFMTVDTDAVCAAIKDVFVDTRSIVEPAGALAVAAIKQYVATHKTKGETYAAILCGANMNFDRLRFVAERAEVGEEREALFAVTIPEERGSFRHFCELIGELPGGPRSVTEFNYRISDDEKAHVFVGLTTSAKGESSKIAANFSRHGFKALDLTHDELAKEHIRHMVGGHSALSKDERLLRFIFPERPGALMKFLSSMQPGWNISLFHYRNQGADYGRILVGLQVPKADNKAFKAFLDTLGYPHVEETDNPVYRLFLQS

SEQ ID NO: 31743 - DNA, 1203 bp, Polaromonas sp. JS666
  CDS (1)..(1203)
atgctcagtctgaccgatattgaacaagccgcccagcgcctgcagggccatttgctggataccccctgcgtggagtccaggacgctgtcacagctgaccggggcgcagatttacctgaaatttgaaaacctgcagtacacggcctctttcaaggagcgtggcgcctgcaacaaacttgcgcaactctcaggcgacgaacggcgccgcggcgtgatcgcgatgagcgccggcaaccatgcccagggtgtggcttatcatgcccagcgcctgggcctgagggccgtcatcgtgatgccgcgcttcacgcccggcgtcaagaccgagcgtacccgcggctttggcgcggaggtggtgctgcacggcgacacgctggaggagtcgcgcgcccacgcgctgatgctggccgagcgcgagggcctggtgtttgtgcacccctacgacgacgaagctatcgtggcgggccagggcaccgtggggctggaaatgctgcacgccgtccccggcctggacacgctggtcgtcgccgtgggcggcggcgggctgatcgcgggcatggccatcgccgccaaggccctgaagcccgagattgaaatcgtgggggtgcagacctcgcgctttccggccatggtcaacgccatcaagggcacgcaccacccgcagggcaccagcaccattgccgagggcatcgccgtgggcacgccgggggtcatcccgcaagccatcattgaaaagctggtggacgacctggtgctggtcgatgaaggggatatcgagcaggccatggtgatgctgctggaaattgaaaaaaccctggtcgagggtgcgggcgcggccggcttggcggcggtgctcaaatacccggcgcgctttgccggcaagaaagtcgggctggtgctgtgcggcggcaatatcgacccgctgctgctggcggccatcatcgagcgcggcatggtgcgcgccgggcggctggcccgcatcaaggtcagcgtgcgtgacgtgccaggctcgctggccaagatcaccgcgacggtagccgatgcgggcgccaacatcgacgaggtacaccaccagcgcgccttcaccacgctgtcggtccagaatgtggagatcgagctggtgatccagacgcgcgggcgcgagcacatcgcgcaggtgctggcggcgctggccgcagccggatttgaggcgtccgagcagcactga

SEQ ID NO: 31744 - protein, 400 aa, Polaromonas sp. JS666
MLSLTDIEQAAQRLQGHLLDTPCVESRTLSQLTGAQIYLKFENLQYTASFKERGACNKLAQLSGDERRRGVIAMSAGNHAQGVAYHAQRLGLRAVIVMPRFTPGVKTERTRGFGAEVVLHGDTLEESRAHALMLAEREGLVFVHPYDDEAIVAGQGTVGLEMLHAVPGLDTLVVAVGGGGLIAGMAIAAKALKPEIEIVGVQTSRFPAMVNAIKGTHHPQGTSTIAEGIAVGTPGVIPQAIIEKLVDDLVLVDEGDIEQAMVMLLEIEKTLVEGAGAAGLAAVLKYPARFAGKKVGLVLCGGNIDPLLLAAIIERGMVRAGRLARIKVSVRDVPGSLAKITATVADAGANIDEVHHQRAFTTLSVQNVEIELVIQTRGREHIAQVLAALAAAGFEASEQH

SEQ ID NO: 31745 - DNA, 1008 bp, Polaromonas sp. JS666
  CDS (1)..(1008)
atgagcaccacgctgcacggcacgcccacggtcaccccgcgggccgatggccttccttcgctgcgcgccatcgaagaggcggccggcgtggtctaccgggagttccaggccacgccgcaataccgctggggcctgtccagccagcggctgggcaccgactgctggatcaagcacgagaaccacacgccggttggcgccttcaagatccgcggcggcctcacctactttgacgccctgaaaaaaagcggcacgctccccctcgaggtcatcagcgccacacggggcaaccacggccagagcataggctgggccgcccgcgcccatggtgtggcctgcaccatcgtcgttccgcacggcaattcgatcgagaagaatgcagccatgcgtgcgctcggcgtgacgctgatcgagcacggccaggacttccaggagagccgcgaatttgccatccagctggccgccgaacgcggcgcccacatggtgcccagctttcacgctgacctgctgcgcggcgtggctaccagctggtgggaattcatgcaggccgtgccgcagctggacgtggtgtacgtgccgattggccagggctccggggcctgctcggccattgccgccaaactggcgctcggacgtaagctgcgcatcgtcggcgtggtgagcgcgcatgccaccacctacgccgattccctggcggcaggccgcgtggtcgaggcaccggtgacaacccggctggccgacggcatggcctgtcgtatcgcggaccctgcggcgctcgaactcatggcgccccatatcgaccacctggtgcaggtcaccgatgacgaggtcgcgcaggcgatgcgcgatctgtatgcggacacgcacaacgtggccgaaggggcaggcgcggccagctttgccgccgccatgcaggagcgcagcgagctcaagggacaggtggtcggcaccacgctgtgcggcagcaatgtggacagcaccacgctggccagcgtactcggggcctgctga

SEQ ID NO: 31746 - protein, 335 aa, Polaromonas sp. JS666
MSTTLHGTPTVTPRADGLPSLRAIEEAAGVVYREFQATPQYRWGLSSQRLGTDCWIKHENHTPVGAFKIRGGLTYFDALKKSGTLPLEVISATRGNHGQSIGWAARAHGVACTIVVPHGNSIEKNAAMRALGVTLIEHGQDFQESREFAIQLAAERGAHMVPSFHADLLRGVATSWWEFMQAVPQLDVVYVPIGQGSGACSAIAAKLALGRKLRIVGVVSAHATTYADSLAAGRVVEAPVTTRLADGMACRIADPAALELMAPHIDHLVQVTDDEVAQAMRDLYADTHNVAEGAGAASFAAAMQERSELKGQVVGTTLCGSNVDSTTLASVLGAC

SEQ ID NO: 31747 - DNA, 942 bp, Polaromonas sp. JS666
  CDS (1)..(942)
atgaccaaccgccatcaaatcgagaactgcctgggcgcgttcaatcaggattaccgccactttattcgtcaaacgccgctgtggaaactgcccggcaaggcgctgggcgtggcctgcgcggaagtctggctcaagctggagcacctgcagacgggcggcagcttcaaggcgcgcggcatgctcaaccggctgctgtccaatccgataccgcccagcggggtgatcgtcgcgtcgggcggcaatgccggcattgccaccgcggcagccgccaaagagctgggtgtgcactgcgaggtgtttgtgcctgaagtgtccagcccggccaagcgcgcccgtctcgccgcgctgggctcccgggtcgtggtcacgggcgcggcttacgccgacgcgctgcaggcctgcctggcgcgccagcaggaaaccggcgcgctgctcacgcatgcctatgaccagcccgaagtgctcacgggggccggcacgatggcgctggagatcgagcagcagggcggcctgcccgatgccgtgctggtcagcgtcggcggcggtggcctgattggcggcgtggccagctggtttgaacagcgctctagagtggtggcgctggagcctgaactggcgccaacgctgttcaaggcccgcgaagccggcgagccggtggacgtggccatcagcggcattgcagccgactcgctgggcgccaagcgcattggcagcatggcgtgggacgcgacccaggcccatgtgcgcgatgcgctgttgctcagcgacgaatccatccgggcggcgcagttgtggctctggaacgaactgaaactggccgttgaacccgccgccgcgttgccgctggccgcgttgcacagcggccgctacgtgccgcgcaccgatgaaaaggtctgcctcatcatttgcggcgccaacctggacccagcgtcgcttgtctga

SEQ ID NO: 31748 - protein, 313 aa, Polaromonas sp. JS666
MTNRHQIENCLGAFNQDYRHFIRQTPLWKLPGKALGVACAEVWLKLEHLQTGGSFKARGMLNRLLSNPIPPSGVIVASGGNAGIATAAAAKELGVHCEVFVPEVSSPAKRARLAALGSRVVVTGAAYADALQACLARQQETGALLTHAYDQPEVLTGAGTMALEIEQQGGLPDAVLVSVGGGGLIGGVASWFEQRSRVVALEPELAPTLFKAREAGEPVDVAISGIAADSLGAKRIGSMAWDATQAHVRDALLLSDESIRAAQLWLWNELKLAVEPAAALPLAALHSGRYVPRTDEKVCLIICGANLDPASLV

SEQ ID NO: 31749 - DNA, 1212 bp, Campylobacter lari RM2100
  CDS (1)..(1212): transl_table=11
atggttgaattaaataaaatttatcaagcaaaacagaaaatcgcagattttgtattaaaaaccccttttgtacactcttcttttttgagtgagtttttagaaactgatgtttttttaaaatgtgaaaatttgcaaaaaacaggtgcttataaaatcagaggagcttataatacaatagctaatttaactaaagaacaaaaacaagcaggcgtaatagctgcaagtgcaggaaatcacgcacaaggagtagcaattagtgctaaaaaatttggcatagaagctgtgattgttatgcctgaagccacgcctttgttaaaagtaagtgcgactaaaaatttaggtgcaaaagtgattttaaaaggagataattttgatgaggcttatgcttatgcactaaattatgccaaagaacatcatttaaatttcattcatccttttgaaaatgaaagtattatagcagggcagggtactttaatgcttgaaatgcttgatgaaataagtgatttagatatgattttagctccagttggtggaggaggtttgattagtggagtggcaagtgctgctaagcaaattaatcctgctataaaagtcattggagtgagtgctaaaggagctcctgcgatgtatgagagttttaaaagtaaaaaaatgattaactcaaaagctgttagaactatagctgatggtatagcagtgcgtgatgtgaataaaattaattttgatattattcttgaatgtgttgatgattttattcaagttgatgatgaggaaatagctaatgcggtattgtatttacttgaaaaacataaaatcacagttgagggagcaggcgcatcagcagtagctgcgcttttgcataaaaaaatagatttaaaaaatcataaaaaaattggcgtgattttaagtggtggaaatatcgatgtgcaaatgttaaatatcattatagaaaaaggcttgtttaaagcttttagaaaaatgcttattaatgttactttgattgataaaccaggggctttgagtgctttgagtgatgcgatcaaagaagcgcaggctaatatagttaaaattgattatgatagattttcaactaaactcgaatacggcgatgcaatgatttcaatcactttagaaaccaaaggaaaggaacatcaagaattagttagaaaaatactttatgataaaggttttaattttaatgaaattttatga

SEQ ID NO: 31750 - protein, 403 aa, Campylobacter lari RM2100
MVELNKIYQAKQKIADFVLKTPFVHSSFLSEFLETDVFLKCENLQKTGAYKIRGAYNTIANLTKEQKQAGVIAASAGNHAQGVAISAKKFGIEAVIVMPEATPLLKVSATKNLGAKVILKGDNFDEAYAYALNYAKEHHLNFIHPFENESIIAGQGTLMLEMLDEISDLDMILAPVGGGGLISGVASAAKQINPAIKVIGVSAKGAPAMYESFKSKKMINSKAVRTIADGIAVRDVNKINFDIILECVDDFIQVDDEEIANAVLYLLEKHKITVEGAGASAVAALLHKKIDLKNHKKIGVILSGGNIDVQMLNIIIEKGLFKAFRKMLINVTLIDKPGALSALSDAIKEAQANIVKIDYDRFSTKLEYGDAMISITLETKGKEHQELVRKILYDKGFNFNEIL

SEQ ID NO: 31751 - DNA, 1038 bp, Leuconostoc mesenteroides
  CDS (1)..(1038): transl_table=11
atgacgactgagggaaagctaacggctgaagaaatagatgaggcgcatcgagtcttgtcaaaggtagtaacgcatacgccattggcatatgatgactatctatcaaaaaaatacagagctaatgtgtatcttaaacgagaagatatgcaacgggttcgttcgttcaaaattcgtggtgcctactacaatatcattaaggcagagaaagaaaaactcaataatggggttgttgctgcttcagctggaaaccacgcgcaaggcgtagccgatacatgtcataatttaaagatacaagcaactatttttatgccagtcactacaccaaatcaaaaagtagaagcggttaaacgttttggtagtcaatatgttacggtaatcctagtcggtgatacctttgacgaagcacaaagtgcagcgtttgaatacactgaaaaacataatatgttctttgtagcaccatttgatgatcggcgtaccatggctgggcaaggcacggtggcggttgaggtatttgaagatgctgtagagcaaaatattaatgttgattatttgattgcttctgttggtggtggcggtttaatcggtggtctgtcgacctattctaaaaaggtatcaccacaaaccacagtagtaggtgtcgaaccagaaacggcacagtcaatgaaagcggattttcaagctcaaaaacctaccaccgtcgagaatattgatcactttgttgatggtgctgccgttgcgcgtgtcagtcagtttacctataatcaagcacagcagtatgttgacaaactgctggctatccctgaaggaaaggttgctcaagcagtattagacttgtacacttatgaggcgatagttgccgaaccagctggagcgatgcctatcgctagtttggattttatggccagtgatatcgtagggaaaaacgtcgttctagttgtttctggtggaaacaatgatatcggccgtatgcaagaaatggaacaaaaggcattaatgtataagggtcgccaacagttttacttagttgagtttccgtaa

SEQ ID NO: 31752 - protein, 345 aa, Leuconostoc mesenteroides
MTTEGKLTAEEIDEAHRVLSKVVTHTPLAYDDYLSKKYRANVYLKREDMQRVRSFKIRGAYYNIIKAEKEKLNNGVVAASAGNHAQGVADTCHNLKIQATIFMPVTTPNQKVEAVKRFGSQYVTVILVGDTFDEAQSAAFEYTEKHNMFFVAPFDDRRTMAGQGTVAVEVFEDAVEQNINVDYLIASVGGGGLIGGLSTYSKKVSPQTTVVGVEPETAQSMKADFQAQKPTTVENIDHFVDGAAVARVSQFTYNQAQQYVDKLLAIPEGKVAQAVLDLYTYEAIVAEPAGAMPIASLDFMASDIVGKNVVLVVSGGNNDIGRMQEMEQKALMYKGRQQFYLVEFP

SEQ ID NO: 31753 - DNA, 1500 bp, Caenorhabditis elegans
  CDS (1)..(1500)
atggttgctccatctcgaaagaagtcgattattcatcatcatgatcactctcatgaatcaacacctcaaaaaactcaccatcatcgagtgaagcaggctgaacgtaaacggacagcaagcatcagtaaagaagatggaatggaatataacaaaagagttcgaaagcttcataaggcattcttaacccatggagccgagtccccacatgttgatgataaacagacttctggaagtaacagtgatactgaagctccacttttcgatccggattgtgatccagagaacccaaagaaattgaaattttctgatatttcaagtgctgcatttaacattaaaaatggagttcaaacaacaccatgtgtgcgatctcttcaactgtcatccaagtgtgaaatggacctttatttcaaaaaagaatatctgcaagtgacaggatcattcaaagaacgaggagcaagatacgctctttcaaaaatggctgagcaattcaaaaaagcaggagtgatcgctgcgagcgcaggaaatcatgctctagctctcagttatcatggacaacaaatggggattccagtgacagtggtcatgcctgttattgctccacttatgaaaattcaattctgcagaagcttgggagcaacagttattctcaagggagagagtattgcagtggccaaggactttgcacttcgtcacgctaaagagaatcacttaaagtacattaatggttatgatgcaattgatattcttgctggacaaggaacaattggacttgaaattcttgatcaagttccagatgttgatacaattcttgtaccagttggaggtggtggattaattgctggaatcgcaacagctgttaagacattgaagccggatgttcatatttatggaattgaatcagaaacctgcccatcgttcactgaagcatatgaagctggccatataataacttcccaggccaaagcgtcacttgctgatggtctcgccgttcccacagtcggcggaaattctttggagacagcaaaaggcttggttgataaggttatcacagtgaaagaagaaagcattgcgctgagtattttaagacttttggaagttgaaaaggctgttgttgaaggaggaggagctgttggattagcagctattttggaaggaaaagtaccagaattgaaaggaaagaaagttgtttcaattctttccggtggaaatattgatacaacagtacttggaagatcaattgaaagaggattagctgtagatggaagacttgttcgtttagaagttgtcgtatcagatagaccaggaggtattgctgaactaacaactacaattgctcatcttggagcatcaatcaaagatattttccacgaaagagcatggatctcaacggatgtattccacgttaaagttaaggttgtggcagaaactcgtggaaaagagcacgtggaggagattgagactgcattgaagaaaatttatgataatgttatacttcattga

SEQ ID NO: 31754 - protein, 499 aa, Caenorhabditis elegans
MVAPSRKKSIIHHHDHSHESTPQKTHHHRVKQAERKRTASISKEDGMEYNKRVRKLHKAFLTHGAESPHVDDKQTSGSNSDTEAPLFDPDCDPENPKKLKFSDISSAAFNIKNGVQTTPCVRSLQLSSKCEMDLYFKKEYLQVTGSFKERGARYALSKMAEQFKKAGVIAASAGNHALALSYHGQQMGIPVTVVMPVIAPLMKIQFCRSLGATVILKGESIAVAKDFALRHAKENHLKYINGYDAIDILAGQGTIGLEILDQVPDVDTILVPVGGGGLIAGIATAVKTLKPDVHIYGIESETCPSFTEAYEAGHIITSQAKASLADGLAVPTVGGNSLETAKGLVDKVITVKEESIALSILRLLEVEKAVVEGGGAVGLAAILEGKVPELKGKKVVSILSGGNIDTTVLGRSIERGLAVDGRLVRLEVVVSDRPGGIAELTTTIAHLGASIKDIFHERAWISTDVFHVKVKVVAETRGKEHVEEIETALKKIYDNVILH

SEQ ID NO: 31755 - DNA, 1137 bp, Sorghum bicolor
  CDS (1)..(1137)
atgcatgtgattgattgcttcctcgtcctacctagatttgggagttccaccgccaccgtcgtcgtcctcgttctcctttctcctagtccttggcgcgttgtggcgaactggagaggcctgatgggaagcagagatggcaccggtgacagcacgggacgccagggctatgctgccgacattgattccatcagggaggcgcaggcacgcattgcgccgtacgttcacaggacgcccgttctgtcgtcggcgtccatcgatgccatggtggggaagcagctcttcttcaagtgcgagtgcttccagaaagcaggggcattcaagatccgaggtgcttcgaattcgatattcgcacttgacgatgagcaggcatcaaagggcgttgtgacacatagcagtgggaaccatgccgccgccgtggctttggctgcaaagctgcgtggcatacctgcacacattgtcataccaagaaatgcaccagcgtgtaaggttgaaaatgttaagcggtatggtggtcatattatccggagcgatgtcagcattgaatcgagagaatctgtttgtaaaagagtccaggaggagactggtgctgttcttatccatcccttcaatgataaatacactatcagtggtcagggtacagtatctcttgaacttttggagcaagtccctgaaattgacacaataattgttcctattagtggcggtggtttaatttctggtgtgacccttgctgcaaaggccataaacccttcgatacgcattctggcagcagaaccaaaaggtgctgatgattctgcccagtctaaggctgctggaaagatcatcacattgccttccacaaacaccattgctgatggtctacgagcttttcttggtgacttgacatggcctgtggtgcgtgacttggtggacgatgttatcgttgtggatgacacagcgattgtggacgccatgaaaatgtgctacgagatcctgaaggtggctgttgagcctagtggcgcaattggcctggccgcagcactgtccgacgagtttaagcaaagctctgcttggcacgagagcagcaagataggaataattgtttccggaggcaatgttgacctcggcactctttgggagtctctgtacaaacaatga

SEQ ID NO: 31756 - protein, 378 aa, Sorghum bicolor
MHVIDCFLVLPRFGSSTATVVVLVLLSPSPWRVVANWRGLMGSRDGTGDSTGRQGYAADIDSIREAQARIAPYVHRTPVLSSASIDAMVGKQLFFKCECFQKAGAFKIRGASNSIFALDDEQASKGVVTHSSGNHAAAVALAAKLRGIPAHIVIPRNAPACKVENVKRYGGHIIRSDVSIESRESVCKRVQEETGAVLIHPFNDKYTISGQGTVSLELLEQVPEIDTIIVPISGGGLISGVTLAAKAINPSIRILAAEPKGADDSAQSKAAGKIITLPSTNTIADGLRAFLGDLTWPVVRDLVDDVIVVDDTAIVDAMKMCYEILKVAVEPSGAIGLAAALSDEFKQSSAWHESSKIGIIVSGGNVDLGTLWESLYKQ

SEQ ID NO: 31757 - DNA, 1002 bp, Saccharopolyspora spinosa
  CDS (1)..(1002): transl_table=11
atgaccttcaagcaacaccaggatgccagcggttttacgctgcctttcgaagcgattaccgctgcacatgatcgaattcgagaacgaatcatcgaaacgccgctgctggagagcgcggccctcaacgcactggtcggcgcacgagttctggtcaaagccgagtcgttgcagaagacgggctcgttcaagtttcgtggggcttgcaatcgcgcgctgcaactcgcgccgcacgagcggtccggcggaatcgtcgcctggtcgtccgggaatcacgcgctggcgatctcggccgtatgtgcggaactgggcgtgccggccaccatcctcatgcccttggacgcaccccgggcgaaggtcgacggcgccaagagctacggggccgaggtccggctttacgaccggcaaaccgaggatcgagaggcactcggcagggagatcgccgaccggacgaacgcggtcatcgttccgccttatgacgatccggagatcatggccggtcagggaacggtcggactcgaactcctcgcccaggcgcgcgaggccggtctaaagcccgacgccgtactcgccagtgcgagcggcggagggctgatcgccggcgtggcaaccgctgtgcgcacgaccctgcctgatgcacaggtattcgcggtcgaacctgaaggcttcgacgaccacgcacgttcccttgccgcaggcgcacgtgtgcggaacgaaccgggggcgcagtcgatctgcgactcgctccacgtgcccacgccaggagaactcacgttctccgtcaaccaccgccttctcactggtggcctcacggtcagcgacaccgaagttcgccgagcgatgcgggtggctttcgagacgctcaagctcgtggcggagcccggaggcgccgcacccctcgccgccctcctcgcggggaagttggacgtgtccggcaagaccgtcgtgacggtgctcagtggcggcaatgtcgatgcggacatgttccagtccgcattctcctga

SEQ ID NO: 31758 - protein, 333 aa, Saccharopolyspora spinosa
MTFKQHQDASGFTLPFEAITAAHDRIRERIIETPLLESAALNALVGARVLVKAESLQKTGSFKFRGACNRALQLAPHERSGGIVAWSSGNHALAISAVCAELGVPATILMPLDAPRAKVDGAKSYGAEVRLYDRQTEDREALGREIADRTNAVIVPPYDDPEIMAGQGTVGLELLAQAREAGLKPDAVLASASGGGLIAGVATAVRTTLPDAQVFAVEPEGFDDHARSLAAGARVRNEPGAQSICDSLHVPTPGELTFSVNHRLLTGGLTVSDTEVRRAMRVAFETLKLVAEPGGAAPLAALLAGKLDVSGKTVVTVLSGGNVDADMFQSAFS

SEQ ID NO: 31759 - DNA, 978 bp, Xenopus laevis
  CDS (1)..(978)
atggattttgcagagcaagctccttttcatattgtcactcctctgaaagagagtcgtgctttatccaaattggctgggactgaagttctcatgaaactggaaaatgttcagcctgcagggtctttcaagatacgtgggattggacactattgtcagaagcttgcgaagaaaggctgcacgaggtttgtctgttcctcagggggtaatgctgggcttgcagcagcttatgcttgtaggggactgaacctcccagcaaccattgttgttccacaaagtactggagcagatattgtacagaagctgcaggatctgggagctgatgttgtgataattggaaaggtctgggatgatgctgatgcacatgctcaccagctgactgaaactcctggcagtgtgtatatctctccatttaaccatcctctcgtctgggaaggccactccagccttgtgtgtgaactaaaggcctctttgggttctcagaagccaggggcactggttgtttctgtagggggtggtgggctcctggctgggctagctgaagggctgaagaaggtgggctggtctgatattcccataattgcaatggagactaaaggggcccactgtttgaatgcagctcttgaagcaggaaaacccatcagccttccagatattaccagtgttgccaagtgtctcggtgccaagacagtatgtgacagagcctttgagtgtacaagggagcacaacgttatttccattactgttgatgacagagaagccatacgggctgtggaaatgtttttggatgatgagttaatttttgtggagcctgcatgtggagctgcccttgctgctgtctattcaggacatatccaacgcctgcagcaggagggaatcttgaagacaccccttgaccccattgtgatggtagtgtgtggaggcagttcgatcagcatttctcagctaaaacacttcaaatcccagctgaatatgaattga

SEQ ID NO: 31760 - protein, 325 aa, Xenopus laevis
MDFAEQAPFHIVTPLKESRALSKLAGTEVLMKLENVQPAGSFKIRGIGHYCQKLAKKGCTRFVCSSGGNAGLAAAYACRGLNLPATIVVPQSTGADIVQKLQDLGADVVIIGKVWDDADAHAHQLTETPGSVYISPFNHPLVWEGHSSLVCELKASLGSQKPGALVVSVGGGGLLAGLAEGLKKVGWSDIPIIAMETKGAHCLNAALEAGKPISLPDITSVAKCLGAKTVCDRAFECTREHNVISITVDDREAIRAVEMFLDDELIFVEPACGAALAAVYSGHIQRLQQEGILKTPLDPIVMVVCGGSSISISQLKHFKSQLNMN

SEQ ID NO: 31761 - DNA, 1536 bp, uncultured bacterium 311
  CDS (1)..(1536): transl_table=11
atgacatttgctaaatctaaaaaatatttaaaaaaaatagaagagagcagtgtttatgatgtagctgatattacacccttgtctcttgcaagccatctaacaaaagaaacaaagaataatatctttttaaaacgcgaggaccttcagccggtattttcttttaaattgaggggggcttataacaaaatttcatatcttaagaagatcggtaccatagaaagagtgataactgcttctgcaggcaatcatgcacaaggagttgcttactctgcaagaaagctcagactcaaagcaaccattgtgatgccagtaacgactcccagtattaaagtaagtgcggttaaaaatctaggtgctcaagttgttcttgtaggggatacttatgatgaagcttatgaacatgctattaagttatcaaaaaaaccaaactatgcttttgtacatccttatgacgacccagacgttatcgctggacaaggaactatcggaaaagagattttagatcaagctggtaatgatttagatgccgtatttgttcctgttgggggcgggggcctgctggcaggcataggagcttatattaaaactctaaggccagatgtaaaaattattggagtagagcctgaggaagcagctggactttatgaagcccttaaagcaaatcggatagtaactttaaaacaagtagggatttttgtagacggggtagccgtaaaacaggttggtaaagttacttttcctataattaaagaatgggtagatgaagtggttacagtatctgtcgatgagatttgtgcagctattgaagatatttttcaagagactagaacaatatctgaacctgcaggagctttatccttggcaggcttgaagaaattaactaaaagtaaaggctggaagaataagaatctagtagctattaattcaggtgcaaaccttaactttgatcgtctttctcacatagtcgaacgagtacagttgggagagaagaaagaagctcttctaagtgtctgcattccagaagaaaaaggcagtttcagacaattttgtaaggatctaggcaaaaggatgattactgaatttaattatcgaattgatgatgaaaaagaagcaaacatttttgtagcttgtagagtaaatgagggaataaaagaaaaaagtagatttataaagaatttgcgcaagaaaggttattcccctaaagatttatctgataatgaaatggctaaattgcatgtcaagcacatggtaggaggcagggctccaaaagacattatttcttacggggaagagatttttagagttgagttcccggaaagacctggagcactgatggatttcttaagtttgttaggagacaaatggaatataactttgtttcactatagaaatcaaggttcagcttatggaagggtgttagtaggctttcaagctaatccaaaagaaactgaaaaattaacaaagcacctcgttaaaacaggctttccattttggaatgaatctaagaactcagcttatttatccttccttgaatga

SEQ ID NO: 31762 - protein, 511 aa, uncultured bacterium 311
MTFAKSKKYLKKIEESSVYDVADITPLSLASHLTKETKNNIFLKREDLQPVFSFKLRGAYNKISYLKKIGTIERVITASAGNHAQGVAYSARKLRLKATIVMPVTTPSIKVSAVKNLGAQVVLVGDTYDEAYEHAIKLSKKPNYAFVHPYDDPDVIAGQGTIGKEILDQAGNDLDAVFVPVGGGGLLAGIGAYIKTLRPDVKIIGVEPEEAAGLYEALKANRIVTLKQVGIFVDGVAVKQVGKVTFPIIKEWVDEVVTVSVDEICAAIEDIFQETRTISEPAGALSLAGLKKLTKSKGWKNKNLVAINSGANLNFDRLSHIVERVQLGEKKEALLSVCIPEEKGSFRQFCKDLGKRMITEFNYRIDDEKEANIFVACRVNEGIKEKSRFIKNLRKKGYSPKDLSDNEMAKLHVKHMVGGRAPKDIISYGEEIFRVEFPERPGALMDFLSLLGDKWNITLFHYRNQGSAYGRVLVGFQANPKETEKLTKHLVKTGFPFWNESKNSAYLSFLE

SEQ ID NO: 31763 - DNA, 972 bp, Rhizobium sp
  CDS (1)..(972): transl_table=11
atgcgcaattaccccaccattcaggacatccgtgaagcccgggaacggctgagaccacacgtcaggcacacgccgctgttgcgcgcggacaagattgagaaagctgctggttgtcagctctatctcaaacccgaaaccctgcagattactggcgccttcaagatccgcggcgccctgaacaaggctctctcgctctcgagagaagagatcgcaaacggcatcatcgcgacgtcgtcgggcaaccatgcccaggggctttcttacgcggccaagatgctcggcgtaaaggtgatattggtacttccggtgaccacacccaaaatcaagattgaaaatacaaaagcccttggcgcggaagtcattctttttgatggtgataatgctgctagatggaaaaaggtctacgaaatcgctgaaggaaacaagtatgcggttattcacggctttgaagaccccattgtaatggctggccagggaacgatcgggtgcgagatactcgaagacttggacgatgtggacacggtcatcgtccccttaggcggcggaggcctaatctcgggaatcgctaccgccataaaagaaacgaaaccatcggtgcgcgttatcggggcagagcctgccttgacaccgaagtattatcacagccggatcaacaaggagcgcacatcgcttccgttgaagaacaccattgcggatggcttgaggttaagtgttccgggtaaaaacccgtatccgattatcgaaaaatatgtggacgagattgttcttgttgaagacgagcacatcatctccgggatgcgcgcgcttgccagggatgcgaagttgatcgctgaaccagccgcctcgattggcattggagccttgttggcgggcagcatagacgtcaagcccgatgaaaaagtctgtgcggtgttgtctggcggcaactgggacctaggcgatcttgcagagatatacaaggcagcggggtaa

SEQ ID NO: 31764 - protein, 323 aa, Rhizobium sp
MRNYPTIQDIREARERLRPHVRHTPLLRADKIEKAAGCQLYLKPETLQITGAFKIRGALNKALSLSREEIANGIIATSSGNHAQGLSYAAKMLGVKVILVLPVTTPKIKIENTKALGAEVILFDGDNAARWKKVYEIAEGNKYAVIHGFEDPIVMAGQGTIGCEILEDLDDVDTVIVPLGGGGLISGIATAIKETKPSVRVIGAEPALTPKYYHSRINKERTSLPLKNTIADGLRLSVPGKNPYPIIEKYVDEIVLVEDEHIISGMRALARDAKLIAEPAASIGIGALLAGSIDVKPDEKVCAVLSGGNWDLGDLAEIYKAAG

SEQ ID NO: 31765 - DNA, 969 bp, Acinetobacter baumannii
  CDS (1)..(969): transl_table=11
atgaaaaatttaacccttccaaattatgaagatgtcgcagccgctgctgaacgtataaaaggttttgtaaataaaactcctgttttaacttcacgtacggtgaacaatgaatttgaagcagaagtgttctttaaatgtgagaattttcagcgtgtaggcgctttcaaatttcgtggtgccatgaatgcacttttgcaatttaatgagactcaaaagaaagcaggtgtagttgctttttcttcgggaaatcatgcacaagctattgcgctttcatcaaaaattcttggtattccagcaaccattatcatgcctaaagatgcacctgctgcaaaaatggcagcaacgcgagaatacggcggtaatattgttgaatttgaccgttatacggaagatcgggaaaaaattggaaaagagattgccgaacaaaatggtctaacattaattccgtcttatgaccatccgcatgtgattgcaggtcaaggtacagctgctaaagagttatttgaagaagtcggtgatttagattacctgtttgtatgtttaggtggcggcggtttgttggcaggttctgccctgtcggctcgccagctttctccgaactgtaaaatatatggcgttgaaggtgcgctaggaaatgatgggcaaatgtcttttagaaaaggcgaaattgttcatattgataccccattaaccattgccgatggcgcgcagactcaatatttgggcaaattgacctttcctattattcaacagaaagttgatgatattttgacggtcacagacgaagaactcattaacgctatgaagttctttgctgaaagaatgaagatggtggttgaaccgacaggatgtctcggatttgcggctgcccgtaatttaaaacatgagttaaaaggcaaacgtatcggcattattattagtggtggcaatgtcgatatttctaaatacgcggagtttttatctgcctaa

SEQ ID NO: 31766 - protein, 322 aa, Acinetobacter baumannii
MKNLTLPNYEDVAAAAERIKGFVNKTPVLTSRTVNNEFEAEVFFKCENFQRVGAFKFRGAMNALLQFNETQKKAGVVAFSSGNHAQAIALSSKILGIPATIIMPKDAPAAKMAATREYGGNIVEFDRYTEDREKIGKEIAEQNGLTLIPSYDHPHVIAGQGTAAKELFEEVGDLDYLFVCLGGGGLLAGSALSARQLSPNCKIYGVEGALGNDGQMSFRKGEIVHIDTPLTIADGAQTQYLGKLTFPIIQQKVDDILTVTDEELINAMKFFAERMKMVVEPTGCLGFAAARNLKHELKGKRIGIIISGGNVDISKYAEFLSA

SEQ ID NO: 31767 - DNA, 3522 bp, Dictyostelium discoideum
  CDS (1)..(3522)
atggcaaagaaacattcaagagaagaaacaataacatcaccaagtccaagtggaaatacaactacaacatctacaacaagtccaacatcaacaacaccaacaaaagaaaaaagaacaaaaatttcaaatggaaataataaagaaaaagaaaccaatagtaataataatataaatacaagtaatacaaatattttaaatggtagtgttaatagtttaaataatagtagtacaaatttatttacaacacatcaaaataatccagtaaagaatttaaaaggatttgatgatattggtgaaggtatacttagattcgaaggatcaaaagaaattgatttcattggatcagtaaagagagttcattcaatgatgaaagattatttaaagaaaactccacaatatgattacgaattattaagtcaattattcaaatgtgatttacaattgaaattagagaatcttcaattgtttggtgatatttatgttagaaattgttttagtatccttttatcaaattattttaatcaagccaaagatttaggtaaagagtttagacaaattggtggtttcgttttagtgattaatccaatggatattgaaagtcaaccaatggtaactggtagtattttaactgctcttcatttaaaaatgaaatgtattatttatgttggtcctggtaatttaccattatcacaaattacaagattatatatgtgtcatgctagaggtgcaaaaattatatttcataaaggtgatgtatcatcatgttatacaagagcatggcaacatgcaaaagatatgagtatggtatttttagattgtaaatttataccacattttagtttattgggtgcagcaactattgcacatgaaatgatggaggatagtccagatagggagacaattatcataccattaagattatattcacagggttggagttatgtcagtggtatttcaattttctataagattatgaaacctgaaatcaagattatagtagttcaaatgactgatgatctctttggtaaagatattgaaggtaaagaatttaatagacaatcattattccctgaccgtttagagattggttggttagcattaattcatgatcaatcagatcttaccaatgttttcgacgctttcgattcaagaaatcaaggtaaattctctgataaagatttagaggcattattgataagcattggtggtgatccaactagaaataaatcaatgtgtccaaaatcatcactttctcaaactgaatttgttcatgaagtaatcacagagatcacaaatggtttagagcaattggaggagaaatttagctactttttaccacaattcaaattggataacttaatcaatcataaaatcatcgatcaattagtaacagcaaccgaggatcaagcttcaatcgctttcattaaatgtttagagtatacccatactctcaccaatggtaagggttcaattgctttgggtggtctaatgagtggtaatattcatttaagacccgatgaaaaagtattggttatgttatcaggtggttatgtcgatgtaatcgattttcaaactattttaaactatggtttagatatcactggtcaaagctttgaaattgaattggatttacccgataatactacatcactaaataaagtattaaatgttattggtgaaaataaagtatcagttatggaggtattaatggatcgttcttgtgaaactttaaaacaatatcatgttagaacttcaattcaatgtcattcaagaaattttgaacaacaatttaaaatctttgatgttattaaatctttaggttttaaatatagtttaagaaaatctgcaattctaaataaagaagaatctggtttcctctcaccaccaatgattaagccttcaacaaatttatcaatttctcaatcaattaatattggtagtagtgtaacgagtttaccatcatttccaaatactttaaattcaagtagttcaaatgcatttaatagatttggtaatggtaatggtagttcatcaaatacaacatcaccatcaccaccaccacaactaccaccacaattacaatataaaatttcaccaaaaccatatcatcaacaaaaaagaaatattggtgatataacagttcaatcaattagagaagcacataatagaattaaacatattatgactcaaccacccatttatcattcaactacctattcaaagatttgtggttgcaaagttacattaatgttagagaatactcaaaagactggtagttttaagattagaggttcatcgaatatggtgttaagagcattggaaggtgcaatggtaaacactgatgaaagaccagttggtttagttgctgcctctgcaggcaatcatgctcaaggtgtagctttaatctctgcaaaagttggtttaccttgtacaatcgtttgtccagagtatgcaccagattcaaaattatcatcaactcgtcaatatggtgccgaagtcattaaaaagggtaaaagtcttgaagaggctgtcaaattggccgatgaaatctgtaaggaaagaaattggacattggttagaccttacaatgatgttgatgtaatcgaaggtcaaggtacaatgggttgtgatatctatgataaagtaccagatgtcgatactgtggttgtaaatgttggtggtggtggtatgatcgctggtatcgcactattcttgaaacgtatcaatccaaacattagaatcattggtgttcaatcagcaaacgtttcaccattatcagaatttaaacaaaccaatcaattccgttatatcgaaccagcagttttatcattggccgatggtacaaatgtaaagatgccaggtggtgtacacactcaagtacttcatgatatggtcgatgagtatgtaaccgttagtgaaaatgaaatcgcttcgaccatagttcatctactttataatagtcgtacagtttcagagggtgcaggttgtttaggtttggctgcattaatgcataagaaaattaaagttagaaaggatgaaagggtttgtgtcatcatttgtggtggtaatatcgatatgtcaacacttcgtcaagtctatgaatatggtttacgttcacttggtcgttctttcacaattcatttaacaacttgggattatcctgggaccctaagtaaaatcattggtttggctgcccgtgccgaattaaaagttcgtgaaattagacatatccgtggtggtggtaatatcaattggaatgaagttatcatttccctctccttctatagtaactcttttaatcatcaaaactttttcttatctctattggctcaagaaggtctcttcccaaagattgtcggtagaaaatacattaaagataatgaaatagtctataaaattttcgataaatctgttgataaaaagaataaagaattaaaagataccttttcagaaagacaacaactatttttagaacaatatggaaaacaagccaatgtttctttggaaagtaaaatgaattaa

SEQ ID NO: 31768 - protein, 1173 aa, Dictyostelium discoideum
MAKKHSREETITSPSPSGNTTTTSTTSPTSTTPTKEKRTKISNGNNKEKETNSNNNINTSNTNILNGSVNSLNNSSTNLFTTHQNNPVKNLKGFDDIGEGILRFEGSKEIDFIGSVKRVHSMMKDYLKKTPQYDYELLSQLFKCDLQLKLENLQLFGDIYVRNCFSILLSNYFNQAKDLGKEFRQIGGFVLVINPMDIESQPMVTGSILTALHLKMKCIIYVGPGNLPLSQITRLYMCHARGAKIIFHKGDVSSCYTRAWQHAKDMSMVFLDCKFIPHFSLLGAATIAHEMMEDSPDRETIIIPLRLYSQGWSYVSGISIFYKIMKPEIKIIVVQMTDDLFGKDIEGKEFNRQSLFPDRLEIGWLALIHDQSDLTNVFDAFDSRNQGKFSDKDLEALLISIGGDPTRNKSMCPKSSLSQTEFVHEVITEITNGLEQLEEKFSYFLPQFKLDNLINHKIIDQLVTATEDQASIAFIKCLEYTHTLTNGKGSIALGGLMSGNIHLRPDEKVLVMLSGGYVDVIDFQTILNYGLDITGQSFEIELDLPDNTTSLNKVLNVIGENKVSVMEVLMDRSCETLKQYHVRTSIQCHSRNFEQQFKIFDVIKSLGFKYSLRKSAILNKEESGFLSPPMIKPSTNLSISQSINIGSSVTSLPSFPNTLNSSSSNAFNRFGNGNGSSSNTTSPSPPPQLPPQLQYKISPKPYHQQKRNIGDITVQSIREAHNRIKHIMTQPPIYHSTTYSKICGCKVTLMLENTQKTGSFKIRGSSNMVLRALEGAMVNTDERPVGLVAASAGNHAQGVALISAKVGLPCTIVCPEYAPDSKLSSTRQYGAEVIKKGKSLEEAVKLADEICKERNWTLVRPYNDVDVIEGQGTMGCDIYDKVPDVDTVVVNVGGGGMIAGIALFLKRINPNIRIIGVQSANVSPLSEFKQTNQFRYIEPAVLSLADGTNVKMPGGVHTQVLHDMVDEYVTVSENEIASTIVHLLYNSRTVSEGAGCLGLAALMHKKIKVRKDERVCVIICGGNIDMSTLRQVYEYGLRSLGRSFTIHLTTWDYPGTLSKIIGLAARAELKVREIRHIRGGGNINWNEVIISLSFYSNSFNHQNFFLSLLAQEGLFPKIVGRKYIKDNEIVYKIFDKSVDKKNKELKDTFSERQQLFLEQYGKQANVSLESKMN

SEQ ID NO: 31769 - DNA, 1053 bp, Dictyostelium discoideum
  CDS (1)..(1053)
atgggtcttaaaacaactatttcaccagattcttcatttgataaaataataaataccaaaacttcacctccattacatataaattctccaatgttggaatcattggctttatcaaaattatttaaagaagaaaatgcaaaagtatggatgaaagtagatgcacttcaaccatcaggctcattcaaaatccgtggagtaggccttctctgtaatcaacttttaaaagaaaaaaaatcaaaaaatgaagaagctcattttatttgttcatcaggaggtaatgcaggtaaaagtgttgcatatgcaggtagaaaattaaatgtaaagacaacgatagttttaccaaatactataccagaggcaacaattgaaaagattaaagatgaaggagcaaatgtaattgtacatggtactatttgggatgaagcaaatacatttgcattggaattggcagagaaagaaggttgtacagattgttatatccatccattcgatcatccattactttgggagggtcattccacaatgattgatgaaatctatcaagatgttcaaaatggtgtttgtgaaaaaccagatgtaattttattttcagttggtggtggtggtatgatgattggtattttacaaggtttagatagatatggttggaatgatataccaattgttactgttgaaactgttggtagtcatagtttttggaaaagttttcaagagaaacaattgacaaaattggatgtatcagaggttacaagtgtaattaaaaccttatcaactcgttcagtttgtagtgaagcttgggaaatttcaaaaagatttaatattaaaccaattttagtcactgatagagatgctgtagatgcttgtttaaaatttgttgatgatgaaagaatcttagtagaaccatcttgtggtgcaacattatctgtactctattcaaaaaaattatcaacacttttagatataaattcaaaaaatattttaacaatcgtttgtggtggaaatggaactagtattttacaattgaatgatttattacaaactttaccaaaatag

SEQ ID NO: 31770 - protein, 350 aa, Dictyostelium discoideum
MGLKTTISPDSSFDKIINTKTSPPLHINSPMLESLALSKLFKEENAKVWMKVDALQPSGSFKIRGVGLLCNQLLKEKKSKNEEAHFICSSGGNAGKSVAYAGRKLNVKTTIVLPNTIPEATIEKIKDEGANVIVHGTIWDEANTFALELAEKEGCTDCYIHPFDHPLLWEGHSTMIDEIYQDVQNGVCEKPDVILFSVGGGGMMIGILQGLDRYGWNDIPIVTVETVGSHSFWKSFQEKQLTKLDVSEVTSVIKTLSTRSVCSEAWEISKRFNIKPILVTDRDAVDACLKFVDDERILVEPSCGATLSVLYSKKLSTLLDINSKNILTIVCGGNGTSILQLNDLLQTLPK

SEQ ID NO: 31771 - DNA, 1740 bp, Giardia lamblia
  CDS (1)..(1740)
atgcatgccctaatccagtctggagagctcatgaacttcgttgtcaagctcaacacacttgatgggaatctcatgacccgtttgacagatatcctctccaagcactcgattaatattcttagctttcacgtaaagactatacaacaccagcaggtctctatcaaggcctcgggccctggctaccagcacttagtttctttgtacaatgagttgtccgaggtcttcggtgatgagaacatcctggggttggcgatccctaagtacaatataaaggaggaggggctgcgcgatgtctcctatgaggagttcaatgagggagcttcgtccagtggcgagcccatcagaacatatgtttcccccatcaagtcgtgtgatgagataacgccggcaactattgagcttgcttacaacaagcttcaggcagctaaagccatacacgagaccccctgcatcatctccaaggcgtacagcaatattttgcagaagaagacaggcgttgaccacaccgttattctccagtttgaaaatgttcagcagacgggctcgtttaagatccgcggggcgagcaatatgctcattaagagcaaggagtgggccgagagcaataatactgagatctctggggttgtggcatgctctgcaggaaaccacgcccagggagtcagcaagacaagtgacttgttgggtattcgctgcacaatagtttgccctgagacggctccgactgtcaaattggttaacacaaagcgatacaacgccgaagtgattaagcacggtgctgtcttcgatgaggcaagcaagtattcccaggaactctgtgagaagcgcggctggatgtttatcccgccctataactcgttcgacgtcattgagggccaaggaacaattgctcacgaactgatgaacaagatggtcgggcaagggcacgtttcctccattgaccgcatcctggtcaatattggaggaggcggtatgatttcaggaatctccctttacgctaagagagtcaatccaaatatcaagatcacagggatccaagcagagaaggtgtttcctctccgcaactacaaagagagtggccagcttgtccctgttgacaaaacggctggaacaatagcagatggctgcaatgtcaaggttcttggaggaatccacaacgatgtcctcaagaactacgttgacgagttcatttcggtgactgagaacgagatcgccagtgcggttgttcatgctcttatcacgacagggacgctctgcgagggcgccggagcaatgggtattgcggccctgatgtatgacaagctgacccttgctgagcgtgagaacatagctgtcgttctgtgtggtggcaatatcgacctcactagagtcagacagatctataactacggactcattgctctagggaggatgctcagcgttgagatcagacaggcagacacatatggcagccttgcaaagctcagcaagattgccttgaaatactactctaccatacgatatgttacatacctgcgaggcggagatgaccttgattgggaccagatggtcgtgaaggtggacatcaagattccaagccctgcagtctatggcttgcttagccaagagattcgtgcgtcctttgatacagttacatttctgggtgaaaccgttatccctcgttaccctgtgtcagcccatgcacctgagctgggatcgtctgctgtggagaactctcaggtacgcgtcgttaagaagtga

SEQ ID NO: 31772 - protein, 579 aa, Giardia lamblia
MHALIQSGELMNFVVKLNTLDGNLMTRLTDILSKHSINILSFHVKTIQHQQVSIKASGPGYQHLVSLYNELSEVFGDENILGLAIPKYNIKEEGLRDVSYEEFNEGASSSGEPIRTYVSPIKSCDEITPATIELAYNKLQAAKAIHETPCIISKAYSNILQKKTGVDHTVILQFENVQQTGSFKIRGASNMLIKSKEWAESNNTEISGVVACSAGNHAQGVSKTSDLLGIRCTIVCPETAPTVKLVNTKRYNAEVIKHGAVFDEASKYSQELCEKRGWMFIPPYNSFDVIEGQGTIAHELMNKMVGQGHVSSIDRILVNIGGGGMISGISLYAKRVNPNIKITGIQAEKVFPLRNYKESGQLVPVDKTAGTIADGCNVKVLGGIHNDVLKNYVDEFISVTENEIASAVVHALITTGTLCEGAGAMGIAALMYDKLTLAERENIAVVLCGGNIDLTRVRQIYNYGLIALGRMLSVEIRQADTYGSLAKLSKIALKYYSTIRYVTYLRGGDDLDWDQMVVKVDIKIPSPAVYGLLSQEIRASFDTVTFLGETVIPRYPVSAHAPELGSSAVENSQVRVVKK

SEQ ID NO: 31773 - DNA, 1848 bp, Podospora anserina
  CDS (1)..(1848)
atggcttccacaaattcgaatgcacctcgtcatgaggggagtgtggcagagcagacggccggccatgttaacggtgactatgtggtcaatggcgtgccacagctgcccaccgcattccgcaacggcaacggcggccttggtgctgggggtttgcccaggaacatgtcgctgaacagcttcgctctgacagagtacagcgcaaagccaacaccccccgctgaagacaagaaagatgaagtgaaaaaggtcgtgccagacgagtatctgctaccgaatggtaacccagatctcattatcctacgtgtacagtatcttcgccttatcatcacctcctacccgcgggtgagagaggtgtgcaaagaaactcctttggtgcacgctgttggcctgagcaaccgactggagcgcaaggtcctgttgaagcgcgaggatgagcaaccggtattcagtttcaaactcagaggagcgtacaacaagatggctcatctcgacgctaccgagtcctggaagggtgtcgtttgttgcagcgctggcaatcatgctcagggcgttgcttactcggcccgcaggttgaaaatcccagccactattgtgatgcccaagggcacaccaagcatcaagcatctcaatgtatcgagaatgggcggacacgttgttcttcacggcgccgactttgacgaggccaaggaggaatgtgctcggcgggaaaagcaggatggcctgataaacattcccccgttcgacgacccttatgttattgccggccaaggaactatcggtatggagattctctcacaaacaaacctgcagaagcttgatgccatcttctgctgcgtgggtggaggcggcctgatcgccggcgttggtgtgtacgtcaagcgtattgcaccgcatgtcaagatcattggcgtggaaacgtacgacgcggatgcgatgactcagtctctcgacaagggggagcgtgtgcttctcaaggatgttgggttgttcgccgatggcgccgcggtcaagattacgggcgaggaaacgttccgtatttgtcaggaggttgtggacgaaatggttcgggtaaccacagacgaggcctgtgccgctatcaaggacatgtttgaggataccaggtctatcattgaaccagctggtgccctggccattgccggtctgaagaagtgggtggccgccaatccaaccccggatcctacacggtctgtcgtggccatcacatccggcgcaaacatgaactttgaccgcttgggctttgttgcagcccgtgctacgtacggcgagggaagagaggctttacttgcagcccgcatcccagaaagcccgggagccttcgctgaactcatcaacgccgtcatgcctcactctgtcaccgagtttagctatcgttacgccagcccaactgaagcaaatgtgctcctgggtatctcattaaccgccgttggtagtgaacgcgcacagcaactgcagtcggttatcagccgcatcaaggagtccggcaccatggatatcaccgatctgtccaacgacgagttagcaaagagtcacattcgatacatggttggtggccgttctagtgtgcctaacgagcgtctgtacacattccgattcccagaacggcccggtgctcttgagcgcttcctacagaccttgcgtgtcaaatacaacatcagtctgttccagtacagaaaccacggtggtgatattgggcaggttttgacaggcatcgtttgcccgaacgaggagattggcgaactagaaacattcctcaagaagatcggctatccgtgggaggactgcacagatgcaccggtgttcaagacattcttacggtcggagtcatag

SEQ ID NO: 31774 - protein, 615 aa, Podospora anserina
MASTNSNAPRHEGSVAEQTAGHVNGDYVVNGVPQLPTAFRNGNGGLGAGGLPRNMSLNSFALTEYSAKPTPPAEDKKDEVKKVVPDEYLLPNGNPDLIILRVQYLRLIITSYPRVREVCKETPLVHAVGLSNRLERKVLLKREDEQPVFSFKLRGAYNKMAHLDATESWKGVVCCSAGNHAQGVAYSARRLKIPATIVMPKGTPSIKHLNVSRMGGHVVLHGADFDEAKEECARREKQDGLINIPPFDDPYVIAGQGTIGMEILSQTNLQKLDAIFCCVGGGGLIAGVGVYVKRIAPHVKIIGVETYDADAMTQSLDKGERVLLKDVGLFADGAAVKITGEETFRICQEVVDEMVRVTTDEACAAIKDMFEDTRSIIEPAGALAIAGLKKWVAANPTPDPTRSVVAITSGANMNFDRLGFVAARATYGEGREALLAARIPESPGAFAELINAVMPHSVTEFSYRYASPTEANVLLGISLTAVGSERAQQLQSVISRIKESGTMDITDLSNDELAKSHIRYMVGGRSSVPNERLYTFRFPERPGALERFLQTLRVKYNISLFQYRNHGGDIGQVLTGIVCPNEEIGELETFLKKIGYPWEDCTDAPVFKTFLRSES

SEQ ID NO: 31775 - DNA, 981 bp, Burkholderia pickettii
  CDS (1)..(981): transl_table=11
atgacccagctagacaccaccactcttcccgacctgtccgccatcgccggcctgcgcgcccggctgaaacaatgggtgcgcaccacgcccgtattcgacaagaccgacttcgaacccgtgccgggcacggcggtgaacttcaagctcgaactgctgcaggccagcggcaccttcaaggcgcgcggcgcgttctcgaacctgctagcgctggacgacgatcagcgcgcggccggcgtcacctgcgtgtcggcaggcaaccatgccgttggggtggcctacgccgccatgcgcctgggcatcccggccaaggtggtcatgatcaagaccgccagcccggcccgcgtggcgctgtgccgccagtacggcgccgaagtggtgctggccgaaaacggccagacggcattcgataccgtgcaccgcatcgaaagcgaggaagggcgcttcttcgtgcaccccttcaatggctaccgcacggtgctgggcaccgccacgctaggtcacgaatggctggagcaggctggcgcgctcgacgccgtgatcgtgcccatcggcggcggcgggctgatggcgggcgtcagcacggcggtgaaactgctggcgccgcaatgccaggtcatcggcgtagagcccgaaggcgccgacgccatgcaccgcagctttgaaaccggcggccccgtcaagatgggctccatgcagagcatcgccgacagcctgatggcgccgcacaccgagcaatacagctacgaactgtgccgccgcaacgtcgaccgcctggtcaaggtgtccgacgatgaactgcgcgccgccatgcgcctgctgttcgaccagctcaagctggccaccgagccggcatgtgccaccgccacggccgcgctggtcggcgggctgaaggccgaactggccggcaagcgggttggcgtgctgctgtgcggcaccaacaccgacgccgccaccttcgcgcggcacctgggcctcggctga

SEQ ID NO: 31776 - protein, 326 aa, Burkholderia pickettii
MTQLDTTTLPDLSAIAGLRARLKQWVRTTPVFDKTDFEPVPGTAVNFKLELLQASGTFKARGAFSNLLALDDDQRAAGVTCVSAGNHAVGVAYAAMRLGIPAKVVMIKTASPARVALCRQYGAEVVLAENGQTAFDTVHRIESEEGRFFVHPFNGYRTVLGTATLGHEWLEQAGALDAVIVPIGGGGLMAGVSTAVKLLAPQCQVIGVEPEGADAMHRSFETGGPVKMGSMQSIADSLMAPHTEQYSYELCRRNVDRLVKVSDDELRAAMRLLFDQLKLATEPACATATAALVGGLKAELAGKRVGVLLCGTNTDAATFARHLGLG

SEQ ID NO: 31777 - DNA, 1779 bp, Arabidopsis thaliana
  CDS (1)..(1779)
atgaattccgttcagcttccgacggcgcaatcctctctccgtagccacattcaccgtccatcaaaaccagtggtcggattcactcacttctcctcccgttctcggatcgcagtggcggttctgtcccgagatgaaacatctatgactccaccgcctccaaagcttcctttaccacgtcttaaggtctctccgaattcgttgcaataccctgccggttacctcggtgctgtaccagaacgtacgaacgaggctgagaacggaagcatcgcggaagctatggagtatttgacgaatatactgtccactaaggtttacgacatcgccattgagtcaccactccaattggctaagaagctatctaagagattaggtgttcgtatgtatcttaaaagagaagacttgcaacctgtattctcgtttaagcttcgtggagcttacaatatgatggtgaaacttccagcagatcaattggcaaaaggagttatctgctcttcagctggaaaccatgctcaaggagttgctttatctgctagtaaactcggctgcactgctgtgattgttatgcctgttacgactcctgagataaagtggcaagctgtagagaatttgggtgcaagggttgttcttttcggagattcgtatgatcaagcacaagcacatgctaagatacgagctgaagaagagggtctgacgtttatacctccttttgatcaccctgatgttattgctggacaagggactgttgggatggagatcactcgtcaggctaagggtccattgcatgctatatttgtgccagttggtggtggtggtttaatagctggtattgctgcttatgtgaagagggtttctcccgaggtgaagatcattggtgtagaaccagctgacgcaaatgcaatggctttgtcgctgcatcacggtgagagggtgatattggaccaggttgggggatttgcagatggtgtagcagttaaagaagttggtgaagagacttttcgtataagcagaaatctaatggatggtgttgttcttgtcactcgtgatgctatttgtgcatcaataaaggatatgtttgaggagaaacggaacatattggaaccagcaggggctcttgcactcgctggagctgaggcatactgtaaatattatggcctaaaggacgtgaatgtcgtagccataaccagtggcgctaacatgaactttgacaagctaaggattgtgacagaactcgccaatgtcggtaggcaacaggaagctgttcttgctactctcatgccggaaaaacctggaagctttaagcaattttgtgagctggttggaccaatgaacataagcgagttcaaatatagatgtagctcggaaaaggaggctgttgtactatacagtgtcggagttcacacagctggagagctcaaagcactacagaagagaatggaatcttctcaactcaaaactgtcaatctcactaccagtgacttagtgaaagatcacctgcgttacttgatgggaggaagatctactgttggagacgaggttctatgccgattcacctttcccgagagacctggtgctctaatgaacttcttggactctttcagtccacggtggaacatcacccttttccattaccgtggacagggtgagacgggcgcgaatgtgctggtcgggatccaagtccccgagcaagaaatggaggaatttaaaaaccgagctaaagctcttggatacgactacttcttagtaagtgatgacgactattttaagcttctgatgcactga

SEQ ID NO: 31778 - protein, 592 aa, Arabidopsis thaliana
MNSVQLPTAQSSLRSHIHRPSKPVVGFTHFSSRSRIAVAVLSRDETSMTPPPPKLPLPRLKVSPNSLQYPAGYLGAVPERTNEAENGSIAEAMEYLTNILSTKVYDIAIESPLQLAKKLSKRLGVRMYLKREDLQPVFSFKLRGAYNMMVKLPADQLAKGVICSSAGNHAQGVALSASKLGCTAVIVMPVTTPEIKWQAVENLGARVVLFGDSYDQAQAHAKIRAEEEGLTFIPPFDHPDVIAGQGTVGMEITRQAKGPLHAIFVPVGGGGLIAGIAAYVKRVSPEVKIIGVEPADANAMALSLHHGERVILDQVGGFADGVAVKEVGEETFRISRNLMDGVVLVTRDAICASIKDMFEEKRNILEPAGALALAGAEAYCKYYGLKDVNVVAITSGANMNFDKLRIVTELANVGRQQEAVLATLMPEKPGSFKQFCELVGPMNISEFKYRCSSEKEAVVLYSVGVHTAGELKALQKRMESSQLKTVNLTTSDLVKDHLRYLMGGRSTVGDEVLCRFTFPERPGALMNFLDSFSPRWNITLFHYRGQGETGANVLVGIQVPEQEMEEFKNRAKALGYDYFLVSDDDYFKLLMH

SEQ ID NO: 31779 - DNA, 1080 bp, Mus musculus
  CDS (1)..(1080)
atggagggggccttggcagaacgcgtcggggcggagcctttccacagggtcacgcccctgctggagagctgggcgctgtctcaggtggcaggcatgccggtcttcctcaaatatgagaatgtgcagatagctggctcctttaagattcggggcatcggacatttctgccagcagatggccaagaggggatgcagacatctggtgtgctcctcagggggcaatgcgggcattgcggctgcatactcggctcgtaagctgggcatccccgtcaccatcgtgctcccagagggcacctccgtgcaggtggtgaggcggctcgagggggaaggggccgaggtccagctgactgggaaagtctgggatgaagccaatgtaaaagcacaagaactggccacaagggatggctgggtgaacgtctccccgtttgaccatccccttatatgggaaggccatgccagcctagtgcgggagctgaaggagtcactagggacccctccaggtgccgtggtgctggccgtggggggcggagggctcctggcaggtgtgactgctggcctgctggaggtgggctggcagcatgtgcccatcgttgccatggagacccgcggggcgcacagtttcaattcggccttgcaggcaggcaggccggtcaccctgccagacatcaccagtgtagccaagagcctcggagccaagacggtggctgcacggaccttggagtgtgcaaaggagtgtgaggtcctctctgaggtggtagaagaccgggaggctgtcagcgctgtgcagaggttcctggacgatgagcgcatgctggtggaacctgcctgcggtgccgccctggccgccatctactcgggcatcctgtggaggcttcaggctgagggccgcctgagttctgccctagcttccgttgtggtcatcgtgtgcggtggcaacaacattagtagccaacagcttcaggagctgaaaaccagctgggctgcattgaaaatctcaggaactcccccaaagttcctggacacctggtgggtcatcaagggacctcggttccagtggtcctgccctcttccttccaggtag

SEQ ID NO: 31780 - protein, 359 aa, Mus musculus
MEGALAERVGAEPFHRVTPLLESWALSQVAGMPVFLKYENVQIAGSFKIRGIGHFCQQMAKRGCRHLVCSSGGNAGIAAAYSARKLGIPVTIVLPEGTSVQVVRRLEGEGAEVQLTGKVWDEANVKAQELATRDGWVNVSPFDHPLIWEGHASLVRELKESLGTPPGAVVLAVGGGGLLAGVTAGLLEVGWQHVPIVAMETRGAHSFNSALQAGRPVTLPDITSVAKSLGAKTVAARTLECAKECEVLSEVVEDREAVSAVQRFLDDERMLVEPACGAALAAIYSGILWRLQAEGRLSSALASVVVIVCGGNNISSQQLQELKTSWAALKISGTPPKFLDTWWVIKGPRFQWSCPLPSR

SEQ ID NO: 31781 - DNA, 1809 bp, Oryza sativa
  CDS (1)..(1809)
atggcggccgccgccaccgccgcggccgcggccacctccaccttcaccgccgccgtgccgcgcgcgcgcgggcgcaggcatccaacgcgcgtggcggcggcggcggcggcgacggcgtcgtcaccggaggcggcgatggcggcggcggcgccgccgttgccgatgatgcgggtggcgcccgagacgctgcagcggcagagcgggtacctcgtgcggggccgcggggaggaggggattggggagggggaggcggaggcggtgggaggggacgcggcgggagggctcggcgcgatggagtacctgaccagcgtgctctcgtccaaggtgtacgacgtcgccatcgagtcgccgctccagctcgccaccaagctctccgagcgcctcggcgtcaacttgtggatcaagcgcgaggacctgcagcccgtattctcattcaagttgagaggagcatacaatatgatggcaaagctctcgcgtgaacagttggagaggggtgtcatctgctcctctgctgggaaccatgcccagggagtggccctttccgctcaaagactcggttgcgatgctgttattgtcatgcctgtgacaacgcctgaaatcaagtggcgatcggtggagagattgggtgcaacagttgtactcaaaggggactcatatgatgaagctcaatcatatgcaaaacaaagatgcgagcaggaaggccgcacattcatacctccttttgaccatcctgatgttataagtggacaaggaacgattggcatggaaattgttcggcagttgcaaggcccacttcatgccatatttgtacctgtaggaggaggtggattaattgctgggatcgctgcctatgtaaaaagggttcgcccagaggtgaaaataattggagtggagccatcagatgcaaatgcaatggcattgtccttgtgtcatggtcaaagggtcatgctggagcaagttggtgggtttgctgatggtgtggctgtcaaagttgtaggggaggaaacatttcgcttgtgccgggaacttgtagatggtattgttcttgtcagtcgagatgctatttgtgcttcaataaaggatatgtttgaggagaaaagaagcatacttgaacctgctggtgcccttgcgctggcaggagctgaagcttactgcaaatactatggcttgaaaggggaaaatgttgttgcaataactagtggagcaaatatgaactttgatcggctcagattagtaactgagctggctgatgttggtcgaaaacgagaagcagttcttgccacatttttgccagaggagcagggaagcttcaaaaagtttgcagagctggttggccggatgaatattactgaattcaaatacagatacgattgcaatgcaaaagatgcccttgtcctttacagtgttggcatctacactgacgatgaacttaaagcaatggtggaacgtatggaatcttcaaaattgagaactgttgatcttactgacaatgatttggcaaaggatcatctaagatactttattggtggcaggtcagaagtaacagatgaacttgtttaccggttcattttcccagaaaggcctggtgcacttatgaaatttttggatgcattcagcccccgctggaatatcagccttttccattaccgtgcacagggtgaaaccggagcgaatgttttggttggcatacaagtgccgccggaggagtttgacgaattcaagagccgtgctgacaatcttgggtacgagtacatgtcggagcagaacaacgagatataccggctcctcttgcgcgatccgaagatctaa

SEQ ID NO: 31782 - protein, 602 aa, Oryza sativa
MAAAATAAAAATSTFTAAVPRARGRRHPTRVAAAAAATASSPEAAMAAAAPPLPMMRVAPETLQRQSGYLVRGRGEEGIGEGEAEAVGGDAAGGLGAMEYLTSVLSSKVYDVAIESPLQLATKLSERLGVNLWIKREDLQPVFSFKLRGAYNMMAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEVKIIGVEPSDANAMALSLCHGQRVMLEQVGGFADGVAVKVVGEETFRLCRELVDGIVLVSRDAICASIKDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDELVYRFIFPERPGALMKFLDAFSPRWNISLFHYRAQGETGANVLVGIQVPPEEFDEFKSRADNLGYEYMSEQNNEIYRLLLRDPKI

SEQ ID NO: 31783 - DNA, 942 bp, Mus musculus
  CDS (1)..(942)
atggctgcccaggagtccctgcatgtgaagaccccacttcgtgacagcatggcgttgtccaaattggccggcaccagcgtgttcctaaaaatggacagctcccagccctcaggctccttcaagatccgaggcattgggcatctctgcaagatgaaagcaaaacaaggctgtagacattttgtctgttcttcagctggcaacgcgggcatggcgaccgcctacgctgccaggaggctgggcatcccagccactatcgttgtgcccaacaccacacctgccctcaccattgagcggctcaagaatgaaggcgccacagttgaagtggtgggagagatgctggatgaggccatccaagtggccaaggctctggaaaagaacaacccgggttgggtgtacatttccccctttgatgaccctctcatctgggaaggccacacttcccttgtgaaagagctgaaggagacgctgagcgccaagcccggggctatcgtgctgtctgtgggcggtggaggcctgctgtgcggagtggtccaggggctgcgggaggtgggctgggaggatgtgcccatcatcgccatggagacctttggcgcccacagcttccatgctgccatcaaggaaggaaagctggtcaccctgcccaagatcaccagtgtcgccaaggccttgggcgtgaacactgtcggggcgcagaccctgaagctgttttacgaacaccccattttctccgaggtcatctcagaccaggaggctgtgtctgctcttgagaagttcgtggacgatgagaagattctggtggagcccgcgtgcggcgcggcgctggctgctgtgtacagccgcgtggtgtgcaggctgcaggatgaaggccggctgcaaaccccactggcctcgctggttgtcatcgtgtgtggcggcagcaacacaagcctggcgcagctctag

SEQ ID NO: 31784 - protein, 313 aa, Mus musculus
MAAQESLHVKTPLRDSMALSKLAGTSVFLKMDSSQPSGSFKIRGIGHLCKMKAKQGCRHFVCSSAGNAGMATAYAARRLGIPATIVVPNTTPALTIERLKNEGATVEVVGEMLDEAIQVAKALEKNNPGWVYISPFDDPLIWEGHTSLVKELKETLSAKPGAIVLSVGGGGLLCGVVQGLREVGWEDVPIIAMETFGAHSFHAAIKEGKLVTLPKITSVAKALGVNTVGAQTLKLFYEHPIFSEVISDQEAVSALEKFVDDEKILVEPACGAALAAVYSRVVCRLQDEGRLQTPLASLVVIVCGGSNTSLAQL

SEQ ID NO: 31785 - DNA, 1806 bp, Nicotiana attenuata
  CDS (1)..(1806)
atggaagttctttgtcaagccccagctggaaactcaaattttgcctgtaaccccaaatttacagcaattagaaccagagcaatttctagcaatgacacatttaaagtaatttccagtactggcaacaacaagaaaatgaagggcgcgatacgtacttcgattccaaaaccatcagcattgccattgaaggtctcacaattatctccatcagctgattcaatgcctgttccagcgtctttgcaggacgtcgaggcggggaagttgatagagaataatccatcagggggcgatacagaggaattgtttcagtatcttgttgaaatattggcttctagagtgtatgatgtagcaattgattcccccttgcaaaatgcagctaagctttccaagaagcttggagttaacttttggatcaaaagagaggatatgcagtccgtgttctcgttcaagcttagaggagcttataacatgatgaccaaactctcaaaggagcagttagaaagaggggttataactgcttcagctggaaatcatgcacaaggtgttgcattaggtgctcagagacttaaatgtactgctacgattgtcatgcctgttaccacaccagagatcaagattgaagcagttaagaacttggatggtaaagtagttctacatggtgacacatttgataaagctcaggaacatgctttaaagttggctgaagatgaaggtctcacattcatcccgcctttcgatcacccagatgtgatcataggccaaggtacaattggaacggagattaatcgtcaacttaaagatatacatgcagtatttgtgcctgtaggaggaggaggtttaatagctggtgttgctgcatatttcaaaagggttgctcctcatacaaagattattggagttgagccatttggtgcaagttcaatgacacaatctttgtaccatggagaaagagtaaagttggaacaagttgataattttgcagatggcgtagctgttgcactagttggtgaagaaactttccgtctttgcaaagatttaatagacggaatggtcttagtcagtaacgatgctattagtgctgcagtaaaggatgtgtacgacgaaggacggaacatattagagacatcaggtgcacttgccatagctggagctgaagcttactgcaaatactataacataaagggcgaaaacgttgtagcaattgctagtggagccaatatggacttcagcaaactaaaattagtcgtcgatttagcagatattggtggacagagggaagctctgctggctacttttatgccagaagaaccaggaagcttcaaaaaattctgcgaacttgtgggacctatgaatattactgaatttaagtacagatataattctggaagaaaacaagctctggtactctacagtgttggtgttaatacaaaatcggatcttgagtcaatgttggagaggatgaaatcatcacagctgaatactgtcaatctcacaaataataatttggtcaaagaacatctaaggcatttgatgggaggcagatcagaaccaagtaatgagattttctgtcaattcatatttcctgagaagcctggagctttaaggaagtttttagatgctttcagccctcgttggaatataagtttgttccattatcgtgaacagggagaacttgatgcaagtgtgttagttggattccaagttccaaaaggtgagatagaagagttccgagttcaagctaacaatcttggttattcatatgaaatcgagagtctcaacgaggcttctcaacttataatggagtga

SEQ ID NO: 31786 - protein, 601 aa, Nicotiana attenuata
MEVLCQAPAGNSNFACNPKFTAIRTRAISSNDTFKVISSTGNNKKMKGAIRTSIPKPSALPLKVSQLSPSADSMPVPASLQDVEAGKLIENNPSGGDTEELFQYLVEILASRVYDVAIDSPLQNAAKLSKKLGVNFWIKREDMQSVFSFKLRGAYNMMTKLSKEQLERGVITASAGNHAQGVALGAQRLKCTATIVMPVTTPEIKIEAVKNLDGKVVLHGDTFDKAQEHALKLAEDEGLTFIPPFDHPDVIIGQGTIGTEINRQLKDIHAVFVPVGGGGLIAGVAAYFKRVAPHTKIIGVEPFGASSMTQSLYHGERVKLEQVDNFADGVAVALVGEETFRLCKDLIDGMVLVSNDAISAAVKDVYDEGRNILETSGALAIAGAEAYCKYYNIKGENVVAIASGANMDFSKLKLVVDLADIGGQREALLATFMPEEPGSFKKFCELVGPMNITEFKYRYNSGRKQALVLYSVGVNTKSDLESMLERMKSSQLNTVNLTNNNLVKEHLRHLMGGRSEPSNEIFCQFIFPEKPGALRKFLDAFSPRWNISLFHYREQGELDASVLVGFQVPKGEIEEFRVQANNLGYSYEIESLNEASQLIME

SEQ ID NO: 31787 - DNA, 1542 bp, Gamma
  CDS (1)..(1542): n means a or g or c or t/u, s means g or c
ttgagactaaaaattaaaaaaacaggttcttttaagaattcccagaagtacctaaagcttattcctaatgcatctgtttatgacgtagcattaaaatcacctataacatttgctctaaatatttcttcaaagctggggaataaagttttcctaaaaagagaggatctgcaacctatattttcttttaaaaacagaggagcgtataacaagattgtaaatttatccgatgccgaaaagaagaggggggttattgctgcatcagcaggaaatcatgctcaaggggtagccagtgcatgtaagaaattaaaaattaattgcttgatagttatgccaataacaactccagaaataaaaataaaagatgtaaaaagatttggagccaaaatactccaacatggggacaacgtagatgcagcattaaaagaggcactgtttattgcaaagaaaaaaaaattgtcttttgttcatccttttgacgaccctctaacaattgctggccaagggactataggacaagaaattcttgaagataaaaataattttgatgttgtctttgttccggtgggaggaggaggtattctagctggtgtatctgcctggatagcacagaataataagaaaataaaaattgttggtgttgaggttgaggattccgcttgtcttgctgaggccgtaaaagctaataaaagagttattttaaaagaagtgggcctctttgctgatggggtggcagtatcaagggttggaaaaaataattttgatgttattaaagagtgcgtagatgaagtcattacagttagcgttgatgaggtctgcaccgctgtaaaagatatctttgaagatacaagggttctatcagaacctgctggggcattagcacttgcagggttaaaagcctacgcaaggaaagttaaaaataaaaaacttattgctataagttctggcgctaatgtaaatttccaaagacttaattttattgttgagcgatcagagattggtgaaaatagagaaaaaatattaagtatcaaaatcccagagatacctggaagttttcttaagctttcaaggatgtttggcagctctcaagttacagagtttaactacaggaaatctagcttaagcgatgcatatgttttagttggtgttagaactaaaactgaaaaatcatttgaaatcttaaagtccaaattaaaaaaagcaggcttcacctttagcgactttactcgaaatgaaatatccaatgatcatctgaggcatatggttggtggcagaaatagtgactcaggctctcataacaatgaaagaatatttaggggagagtttcctgagaagccgggcgcgctgttaaattttctagagaaatttggaaataaatggmatatttccttatttcattacaggaacctaggttcagcttttggaaagatattaattggcatcgagagtaaggataaagacaagctaataaatcatttaaataagtcaggnactatttttacagaagaaacctctaacaaggcatacaaagattttttaaaatga

SEQ ID NO: 31788 - protein, 513 aa, Gamma
  Xaa in position 460 is unknown
MRLKIKKTGSFKNSQKYLKLIPNASVYDVALKSPITFALNISSKLGNKVFLKREDLQPIFSFKNRGAYNKIVNLSDAEKKRGVIAASAGNHAQGVASACKKLKINCLIVMPITTPEIKIKDVKRFGAKILQHGDNVDAALKEALFIAKKKKLSFVHPFDDPLTIAGQGTIGQEILEDKNNFDVVFVPVGGGGILAGVSAWIAQNNKKIKIVGVEVEDSACLAEAVKANKRVILKEVGLFADGVAVSRVGKNNFDVIKECVDEVITVSVDEVCTAVKDIFEDTRVLSEPAGALALAGLKAYARKVKNKKLIAISSGANVNFQRLNFIVERSEIGENREKILSIKIPEIPGSFLKLSRMFGSSQVTEFNYRKSSLSDAYVLVGVRTKTEKSFEILKSKLKKAGFTFSDFTRNEISNDHLRHMVGGRNSDSGSHNNERIFRGEFPEKPGALLNFLEKFGNKWXISLFHYRNLGSAFGKILIGIESKDKDKLINHLNKSGTIFTEETSNKAYKDFLK

SEQ ID NO: 31789 - DNA, 1113 bp, Bacillus halodurans
  CDS (1)..(1113): transl_table=11
atgcaagtggttcgctcgttcaaaatccgcggcgcgttccatcaaatttccagcattccgaaagaggaattaaacaacggggtcgtctgtgccagtgcaggaaatcacgcacaaggtgttgcgtattcctgtcacacgttgcaaattccggggaaaatttttatgccgacgacgacgccacggcaaaaagtagaccaagtcaaattcttcggtaaggaatatgtggaggtcatattaacaggggaaacgttcgatgattcttttaacgaagcgaaagagtacggaataaagcataaaatgacctttatccatccattcgatcaagaaaagattgttgcaggtcaaggaaccgttgggatggaaatcatgaacgatattgacgacaacattgattacttgttctgttcgattggtggaggcggccttattagtggtgttggaacatacattaaaagcattagcccgcggacgaaagtgatcggatgtgaaccggctggagcgccagccatgaaggaatcacttaagcaagggaaggttatcgagcttgaaaaaatcgacaaatttgtcgacggcgcagccgtaaaaaaggtcggagaaattccttttgaaatttgccaaaaaattctggaagatattgttctagtacctgagggaaaaatatgtacaaccatccttaacctctacaatcaagatgcgatcgtagcggagcctgcaggggcgatgccgattgctgcactcgacttttttaaagacgagatcaaaggaaagacagtcgtctgtgtgttaagtggtggaaacaacgatattggccggatgcaggaaatgagggaacgctcattgatctatgaaggattacagcattactttatcatccaatttccgcaacgagctggggcattgaaagaattcattcttgatgttctcggtccagatgatgacatcactcggtttgaatatacaaagaaaaacaataaatcaaatggccccgtattaatagggattgagctgaaatgtgatgaggactatcatcgtttaatggatcgtctcaacaaaaaaggttttgaatatcgtgaaattaataaaaatgagagtttgtttaacctgttaatttga

SEQ ID NO: 31790 - protein, 370 aa, Bacillus halodurans
MQVVRSFKIRGAFHQISSIPKEELNNGVVCASAGNHAQGVAYSCHTLQIPGKIFMPTTTPRQKVDQVKFFGKEYVEVILTGETFDDSFNEAKEYGIKHKMTFIHPFDQEKIVAGQGTVGMEIMNDIDDNIDYLFCSIGGGGLISGVGTYIKSISPRTKVIGCEPAGAPAMKESLKQGKVIELEKIDKFVDGAAVKKVGEIPFEICQKILEDIVLVPEGKICTTILNLYNQDAIVAEPAGAMPIAALDFFKDEIKGKTVVCVLSGGNNDIGRMQEMRERSLIYEGLQHYFIIQFPQRAGALKEFILDVLGPDDDITRFEYTKKNNKSNGPVLIGIELKCDEDYHRLMDRLNKKGFEYREINKNESLFNLLI

SEQ ID NO: 31791 - DNA, 1263 bp, Bacillus cereus
  CDS (1)..(1263): transl_table=11
atggtgcaaaaggtaaaggagagagtgaaaattgaagatatcttaatggctcataattgcatgaaagatatcgttattaaaacaccgttacaacgtgatacagttttatctgagaaatatgattgtgacgtttatgtaaaacgagaagatttacaattgattcgctctttcaaaattcgtggtgcgtacaatttaattcaaagcttaccgaaagaacaattacaaaacggtgttgtttgcgcaagcgctggtaatcacgcacaaggggtagcttttacgtgtaatttattgaagattccgtcaaaaatctttatgccaacaacgacgccgaaacaaaaagtatcgcaagtacaatttttcggtggtgatttcgcagagattgtattagttggtgatacattcgatagctcttttcaagaagcacagcgttattgtgaagaaaatagaatgacgtttgttcatccatttgatgatccgtatgtggttgctggtcaaggaacagtggcagttgaaattatgcatgatatggagaaaccagtggattatatctttacagcaattggcggcggtggattagcatcaggtgttggtacatatgtgaaaggtgttagtcctgctacaaaggttattggggtagagccaatgggagcagcatctatgaaagaggcttttcttcaaaacgataatgtcgcattggagaaaatagatagttttgttgatggagcagcagttaaaaaggtaggaaagttaacatttgaaacgtgtaaagatgtaattgatgacatcgttttagtaccagaaggaaaggtttgtacgacgattttagaactgtataagaaaaatgcgattgtagcagagcctgctggtgcactttctattgccgcacttgatctatacaaggatgaaattcaaggtaaaacagttgtatgcacattaagcggtggaaataacgatattgatagaatgcaagagatgaaagaacgttctctcatttacgaaggattaaaacattatttcatcattgaattcccgcagcgttcaggtgcgctaagagaatttcttgataaaggattaggaccagaagatgatattacgcgctttgagtatattaagaaacataataaggaaaatggtccagcgttagtcggagtagagttaaaacataaagaagattacgcgcagttaattacccgttttaaagaaaataacattcaatttatggagcttaataaaaatcctgttttgtttgatttacttatttaa

SEQ ID NO: 31792 - protein, 420 aa, Bacillus cereus
MVQKVKERVKIEDILMAHNCMKDIVIKTPLQRDTVLSEKYDCDVYVKREDLQLIRSFKIRGAYNLIQSLPKEQLQNGVVCASAGNHAQGVAFTCNLLKIPSKIFMPTTTPKQKVSQVQFFGGDFAEIVLVGDTFDSSFQEAQRYCEENRMTFVHPFDDPYVVAGQGTVAVEIMHDMEKPVDYIFTAIGGGGLASGVGTYVKGVSPATKVIGVEPMGAASMKEAFLQNDNVALEKIDSFVDGAAVKKVGKLTFETCKDVIDDIVLVPEGKVCTTILELYKKNAIVAEPAGALSIAALDLYKDEIQGKTVVCTLSGGNNDIDRMQEMKERSLIYEGLKHYFIIEFPQRSGALREFLDKGLGPEDDITRFEYIKKHNKENGPALVGVELKHKEDYAQLITRFKENNIQFMELNKNPVLFDLLI

SEQ ID NO: 31793 - DNA, 987 bp, Homo sapiens
  CDS (1)..(987)
atgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtagtgcccggcaccacacctgctctcaccattgagcgcctcaagaatgaaggtgccacatgcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggagtgtggctggggggacgtgcctgtcatcgccatggagacttttggtgcccacagcttccacgctgccaccaccgcaggcaaacttgtctccctgcccaagatcaccagtgttgccaaggccctgggcgtgaagactgtggggtctcaggccctgaagctgtttcaggaacaccccattttctctgaagttatctcggaccaggaggctgtggccgccattgagaagttcgtggatgatgagaagatcctggtggagcccgcctggggcgcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtga

SEQ ID NO: 31794 - protein, 328 aa, Homo sapiens
MMSGEPLHVKTPIRDSMALSKMAGTSVYLKMDSAQPSGSFKIRGIGHFCKRWAKQGCAHFVCSSAGNAGMAAAYAARQLGVPATIVVPGTTPALTIERLKNEGATCKVVGELLDEAFELAKALAKNNPGWVYIPPFDDPLIWEGHASIVKELKETLWEKPGAIALSVGGGGLLCGVVQGLQECGWGDVPVIAMETFGAHSFHAATTAGKLVSLPKITSVAKALGVKTVGSQALKLFQEHPIFSEVISDQEAVAAIEKFVDDEKILVEPAWGAALAAVYSHVIQKLQLEGNLRTPLPSLVVIVCGGSNISLAQLRALKEQLGMTNRLPK

SEQ ID NO: 31795 - DNA, 984 bp, Mus musculus
  CDS (1)..(984)
atggctgcccaggagtccctgcatgtgaagaccccacttcgtgacagcatggcgttgtccaaattggccggcaccagcgtgttcctaaaaatggacagctcccagccctcaggctccttcaagatccgaggcattgggcatctctgcaagatgaaagcaaaacaaggctgtagacattttgtctgttcttcagctggcaacgcgggcatggcgaccgcctacgctgccaggaggctgggcatcccagccactatcgttgtgcccaacaccacacctgccctcaccattgagcggctcaagaatgaaggcgccacagttgaagtggtgggagagatgctggatgaggccatccaagtggccaaggctctggaaaagaacaacccgggttgggtgtacatttccccctttgatgaccctctcatctgggaaggccacacttcccttgtgaaagagctgaaggagacgctgagcgccaagcccggggctatcgtgctgtctgtgggcggtggaggcctgctgtgcggagtggtccaggggctgcgggaggtgggctgggaggatgtgcccatcatcgccatggagacctttggcgcccacagcttccatgctgccatcaaggaaggaaagctggtcaccctgcccaagatcaccagtgtcgccaaggccttgggcgtgaacactgtcggggcgcagaccctgaagctgttttacgaacaccccattttctccgaggtcatctcagaccaggaggctgtgtctgctcttgagaagttcgtggacgatgagaagattctggtggagcccgcgtgcggcgcggcgctggctgctgtgtacagccgcgtggtgtgcaggctgcaggatgaaggccggctgcaaaccccactggcctcgctggttgtcatcgtgtgtggcggcagcaacataagcctggcgcagctgcaggcactcaaggtgcagctgggcctgaacgggctgcccgagtga

SEQ ID NO: 31796 - protein, 327 aa, Mus musculus
MAAQESLHVKTPLRDSMALSKLAGTSVFLKMDSSQPSGSFKIRGIGHLCKMKAKQGCRHFVCSSAGNAGMATAYAARRLGIPATIVVPNTTPALTIERLKNEGATVEVVGEMLDEAIQVAKALEKNNPGWVYISPFDDPLIWEGHTSLVKELKETLSAKPGAIVLSVGGGGLLCGVVQGLREVGWEDVPIIAMETFGAHSFHAAIKEGKLVTLPKITSVAKALGVNTVGAQTLKLFYEHPIFSEVISDQEAVSALEKFVDDEKILVEPACGAALAAVYSRVVCRLQDEGRLQTPLASLVVIVCGGSNISLAQLQALKVQLGLNGLPE

SEQ ID NO: 31797 - DNA, 1023 bp, Homo sapiens
  CDS (1)..(1023)
atgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccagagaaaatgttgcaaaaagagttacagaagaaacagaaggcatcatggtacatcccaaccaggagcctgcagtgatagctggacaagggacaattgccctggaagtgctgaaccaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaa

SEQ ID NO: 31798 - protein, 340 aa, Homo sapiens
MCAQYCISFADVEKAHINIRDSIHLTPVLTSSILNQLTGRNLFFKCELFQKTGSFKIRGALNAVRSLVPDALERKPKAVVTHSSGNHGQALTYAAKLEGIPAYIVVPQTAPDCKKLAIQAYGASIVYCEPSDESRENVAKRVTEETEGIMVHPNQEPAVIAGQGTIALEVLNQVPLVDALVVPVGGGGMLAGIAITVKALKPSVKVYAAEPSNADDCYQSKLKGKLMPNLYPPETIADGVKSSIGLNTWPIIRDLVDDIFTVTEDEIKCATQLVWERMKLLIEPTAGVGVAAVLSQHFQTVSPEVKNICIVLSGGNVDLTSSITWVKQAERPASYQSVSV

SEQ ID NO: 31799 - DNA, 1020 bp, Mus musculus
  CDS (1)..(1020)
atgtgtgctcagtactgcatctcctttgctgatgttgaaaaagctcatatcaacattcaagactctatccacctcaccccagtgctaacaagctccattttgaatcaaatagcagggcgcaatcttttcttcaaatgtgagctcttccagaaaactgggtcttttaagattcgaggtgcccttaatgccatcagaggcttaattcctgacacgccagaagagaagcccaaagccgtagttactcacagcagcggaaaccatggccaagctctcacctatgctgctaaactggaaggaattcctgcttacattgtggttccccaaacagctcccaactgcaagaaactggcaatccaagcctatggagcatcgatagtatactgtgacccaagtgacgagtccagagaaaaggtcactcaaagaattatgcaagaaacagaaggcatcttggtccatcccaaccaggagcctgcagtgatagctggacaaggaacaattgccctggaagtgctgaaccaggttcccttggtagatgcactggtggtaccagtaggaggaggaggaatggttgctggaatagccattacaattaaggccctgaaacctagtgtgaaggtatacgctgctgagccctcgaatgcagatgactgctaccagtctaaactgaaaggagaactgacccccaatcttcatcctccagaaaccatagcagatggtgtcaaatccagcattggcttgaatacctggcctattataagagaccttgtggatgatgtcttcactgtcaccgaagatgaaatcaagtatgcaacccagctggtgtgggggagaatgaaactgctcattgagccgactgctggcgtggcactggctgcagtgctgtctcagcatttccaaacagtctctccagaagtaaagaacgtctgcattgtactcagtggggggaatgtagacctaacctccctgaactgggtggggcaggctgaacggccagctccttaccagacggtttctgtttaa

SEQ ID NO: 31800 - protein, 339 aa, Mus musculus
MCAQYCISFADVEKAHINIQDSIHLTPVLTSSILNQIAGRNLFFKCELFQKTGSFKIRGALNAIRGLIPDTPEEKPKAVVTHSSGNHGQALTYAAKLEGIPAYIVVPQTAPNCKKLAIQAYGASIVYCDPSDESREKVTQRIMQETEGILVHPNQEPAVIAGQGTIALEVLNQVPLVDALVVPVGGGGMVAGIAITIKALKPSVKVYAAEPSNADDCYQSKLKGELTPNLHPPETIADGVKSSIGLNTWPIIRDLVDDVFTVTEDEIKYATQLVWGRMKLLIEPTAGVALAAVLSQHFQTVSPEVKNVCIVLSGGNVDLTSLNWVGQAERPAPYQTVSV

SEQ ID NO: 31801 - DNA, 1083 bp, Saccharomyces cerevisiae
  CDS (1)..(1083)
atgtcgatagtctacaataaaacaccattattacgtcaattcttccccggaaaggcttctgcacaatttttcttgaaatatgaatgccttcaaccaagtggctccttcaaaagtagaggaatcggtaatctcatcatgaaaagtgccattcgaattcaaaaggacggtaaaagatctcctcaggttttcgctagttctggcggtaatgccggttttgctgctgcaacagcatgtcaaagactgtctctaccatgtacagtcgtggttcctacagcgacaaagaagagaatggtagataaaatcaggaacaccggtgcccaggttatcgtgagtggtgcctactggaaagaagcagatacttttttaaaaacaaatgtcatgaataaaatagactctcaggtcattgagcccatttatgttcatcccttcgataatccggatatttgggaaggacattcatctatgatagatgaaatagtacaagatttgaaatcgcaacatatttccgtgaataaggttaaaggcatagtatgcagcgttggtggaggtggtttatacaatggtattattcaaggtttggaaaggtatggtttagctgataggatccctattgtgggggtggaaacgaatggatgtcatgttttcaatacttctttgaaaataggccaaccagttcaattcaagaagataacaagtattgctacttctctaggaacggccgtgatctctaatcaaactttcgaatacgctcgcaaatacaacaccagatccgttgtaatagaggacaaagatgttattgaaacctgtcttaaatatacacatcaattcaatatggtgattgaaccggcatgtggcgccgcattgcatttgggttacaacactaagatcctagaaaatgcactgggctcaaaattagctgcggatgacattgtgataattattgcttgtggcggctcctctaatactataaaggacttggaagaagcgttggatagcatgagaaaaaaagacactcctgtaatagaagtcgctgacaatttcatatttccagaaaaaaatattgtgaatttaaaaagtgcttga

SEQ ID NO: 31802 - protein, 360 aa, Saccharomyces cerevisiae
MSIVYNKTPLLRQFFPGKASAQFFLKYECLQPSGSFKSRGIGNLIMKSAIRIQKDGKRSPQVFASSGGNAGFAAATACQRLSLPCTVVVPTATKKRMVDKIRNTGAQVIVSGAYWKEADTFLKTNVMNKIDSQVIEPIYVHPFDNPDIWEGHSSMIDEIVQDLKSQHISVNKVKGIVCSVGGGGLYNGIIQGLERYGLADRIPIVGVETNGCHVFNTSLKIGQPVQFKKITSIATSLGTAVISNQTFEYARKYNTRSVVIEDKDVIETCLKYTHQFNMVIEPACGAALHLGYNTKILENALGSKLAADDIVIIIACGGSSNTIKDLEEALDSMRKKDTPVIEVADNFIFPEKNIVNLKSA

SEQ ID NO: 31803 - DNA, 1269 bp, Bacillus subtilis
  CDS (1)..(1269): transl_table=11
atgaaaccgttgcttaaagaaaactctctcatccaagtgaaacacattttgaaggctcaccaaaacgtaaaggacgttgtcattcacacacctttgcagaggaatgacagactttctgagagatatgaatgcaatatctatttaaaacgcgaagacttgcaagttgtcagatcttttaagctcagaggggcttatcataaaatgaaacagctttccagcgagcagacagagaacggagttgtgtgtgcaagtgccggaaaccacgctcaaggtgtggcattttcgtgtaaacatcttggcattcacgggaaaatttttatgccgtctactacaccgagacaaaaagtatctcaagttgaactattcggaaaaggatttatcgatattattttgacaggcgatacgtttgacgacgtgtataaaagcgctgctgaatgctgtgaggcggaatctcggacgtttatccatccgttcgatgatccggatgtgatggccggacagggaacgctcgcagtcgagattttaaacgacattgatacagaaccgcattttctttttgcaagtgtcggaggcggcggccttctctctggggtaggtacatatttgaaaaacgtgtctcctgatacaaaggtaattgctgttgagccggcgggagcggcatcctactttgaatcaaacaaagctgggcatgtcgtcacacttgataaaattgataagtttgtagatggggcggctgttaaaaaaattggcgaggaaaccttccggacgctggaaactgtcgttgatgacattctccttgtgcctgaaggaaaagtatgtacatccattcttgaattatataacgaatgtgcggttgttgctgaaccggctggagctctttctgtcgcagcgcttgatttgtacaaggatcaaattaaagggaaaaacgtggtgtgtgtggtaagcgggggcaataacgatatcggaagaatgcaggaaatgaaggagcgttccttgatttttgaaggccttcagcattattttatcgtcaattttccacaaagagcgggggcgctccgcgaatttcttgacgaagtcctcgggccgaatgatgacattacaaggtttgaatatacgaagaaaaataataaaagcaatggacctgctcttgtcggcatcgagctgcagaacaaagccgattatgggccgctgattgaacggatgaacaaaaaaccgtttcattatgtagaggtgaacaaggatgaggacttgttccatttgctaatctaa

SEQ ID NO: 31804 - protein, 422 aa, Bacillus subtilis
MKPLLKENSLIQVKHILKAHQNVKDVVIHTPLQRNDRLSERYECNIYLKREDLQVVRSFKLRGAYHKMKQLSSEQTENGVVCASAGNHAQGVAFSCKHLGIHGKIFMPSTTPRQKVSQVELFGKGFIDIILTGDTFDDVYKSAAECCEAESRTFIHPFDDPDVMAGQGTLAVEILNDIDTEPHFLFASVGGGGLLSGVGTYLKNVSPDTKVIAVEPAGAASYFESNKAGHVVTLDKIDKFVDGAAVKKIGEETFRTLETVVDDILLVPEGKVCTSILELYNECAVVAEPAGALSVAALDLYKDQIKGKNVVCVVSGGNNDIGRMQEMKERSLIFEGLQHYFIVNFPQRAGALREFLDEVLGPNDDITRFEYTKKNNKSNGPALVGIELQNKADYGPLIERMNKKPFHYVEVNKDEDLFHLLI

SEQ ID NO: 31805 - DNA, 1773 bp, Cicer arietinum
  CDS (1)..(1773)
atgctctcgacctccacgaccaattcttccattctgcccttccggtctagggcaagtagttctacttttatcgcgcgccccccagccaacttcaactccatctttacgacttcggtgagggtcttcccaatcagtatgtcacgatattgcgtttttccacatacttgggagcgagatcataacgttcctggagttcctggagttttacgaaaagtggttccagcagcacctattaagaacaaaccaacttgtgcagattcagatgagttacctgagtacttaagagacgtactacgctcacctgtttacgacgtagttgtcgagtcacctgtcgagctaactgagagattatcagatcgcttaggtgttaacttttacgttaaaagagaggatcgccaacgcgttttttcatttaaattacgcggtccatacaatatgatgtcatcattatcacatgaggaaattgataaaggtgttatcaccgcatcagcaggaaaccatgcacaaggagtcccatttccatttccaggaagacgcctaaaatgtgtcgcaaaaattgtcatgccaactactactccaaacattaaacttgatggtgtccgcgcactaggagcagatgttgtattatggggtcatacttttgatgaggcaaaaacccatgctgtcgagttatgtgagaaggatggattaagaactattcctccatttgaggatccagcagtaattaaaggacaaggtactattggaagtgagattaacagacaaattaaacgcattgacgcagtttttgtacctgttggtggaggtggtttaattgctggcgttgcagcatttttcaaacaaattgctccacaaactaaaattattgtagttgagccatatgatgcagcatcaatggcattatcagttcatgcagagcacagagcaaaattatcaaatgtcgatacttttgcagacggtgcaactgtcgccgtaattggtgagtatacttttgcaagatgccaagacgttgttgatgcaatggttctagttgcaaacgatggaattggtgcagcaataaaggatgtttttgatgagggtcgaaacatagttgagacttcaggtgcagcgggcattgcaggaatgtattgtgagatgtacagaataaagaatgacaacatggtgggaattgtaagcggagctaacatgaacttcagaaaactccataaggtttcagaattagcagtgttgggttcaggacacgaggcattattgggtacttatatgccaggtcaaaaaggatgttttaaaactatggcaggtttagttcatggatcactctcatttactgagattacttacagatttacttcacatcgcagatcgatactggtactaatgcttaagctcgagccatggcggtatattgagaaaatgattgaaatgatgaaatatagtggtgttactgttttaaacatttcacataacgagttagcagttattcatggtaaacatttagtcggaggatcagcaaaagtctcagatgaggtctttgtagagtttataattccagagaaagcagatctaaaaaaatttctagaggtattatcacctcattggaaccttactttatacaggtaccgcaaccaaggagacttaaaagcaacgattttaatggtcatagctagtttcctgtgtgaaattgttatccgtaaaaaccaaattgatgatttaggatacccatatgaaattgatcaatacaacgacgcatttaacttagcggtaacagagtaa

SEQ ID NO: 31806 - protein, 590 aa, Cicer arietinum
MLSTSTTNSSILPFRSRASSSTFIARPPANFNSIFTTSVRVFPISMSRYCVFPHTWERDHNVPGVPGVLRKVVPAAPIKNKPTCADSDELPEYLRDVLRSPVYDVVVESPVELTERLSDRLGVNFYVKREDRQRVFSFKLRGPYNMMSSLSHEEIDKGVITASAGNHAQGVPFPFPGRRLKCVAKIVMPTTTPNIKLDGVRALGADVVLWGHTFDEAKTHAVELCEKDGLRTIPPFEDPAVIKGQGTIGSEINRQIKRIDAVFVPVGGGGLIAGVAAFFKQIAPQTKIIVVEPYDAASMALSVHAEHRAKLSNVDTFADGATVAVIGEYTFARCQDVVDAMVLVANDGIGAAIKDVFDEGRNIVETSGAAGIAGMYCEMYRIKNDNMVGIVSGANMNFRKLHKVSELAVLGSGHEALLGTYMPGQKGCFKTMAGLVHGSLSFTEITYRFTSHRRSILVLMLKLEPWRYIEKMIEMMKYSGVTVLNISHNELAVIHGKHLVGGSAKVSDEVFVEFIIPEKADLKKFLEVLSPHWNLTLYRYRNQGDLKATILMVIASFLCEIVIRKNQIDDLGYPYEIDQYNDAFNLAVTE

SEQ ID NO: 31807 - DNA, 1311 bp, Corynebacterium glutamicum
  CDS (1)..(1311): transl_table=11
atgagtgaaacatacgtgtctgagaaaagtccaggagtgatggctagcggagcggagctgattcgtgccgccgacattcaaacggcgcaggcacgaatttcctccgtcattgcaccaactccattgcagtattgccctcgtctttctgaggaaaccggagcggaaatctaccttaagcgtgaggatctgcaggatgttcgttcctacaagatccgcggtgcgctgaactctggagcgcagctcacccaagagcagcgcgatgcaggtatcgttgccgcatctgcaggtaaccatgcccagggcgtggcctatgtgtgcaagtccttgggcgttcagggacgcatctatgttcctgtgcagactccaaagcaaaagcgtgaccgcatcatggttcacggcggagagtttgtctccttggtggtcactggcaataacttcgacgaagcatcggctgcagcgcatgaagatgcagagcgcaccggcgcaacgctgatcgagcctttcgatgctcgcaacaccgtcatcggtcagggcaccgtggctgctgagatcttgtcgcagctgacttccatgggcaagagtgcagatcacgtgatggttccagtcggcggtggcggacttcttgcaggtgtggtcagctacatggctgatatggcacctcgcactgcgatcgttggtatcgaaccagcgggagcagcatccatgcaggctgcattgcacaatggtggaccaatcactttggagactgttgatccctttgtggacggcgcagcagtcaaacgtgtcggagatctcaactacaccatcgtggagaagaaccagggtcgcgtgcacatgatgagcgcgaccgagggcgctgtgtgtactgagatgctcgatctttaccaaaacgaaggcatcatcgcggagcctgctggcgcgctgtctatcgctgggttgaaggaaatgtcctttgcacctggttctgtcgtggtgtgcatcatctctggtggcaacaacgatgtgctgcgttatgcggaaatcgctgagcgctccttggtgcaccgcggtttgaagcactacttcttggtgaacttcccgcaaaagcctggtcagttgcgtcacttcctggaagatatcctgggaccggatgatgacatcacgctgtttgagtacctcaagcgcaacaaccgtgagaccggtactgcgttggtgggtattcacttgagtgaagcatcaggattggattctttgctggaacgtatggaggaatcggcaattgattcccgtcgcctcgagccgggcacccctgagtacgaatacttgacctaa

SEQ ID NO: 31808 - protein, 436 aa, Corynebacterium glutamicum
MSETYVSEKSPGVMASGAELIRAADIQTAQARISSVIAPTPLQYCPRLSEETGAEIYLKREDLQDVRSYKIRGALNSGAQLTQEQRDAGIVAASAGNHAQGVAYVCKSLGVQGRIYVPVQTPKQKRDRIMVHGGEFVSLVVTGNNFDEASAAAHEDAERTGATLIEPFDARNTVIGQGTVAAEILSQLTSMGKSADHVMVPVGGGGLLAGVVSYMADMAPRTAIVGIEPAGAASMQAALHNGGPITLETVDPFVDGAAVKRVGDLNYTIVEKNQGRVHMMSATEGAVCTEMLDLYQNEGIIAEPAGALSIAGLKEMSFAPGSVVVCIISGGNNDVLRYAEIAERSLVHRGLKHYFLVNFPQKPGQLRHFLEDILGPDDDITLFEYLKRNNRETGTALVGIHLSEASGLDSLLERMEESAIDSRRLEPGTPEYEYLT

SEQ ID NO: 31809 - DNA, 1545 bp, Escherichia coli
  CDS (1)..(1545): transl_table=11
atggctgactcgcaacccctgtccggtgctccggaaggtgccgaatatttaagagcagtgctgcgcgcgccggtttacgaggcggcgcaggttacgccgctacaaaaaatggaaaaactgtcgtcgcgtcttgataacgtcattctggtgaagcgcgaagatcgccagccagtgcacagctttaagctgcgcggcgcatacgccatgatggcgggcctgacggaagaacagaaagcgcacggcgtgatcactgcttctgcgggtaaccacgcgcagggcgtcgcgttttcttctgcgcggttaggcgtgaaggccctgatcgttatgccaaccgccaccgccgacatcaaagtcgacgcggtgcgcggcttcggcggcgaagtgctgctccacggcgcgaactttgatgaagcgaaagccaaagcgatcgaactgtcacagcagcaggggttcacctgggtgccgccgttcgaccatccgatggtgattgccgggcaaggcacgctggcgctggaactgctccagcaggacgcccatctcgaccgcgtatttgtgccagtcggcggcggcggtctggctgctggcgtggcggtgctgatcaaacaactgatgccgcaaatcaaagtgatcgccgtagaagcggaagactccgcctgcctgaaagcagcgctggatgcgggtcatccggttgatctgccgcgcgtagggctatttgctgaaggcgtagcggtaaaacgcatcggtgacgaaaccttccgtttatgccaggagtatctcgacgacatcatcaccgtcgatagcgatgcgatctgtgcggcgatgaaggatttattcgaagatgtgcgcgcggtggcggaaccctctggcgcgctggcgctggcgggaatgaaaaaatatatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttag

SEQ ID NO: 31810 - protein, 514 aa, Escherichia coli [sequence omitted]

SEQ ID NO: 31811 - DNA, 1251 bp, Lactococcus lactis
  CDS (1)..(1251): transl_table=11
atgataagtgccaaagaggttgaagatgcctatgatttgttaaaagcagttgtcactaaaacacctttacaattagacccctacctttccaataaatatcaagcaaatatttacttaaaagaagaaaatttacagaaagttcgttcttttaaattacgaggagcttattattctatcagtaaattatctgatgagcaacgctctaaaggagtggtttgtgcctccgcaggtaatcacgcacaaggagttgcttttgctgcaaatcaattaaatatttctgcgacaattttcatgcccgttactacacctaaccaaaaaatttcacaagttaaattttttggcgaaagtcatgtaacaattcgtttaattggtgatacttttgatgaatcagccagagcagcaaaagctttttctcaagataatgacaaaccatttatagacccttttgatgatgaaaatgtaattgctggtcaagggacagtggctttagaaatttttgcgcaagctaaaaaacaaggaataagtttagataagatttttgtacagattggtggaggtggtttaattgcaggaattacggcctacagtaaggagcgctatccccaaactgaaattattggagttgaagcaaaaggggcaacaagtatgaaagctgcctactctgctggtcagcccgtcaccttggaacacattgataaatttgctgacggaattgcggttgcgactgttggtcagaaaacttaccaacttattaatgacaaagtgaaacaattgcttgcggttgatgaaggtttaatttctcaaaccatactcgaattgtattcaaaattaggaattgtcgccgaaccagcaggtgcaacatctgttgccgcacttgaacttattaaagatgaaatcaagggtaaaaatattgtctgtatcatcagcggcggaaataatgatattagtcgaatgcaagaaattgaagaaagagctttggtttatgaaggtctaaaacattattttgtcattaactttcctcaaagaccaggagccttaagaacttttgtcagtgatattttagggccaaatgatgatattacccgatttgagtacatcaaaagggctgataaaggtaaagggccttgtcttgttgggattttactttcagatgctagtgattatgattcattgattgatcggattgaaagatttgataatcgttatgttaacttacatggaaatgatagtttatacgaacttttggtctaa

SEQ ID NO: 31812 - protein, 416 aa, Lactococcus lactis
MISAKEVEDAYDLLKAVVTKTPLQLDPYLSNKYQANIYLKEENLQKVRSFKLRGAYYSISKLSDEQRSKGVVCASAGNHAQGVAFAANQLNISATIFMPVTTPNQKISQVKFFGESHVTIRLIGDTFDESARAAKAFSQDNDKPFIDPFDDENVIAGQGTVALEIFAQAKKQGISLDKIFVQIGGGGLIAGITAYSKERYPQTEIIGVEAKGATSMKAAYSAGQPVTLEHIDKFADGIAVATVGQKTYQLINDKVKQLLAVDEGLISQTILELYSKLGIVAEPAGATSVAALELIKDEIKGKNIVCIISGGNNDISRMQEIEERALVYEGLKHYFVINFPQRPGALRTFVSDILGPNDDITRFEYIKRADKGKGPCLVGILLSDASDYDSLIDRIERFDNRYVNLHGNDSLYELLV

SEQ ID NO: 31813 - DNA, 1788 bp, Lycopersicon esculentum
  CDS (1)..(1788)
atggaattcctttgtttagccccaacacgtagtttttccaccaatcccaaattaacaaaaagtattcctagcgatcatactagtaccacgagtcgtattttcacataccaaaacatgcgtggctcaacgatgagaccattagcgttgccgttaaaaatgtcaccaattgtttctgtgccggatattacagctccggtggaaaatgttccggctatcttgccaaaagtcgttcccggagagttgatagtgaataaaccaacggggggcgatagcgatgaattgtttcaatatttagttgatattttggcatcgccagtgtatgatgtagcgatcgaatcgccattagagctagcagagaagctctcggataggctcggagttaatttttatatcaaaagagaagataaacagagggtgttttcattcaagcttagaggagcttacaacatgatgagtaacctctcaagggaggaattagataaaggggttataacagcatcagctggaaatcatgcacaaggtgtagcattagctggtcaaagacttaactgtgtagctaaaattgtcatgcctacaaccaccccacaaatcaagattgatgcggttagagccctgggaggtgatgtagttctttatggtaaaacatttgatgaagctcaaacacacgcgctggaattgagtgaaaaagacgggctcaaatacatcccaccattcgatgatccaggagtcatcaaaggccaaggtacaattggaacagagataaaccgtcaactgaaggacattcacgctgtgtttatacctgttggtggtgggggtttgatagctggtgttgctacctttttcaaacaaattgccccaaatacaaaaattattggagttgagccatatggtgcagcttcaatgacattgtcattgcatgaaggacatagagtgaaattatcaaatgttgatacttttgctgacggtgtagctgttgcactagttggtgaatacacttttgcaaaatgccaagagttaattgatggaatggtacttgttgcaaatgatggtattagtgctgcaataaaggatgtgtatgatgaaggaaggaacatattagagacatcaggtgcagtggccatagctggagctgcagcctattgtgaattttataaaataaaaaatgaaaatattgtagcaattgcaagtggagctaatatggatttcagcaaactacacaaagttacagagttagcagggttaggttcaggcaaagaggctttattggctacttttatggtagaacaacaaggaagcttcaagacatttgttggacttgtgggctctttgaattttactgaattgacatacagattcacttctgaaaggaaaaatgctctaattttgtacagggttaatgttgataaagaatcagatcttgaaaaaatgattgaggatatgaaatcatcaaatatgactactcttaatctctcacataatgaattggttgtagaccatctaaaacatttggttggtggctcagcaaatatcagtgatgaaattttcggtgaatttattgtacctgagaaggctgaaactttaaaaacattcttagacgctttctcccctcgttggaatataactttatgccgttaccgtaatcagggagatataaatgcaagtttgttgatgggattccaagttcctcaagctgagatggatgagttcaaaaatcaagctgataagcttggttatccatatgaacttgataattataatgaggcttttaaccttgtagtaagtgagtga

SEQ ID NO: 31814 - protein, 595 aa, Lycopersicon esculentum
MEFLCLAPTRSFSTNPKLTKSIPSDHTSTTSRIFTYQNMRGSTMRPLALPLKMSPIVSVPDITAPVENVPAILPKVVPGELIVNKPTGGDSDELFQYLVDILASPVYDVAIESPLELAEKLSDRLGVNFYIKREDKQRVFSFKLRGAYNMMSNLSREELDKGVITASAGNHAQGVALAGQRLNCVAKIVMPTTTPQIKIDAVRALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSKLHKVTELAGLGSGKEALLATFMVEQQGSFKTFVGLVGSLNFTELTYRFTSERKNALILYRVNVDKESDLEKMIEDMKSSNMTTLNLSHNELVVDHLKHLVGGSANISDEIFGEFIVPEKAETLKTFLDAFSPRWNITLCRYRNQGDINASLLMGFQVPQAEMDEFKNQADKLGYPYELDNYNEAFNLVVSE

SEQ ID NO: 31815 - DNA, 1290 bp, Mycobacterium bovis
  CDS (1)..(1290): transl_table=11
gtgtccgccgaactgagccagagcccgagcagctcgccgctgttttcactatctggggcagacatcgaccgtgccgccaagcggatcgcaccggtagtcacgcccaccccgttgcaacctagcgatcggttgtcggcgatcactggcgccacggtctacctcaagcgcgaagacttgcagacggtgcgctcttataagctacgcggagcgtacaacctgttggtgcagttgtccgatgaggaactggccgcgggcgtggtgtgttcttctgcgggcaaccacgcgcagggcttcgcgtatgcgtgtcgctgtctgggtgtgcacggccgggtctacgtacctgccaaaacccccaagcagaagcgtgaccggatccgctaccacggcggggagttcatcgacctgatcgtgggtgggtcgacctatgatctggctgcggcggcggcccttgaggacgtggaacgcaccggggccacgctggtaccgccgtttgacgacctgcgcaccatcgccggccagggcacgatagccgtcgaagtgcttggccagctcgaggacgagccggacctggtggtggtcccggtgggtggcggcggctgcatcgcggggatcaccacctacctggccgagcggacgaccaacaccgcggtgctgggcgtcgagccggctggtgcggccgccatgatggccgcgctcgcggcgggcgagccggtgacgctggaccatgtcgaccagttcgtcgacggcgccgcggtgaaccgggcgggcacgctgacctatgccgcgctagccgccgccggcgacatggtttcgctcaccaccgtcgacgagggtgcggtgtgcacggcgatgctcgatctgtatcagaacgagggcatcatcgccgaaccggccggtgccctgtcggtcgccggtctgttggaagccgacatcgagcccgggtccaccgtggtgtgcctgatttcgggcggcaacaacgacgtgtcccgttacggggaggtgttggagcgctcgctggtccacctgggcctcaagcactatttcctggtcgacttcccgcaggagcccggtgcgctgcgccggtttctcgacgacgtgctcggacccaacgacgacatcaccttgttcgagtacgtcaagcgcaacaaccgggagaccggtgaggcgctggtgggtatcgagctgggatcggccgcggatctagacggtctgctggcccggatgcgggcgaccgacattcacgtcgaggcgttggaaccggggtcgccggcttaccgctatctgctgtag

SEQ ID NO: 31816 - protein, 429 aa, Mycobacterium bovis
MSAELSQSPSSSPLFSLSGADIDRAAKRIAPVVTPTPLQPSDRLSAITGATVYLKREDLQTVRSYKLRGAYNLLVQLSDEELAAGVVCSSAGNHAQGFAYACRCLGVHGRVYVPAKTPKQKRDRIRYHGGEFIDLIVGGSTYDLAAAAALEDVERTGATLVPPFDDLRTIAGQGTIAVEVLGQLEDEPDLVVVPVGGGGCIAGITTYLAERTTNTAVLGVEPAGAAAMMAALAAGEPVTLDHVDQFVDGAAVNRAGTLTYAALAAAGDMVSLTTVDEGAVCTAMLDLYQNEGIIAEPAGALSVAGLLEADIEPGSTVVCLISGGNNDVSRYGEVLERSLVHLGLKHYFLVDFPQEPGALRRFLDDVLGPNDDITLFEYVKRNNRETGEALVGIELGSAADLDGLLARMRATDIHVEALEPGSPAYRYLL

SEQ ID NO: 31817 - DNA, 1284 bp, Mycobacterium leprae
  CDS (1)..(1284): transl_table=11
atgtccgccgaacctagtagaaaccccaggaccccaccggtgtccgcggttgacattgacggtgcggcgaagcggatcgcgccggtggtcacgcctaccccgttgcaacttagcgatcggttgtcggcgatcactggtgcagcggtgtacctcaagcgtgaagacctgcagacggtgcgctcttacaaactgcgcggcgcctacaacctgttggtgcagctgaccgacgaggagatcgccgccggcgttgtgtgctcttcggcgggtaaccatgcacagggtgtcgcgtatgcatgtcggtcactgggtgtgcacggccgtgtctatgtacctgccaagacacccaaacaaaagtgggatcggatccgctaccatggcggggcattcatcgagctgatcgtcgggagatcgacctacgatctcgccgctgccgcggcggtcgacgacattgaacgcaccggcgcgacgttggtacctccttatgacgacgtccgcgtcatcgctggtcagggcaccattgccgtcgagttgctggagcaactcaacaccgagcctgacctagtggtggtcccggtgggcggcggtggctgcatcgccggcatgaccacttacttggccgaacgaacggcgaacactgctgtgcttggtgtcgagccggctggtgccgcggctatgatggccgcgctggccgcgggtgagccggtgacactggactacgtcgatcagttcgtggatggcgctgcggtgaaccgggtgggaacgttgccttatgccgcgttgactgccgcaggtgacatggtgtccatcaccaccgtcgacgagggggcggtgtgcactgcgatgctcgacctttaccagaacgagggcattatagctgagccggcgggcgcactgtcagtagctgggctgctggaaactgacattgaacccgggtccaccgtggtttgcctgatctcgggcggcaacaacgacgtattgcgctacggtgaggtgttggagcgttcgctgatccacctaggtctcaaacactatttcctggtagacttcccccagaagcctggtgccttgcgccgttttcttgacgaagtgcttggacccaacgacgacatcaccttgttcgagtacgtcaagcgcaacaaccgagagaccggcgaggcgctggtaggtatccagctggggtctgctgtcgacttagacgtcctgctggcccggatgcaggggaccgaaatgcacgtcgaaaccctacaaccaggttcgccggcctaccgctacctgttgctttag

SEQ ID NO: 31818 - protein, 427 aa, Mycobacterium leprae
MSAEPSRNPRTPPVSAVDIDGAAKRIAPVVTPTPLQLSDRLSAITGAAVYLKREDLQTVRSYKLRGAYNLLVQLTDEEIAAGVVCSSAGNHAQGVAYACRSLGVHGRVYVPAKTPKQKWDRIRYHGGAFIELIVGRSTYDLAAAAAVDDIERTGATLVPPYDDVRVIAGQGTIAVELLEQLNTEPDLVVVPVGGGGCIAGMTTYLAERTANTAVLGVEPAGAAAMMAALAAGEPVTLDYVDQFVDGAAVNRVGTLPYAALTAAGDMVSITTVDEGAVCTAMLDLYQNEGIIAEPAGALSVAGLLETDIEPGSTVVCLISGGNNDVLRYGEVLERSLIHLGLKHYFLVDFPQKPGALRRFLDEVLGPNDDITLFEYVKRNNRETGEALVGIQLGSAVDLDVLLARMQGTEMHVETLQPGSPAYRYLLL

SEQ ID NO: 31819 - DNA, 1542 bp, Pasteurella multocida
  CDS (1)..(1542): transl_table=11
atggtcaataacctccattcagctcacccaacaggtgcagaatacctcaaagccgtgttgagttctaaagtctatgacgtggcgcaagtgactccgcttcaagacatggcaaaactgtctgaacgtttaggtaataaagtgtttatcaaacgtgaagatcgccaacccgtacacagtttcaaactgcgtggtgcgtatgccatgattgctggcttaagtgccgaacaaaaagcctcgggcgtgattgccgcctcagcgggaaaccatgcacaaggcgtggcgctgtctgccaaacatcttggcttgcgtgccttaatcgtgatgccacaaaacaccccaagtatcaaagtcgatgccgtgcgtggatttggtggtgaagtgctattacatggcgccaatttcgatgaagccaaagccaaagcgattgaattggcggaaagcaaaaatatgacattcattccgccttttgatcaccccgcggtgattgcaggacaaggctcgattgccatggaattgttacaacaaaacagccaaattgatcgtatttttgtccctgttggtggcggtggcttagccgcaggcattgctgtattaattaaacaattaatgcccgaaatcaaagtaattggggttgagtcgaaagattccgcctgcttgtatcgtgctctcaaagcaggtaagcccattgatttagatcgcgttggcttatttgctgacggggtcgcagtgaaacgtattggcgatgagactttccgcgtttgtcagcaatatattgatgatgtagtgttagtagatggtgatgaaatctgcgctgcggtcaaagatatttttgagaatgtgcgcgctattgctgaaccgtcgggggcattatcgcttgctggtttaaaaaaatacgtgaaagagcacaatattcaaggtgaaaccttggtgaatgtattatctggtgccaatttaaatttccataccttacgttatgtgtcagagcgttgtgaaattggtgaacagcacgaagcccttttagccgtgaccattcctgaacaaccagggagtttcttaaaattctgccatattttaggtcatgtccctgttactgaatttaaataccgttatgccgacgacaaacaagcttgtattttcgtgggggtacgcattacagggcaagaagaaaaacaaacgatcatcaatcaattacaacaaaatggttatgatttaattgatttgtctaatgatgatatcgccaaaacgcatgtacgctatatgattggcggacgttcaaacagtcccttaaaagagcgtttatacagttttgaattcccagaacaaaaaggcgccttattaaaattcctcgaaactttggggcaaacacattggaatatttccgtgttccattatcgtgcgcacggggcagattacggtaacgtgcttgctggcttccaattaaatgatgaagatctcgacgcctttaatcagcatttggaaaaactgggttatgtctatcaagatgtcacagaaagccctgcttatcgttatttcttagtgtaa

SEQ ID NO: 31820 - protein, 513 aa, Pasteurella multocida
MVNNLHSAHPTGAEYLKAVLSSKVYDVAQVTPLQDMAKLSERLGNKVFIKREDRQPVHSFKLRGAYAMIAGLSAEQKASGVIAASAGNHAQGVALSAKHLGLRALIVMPQNTPSIKVDAVRGFGGEVLLHGANFDEAKAKAIELAESKNMTFIPPFDHPAVIAGQGSIAMELLQQNSQIDRIFVPVGGGGLAAGIAVLIKQLMPEIKVIGVESKDSACLYRALKAGKPIDLDRVGLFADGVAVKRIGDETFRVCQQYIDDVVLVDGDEICAAVKDIFENVRAIAEPSGALSLAGLKKYVKEHNIQGETLVNVLSGANLNFHTLRYVSERCEIGEQHEALLAVTIPEQPGSFLKFCHILGHVPVTEFKYRYADDKQACIFVGVRITGQEEKQTIINQLQQNGYDLIDLSNDDIAKTHVRYMIGGRSNSPLKERLYSFEFPEQKGALLKFLETLGQTHWNISVFHYRAHGADYGNVLAGFQLNDEDLDAFNQHLEKLGYVYQDVTESPAYRYFLV

SEQ ID NO: 31821 - DNA, 1545 bp, Salmonella typhimurium
  CDS (1)..(1545): transl_table=11
atggcggaatctcaacctctgtcagtcgcgccggaaggggcggagtatctgcgcgcggtgctacgcgcgccagtatacgaagcggcgcaggtgacaccgctgcaaaaaatggaaaagctctcgtcacgtctggacaacgttattctcgtcaaacgcgaagaccggcagccggtacatagctttaagctgcgcggcgcttacgcgatgatggccggattgaccgaagaacaaaaagcccacggcgtgattaccgcgtcggcggggaaccatgcacagggcgtggcgttttcctccgcgcggcttggcgtgaagtcgctgatcgtcatgccaaaagcaacggcggatattaaagtcgatgcggtacgcggttttggcggcgaagtgctgttgcacggcgctaattttgatgaagcgaaagcgaaagctattgaactggcgcagcagcagggttttacttgggtgccgccgtttgatcacccaatggtgatcgccgggcagggcacgctggcgctggaactgcttcagcaggattcgcatctcgatcgtgtctttgtgccggttggcggcggcggcctggcggcgggcgtagcggtactgatcaaacaattgatgccgcaaatcaaagtgattgccgtcgaagcggaggattccgcctgcctgaaagcggcgttggaagccggtcatccagtggatctcccgcgcgttgggttgtttgctgaaggcgtagcggtaaaacgcatcggcgacgaaaccttccgcctgtgccaggaatatctcgacgacattattacagtcgatagcgacgctatctgcgcggcgatgaaagatctgtttgaagatgtgcgtgcggtggcggagccgtccggcgcgctggcgctggcggggatgaagaaatatatcgcccagcacaatattcgcggcgaacgcctggcgcacgtcctttccggcgccaacgtcaacttccacggcttgcgctatgtgtctgaacgctgcgagctgggggaacagcgcgaagcgttactggcggtgaccattccggaagaaaaggggagctttctcaaattctgccagttgcttggcgggcgtatggtcaccgaatttaactaccgttttgccgacgcgaaaaatgcctgtatttttgtcggcgtacgcgtcagtcaggggctggaggagcgaaaagagattatcacccaactgtgcgacggcggttatagcgtagtggatctctccgacgatgaaatggcgaagctgcatgtgcgctatatggtcggcggacgcccctccaagccattacaggagcgtttgtatagtttcgaatttccggagtcgcccggcgcgttgctcaaattcctgcatacgcttggcacgcactggaatatttcgctattccattaccgtagccacggtaccgattatggccgcgtgctggcggcgttcgagttaggcgatcatgagccggatttcgaaacccggctgcatgagctgggctatgaatgccatgatgagagcaataacccggcgttccggttctttctggcgggttaa

SEQ ID NO: 31822 - protein, 514 aa, Salmonella typhimurium
MAESQPLSVAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKSLIVMPKATADIKVDAVRGFGGEVLLHGANFDEAKAKAIELAQQQGFTWVPPFDHPMVIAGQGTLALELLQQDSHLDRVFVPVGGGGLAAGVAVLIKQLMPQIKVIAVEAEDSACLKAALEAGHPVDLPRVGLFAEGVAVKRIGDETFRLCQEYLDDIITVDSDAICAAMKDLFEDVRAVAEPSGALALAGMKKYIAQHNIRGERLAHVLSGANVNFHGLRYVSERCELGEQREALLAVTIPEEKGSFLKFCQLLGGRMVTEFNYRFADAKNACIFVGVRVSQGLEERKEIITQLCDGGYSVVDLSDDEMAKLHVRYMVGGRPSKPLQERLYSFEFPESPGALLKFLHTLGTHWNISLFHYRSHGTDYGRVLAAFELGDHEPDFETRLHELGYECHDESNNPAFRFFLAG

SEQ ID NO: 31823 - DNA, 990 bp, Salmonella typhimurium
  CDS (1)..(990): transl_table=11
atgcacattacatacgatctcccggttgcaattgaagatatcctcgaagcgaaaaaaagactggcggggaagatatataaaacgggaatgcctcgctctaactattttagtgaacgttgcaaaggcgaaatatttctcaagtttgaaaatatgcagcgtacgggttcatttaaaattcgtggcgcttttaacaaacttagctcgttaacggaggcggaaaaacgtaaaggcgtcgtggcctgttccgcaggtaatcatgcacagggcgtttctctttcttgcgcaatgctgggtattgacggcaaagtcgtgatgccgaagggcgcgccaaagtcaaaagtggcggccacctgtgattattcggcggaagtggtgctccacggtgacaacttcaatgacaccatcgctaaggtgagtgaaattgtcgaaaccgaaggccgcatttttattccgccttacgacgatccaaaagtcattgccggacagggcactattggtctggaaattatggaagatctgtacgatgtcgataatgtcatcgtgcctattggcggcggcggtttaattgcaggtattgccattgcgattaaatcgattaacccgaccattaaagttatcggcgtacaggccgaaaatgttcacggtatggcggcgtcttattacactggcgaaataaccacgcaccgaacgaccggcaccctggcggatggttgtgatgtctcccgcccgggtaatttaacctatgaaatcgttcgtgaattagtcgatgacattgtcctggttagcgaagatgaaattcgtaacagcatgatcgctttaattcagcgcaataaggttattactgaaggcgctggcgctctggcttgcgccgcactattaagtgggaaattagatagccatattcagaacagaaaaacggtcagtattatttctggcggcaatatcgatctttctcgggtatcacaaattacgggtttagttgacgcttaa

SEQ ID NO: 31824 - protein, 329 aa, Salmonella typhimurium
MHITYDLPVAIEDILEAKKRLAGKIYKTGMPRSNYFSERCKGEIFLKFENMQRTGSFKIRGAFNKLSSLTEAEKRKGVVACSAGNHAQGVSLSCAMLGIDGKVVMPKGAPKSKVAATCDYSAEVVLHGDNFNDTIAKVSEIVETEGRIFIPPYDDPKVIAGQGTIGLEIMEDLYDVDNVIVPIGGGGLIAGIAIAIKSINPTIKVIGVQAENVHGMAASYYTGEITTHRTTGTLADGCDVSRPGNLTYEIVRELVDDIVLVSEDEIRNSMIALIQRNKVITEGAGALACAALLSGKLDSHIQNRKTVSIISGGNIDLSRVSQITGLVDA

SEQ ID NO: 31825 - DNA, 1653 bp, Arxula adeninivorans
  CDS (1)..(1653)
atgtctaatatatcgactccgcgcatctcggggctgactgaatatacttctcagcctgataaatcccattacgactctatcgaatcccatttcttgcttcctgatggaaccccagactatttaaagctcattctcacttcaaaagtgtacgatgtttgcaacgagacccccgtaactcctgcggtcaatttgtcgtcaaagctgggcgccaacatctttctcaaaagagaggatctccagccggtattttcgttcaagcttcgaggagcttacaacatgatggctcatttgcctcaggagactcgatggaagggtgtcattgcatgctctgctggtaaccatgctcagggagtagcatactcggccaaacatctcaacattcctgccacaattgtcatgcccgtggtgacccctgctatcaagtacaagaacgtggaccgactgggagcaaaggtagtgctccatggtaacgattttgatgccgcaaaggccgagtgcaatcgattgtcggaaaagcacggattgactaatattcctctttttgacaacccctatgtgattgcgggacagggcacaattggagtggagcttctgcgccagattgacgtggaatcgctcaaggctatttttgtgtgcattggtggaggaggacttattgctggagtgggggcctacattaagcgtattgctcctcaggtaaaaatcattggtgtggaaacttatgacgccaatgccatgcgccagtcgctgcagaagggtgaacgaatcactctgtcagaggtaggattgtttgccgacggtgctgcagttaaaattcttggagaggagactttccggttgtgccaacaagtggtagatgaaattgtattggtgtctactgacgagatttgtgctgctattaaggatgtgtttactgagactcgatccatcgtcgagcccgctggtgcgctgtcggtggcaggactcgtcaagtacgttgaatctcaccctgaaattgatcactctgcctccggatacactgccatcttgtcaggagcgaatatggattttgaccgactgcgatttgtttctgaacgagcaaagctcggagagggatccgaggtgttcattgtagccaccatccccgagaagcctggttcgtttggaaagctcattgatctggtccaccctcgagccgttactgagtttagctacagatactccaatggagaactagaaaagagcgacggaaaggcccatgtgtacatttcattttcagttgataatgctaaagctgaagtgccccgcatcctcgatgatttcaagggagctgggttcgatgctattgatatctcccacaatgagtttccaaaaagtcacccaagatacttggtaggagcaaaccagccagttaccaatgagagagtgttccgatttgagttccccgaaagaccaggagctttggtgaaattccttcacggagtcaaatccaagtggaacattactctgttccactaccgaaaccagggatcggacattgcaaaggtcttggctggtatctctgtaccttctcacgagagcgatcaattccagcaattcttggacaatcttgagtacccatatgccgaggagactgacaatgtggtgtacaagcttttttcgcagggagactag

SEQ ID NO: 31826 - protein, 550 aa, Arxula adeninivorans
MSNISTPRISGLTEYTSQPDKSHYDSIESHFLLPDGTPDYLKLILTSKVYDVCNETPVTPAVNLSSKLGANIFLKREDLQPVFSFKLRGAYNMMAHLPQETRWKGVIACSAGNHAQGVAYSAKHLNIPATIVMPVVTPAIKYKNVDRLGAKVVLHGNDFDAAKAECNRLSEKHGLTNIPLFDNPYVIAGQGTIGVELLRQIDVESLKAIFVCIGGGGLIAGVGAYIKRIAPQVKIIGVETYDANAMRQSLQKGERITLSEVGLFADGAAVKILGEETFRLCQQVVDEIVLVSTDEICAAIKDVFTETRSIVEPAGALSVAGLVKYVESHPEIDHSASGYTAILSGANMDFDRLRFVSERAKLGEGSEVFIVATIPEKPGSFGKLIDLVHPRAVTEFSYRYSNGELEKSDGKAHVYISFSVDNAKAEVPRILDDFKGAGFDAIDISHNEFPKSHPRYLVGANQPVTNERVFRFEFPERPGALVKFLHGVKSKWNITLFHYRNQGSDIAKVLAGISVPSHESDQFQQFLDNLEYPYAEETDNVVYKLFSQGD

SEQ ID NO: 31827 - DNA, 1731 bp, Saccharomyces cerevisiae
  CDS (1)..(1731)
atgtcagctactctactaaagcaaccattatgtacggttgttcggcaaggtaaacagtccaaagtgtctggattgaaccttttgagactaaaggctcatttgcacagacaacacctgtcaccttccttgataaaactacactctgaattgaaattggatgagctgcaaactgataacacccctgattacgtccgtttagttttaaggtcctctgtatacgatgttattaatgaatctccaatctctcaaggtgtaggtttgtcttcccgtctaaacacgaatgtcatcttgaaaagagaagatctattgcctgttttctctttcaagcttcgtggtgcctataacatgattgccaagttggacgattctcaaagaaaccagggtgttattgcctgttcagctgggaatcatgcccaaggtgtggcctttgctgctaaacacttgaaaatacctgctactatcgttatgcctgtttgtacaccatctattaagtatcaaaatgtctcgagattagggtctcaagtcgtcctatatggtaacgattttgacgaggctaaggctgaatgtgccaaattggctgaagagcgtggcttgacgaacattcctcctttcgatcatccttatgtcattgccggtcaaggtactgtagctatggaaatcctaagacaagtacgtaccgctaataagatcggtgctgtctttgttcccgtcggcggtggtggtttaattgctggtattggtgcttatttgaaaagggttgctcctcatatcaaaatcattggtgttgaaacttacgatgcggccactttacataattccttgcaacgcaaccagagaactcctttacctgtggtgggtacttttgccgatggtacgtctgtgcgtatgattggtgaagaaacatttagagtcgcccaacaagtggttgatgaagttgttcttgttaacactgacgaaatctgtgctgcagtaaaggatatttttgaagatactagaagtattgtagaaccatctggtgccctttcagtagccggtatgaagaaatacatctctaccgtacatccagaaattgaccacactaaaaacacctatgttcccatcctttctggtgctaacatgaactttgatagattaagatttgtttccgaacgtgctgttcttggtgaaggaaaggaagtcttcatgttagttactttacccgacgtccctggtgcgttcaagaaaatgcaaaagatcatccacccaagatctgtcactgaattctcttaccgttacaatgaacatcgtcatgagtcctctagtgaagtgcccaaggcttacatttacacttctttcagcgtcgttgacagagaaaaggaaatcaagcaagttatgcaacagttgaatgctttaggttttgaagctgtggatatctccgataacgaattggctaaatctcatggtagatacttggttggtggtgcttctaaggttcctaatgaaagaattatttcatttgaattccctgaaagaccaggtgccttgactaggttccttggaggcctaagcgattcttggaatcttactttattccattatagaaaccatggtgccgatatcggtaaggttttagctggtatttccgttcctccaagggaaaacttaaccttccaaaaattcttggaagatttaggctacacttatcatgatgaaactgataacactgtttatcaaaaattcttgaaatattaa

SEQ ID NO: 31828 - protein, 576 aa, Saccharomyces cerevisiae
MSATLLKQPLCTVVRQGKQSKVSGLNLLRLKAHLHRQHLSPSLIKLHSELKLDELQTDNTPDYVRLVLRSSVYDVINESPISQGVGLSSRLNTNVILKREDLLPVFSFKLRGAYNMIAKLDDSQRNQGVIACSAGNHAQGVAFAAKHLKIPATIVMPVCTPSIKYQNVSRLGSQVVLYGNDFDEAKAECAKLAEERGLTNIPPFDHPYVIAGQGTVAMEILRQVRTANKIGAVFVPVGGGGLIAGIGAYLKRVAPHIKIIGVETYDAATLHNSLQRNQRTPLPVVGTFADGTSVRMIGEETFRVAQQVVDEVVLVNTDEICAAVKDIFEDTRSIVEPSGALSVAGMKKYISTVHPEIDHTKNTYVPILSGANMNFDRLRFVSERAVLGEGKEVFMLVTLPDVPGAFKKMQKIIHPRSVTEFSYRYNEHRHESSSEVPKAYIYTSFSVVDREKEIKQVMQQLNALGFEAVDISDNELAKSHGRYLVGGASKVPNERIISFEFPERPGALTRFLGGLSDSWNLTLFHYRNHGADIGKVLAGISVPPRENLTFQKFLEDLGYTYHDETDNTVYQKFLKY

SEQ ID NO: 31829 - DNA, 1149 bp, Synechocystis sp
  CDS (1)..(1149)
atgatttcttgtcattctttcaccatgaccccatccgccccaaattcgacagtgttgcccagtgctacccccgtctgtccccagagttcggcctgtcgttggcgtggattgattgaaacctatcggccctatttaccggtatccgaccagactccagtggtcacccttttagaaggcaatactcccctgattcccgctccggcgatcgccaaacgcattggcaaggacgtaagggtttttgttaaatatgacggcctaaaccccaccggtagtttcaaggaccggggcatgaccatggccatttccaaagccaaggaagcaggggccaaagcggtaatttgtgccagcacaggtaatacttcagcggcggcggcggcctacgctcggcgggccggtttgcgggcttttgtgatcattcccgatggttatgtcgctttgggaaaattaggccaagctttaatttacggtgcggaagtgattgccattgatggtaactttgacgatgcgttgaccaccgtgcggcagttatcggaacattaccccgtaaccttggtaaattccgttaatccctaccgtttggaaggacaaaagaccgccgcgtttgaaattgttgatgtcctcggccaggcccccgattggctctgtatccccgtgggcaatgcgggcaatatcaccgcctactggatgggtttttgtcagtataaagaattgggcaaaggcgatcgcctaccgaggatgatgggtttccaagccgctggttccgctccttttatccaagggcaacccattagccatcccgaaaccctagccactgctattcgtattggcaatcctgccaactgggataaggcctgggccgcttctagggaaagtaatggggaatttcaccccgtcaccgatgccgaaattttggaagcctatcgtatcctagctgccgaagaaggggttttttgtgagcccgccagtgccgcttccgtagctggtttattgaagcaaaaagatcaagttcccgctggagccaccgtggtttgtgtgctgaccggcaacggcttgaaagatccagattgtgctgtgcaaaatagtggcaatcaagtgaaagcgggtttaaaaccagatttggaaattgttgctaaagcgatgggtttttag

SEQ ID NO: 31830 - protein, 382 aa, Synechocystis sp
MISCHSFTMTPSAPNSTVLPSATPVCPQSSACRWRGLIETYRPYLPVSDQTPVVTLLEGNTPLIPAPAIAKRIGKDVRVFVKYDGLNPTGSFKDRGMTMAISKAKEAGAKAVICASTGNTSAAAAAYARRAGLRAFVIIPDGYVALGKLGQALIYGAEVIAIDGNFDDALTTVRQLSEHYPVTLVNSVNPYRLEGQKTAAFEIVDVLGQAPDWLCIPVGNAGNITAYWMGFCQYKELGKGDRLPRMMGFQAAGSAPFIQGQPISHPETLATAIRIGNPANWDKAWAASRESNGEFHPVTDAEILEAYRILAAEEGVFCEPASAASVAGLLKQKDQVPAGATVVCVLTGNGLKDPDCAVQNSGNQVKAGLKPDLEIVAKAMGF

SEQ ID NO: 31831 - DNA, 999 bp, Rhizobium sp
  CDS (1)..(999): transl_table=11
gtgaatgaattgtcgaacttaagtctagaatcgatcgagcgagcgcgtgagcggatcgaagagcacgtcttccgtacccctctgacgacatcaaggtcgctaaccgaacttaccggaactcaggtcagcctcaagctcgagcactatcagcgcactggtagctttaagctgcggggtgcgacaaacgcaattcttcaactcagcccgtcggatcgggcacgtggggttattgcggcatctacgggcaatcacggacgggctctttcctacgccgcaaaagcggtcggctctcgcgccaccatctgcatgtcggatcttgttccagaaaacaaggtttccgagatccggaagcttggcgcgacagttcggatagtgggatcgtcacaagacgatgcgcaagtcgaagtcgagcggctcgtcgcggaggaaggcctcagcatgatcccgcctttcgatcacccgcatatcatcgccggccagcgaaccgtcggtcttgagatcgttgaggcgatgccggacgtcgcgatggtactgcttccactgtcgggtggcggcttggctgcaggcgttgcagcagcggtgaaggcactgcggcctcatgcgaggatcatcggtgtcactatggatcgaggcgccgcgatgaaggccagcatcgaagctgggcatccggtacaagtgaaggagtatcggagcttggctgattctttaggtggaggaatcggcatggccaacgcttggacctttcaaatgtgcagagcccttctggacgatgttgtcctcgttaatgaaggcgaaatagccgcgggaattagacatgcttatgagcatgagcgtcagatactcgagggcgccggcgctgtcggtatcgcagcgcttctctccggcaaggtggctgctcgcggaggttcagtaggagtcgttttgtcaggtcaaaacatcgacatgggcctgcatcgggaggtcattaacggagttgtcagagcgaccgaggaggattga

SEQ ID NO: 31832 - protein, 332 aa, Rhizobium sp
MNELSNLSLESIERARERIEEHVFRTPLTTSRSLTELTGTQVSLKLEHYQRTGSFKLRGATNAILQLSPSDRARGVIAASTGNHGRALSYAAKAVGSRATICMSDLVPENKVSEIRKLGATVRIVGSSQDDAQVEVERLVAEEGLSMIPPFDHPHIIAGQRTVGLEIVEAMPDVAMVLLPLSGGGLAAGVAAAVKALRPHARIIGVTMDRGAAMKASIEAGHPVQVKEYRSLADSLGGGIGMANAWTFQMCRALLDDVVLVNEGEIAAGIRHAYEHERQILEGAGAVGIAALLSGKVAARGGSVGVVLSGQNIDMGLHREVINGVVRATEED

SEQ ID NO: 31833 - DNA, 972 bp, Schizosaccharomyces pombe
  CDS (1)..(972)
atgagcgataacctggtgcttcctacctatgatgatgttgcttcagctagtgagcgaattaagaaattcgccaacaaaaccccagtactcacgtcgagcacagtaaataaagagtttgtggcagaagtgttttttaaatgtgaaaatttccaaaaaatgggtgctttcaaatttcgcggtgcccttaatgctctttctcaactcaatgaagctcaacgtaaagctggtgttttgacgttttcttctggtaatcatgctcaggccattgcactgtcggcaaagatcttgggaattccagcaaaaatcattatgccactcgatgcacccgaagccaaggtcgctgccacgaaaggctatggtggtcaagtaatcatgtatgatagatacaaagatgatagagaaaagatggccaaagaaatttctgaaagagaaggtcttaccattatccctccttacgatcacccccatgtacttgctggtcaaggaaccgcagctaaggaactgtttgaagaggttggccctcttgatgcactttttgtttgtctcggaggcggtggcttgctttctggatcagcacttgctgctcgccattttgctccaaactgcgaagtttatggagttgaacctgaagctggaaacgatgggcaacagtcctttaggaaaggatctatcgtacatattgatacaccaaaaactatagccgatggtgctcaaactcaacatttgggtaactacacgttttccattataaaagaaaaggtcgatgatatattgactgtgtccgacgaggaactaattgactgtcttaagttttatgccgcacgtatgaaaattgtagtcgaacccactggatgtcttagctttgcggcagcgcgcgctatgaaggaaaagctaaagaataaacgaattggtatcattataagtggaggaaacgtagacattgagcgttatgcccatttcttatcacagtaa

SEQ ID NO: 31834 - protein, 323 aa, Schizosaccharomyces pombe
MSDNLVLPTYDDVASASERIKKFANKTPVLTSSTVNKEFVAEVFFKCENFQKMGAFKFRGALNALSQLNEAQRKAGVLTFSSGNHAQAIALSAKILGIPAKIIMPLDAPEAKVAATKGYGGQVIMYDRYKDDREKMAKEISEREGLTIIPPYDHPHVLAGQGTAAKELFEEVGPLDALFVCLGGGGLLSGSALAARHFAPNCEVYGVEPEAGNDGQQSFRKGSIVHIDTPKTIADGAQTQHLGNYTFSIIKEKVDDILTVSDEELIDCLKFYAARMKIVVEPTGCLSFAAARAMKEKLKNKRIGIIISGGNVDIERYAHFLSQ

SEQ ID NO: 31835 - DNA, 981 bp, Saccharomyces cerevisiae
  CDS (1)..(981)
atgattgttcccacttatggagacgttttggatgccagcaacagaattaaagaatatgtaaataaaacaccggttctcacttcacgaatgcttaatgatcgacttggagcacaaatatactttaaaggtgagaatttccaacgagtgggagcgttcaagtttcgtggagcaatgaatgctgtttcaaaattaagtgatgaaaaaagaagtaagggagtaattgccttctcatcaggaaaccatgcacaggctattgctcttagtgcaaaactattaaatgtacctgcaacaattgttatgcccgaggatgcgcccgcccttaaagttgctgctacagccggttacggagcacatatcataaggtataacaggtatactgaagatcgcgagcagattgggcgtcaactagcagccgaacatggttttgcattgattccgccctacgatcatcctgatgttattgcagggcaaggtacgtcggcaaaagagctattagaagaggttggacaacttgatgcattatttgttcctttgggcggtggtgggctcctttcaggatctgcacttgccgctagaagcctttctccaggctgcaaaatttttggggttgaacctgaagctggtaacgatggacaacaatccttcagatcgggttccattgttcatatcaatacgccaaaaactatcgcagatggcgctcaaacacaacacctcggtgagtacacatttgccattattcgcgaaaatgtcgatgatattttaacggttagcgaccaagagctagtaaaatgcatgcactttcttgcggaacgcatgaaggtggttgttgagcccacagcttgtttgggatttgcaggtgcacttctaaaaaaggaagagctagttgggaagaaagtaggcataatactaagtggaggtaatgtagacatgaagagatatgctactttaatctctgggaaggaagatggcccaacgatttag

SEQ ID NO: 31836 - protein, 326 aa, Saccharomyces cerevisiae
MIVPTYGDVLDASNRIKEYVNKTPVLTSRMLNDRLGAQIYFKGENFQRVGAFKFRGAMNAVSKLSDEKRSKGVIAFSSGNHAQAIALSAKLLNVPATIVMPEDAPALKVAATAGYGAHIIRYNRYTEDREQIGRQLAAEHGFALIPPYDHPDVIAGQGTSAKELLEEVGQLDALFVPLGGGGLLSGSALAARSLSPGCKIFGVEPEAGNDGQQSFRSGSIVHINTPKTIADGAQTQHLGEYTFAIIRENVDDILTVSDQELVKCMHFLAERMKVVVEPTACLGFAGALLKKEELVGKKVGIILSGGNVDMKRYATLISGKEDGPTI

SEQ ID NO: 31837 - DNA, 24 bp, Artificial sequence
  (1)..(24): primer
atgcatattacatacgatctgccg

SEQ ID NO: 31838 - DNA, 23 bp, Artificial sequence
  (1)..(23): primer
ttaagcgtcaacgaaaccggtga

SEQ ID NO: 31839 - protein, 516 aa, Artificial sequence
  Variant (3)..(13): xaa in position 3 to 13 is any amino acid
  Variant (14)..(96): xaa in position 14 to 96 is any or no amino acid
  Variant (98)..(98): xaa in position 98 is any amino acid
  Variant (100)..(101): xaa in position 100 to 101 is any amino acid
  Variant (103)..(106): xaa in position 103 to 106 is any amino acid
  Variant (107)..(121): xaa in position 107 to 121 is any or no amino acid
  Variant (124)..(124): xaa in position 124 is any amino acid
  Variant (127)..(138): xaa in position 127 to 138 is any amino acid
  Variant (139)..(178): xaa in position 139 to 178 is any or no amino acid
  Variant (180)..(180): xaa in position 180 is any amino acid
  Variant (184)..(185): xaa in position 184 to 185 is any amino acid
  Variant (186)..(189): xaa in position 186 to 189 is any or no amino acid
  Variant (191)..(204): xaa in position 191 to 204 is any amino acid
  Variant (206)..(211): xaa in position 206 to 211 is any amino acid
  Variant (213)..(219): xaa in position 213 to 219 is any amino acid
  Variant (221)..(257): xaa in position 221 to 257 is any amino acid
  Variant (258)..(270): xaa in position 258 to 270 is any or no amino acid
  Variant (273)..(273): xaa in position 273 is any amino acid
  Variant (275)..(277): xaa in position 275 to 277 is any amino acid
  Variant (279)..(291): xaa in position 279 to 291 is any amino acid
  Variant (292)..(340): xaa in position 292 to 340 is any or no amino acid
  Variant (346)..(347): xaa in position 346 to 347 is any amino acid
  Variant (349)..(394): xaa in position 349 to 394 is any amino acid
  Variant (395)..(440): xaa in position 395 to 440 is any or no amino acid
  Variant (442)..(461): xaa in position 442 to 461 is any amino acid
  Variant (463)..(469): xaa in position 463 to 469 is any amino acid
  Variant (471)..(484): xaa in position 471 to 484 is any amino acid
  Variant (485)..(513): xaa in position 485 to 513 is any or no amino acid
  Variant (515)..(515): xaa in position 515 is any amino acid
TPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXEXXQXXXXXXXXXXXXXXXXXXXFKXRGXXXXXXXXXXXXXXXXXXXXXXXXXXXXXXXXXXXXXXXXXXXXXXXXXXXXSXGNHXXXXXXAXXXXXXXXXXXXXXPXXXXXXKXXXXXXXGXXXXXXXXXXXXXXXXXXXXXXXXXXXXXXXXXXXXXXXXXXXXXXXXXXGQXTXXXEXXXXXXXXXXXXXXXXXXXXXXXXXXXXXXXXXXXXXXXXXXXXXXXXXXXXXXXXXXXXXXGGGGLXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXEXXXXXXXAXXXXXXXXXXXXXXXXXXXXXXXXXXXXXXXXXXXXXXXXXXXGXN

SEQ ID NO: 31840 - protein, 224 aa, Artificial sequence
  Variant (1)..(1): xaa in position 1 is Val, Ile, Leu, Phe or Met
  Variant (2)..(3): xaa in position 2 to 3 is any amino acid
  Variant (5)..(5): xaa in position 5 is any amino acid
  Variant (6)..(6): xaa in position 6 is Glu or Asp
  Variant (7)..(8): xaa in position 7 to 8 is any amino acid
  Variant (9)..(9): xaa in position 9 is Gln, Asn, Leu, Thr or Ser
  Variant (10)..(12): xaa in position 10 to 12 is any amino acid
  Variant (13)..(13): xaa in position 13 is Ser, Ala or Thr
  Variant (14)..(14): xaa in position 14 is Phe or Tyr
  Variant (15)..(15): xaa in position 15 is Lys or Arg
  Variant (16)..(16): xaa in position 16 is any amino acid
  Variant (18)..(18): xaa in position 18 is Gly or Leu
  Variant (19)..(35): xaa in position 19 to 35 is any amino acid
  Variant (36)..(54): xaa in position 36 to 54 is any or no amino acid
  Variant (55)..(55): xaa in position 55 is Ser or Thr
  Variant (56)..(56): xaa in position 56 is any amino acid
  Variant (58)..(58): xaa in position 58 is Asn or Gly
  Variant (59)..(59): xaa in position 59 is any amino acid
  Variant (60)..(60): xaa in position 60 is Ala, Gly or Ser
  Variant (61)..(61): xaa in position 61 is any amino acid
  Variant (62)..(62): xaa in position 62 is any or no amino acid
  Variant (63)..(63): xaa in position 63 is Gly, Ala, Leu, Ser or Cys
  Variant (64)..(64): xaa in position 64 is any amino acid
  Variant (65)..(65): xaa in position 65 is Ala or Ser
  Variant (66)..(67): xaa in position 66 to 67 is any amino acid
  Variant (68)..(68): xaa in position 68 is Ala, Cys, Gly or Ser
  Variant (69)..(76): xaa in position 69 to 76 is any amino acid
  Variant (77)..(77): xaa in position 77 is Ile, Val, Leu or Thr
  Variant (78)..(78): xaa in position 78 is Val, Phe, Ile, Tyr, Leu, Cys or Ala
  Variant (79)..(79): xaa in position 79 is Met, Val, Pro, Leu, Ile or Ala
  Variant (80)..(80): xaa in position 80 is Pro, Ser, Thr, Glu, Lys or Asp
  Variant (81)..(82): xaa in position 81 to 82 is any amino acid
  Variant (83)..(83): xaa in position 83 is Thr, Ala, Val, Ile, Lys, Ser or Asn
  Variant (84)..(86): xaa in position 84 to 86 is any amino acid
  Variant (87)..(87): xaa in position 87 is Lys, Ile, Val, Thr, Ala or Met
  Variant (88)..(94): xaa in position 88 to 94 is any amino acid
  Variant (95)..(95): xaa in position 95 is any or no amino acid
  Variant (96)..(96): xaa in position 96 is Gly or Ser
  Variant (97)..(97): xaa in position 97 is Ala, Gly, Lys or Ser
  Variant (98)..(123): xaa in position 98 to 123 is any amino acid
  Variant (124)..(135): xaa in position 124 to 135 is any or no amino acid
  Variant (136)..(136): xaa in position 136 is Ile, Val, Leu or Phe
  Variant (137)..(144): xaa in position 137 to 144 is any amino acid
  Variant (145)..(145): xaa in position 145 is Ile, Met, Leu, Val, Trp, Ala or Gln
  Variant (146)..(146): xaa in position 146 is any amino acid
  Variant (148)..(148): xaa in position 148 is any amino acid
  Variant (149)..(149): xaa in position 149 is Gly, Ala, Lys, Ser, Arg or Thr
  Variant (150)..(150): xaa in position 150 is Thr or Ser
  Variant (151)..(153): xaa in position 151 to 153 is any amino acid
  Variant (154)..(154): xaa in position 154 is Glu or Asp
  Variant (155)..(155): xaa in position 155 is Ile, Leu, Met, Val, Ala, Phe or Trp
  Variant (156)..(162): xaa in position 156 to 162 is any amino acid
  Variant (163)..(211): xaa in position 163 to 211 is any or no amino acid
  Variant (212)..(212): xaa in position 212 is Val, Ile or Leu
  Variant (213)..(214): xaa in position 213 to 214 is any amino acid
  Variant (215)..(215): xaa in position 215 is Pro, Ala, Ser, Cys, Gly, Gln or Asn
  Variant (216)..(216): xaa in position 216 is Val, Ile, Leu, Met, Thr, Cys or Ala
  Variant (217)..(217): xaa in position 217 is Gly or Ser
  Variant (218)..(218): xaa in position 218 is any amino acid
  Variant (219)..(219): xaa in position 219 is Gly or Ala
  Variant (220)..(220): xaa in position 220 is Gly or Ser
  Variant (221)..(223): xaa in position 221 to 223 is any amino acid
  Variant (224)..(224): xaa in position 224 is Gly, Ala or Ser
XXXKXXXXXXXXXXXXRXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXX

SEQ ID NO: 31841 - DNA, 1419 bp, Escherichia coli K12; identical to SEQ ID NO: 4337
  CDS (1)..(1419)

SEQ ID NO: 31842 - protein, 472 aa, Escherichia coli K12; identical to SEQ ID NO: 4338

SEQ ID NO: 31843 - DNA, 3951 bp, Homo sapiens (man); identical to SEQ ID NO: 4339
  CDS (82)..(3159)

SEQ ID NO: 31844 - protein, 1025 aa, Homo sapiens (man); identical to SEQ ID NO: 4340

SEQ ID NO: 31845 - DNA, 1239 bp, Escherichia coli; identical to SEQ ID NO: 4341
  CDS (1)..(1239)

SEQ ID NO: 31846 - protein, 412 aa, Escherichia coli; identical to SEQ ID NO: 4342

SEQ ID NO: 31847 - DNA, 1431 bp, Aquifex aeolicus; identical to SEQ ID NO: 4343
  CDS (1)..(1431)

SEQ ID NO: 31848 - protein, 476 aa, Aquifex aeolicus; identical to SEQ ID NO: 4344

SEQ ID NO: 31849 - DNA, 1488 bp, Bacillus halodurans; identical to SEQ ID NO: 4345
  CDS (1)..(1488)

SEQ ID NO: 31850 - protein, 495 aa, Bacillus halodurans; identical to SEQ ID NO: 4346

SEQ ID NO: 31851 - DNA, 1236 bp, Clostridium acetobutylicum; identical to SEQ ID NO: 4347
  CDS (1)..(1236)

SEQ ID NO: 31852 - protein, 411 aa, Clostridium acetobutylicum; identical to SEQ ID NO: 4348

SEQ ID NO: 31853 - DNA, 1419 bp, Salmonella enterica subsp. enterica serovar Typhi; identical to SEQ ID NO: 4349
  CDS (1)..(1419)

SEQ ID NO: 31854 - protein, 472 aa, Salmonella enterica subsp. enterica serovar Typhi; identical to SEQ ID NO: 4350

SEQ ID NO: 31855 - DNA, 1860 bp, Salmonella enterica subsp. enterica serovar Typhi; identical to SEQ ID NO: 4351
  CDS (1)..(1860)

SEQ ID NO: 31856 - protein, 619 aa, Salmonella enterica subsp. enterica serovar Typhi; identical to SEQ ID NO: 4352

SEQ ID NO: 31857 - DNA, 1470 bp, Listeria innocua; identical to SEQ ID NO: 4353
  CDS (1)..(1470)

SEQ ID NO: 31858 - protein, 489 aa, Listeria innocua; identical to SEQ ID NO: 4354

SEQ ID NO: 31859 - DNA, 1470 bp, Listeria monocytogenes; identical to SEQ ID NO: 4355
  CDS (1)..(1470)

SEQ ID NO: 31860 - protein, 489 aa, Listeria monocytogenes; identical to SEQ ID NO: 4356

SEQ ID NO: 31861 - DNA, 1419 bp, Yersinia pestis; identical to SEQ ID NO: 4357
  CDS (1)..(1419)

SEQ ID NO: 31862 - protein, 472 aa, Yersinia pestis; identical to SEQ ID NO: 4358

SEQ ID NO: 31863 - DNA, 1242 bp, Salmonella enterica subsp. enterica serovar Typhi; identical to SEQ ID NO: 4359
  CDS (1)..(1242)

SEQ ID NO: 31864 - protein, 413 aa, Salmonella enterica subsp. enterica serovar Typhi; identical to SEQ ID NO: 4360

SEQ ID NO: 31865 - DNA, 1467 bp, Deinococcus radiodurans; identical to SEQ ID NO: 4361
  CDS (1)..(1467)

SEQ ID NO: 31866 - protein, 488 aa, Deinococcus radiodurans; identical to SEQ ID NO: 4362

SEQ ID NO: 31867 - DNA, 1980 bp, Escherichia coli; identical to SEQ ID NO: 4363
  CDS (1)..(1980)

SEQ ID NO: 31868 - protein, 659 aa, Escherichia coli; identical to SEQ ID NO: 4364

SEQ ID NO: 31869 - DNA, 1419 bp, Pyrococcus horikoshii; identical to SEQ ID NO: 4365
  CDS (1)..(1419)

SEQ ID NO: 31870 - protein, 472 aa, Pyrococcus horikoshii; identical to SEQ ID NO: 4366

SEQ ID NO: 31871 - DNA, 1431 bp, Pyrococcus horikoshii; identical to SEQ ID NO: 4367
  CDS (1)..(1431)

SEQ ID NO: 31872 - protein, 476 aa, Pyrococcus horikoshii; identical to SEQ ID NO: 4368

SEQ ID NO: 31873 - DNA, 1557 bp, Treponema pallidum subsp. pallidum (syphilis spirochete); identical to SEQ ID NO: 4369
  CDS (1)..(1557)

SEQ ID NO: 31874 - protein, 518 aa, Treponema pallidum subsp. pallidum (syphilis spirochete); identical to SEQ ID NO: 4370

SEQ ID NO: 31875 - DNA, 1446 bp, Campylobacter jejuni; identical to SEQ ID NO: 4371
  CDS (1)..(1446)

SEQ ID NO: 31876 - protein, 481 aa, Campylobacter jejuni; identical to SEQ ID NO: 4372

SEQ ID NO: 31877 - DNA, 1446 bp, Caulobacter crescentus; identical to SEQ ID NO: 4373
  CDS (1)..(1446)

SEQ ID NO: 31878 - protein, 481 aa, Caulobacter crescentus; identical to SEQ ID NO: 4374

SEQ ID NO: 31879 - DNA, 1425 bp, Pyrococcus abyssi; identical to SEQ ID NO: 4375
  CDS (1)..(1425)

SEQ ID NO: 31880 - protein, 474 aa, Pyrococcus abyssi; identical to SEQ ID NO: 4376

SEQ ID NO: 31881 - DNA, 1440 bp, Lactococcus lactis subsp. lactis; identical to SEQ ID NO: 4377
  CDS (1)..(1440)

SEQ ID NO: 31882 - protein, 479 aa, Lactococcus lactis subsp. lactis; identical to SEQ ID NO: 4378

SEQ ID NO: 31883 - DNA, 1440 bp, Clostridium acetobutylicum; identical to SEQ ID NO: 4379
  CDS (1)..(1440)

SEQ ID NO: 31884 - protein, 479 aa, Clostridium acetobutylicum; identical to SEQ ID NO: 4380

SEQ ID NO: 31885 - DNA, 3099 bp, Escherichia coli; identical to SEQ ID NO: 4381
  CDS (1)..(3099)

SEQ ID NO: 31886 - protein, 1032 aa, Escherichia coli; identical to SEQ ID NO: 4382

SEQ ID NO: 31887 - DNA, 1470 bp, Vibrio cholerae; identical to SEQ ID NO: 4383
  CDS (1)..(1470)

SEQ ID NO: 31888 - protein, 489 aa, Vibrio cholerae; identical to SEQ ID NO: 4384

SEQ ID NO: 31889 - DNA, 1467 bp, Mycobacterium leprae; identical to SEQ ID NO: 4385
  CDS (1)..(1467)

SEQ ID NO: 31890 - protein, 488 aa, Mycobacterium leprae; identical to SEQ ID NO: 4386

SEQ ID NO: 31891 - DNA, 1935 bp, Escherichia coli; identical to SEQ ID NO: 4387
  CDS (1)..(1935)

SEQ ID NO: 31892 - protein, 644 aa, Escherichia coli; identical to SEQ ID NO: 4388

SEQ ID NO: 31893 - DNA, 1857 bp, Thermotoga maritima; identical to SEQ ID NO: 4389
  CDS (1)..(1857)

SEQ ID NO: 31894 - protein, 618 aa, Thermotoga maritima; identical to SEQ ID NO: 4390

SEQ ID NO: 31895 - DNA, 1416 bp, Vibrio cholerae; identical to SEQ ID NO: 4391
  CDS (1)..(1416)

SEQ ID NO: 31896 - protein, 471 aa, Vibrio cholerae; identical to SEQ ID NO: 4392

SEQ ID NO: 31897 - DNA, 1434 bp, Pseudomonas aeruginosa; identical to SEQ ID NO: 4393
  CDS (1)..(1434)

SEQ ID NO: 31898 - protein, 477 aa, Pseudomonas aeruginosa; identical to SEQ ID NO: 4394

SEQ ID NO: 31899 - DNA, 1368 bp, Pseudomonas aeruginosa; identical to SEQ ID NO: 4395
  CDS (1)..(1368)

SEQ ID NO: 31900 - protein, 455 aa, Pseudomonas aeruginosa; identical to SEQ ID NO: 4396

SEQ ID NO: 31901 - DNA, 1455 bp, Agrobacterium tumefaciens; identical to SEQ ID NO: 4397
  CDS (1)..(1455)

SEQ ID NO: 31902 - protein, 484 aa, Agrobacterium tumefaciens; identical to SEQ ID NO: 4398

SEQ ID NO: 31903 - DNA, 1482 bp, Bacillus subtilis; identical to SEQ ID NO: 4399
  CDS (1)..(1482)

SEQ ID NO: 31904 - protein, 493 aa, Bacillus subtilis; identical to SEQ ID NO: 4400

SEQ ID NO: 31905 - DNA, 1407 bp, Thermotoga maritima; identical to SEQ ID NO: 4401
  CDS (1)..(1407)

SEQ ID NO: 31906 - protein, 468 aa, Thermotoga maritima; identical to SEQ ID NO: 4402

SEQ ID NO: 31907 - DNA, 1485 bp, Xylella fastidiosa; identical to SEQ ID NO: 4403
  CDS (1)..(1485)

SEQ ID NO: 31908 - protein, 494 aa, Xylella fastidiosa; identical to SEQ ID NO: 4404

SEQ ID NO: 31909 - DNA, 2065 bp, Thiobacillus ferrooxidans; identical to SEQ ID NO: 4405
  CDS (336)..(1733)

SEQ ID NO: 31910 - protein, 465 aa, Thiobacillus ferrooxidans; identical to SEQ ID NO: 4406

SEQ ID NO: 31911 - DNA, 7174 bp, Medicago sativa (alfalfa); identical to SEQ ID NO: 4407
  CDS (228)..(6812)

SEQ ID NO: 31912 - protein, 2194 aa, Medicago sativa (alfalfa); identical to SEQ ID NO: 4408

SEQ ID NO: 31913 - DNA, 7231 bp, Saccharomyces cerevisiae; identical to SEQ ID NO: 4409
  CDS (678)..(7115)

SEQ ID NO: 31914 - protein, 2145 aa, Saccharomyces cerevisiae; identical to SEQ ID NO: 4410

SEQ ID NO: 31915 - DNA, 1485 bp, Synechocystis sp; identical to SEQ ID NO: 4411
  CDS (1)..(1485)

SEQ ID NO: 31916 - protein, 494 aa, Synechocystis sp; identical to SEQ ID NO: 4412

SEQ ID NO: 31917 - DNA, 3255 bp, Caenorhabditis elegans; identical to SEQ ID NO: 4413
  CDS (1)..(3255)

SEQ ID NO: 31918 - protein, 1084 aa, Caenorhabditis elegans; identical to SEQ ID NO: 4414

SEQ ID NO: 31919 - DNA, 6624 bp, Caenorhabditis elegans; identical to SEQ ID NO: 4415
  CDS (1)..(6624)

SEQ ID NO: 31920 - protein, 2207 aa, Caenorhabditis elegans; identical to SEQ ID NO: 4416

SEQ ID NO: 31921 - DNA, 6351 bp, Neurospora crassa; identical to SEQ ID NO: 4417
  CDS (1)..(6351)

SEQ ID NO: 31922 - protein, 2116 aa, Neurospora crassa; identical to SEQ ID NO: 4418

SEQ ID NO: 31923 - DNA, 2387 bp, Rhodobacter sphaeroides; identical to SEQ ID NO: 4419
  CDS (587)..(1828)

SEQ ID NO: 31924 - protein, 413 aa, Rhodobacter sphaeroides; identical to SEQ ID NO: 4420

SEQ ID NO: 31925 - DNA, 1800 bp, Pyrococcus sp; identical to SEQ ID NO: 4421
  CDS (144)..(1589)

SEQ ID NO: 31926 - protein, 481 aa, Pyrococcus sp; identical to SEQ ID NO: 4422

SEQ ID NO: 31927 - DNA, 1332 bp, Rhodobacter capsulatus; identical to SEQ ID NO: 4423
  CDS (1)..(1332)

SEQ ID NO: 31928 - protein, 443 aa, Rhodobacter capsulatus; identical to SEQ ID NO: 4424

SEQ ID NO: 31929 - DNA, 4358 bp, Rattus norvegicus; identical to SEQ ID NO: 4425
  CDS (59)..(3136)

SEQ ID NO: 31930 - protein, 1025 aa, Rattus norvegicus; identical to SEQ ID NO: 4426

SEQ ID NO: 31931 - DNA, 2124 bp, Moorella thermoacetica; identical to SEQ ID NO: 4427
  CDS (1)..(2124)

SEQ ID NO: 31932 - protein, 707 aa, Moorella thermoacetica; identical to SEQ ID NO: 4428

SEQ ID NO: 31933 - DNA, 1479 bp, Plectonema boryanum; identical to SEQ ID NO: 4429
  CDS (1)..(1479)

SEQ ID NO: 31934 - protein, 492 aa, Plectonema boryanum; identical to SEQ ID NO: 4430

SEQ ID NO: 31935 - DNA, 2016 bp, Yersinia pseudotuberculosis IP 32953; identical to SEQ ID NO: 4431
  CDS (1)..(2016)

SEQ ID NO: 31936 - protein, 671 aa, Yersinia pseudotuberculosis IP 32953; identical to SEQ ID NO: 4432

SEQ ID NO: 31937 - DNA, 4160 bp, Xenopus laevis; identical to SEQ ID NO: 4433
  CDS (101)..(2923)

SEQ ID NO: 31938 - protein, 940 aa, Xenopus laevis; identical to SEQ ID NO: 4434

SEQ ID NO: 31939 - DNA, 2550 bp, Azoarcus sp; identical to SEQ ID NO: 4435
  CDS (1)..(2550)

SEQ ID NO: 31940 - protein, 849 aa, Azoarcus sp; identical to SEQ ID NO: 4436

SEQ ID NO: 31941 - DNA, 1473 bp, Propionibacterium acnes; identical to SEQ ID NO: 4437
  CDS (1)..(1473)

SEQ ID NO: 31942 - protein, 490 aa, Propionibacterium acnes; identical to SEQ ID NO: 4438

SEQ ID NO: 31943 - DNA, 1458 bp, Leifsonia xyli; identical to SEQ ID NO: 4439
  CDS (1)..(1458)

SEQ ID NO: 31944 - protein, 485 aa, Leifsonia xyli; identical to SEQ ID NO: 4440

SEQ ID NO: 31945 - DNA, 2328 bp, Desulfotalea psychrophila; identical to SEQ ID NO: 4441
  CDS (1)..(2328)

SEQ ID NO: 31946 - protein, 775 aa, Desulfotalea psychrophila; identical to SEQ ID NO: 4442

SEQ ID NO: 31947 - DNA, 1764 bp, Desulfotalea psychrophila; identical to SEQ ID NO: 4443
  CDS (1)..(1764)

SEQ ID NO: 31948 - protein, 587 aa, Desulfotalea psychrophila; identical to SEQ ID NO: 4444

SEQ ID NO: 31949 - DNA, 2226 bp, Desulfotalea psychrophila; identical to SEQ ID NO: 4445
  CDS (1)..(2226)

SEQ ID NO: 31950 - protein, 741 aa, Desulfotalea psychrophila; identical to SEQ ID NO: 4446

SEQ ID NO: 31951 - DNA, 6360 bp, Yarrowia lipolytica CLIB99; identical to SEQ ID NO: 4447
  CDS (1)..(6360)

SEQ ID NO: 31952 - protein, 2119 aa, Yarrowia lipolytica CLIB99; identical to SEQ ID NO: 4448

SEQ ID NO: 31953 - DNA, 6426 bp, Kluyveromyces lactis NRRL Y; identical to SEQ ID NO: 4449
  CDS (1)..(6426)

SEQ ID NO: 31954 - protein, 2141 aa, Kluyveromyces lactis NRRL Y; identical to SEQ ID NO: 4450

SEQ ID NO: 31955 - DNA, 2025 bp, Erwinia carotovora; identical to SEQ ID NO: 4451
  CDS (1)..(2025)

SEQ ID NO: 31956 - protein, 674 aa, Erwinia carotovora; identical to SEQ ID NO: 4452

SEQ ID NO: 31957 - DNA, 1419 bp, Erwinia carotovora; identical to SEQ ID NO: 4453
  CDS (1)..(1419)

SEQ ID NO: 31958 - protein, 472 aa, Erwinia carotovora; identical to SEQ ID NO: 4454

SEQ ID NO: 31959 - DNA, 1422 bp, Acinetobacter sp; identical to SEQ ID NO: 4455
  CDS (1)..(1422)

SEQ ID NO: 31960 - protein, 473 aa, Acinetobacter sp; identical to SEQ ID NO: 4456

SEQ ID NO: 31961 - DNA, 6459 bp, Candida glabrata CBS138; identical to SEQ ID NO: 4457
  CDS (1)..(6459)

SEQ ID NO: 31962 - protein, 2152 aa, Candida glabrata CBS138; identical to SEQ ID NO: 4458

SEQ ID NO: 31963 - DNA, 1464 bp, Staphylococcus aureus; identical to SEQ ID NO: 4459
  CDS (1)..(1464)

SEQ ID NO: 31964 - protein, 487 aa, Staphylococcus aureus; identical to SEQ ID NO: 4460

SEQ ID NO: 31965 - DNA, 1830 bp, Oryza sativa; identical to SEQ ID NO: 4461
  CDS (1)..(1830)

SEQ ID NO: 31966 - protein, 609 aa, Oryza sativa; identical to SEQ ID NO: 4462

SEQ ID NO: 31967 - DNA, 4185 bp, Photobacterium profundum; identical to SEQ ID NO: 4463
  CDS (1)..(4185)

SEQ ID NO: 31968 - protein, 1394 aa, Photobacterium profundum; identical to SEQ ID NO: 4464

SEQ ID NO: 31969 - DNA, 1611 bp, Photobacterium profundum; identical to SEQ ID NO: 4465
  CDS (1)..(1611)

SEQ ID NO: 31970 - protein, 536 aa, Photobacterium profundum; identical to SEQ ID NO: 4466

SEQ ID NO: 31971 - DNA, 3144 bp, Photobacterium profundum; identical to SEQ ID NO: 4467
  CDS (1)..(3144)

SEQ ID NO: 31972 - protein, 1047 aa, Photobacterium profundum; identical to SEQ ID NO: 4468

SEQ ID NO: 31973 - DNA, 1473 bp, Photobacterium profundum; identical to SEQ ID NO: 4469
  CDS (1)..(1473)

SEQ ID NO: 31974 - protein, 490 aa, Photobacterium profundum; identical to SEQ ID NO: 4470

SEQ ID NO: 31975 - DNA, 1413 bp, Photobacterium profundum; identical to SEQ ID NO: 4471
  CDS (1)..(1413)

SEQ ID NO: 31976 - protein, 470 aa, Photobacterium profundum; identical to SEQ ID NO: 4472

SEQ ID NO: 31977 - DNA, 2835 bp, Rhodopseudomonas palustris; identical to SEQ ID NO: 4473
  CDS (1)..(2835)

SEQ ID NO: 31978 - protein, 944 aa, Rhodopseudomonas palustris; identical to SEQ ID NO: 4474

SEQ ID NO: 31979 - DNA, 1455 bp, Rhodopseudomonas palustris; identical to SEQ ID NO: 4475
  CDS (1)..(1455)

SEQ ID NO: 31980 - protein, 484 aa, Rhodopseudomonas palustris; identical to SEQ ID NO: 4476

SEQ ID NO: 31981 - DNA, 3108 bp, Rhodopseudomonas palustris; identical to SEQ ID NO: 4477
  CDS (1)..(3108)

SEQ ID NO: 31982 - protein, 1035 aa, Rhodopseudomonas palustris; identical to SEQ ID NO: 4478

SEQ ID NO: 31983 - DNA, 2022 bp, Rhodopseudomonas palustris; identical to SEQ ID NO: 4479
  CDS (1)..(2022)

SEQ ID NO: 31984 - protein, 673 aa, Rhodopseudomonas palustris; identical to SEQ ID NO: 4480

SEQ ID NO: 31985 - DNA, 3593 bp, Brachydanio rerio; identical to SEQ ID NO: 4481
  CDS (36)..(3104)

SEQ ID NO: 31986 - protein, 1022 aa, Brachydanio rerio; identical to SEQ ID NO: 4482

SEQ ID NO: 31987 - DNA, 1440 bp, uncultured bacterium 314; identical to SEQ ID NO: 4483
  CDS (1)..(1440)

SEQ ID NO: 31988 - protein, 479 aa, uncultured bacterium 314; identical to SEQ ID NO: 4484

SEQ ID NO: 31989 - DNA, 2331 bp, Desulfovibrio vulgaris; identical to SEQ ID NO: 4485
  CDS (1)..(2331)

SEQ ID NO: 31990 - protein, 776 aa, Desulfovibrio vulgaris; identical to SEQ ID NO: 4486

SEQ ID NO: 31991 - DNA, 1431 bp, Desulfovibrio vulgaris; identical to SEQ ID NO: 4487
  CDS (1)..(1431)

SEQ ID NO: 31992 - protein, 476 aa, Desulfovibrio vulgaris; identical to SEQ ID NO: 4488

SEQ ID NO: 31993 - DNA, 2022 bp, Desulfovibrio vulgaris; identical to SEQ ID NO: 4489
  CDS (1)..(2022)

SEQ ID NO: 31994 - protein, 673 aa, Desulfovibrio vulgaris; identical to SEQ ID NO: 4490

SEQ ID NO: 31995 - DNA, 2745 bp, Treponema denticola; identical to SEQ ID NO: 4491
  CDS (1)..(2745)

SEQ ID NO: 31996 - protein, 914 aa, Treponema denticola; identical to SEQ ID NO: 4492

SEQ ID NO: 31997 - DNA, 1830 bp, Treponema denticola; identical to SEQ ID NO: 4493
  CDS (1)..(1830)

SEQ ID NO: 31998 - protein, 609 aa, Treponema denticola; identical to SEQ ID NO: 4494

SEQ ID NO: 31999 - DNA, 1512 bp, Treponema denticola; identical to SEQ ID NO: 4495
  CDS (1)..(1512)

SEQ ID NO: 32000 - protein, 503 aa, Treponema denticola; identical to SEQ ID NO: 4496

SEQ ID NO: 32001 - DNA, 1413 bp, Geobacter sulfurreducens; identical to SEQ ID NO: 4497
  CDS (1)..(1413)

SEQ ID NO: 32002 - protein, 470 aa, Geobacter sulfurreducens; identical to SEQ ID NO: 4498

SEQ ID NO: 32003 - DNA, 2019 bp, Geobacter sulfurreducens; identical to SEQ ID NO: 4499
  CDS (1)..(2019)

SEQ ID NO: 32004 - protein, 672 aa, Geobacter sulfurreducens; identical to SEQ ID NO: 4500

SEQ ID NO: 32005 - DNA, 6588 bp, Ashbya gossypii; identical to SEQ ID NO: 4501
  CDS (1)..(6588)

SEQ ID NO: 32006 - protein, 2195 aa, Ashbya gossypii; identical to SEQ ID NO: 4502

SEQ ID NO: 32007 - DNA, 1383 bp, Wolinella succinogenes; identical to SEQ ID NO: 4503
  CDS (1)..(1383)

SEQ ID NO: 32008 - protein, 460 aa, Wolinella succinogenes; identical to SEQ ID NO: 4504

SEQ ID NO: 32009 - DNA, 1950 bp, Wolinella succinogenes; identical to SEQ ID NO: 4505
  CDS (1)..(1950)

SEQ ID NO: 32010 - protein, 649 aa, Wolinella succinogenes; identical to SEQ ID NO: 4506

SEQ ID NO: 32011 - DNA, 4200 bp, Vibrio vulnificus; identical to SEQ ID NO: 4507
  CDS (1)..(4200)

SEQ ID NO: 32012 - protein, 1399 aa, Vibrio vulnificus; identical to SEQ ID NO: 4508

SEQ ID NO: 32013 - DNA, 1470 bp, Vibrio vulnificus; identical to SEQ ID NO: 4509
  CDS (1)..(1470)

SEQ ID NO: 32014 - protein, 489 aa, Vibrio vulnificus; identical to SEQ ID NO: 4510

SEQ ID NO: 32015 - DNA, 1389 bp, Porphyromonas gingivalis; identical to SEQ ID NO: 4511
  CDS (1)..(1389)

SEQ ID NO: 32016 - protein, 462 aa, Porphyromonas gingivalis; identical to SEQ ID NO: 4512

SEQ ID NO: 32017 - DNA, 1419 bp, Photorhabdus luminescens; identical to SEQ ID NO: 4513
  CDS (1)..(1419)

SEQ ID NO: 32018 - protein, 472 aa, Photorhabdus luminescens; identical to SEQ ID NO: 4514

SEQ ID NO: 32019 - DNA, 1431 bp, Chromobacterium violaceum; identical to SEQ ID NO: 4515
  CDS (1)..(1431)

SEQ ID NO: 32020 - protein, 476 aa, Chromobacterium violaceum; identical to SEQ ID NO: 4516

SEQ ID NO: 32021 - DNA, 1293 bp, Anopheles gambiae str; identical to SEQ ID NO: 4517
  CDS (1)..(1293)

SEQ ID NO: 32022 - protein, 430 aa, Anopheles gambiae str; identical to SEQ ID NO: 4518

SEQ ID NO: 32023 - DNA, 2733 bp, Giardia lamblia ATCC 50803; identical to SEQ ID NO: 4519
  CDS (1)..(2733)

SEQ ID NO: 32024 - protein, 910 aa, Giardia lamblia ATCC 50803; identical to SEQ ID NO: 4520

SEQ ID NO: 32025 - DNA, 8874 bp, Plasmodium yoelii yoelii; identical to SEQ ID NO: 4521
  CDS (1)..(8874)

SEQ ID NO: 32026 - protein, 2957 aa, Plasmodium yoelii yoelii; identical to SEQ ID NO: 4522

SEQ ID NO: 32027 - DNA, 1467 bp, Mycobacterium bovis; identical to SEQ ID NO: 4523
  CDS (1)..(1467)

SEQ ID NO: 32028 - protein, 488 aa, Mycobacterium bovis; identical to SEQ ID NO: 4524

SEQ ID NO: 32029 - DNA, 1503 bp, Rhodopirellula baltica; identical to SEQ ID NO: 4525
  CDS (1)..(1503)

SEQ ID NO: 32030 - protein, 500 aa, Rhodopirellula baltica; identical to SEQ ID NO: 4526

SEQ ID NO: 32031 - DNA, 1710 bp, Prochlorococcus marinus; identical to SEQ ID NO: 4527
  CDS (1)..(1710)

SEQ ID NO: 32032 - protein, 569 aa, Prochlorococcus marinus; identical to SEQ ID NO: 4528

SEQ ID NO: 32033 - DNA, 1479 bp, Bordetella parapertussis; identical to SEQ ID NO: 4529
  CDS (1)..(1479)

SEQ ID NO: 32034 - protein, 492 aa, Bordetella parapertussis; identical to SEQ ID NO: 4530

SEQ ID NO: 32035 - DNA, 1491 bp, Streptomyces avermitilis; identical to SEQ ID NO: 4531
  CDS (1)..(1491)

SEQ ID NO: 32036 - protein, 496 aa, Streptomyces avermitilis; identical to SEQ ID NO: 4532

SEQ ID NO: 32037 - DNA, 1461 bp, Streptomyces avermitilis; identical to SEQ ID NO: 4533
  CDS (1)..(1461)

SEQ ID NO: 32038 - protein, 486 aa, Streptomyces avermitilis; identical to SEQ ID NO: 4534

SEQ ID NO: 32039 - DNA, 3024 bp, Enterococcus faecalis; identical to SEQ ID NO: 4535
  CDS (19)..(3024)

SEQ ID NO: 32040 - protein, 1001 aa, Enterococcus faecalis; identical to SEQ ID NO: 4536

SEQ ID NO: 32041 - DNA, 1437 bp, Enterococcus faecalis; identical to SEQ ID NO: 4537
  CDS (19)..(1437)

SEQ ID NO: 32042 - protein, 472 aa, Enterococcus faecalis; identical to SEQ ID NO: 4538

SEQ ID NO: 32043 - DNA, 1239 bp, Shigella flexneri; identical to SEQ ID NO: 4539
  CDS (1)..(1239)

SEQ ID NO: 32044 - protein, 412 aa, Shigella flexneri; identical to SEQ ID NO: 4540

SEQ ID NO: 32045 - DNA, 1401 bp, Clostridium saccharobutylicum; identical to SEQ ID NO: 4541
  CDS (85)..(1329)

SEQ ID NO: 32046 - protein, 414 aa, Clostridium saccharobutylicum; identical to SEQ ID NO: 4542

SEQ ID NO: 32047 - DNA, 1347 bp, Brevibacillus agri; identical to SEQ ID NO: 4543
  CDS (1)..(1347)

SEQ ID NO: 32048 - protein, 448 aa, Brevibacillus agri; identical to SEQ ID NO: 4544

SEQ ID NO: 32049 - DNA, 3073 bp, Drosophila melanogaster; identical to SEQ ID NO: 4545
  CDS (966)..(2894)

SEQ ID NO: 32050 - protein, 642 aa, Drosophila melanogaster; identical to SEQ ID NO: 4546

SEQ ID NO: 32051 - DNA, 1485 bp, Xylella fastidiosa; identical to SEQ ID NO: 4547
  CDS (1)..(1485)

SEQ ID NO: 32052 - protein, 494 aa, Xylella fastidiosa; identical to SEQ ID NO: 4548

SEQ ID NO: 32053 - DNA, 4269 bp, Vibrio parahaemolyticus; identical to SEQ ID NO: 4549
  CDS (1)..(4269)

SEQ ID NO: 32054 - protein, 1422 aa, Vibrio parahaemolyticus; identical to SEQ ID NO: 4550

SEQ ID NO: 32055 - DNA, 1797 bp, Vibrio parahaemolyticus; identical to SEQ ID NO: 4551
  CDS (1)..(1797)

SEQ ID NO: 32056 - protein, 598 aa, Vibrio parahaemolyticus; identical to SEQ ID NO: 4552

SEQ ID NO: 32057 - DNA, 1470 bp, Vibrio parahaemolyticus; identical to SEQ ID NO: 4553
  CDS (1)..(1470)

SEQ ID NO: 32058 - protein, 489 aa, Vibrio parahaemolyticus; identical to SEQ ID NO: 4554

SEQ ID NO: 32059 - DNA, 1413 bp, Vibrio parahaemolyticus; identical to SEQ ID NO: 4555
  CDS (1)..(1413)

SEQ ID NO: 32060 - protein, 470 aa, Vibrio parahaemolyticus; identical to SEQ ID NO: 4556

SEQ ID NO: 32061 - DNA, 1419 bp, Pseudomonas syringae; identical to SEQ ID NO: 4557
  CDS (1)..(1419)

SEQ ID NO: 32062 - protein, 472 aa, Pseudomonas syringae; identical to SEQ ID NO: 4558

SEQ ID NO: 32063 - DNA, 1419 bp, Pseudomonas putida; identical to SEQ ID NO: 4559
  CDS (1)..(1419)

SEQ ID NO: 32064 - protein, 472 aa, Pseudomonas putida; identical to SEQ ID NO: 4560

SEQ ID NO: 32065 - DNA, 1368 bp, Pseudomonas putida; identical to SEQ ID NO: 4561
  CDS (1)..(1368)

SEQ ID NO: 32066 - protein, 455 aa, Pseudomonas putida; identical to SEQ ID NO: 4562

SEQ ID NO: 32067 - DNA, 1425 bp, Clostridium tetani; identical to SEQ ID NO: 4563
  CDS (1)..(1425)

SEQ ID NO: 32068 - protein, 474 aa, Clostridium tetani; identical to SEQ ID NO: 4564

SEQ ID NO: 32069 - DNA, 1272 bp, Clostridium tetani; identical to SEQ ID NO: 4565
  CDS (1)..(1272)

SEQ ID NO: 32070 - protein, 423 aa, Clostridium tetani; identical to SEQ ID NO: 4566

SEQ ID NO: 32071 - DNA, 1452 bp, Bradyrhizobium japonicum; identical to SEQ ID NO: 4567
  CDS (1)..(1452)

SEQ ID NO: 32072 - protein, 483 aa, Bradyrhizobium japonicum; identical to SEQ ID NO: 4568

SEQ ID NO: 32073 - DNA, 1800 bp, Bradyrhizobium japonicum; identical to SEQ ID NO: 4569
  CDS (1)..(1800)

SEQ ID NO: 32074 - protein, 599 aa, Bradyrhizobium japonicum; identical to SEQ ID NO: 4570

SEQ ID NO: 32075 - DNA, 2292 bp, Bacteroides thetaiotaomicron; identical to SEQ ID NO: 4571
  CDS (1)..(2292)

SEQ ID NO: 32076 - protein, 763 aa, Bacteroides thetaiotaomicron; identical to SEQ ID NO: 4572

SEQ ID NO: 32077 - DNA, 1341 bp, Bacteroides thetaiotaomicron; identical to SEQ ID NO: 4573
  CDS (1)..(1341)

SEQ ID NO: 32078 - protein, 446 aa, Bacteroides thetaiotaomicron; identical to SEQ ID NO: 4574

SEQ ID NO: 32079 - DNA, 4452 bp, Mus musculus; identical to SEQ ID NO: 4575
  CDS (100)..(3177)

SEQ ID NO: 32080 - protein, 1025 aa, Mus musculus; identical to SEQ ID NO: 4576

SEQ ID NO: 32081 - DNA, 1464 bp, Staphylococcus epidermidis; identical to SEQ ID NO: 4577
  CDS (1)..(1464)

SEQ ID NO: 32082 - protein, 487 aa, Staphylococcus epidermidis; identical to SEQ ID NO: 4578

SEQ ID NO: 32083 - DNA, 1437 bp, Streptococcus mutans; identical to SEQ ID NO: 4579
  CDS (1)..(1437)

SEQ ID NO: 32084 - protein, 478 aa, Streptococcus mutans; identical to SEQ ID NO: 4580

SEQ ID NO: 32085 - DNA, 1419 bp, Vibrio vulnificus; identical to SEQ ID NO: 4581
  CDS (1)..(1419)

SEQ ID NO: 32086 - protein, 472 aa, Vibrio vulnificus; identical to SEQ ID NO: 4582

SEQ ID NO: 32087 - DNA, 1407 bp, Shewanella oneidensis; identical to SEQ ID NO: 4583
  CDS (1)..(1407)

SEQ ID NO: 32088 - protein, 468 aa, Shewanella oneidensis; identical to SEQ ID NO: 4584

SEQ ID NO: 32089 - DNA, 4287 bp, Shewanella oneidensis; identical to SEQ ID NO: 4585
  CDS (1)..(4287)

SEQ ID NO: 32090 - protein, 1428 aa, Shewanella oneidensis; identical to SEQ ID NO: 4586

SEQ ID NO: 32091 - DNA, 1485 bp, Oceanobacillus iheyensis; identical to SEQ ID NO: 4587
  CDS (1)..(1485)

SEQ ID NO: 32092 - protein, 494 aa, Oceanobacillus iheyensis; identical to SEQ ID NO: 4588

SEQ ID NO: 32093 - DNA, 3099 bp, Escherichia coli O6; identical to SEQ ID NO: 4589
  CDS (1)..(3099)

SEQ ID NO: 32094 - protein, 1032 aa, Escherichia coli O6; identical to SEQ ID NO: 4590

SEQ ID NO: 32095 - DNA, 1980 bp, Escherichia coli O6; identical to SEQ ID NO: 4591
  CDS (1)..(1980)

SEQ ID NO: 32096 - protein, 659 aa, Escherichia coli O6; identical to SEQ ID NO: 4592

SEQ ID NO: 32097 - DNA, 1239 bp, Escherichia coli O6; identical to SEQ ID NO: 4593
  CDS (1)..(1239)

SEQ ID NO: 32098 - protein, 412 aa, Escherichia coli O6; identical to SEQ ID NO: 4594

SEQ ID NO: 32099 - DNA, 1527 bp, Corynebacterium efficiens; identical to SEQ ID NO: 4595
  CDS (1)..(1527)

SEQ ID NO: 32100 - protein, 508 aa, Corynebacterium efficiens; identical to SEQ ID NO: 4596

SEQ ID NO: 32101 - DNA, 1455 bp, Brucella suis; identical to SEQ ID NO: 4597
  CDS (1)..(1455)

SEQ ID NO: 32102 - protein, 484 aa, Brucella suis; identical to SEQ ID NO: 4598

SEQ ID NO: 32103 - DNA, 1506 bp, Brucella suis; identical to SEQ ID NO: 4599
  CDS (1)..(1506)

SEQ ID NO: 32104 - protein, 501 aa, Brucella suis; identical to SEQ ID NO: 4600

SEQ ID NO: 32105 - DNA, 1536 bp, Bifidobacterium longum; identical to SEQ ID NO: 4601
  CDS (1)..(1536)

SEQ ID NO: 32106 - protein, 511 aa, Bifidobacterium longum; identical to SEQ ID NO: 4602

SEQ ID NO: 32107 - DNA, 9321 bp, Plasmodium falciparum; identical to SEQ ID NO: 4603
  CDS (1)..(9321)

SEQ ID NO: 32108 - protein, 3106 aa, Plasmodium falciparum; identical to SEQ ID NO: 4604

SEQ ID NO: 32109 - DNA, 1734 bp, Chlorobium tepidum; identical to SEQ ID NO: 4605
  CDS (1)..(1734)

SEQ ID NO: 32110 - protein, 577 aa, Chlorobium tepidum; identical to SEQ ID NO: 4606

SEQ ID NO: 32111 - DNA, 1419 bp, Chlorobium tepidum; identical to SEQ ID NO: 4607
  CDS (1)..(1419)

SEQ ID NO: 32112 - protein, 472 aa, Chlorobium tepidum; identical to SEQ ID NO: 4608

SEQ ID NO: 32113 - DNA, 1473 bp, Chlorobium tepidum; identical to SEQ ID NO: 4609
  CDS (1)..(1473)

SEQ ID NO: 32114 - protein, 490 aa, Chlorobium tepidum; identical to SEQ ID NO: 4610

SEQ ID NO: 32115 - DNA, 1749 bp, Chlorobium tepidum; identical to SEQ ID NO: 4611
  CDS (1)..(1749)

SEQ ID NO: 32116 - protein, 582 aa, Chlorobium tepidum; identical to SEQ ID NO: 4612

SEQ ID NO: 32117 - DNA, 1521 bp, Corynebacterium glutamicum; identical to SEQ ID NO: 4613
  CDS (1)..(1521)

SEQ ID NO: 32118 - protein, 506 aa, Corynebacterium glutamicum; identical to SEQ ID NO: 4614

SEQ ID NO: 32119 - DNA, 1482 bp, Xanthomonas campestris; identical to SEQ ID NO: 4615
  CDS (1)..(1482)

SEQ ID NO: 32120 - protein, 493 aa, Xanthomonas campestris; identical to SEQ ID NO: 4616

SEQ ID NO: 32121 - DNA, 1482 bp, Xanthomonas axonopodis; identical to SEQ ID NO: 4617
  CDS (1)..(1482)

SEQ ID NO: 32122 - protein, 493 aa, Xanthomonas axonopodis; identical to SEQ ID NO: 4618

SEQ ID NO: 32123 - DNA, 1410 bp, Methanosarcina mazei; identical to SEQ ID NO: 4619
  CDS (1)..(1410)

SEQ ID NO: 32124 - protein, 469 aa, Methanosarcina mazei; identical to SEQ ID NO: 4620

SEQ ID NO: 32125 - DNA, 1401 bp, Thermoanaerobacter tengcongensis; identical to SEQ ID NO: 4621
  CDS (1)..(1401)

SEQ ID NO: 32126 - protein, 466 aa, Thermoanaerobacter tengcongensis; identical to SEQ ID NO: 4622

SEQ ID NO: 32127 - DNA, 1395 bp, Thermoanaerobacter tengcongensis; identical to SEQ ID NO: 4623
  CDS (1)..(1395)

SEQ ID NO: 32128 - protein, 464 aa, Thermoanaerobacter tengcongensis; identical to SEQ ID NO: 4624

SEQ ID NO: 32129 - DNA, 1410 bp, Methanosarcina acetivorans; identical to SEQ ID NO: 4625
  CDS (1)..(1410)

SEQ ID NO: 32130 - protein, 469 aa, Methanosarcina acetivorans; identical to SEQ ID NO: 4626

SEQ ID NO: 32131 - DNA, 1431 bp, Pyrococcus furiosus; identical to SEQ ID NO: 4627
  CDS (1)..(1431)

SEQ ID NO: 32132 - protein, 476 aa, Pyrococcus furiosus; identical to SEQ ID NO: 4628

SEQ ID NO: 32133 - DNA, 1425 bp, Pyrococcus furiosus; identical to SEQ ID NO: 4629
  CDS (1)..(1425)

SEQ ID NO: 32134 - protein, 474 aa, Pyrococcus furiosus; identical to SEQ ID NO: 4630

SEQ ID NO: 32135 - DNA, 2553 bp, Azoarcus evansii; identical to SEQ ID NO: 4631
  CDS (1)..(2553)

SEQ ID NO: 32136 - protein, 850 aa, Azoarcus evansii; identical to SEQ ID NO: 4632

SEQ ID NO: 32137 - DNA, 1242 bp, Clostridium perfringens; identical to SEQ ID NO: 4633
  CDS (1)..(1242)

SEQ ID NO: 32138 - protein, 413 aa, Clostridium perfringens; identical to SEQ ID NO: 4634

SEQ ID NO: 32139 - DNA, 1407 bp, Clostridium perfringens; identical to SEQ ID NO: 4635
  CDS (1)..(1407)

SEQ ID NO: 32140 - protein, 468 aa, Clostridium perfringens; identical to SEQ ID NO: 4636

SEQ ID NO: 32141 - DNA, 1464 bp, Ralstonia solanacearum; identical to SEQ ID NO: 4637
  CDS (1)..(1464)

SEQ ID NO: 32142 - protein, 487 aa, Ralstonia solanacearum; identical to SEQ ID NO: 4638

SEQ ID NO: 32143 - DNA, 1962 bp, Salmonella typhimurium; identical to SEQ ID NO: 4639
  CDS (1)..(1962)

SEQ ID NO: 32144 - protein, 653 aa, Salmonella typhimurium; identical to SEQ ID NO: 4640

SEQ ID NO: 32145 - DNA, 1437 bp, Rhizobium meliloti; identical to SEQ ID NO: 4641
  CDS (1)..(1437)

SEQ ID NO: 32146 - protein, 478 aa, Rhizobium meliloti; identical to SEQ ID NO: 4642

SEQ ID NO: 32147 - DNA, 1362 bp, Rhizobium meliloti; identical to SEQ ID NO: 4643
  CDS (1)..(1362)

SEQ ID NO: 32148 - protein, 453 aa, Rhizobium meliloti; identical to SEQ ID NO: 4644

SEQ ID NO: 32149 - DNA, 1428 bp, Klebsiella aerogenes; identical to SEQ ID NO: 4645
  CDS (10)..(1428)

SEQ ID NO: 32150 - protein, 472 aa, Klebsiella aerogenes; identical to SEQ ID NO: 4646

SEQ ID NO: 32151 - DNA, 1491 bp, Streptomyces coelicolor; identical to SEQ ID NO: 4647
  CDS (1)..(1491)

SEQ ID NO: 32152 - protein, 496 aa, Streptomyces coelicolor; identical to SEQ ID NO: 4648

SEQ ID NO: 32153 - DNA, 1455 bp, Thermoplasma volcanium; identical to SEQ ID NO: 4649
  CDS (1)..(1455)

SEQ ID NO: 32154 - protein, 484 aa, Thermoplasma volcanium; identical to SEQ ID NO: 4650

SEQ ID NO: 32155 - DNA, 1455 bp, Rhizobium loti; identical to SEQ ID NO: 4651
  CDS (1)..(1455)

SEQ ID NO: 32156 - protein, 484 aa, Rhizobium loti; identical to SEQ ID NO: 4652

SEQ ID NO: 32157 - DNA, 1356 bp, Rhizobium loti; identical to SEQ ID NO: 4653
  CDS (1)..(1356)

SEQ ID NO: 32158 - protein, 451 aa, Rhizobium loti; identical to SEQ ID NO: 4654

SEQ ID NO: 32159 - DNA, 1965 bp, Chromatium vinosum; identical to SEQ ID NO: 4655
  CDS (1)..(1965)

SEQ ID NO: 32160 - protein, 654 aa, Chromatium vinosum; identical to SEQ ID NO: 4656

SEQ ID NO: 32161 - DNA, 1455 bp, Thermoplasma acidophilum; identical to SEQ ID NO: 4657
  CDS (1)..(1455)

SEQ ID NO: 32162 - protein, 484 aa, Thermoplasma acidophilum; identical to SEQ ID NO: 4658

SEQ ID NO: 32163 - DNA, 6651 bp, Arabidopsis thaliana; identical to SEQ ID NO: 4659
  CDS (1)..(6651)

SEQ ID NO: 32164 - protein, 2216 aa, Arabidopsis thaliana; identical to SEQ ID NO: 4660

SEQ ID NO: 32165 - DNA, 1473 bp, Zymomonas mobilis; identical to SEQ ID NO: 4661
  CDS (1)..(1473)

SEQ ID NO: 32166 - protein, 490 aa, Zymomonas mobilis; identical to SEQ ID NO: 4662

SEQ ID NO: 32167 - DNA, 1473 bp, Clostridium saccharobutylicum; identical to SEQ ID NO: 4663
  CDS (1)..(1473)

SEQ ID NO: 32168 - protein, 490 aa, Clostridium saccharobutylicum; identical to SEQ ID NO: 4664

SEQ ID NO: 32169 - DNA, 1521 bp, Corynebacterium glutamicum; identical to SEQ ID NO: 4665
  CDS (1)..(1521)

SEQ ID NO: 32170 - protein, 506 aa, Corynebacterium glutamicum; identical to SEQ ID NO: 4666

SEQ ID NO: 32171 - DNA, 7037 bp, Oryza sativa; identical to SEQ ID NO: 4667
  CDS (262)..(6762)

SEQ ID NO: 32172 - protein, 2166 aa, Oryza sativa; identical to SEQ ID NO: 4668

SEQ ID NO: 32173 - DNA, 4421 bp, Bos taurus; identical to SEQ ID NO: 4669
  CDS (75)..(3152)

SEQ ID NO: 32174 - protein, 1025 aa, Bos taurus; identical to SEQ ID NO: 4670

SEQ ID NO: 32175 - DNA, 6336 bp, Schizosaccharomyces pombe; identical to SEQ ID NO: 4671
  CDS (1)..(6336)

SEQ ID NO: 32176 - protein, 2111 aa, Schizosaccharomyces pombe; identical to SEQ ID NO: 4672

SEQ ID NO: 32177 - DNA, 7056 bp, Saccharomyces cerevisiae; identical to SEQ ID NO: 4673
  CDS (263)..(6697)

SEQ ID NO: 32178 - protein, 2144 aa, Saccharomyces cerevisiae; identical to SEQ ID NO: 4674

SEQ ID NO: 32179 - DNA, 1449 bp, Azospirillum brasilense; identical to SEQ ID NO: 4675
  CDS (1)..(1449)

SEQ ID NO: 32180 - protein, 482 aa, Azospirillum brasilense; identical to SEQ ID NO: 4676

SEQ ID NO: 32181 - DNA, 27 bp, Artificial sequence
  (1)..(27): primer
atgagtcagaatgtttatcaatttatc

SEQ ID NO: 32182 - DNA, 26 bp, Artificial sequence
  (1)..(26): primer
ttaaacttccagccagttcataatac

SEQ ID NO: 32183 - protein, 313 aa, Artificial sequence; identical to SEQ ID NO: 6175
  Variant (3)..(6): xaa in position 3 to 6 is any amino acid
  Variant (9)..(27): xaa in position 9 to 27 is any amino acid
  Variant (29)..(35): xaa in position 29 to 35 is any amino acid
  Variant (37)..(38): xaa in position 37 to 38 is any amino acid
  Variant (40)..(42): xaa in position 40 to 42 is any amino acid
  Variant (45)..(45): xaa in position 45 is any amino acid
  Variant (48)..(74): xaa in position 48 to 74 is any amino acid
  Variant (76)..(127): xaa in position 76 to 127 is any amino acid
  Variant (129)..(130): xaa in position 129 to 130 is any amino acid
  Variant (132)..(132): xaa in position 132 is any amino acid
  Variant (138)..(139): xaa in position 138 to 139 is any amino acid
  Variant (141)..(142): xaa in position 141 to 142 is any amino acid
  Variant (144)..(146): xaa in position 144 to 146 is any amino acid
  Variant (148)..(161): xaa in position 148 to 161 is any amino acid
  Variant (164)..(167): xaa in position 164 to 167 is any amino acid
  Variant (171)..(190): xaa in position 171 to 190 is any amino acid
  Variant (192)..(200): xaa in position 192 to 200 is any amino acid
  Variant (202)..(227): xaa in position 202 to 227 is any amino acid
  Variant (229)..(233): xaa in position 229 to 233 is any amino acid
  Variant (235)..(256): xaa in position 235 to 256 is any amino acid
  Variant (258)..(260): xaa in position 258 to 260 is any amino acid
  Variant (262)..(294): xaa in position 262 to 294 is any amino acid
  Variant (296)..(296): xaa in position 296 is any amino acid
  Variant (298)..(298): xaa in position 298 is any amino acid
  Variant (302)..(302): xaa in position 302 is any amino acid
  Variant (304)..(305): xaa in position 304 to 305 is any amino acid
  Variant (307)..(312): xaa in position 307 to 312 is any amino acid

SEQ ID NO: 32184 - protein, 48 aa, Artificial sequence; identical to SEQ ID NO: 6172
  Variant (1)..(1): xaa in position 1 is Val, Ile or Ala
  Variant (2)..(2): xaa in position 2 is Ala or Gly
  Variant (3)..(3): xaa in position 3 is Ile, Val or Leu
  Variant (4)..(4): xaa in position 4 is Ile, Val or Phe
  Variant (6)..(6): xaa in position 6 is Ser, Ala, Gly or Cys
  Variant (9)..(9): xaa in position 9 is Ala, Ser or Gly
  Variant (10)..(10): xaa in position 10 is Gly or Ser
  Variant (11)..(11): xaa in position 11 is Leu, Ile or Met
  Variant (12)..(13): xaa in position 12 to 13 is any amino acid
  Variant (14)..(14): xaa in position 14 is Ala, Ser or Gly
  Variant (15)..(16): xaa in position 15 to 16 is any amino acid
  Variant (17)..(17): xaa in position 17 is Leu or Met
  Variant (18)..(20): xaa in position 18 to 20 is any amino acid
  Variant (22)..(25): xaa in position 22 to 25 is any amino acid
  Variant (26)..(26): xaa in position 26 is any or no amino acid
  Variant (27)..(27): xaa in position 27 is Val, Ile or Leu
  Variant (28)..(28): xaa in position 28 is Phe, Tyr or His
  Variant (29)..(29): xaa in position 29 is Glu or Asp
  Variant (30)..(30): xaa in position 30 is Arg, Ala, Lys, Glu or Ser
  Variant (31)..(34): xaa in position 31 to 34 is any amino acid
  Variant (35)..(36): xaa in position 35 to 36 is any or no amino acid
  Variant (39)..(42): xaa in position 39 to 42 is any amino acid
  Variant (43)..(43): xaa in position 43 is Gly, Glu or Ile
  Variant (44)..(44): xaa in position 44 is Ile or Val
  Variant (45)..(45): xaa in position 45 is Pro or Ala
  Variant (46)..(46): xaa in position 46 is any amino acid
  Variant (47)..(47): xaa in position 47 is Phe, Tyr, Met or Val
  Variant (48)..(48): xaa in position 48 is Lys or Arg

SEQ ID NO: 32185 - protein, 19 aa, Artificial sequence
  Variant (1)..(1): xaa in position 1 is Val, Ala, Thr, Leu or Ile
  Variant (2)..(2): xaa in position 2 is Val, Ile, Ala or Leu
  Variant (3)..(3): xaa in position 3 is Val or Ile
  Variant (4)..(4): xaa in position 4 is Ile, Leu, Val or Phe
  Variant (6)..(6): xaa in position 6 is Gly or Ala
  Variant (8)..(8): xaa in position 8 is Asp, Asn, Phe or Met
  Variant (9)..(9): xaa in position 9 is Thr or Val
  Variant (10)..(10): xaa in position 10 is Ala or Gly
  Variant (11)..(11): xaa in position 11 is any amino acid
  Variant (13)..(13): xaa in position 13 is Cys, Ala, Val or Ser
  Variant (14)..(16): xaa in position 14 to 16 is any amino acid
  Variant (17)..(17): xaa in position 17 is Ala, Ser, Leu, Val or Met
  Variant (18)..(18): xaa in position 18 is any amino acid
  Variant (19)..(19): xaa in position 19 is Arg, Leu or Val
XXXXGXGXXXXDXXXXXXX

SEQ ID NO: 32186 - protein, 28 aa, Artificial sequence
  Variant (1)..(1): xaa in position 1 is Val, Ile, Leu, Thr or Cys
  Variant (2)..(2): xaa in position 2 is Phe, Tyr, Trp, Gly or Leu
  Variant (3)..(4): xaa in position 3 to 4 is any amino acid
  Variant (5)..(5): xaa in position 5 is Gly or Lys
  Variant (6)..(6): xaa in position 6 is Asp or Arg
  Variant (7)..(9): xaa in position 7 to 9 is any amino acid
  Variant (10)..(10): xaa in position 10 is Gly or Cys
  Variant (11)..(12): xaa in position 11 to 12 is any amino acid
  Variant (13)..(20): xaa in position 13 to 20 is any or no amino acid
  Variant (21)..(21): xaa in position 21 is Val, Ile, Ala, Thr or Leu
  Variant (22)..(22): xaa in position 22 is Val, Ile or Leu
  Variant (23)..(23): xaa in position 23 is any amino acid
  Variant (24)..(24): xaa in position 24 is Ala, Gly, Cys or Ser
  Variant (25)..(25): xaa in position 25 is Ile, Val, Met, Ala or Leu
  Variant (26)..(27): xaa in position 26 to 27 is any amino acid
  Variant (28)..(28): xaa in position 28 is Gly, Ile or Ala
XXXXXXXXXXXXXXXXXXXXXXXXXXXX

SEQ ID NO: 32187 - DNA, 723 bp, Escherichia coli K12; identical to SEQ ID NO: 2001
  CDS (1)..(723)

SEQ ID NO: 32188 - protein, 240 aa, Escherichia coli K12; identical to SEQ ID NO: 2002

SEQ ID NO: 32189 - DNA, 507 bp, Aquifex aeolicus; identical to SEQ ID NO: 2003
  CDS (1)..(507)

SEQ ID NO: 32190 - protein, 168 aa, Aquifex aeolicus; identical to SEQ ID NO: 2004

SEQ ID NO: 32191 - DNA, 717 bp, Deinococcus radiodurans; identical to SEQ ID NO: 2005
  CDS (1)..(717)

SEQ ID NO: 32192 - protein, 238 aa, Deinococcus radiodurans; identical to SEQ ID NO: 2006

SEQ ID NO: 32193 - DNA, 498 bp, Campylobacter jejuni; identical to SEQ ID NO: 2007
  CDS (1)..(498)

SEQ ID NO: 32194 - protein, 165 aa, Campylobacter jejuni; identical to SEQ ID NO: 2008

SEQ ID NO: 32195 - DNA, 546 bp, Salmonella enterica subsp. enterica serovar Typhi; identical to SEQ ID NO: 2009
  CDS (1)..(546)

SEQ ID NO: 32196 - protein, 181 aa, Salmonella enterica subsp. enterica serovar Typhi; identical to SEQ ID NO: 2010

SEQ ID NO: 32197 - DNA, 522 bp, Salmonella enterica subsp. enterica serovar Typhi; identical to SEQ ID NO: 2011
  CDS (1)..(522)

SEQ ID NO: 32198 - protein, 173 aa, Salmonella enterica subsp. enterica serovar Typhi; identical to SEQ ID NO: 2012

SEQ ID NO: 32199 - DNA, 474 bp, Listeria innocua; identical to SEQ ID NO: 2013
  CDS (1)..(474)

SEQ ID NO: 32200 - protein, 157 aa, Listeria innocua; identical to SEQ ID NO: 2014

SEQ ID NO: 32201 - DNA, 474 bp, Listeria monocytogenes; identical to SEQ ID NO: 2015
  CDS (1)..(474)

SEQ ID NO: 32202 - protein, 157 aa, Listeria monocytogenes; identical to SEQ ID NO: 2016

SEQ ID NO: 32203 - DNA, 525 bp, Yersinia pestis; identical to SEQ ID NO: 2017
  CDS (1)..(525)

SEQ ID NO: 32204 - protein, 174 aa, Yersinia pestis; identical to SEQ ID NO: 2018

SEQ ID NO: 32205 - DNA, 546 bp, Nostoc sp. PCC 7120; identical to SEQ ID NO: 2019
  CDS (1)..(546)

SEQ ID NO: 32206 - protein, 181 aa, Nostoc sp. PCC 7120; identical to SEQ ID NO: 2020

SEQ ID NO: 32207 - DNA, 1479 bp, Thermotoga maritima; identical to SEQ ID NO: 2021
  CDS (1)..(1479)

SEQ ID NO: 32208 - protein, 492 aa, Thermotoga maritima; identical to SEQ ID NO: 2022

SEQ ID NO: 32209 - DNA, 525 bp, Vibrio cholerae; identical to SEQ ID NO: 2023
  CDS (1)..(525)

SEQ ID NO: 32210 - protein, 174 aa, Vibrio cholerae; identical to SEQ ID NO: 2024

SEQ ID NO: 32211 - DNA, 531 bp, Chlamydophila pneumoniae, Chlamydia pneumoniae; identical to SEQ ID NO: 2025
  CDS (1)..(531)

SEQ ID NO: 32212 - protein, 176 aa, Chlamydophila pneumoniae, Chlamydia pneumoniae; identical to SEQ ID NO: 2026

SEQ ID NO: 32213 - DNA, 477 bp, Streptococcus pneumoniae; identical to SEQ ID NO: 2027
  CDS (1)..(477)

SEQ ID NO: 32214 - protein, 158 aa, Streptococcus pneumoniae; identical to SEQ ID NO: 2028

SEQ ID NO: 32215 - DNA, 477 bp, Streptococcus pneumoniae; identical to SEQ ID NO: 2029
  CDS (1)..(477)

SEQ ID NO: 32216 - protein, 158 aa, Streptococcus pneumoniae; identical to SEQ ID NO: 2030

SEQ ID NO: 32217 - DNA, 543 bp, Xylella fastidiosa; identical to SEQ ID NO: 2031
  CDS (1)..(543)

SEQ ID NO: 32218 - protein, 180 aa, Xylella fastidiosa; identical to SEQ ID NO: 2032

SEQ ID NO: 32219 - DNA, 552 bp, Bacillus halodurans; identical to SEQ ID NO: 2033
  CDS (1)..(552)

SEQ ID NO: 32220 - protein, 183 aa, Bacillus halodurans; identical to SEQ ID NO: 2034

SEQ ID NO: 32221 - DNA, 489 bp, Helicobacter pylori; identical to SEQ ID NO: 2035
  CDS (1)..(489)

SEQ ID NO: 32222 - protein, 162 aa, Helicobacter pylori; identical to SEQ ID NO: 2036

SEQ ID NO: 32223 - DNA, 600 bp, Mycobacterium leprae; identical to SEQ ID NO: 2037
  CDS (1)..(600)

SEQ ID NO: 32224 - protein, 199 aa, Mycobacterium leprae; identical to SEQ ID NO: 2038

SEQ ID NO: 32225 - DNA, 543 bp, Haemophilus influenzae; identical to SEQ ID NO: 2039
  CDS (1)..(543)

SEQ ID NO: 32226 - protein, 180 aa, Haemophilus influenzae; identical to SEQ ID NO: 2040

SEQ ID NO: 32227 - DNA, 513 bp, Neisseria meningitidis; identical to SEQ ID NO: 2041
  CDS (1)..(513)

SEQ ID NO: 32228 - protein, 170 aa, Neisseria meningitidis; identical to SEQ ID NO: 2042

SEQ ID NO: 32229 - DNA, 603 bp, Caulobacter crescentus; identical to SEQ ID NO: 2043
  CDS (1)..(603)

SEQ ID NO: 32230 - protein, 200 aa, Caulobacter crescentus; identical to SEQ ID NO: 2044

SEQ ID NO: 32231 - DNA, 531 bp, Mycobacterium tuberculosis; identical to SEQ ID NO: 2045
  CDS (1)..(531)

SEQ ID NO: 32232 - protein, 176 aa, Mycobacterium tuberculosis; identical to SEQ ID NO: 2046

SEQ ID NO: 32233 - DNA, 489 bp, Lactococcus lactis subsp. lactis; identical to SEQ ID NO: 2047
  CDS (1)..(489)

SEQ ID NO: 32234 - protein, 162 aa, Lactococcus lactis subsp. lactis; identical to SEQ ID NO: 2048

SEQ ID NO: 32235 - DNA, 498 bp, Clostridium acetobutylicum; identical to SEQ ID NO: 2049
  CDS (1)..(498)

SEQ ID NO: 32236 - protein, 165 aa, Clostridium acetobutylicum; identical to SEQ ID NO: 2050

SEQ ID NO: 32237 - DNA, 519 bp, Pseudomonas aeruginosa; identical to SEQ ID NO: 2051
  CDS (1)..(519)

SEQ ID NO: 32238 - protein, 172 aa, Pseudomonas aeruginosa; identical to SEQ ID NO: 2052

SEQ ID NO: 32239 - DNA, 522 bp, Buchnera sp; identical to SEQ ID NO: 2053
  CDS (1)..(522)

SEQ ID NO: 32240 - protein, 173 aa, Buchnera sp; identical to SEQ ID NO: 2054

SEQ ID NO: 32241 - DNA, 501 bp, Agrobacterium tumefaciens; identical to SEQ ID NO: 2055
  CDS (1)..(501)

SEQ ID NO: 32242 - protein, 166 aa, Agrobacterium tumefaciens; identical to SEQ ID NO: 2056

SEQ ID NO: 32243 - DNA, 561 bp, Bacillus subtilis; identical to SEQ ID NO: 2057
  CDS (1)..(561)

SEQ ID NO: 32244 - protein, 186 aa, Bacillus subtilis; identical to SEQ ID NO: 2058

SEQ ID NO: 32245 - DNA, 810 bp, Escherichia coli; identical to SEQ ID NO: 2059
  CDS (286)..(810)

SEQ ID NO: 32246 - protein, 174 aa, Escherichia coli; identical to SEQ ID NO: 2060

SEQ ID NO: 32247 - DNA, 522 bp, Erwinia chrysanthemi; identical to SEQ ID NO: 2061
  CDS (1)..(522)

SEQ ID NO: 32248 - protein, 173 aa, Erwinia chrysanthemi; identical to SEQ ID NO: 2062

SEQ ID NO: 32249 - DNA, 1293 bp, Lycopersicon esculentum (tomato); identical to SEQ ID NO: 2063
  CDS (123)..(1025)

SEQ ID NO: 32250 - protein, 300 aa, Lycopersicon esculentum (tomato); identical to SEQ ID NO: 2064

SEQ ID NO: 32251 - DNA, 489 bp, Lactococcus lactis; identical to SEQ ID NO: 2065
  CDS (1)..(489)

SEQ ID NO: 32252 - protein, 162 aa, Lactococcus lactis; identical to SEQ ID NO: 2066

SEQ ID NO: 32253 - DNA, 570 bp, Synechocystis sp; identical to SEQ ID NO: 2067
  CDS (1)..(570)

SEQ ID NO: 32254 - protein, 189 aa, Synechocystis sp; identical to SEQ ID NO: 2068

SEQ ID NO: 32255 - DNA, 693 bp, Corynebacterium glutamicum; identical to SEQ ID NO: 2069
  CDS (101)..(673)

SEQ ID NO: 32256 - protein, 190 aa, Corynebacterium glutamicum; identical to SEQ ID NO: 2070

SEQ ID NO: 32257 - DNA, 522 bp, Erwinia carotovora subsp; identical to SEQ ID NO: 2071
  CDS (1)..(522)

SEQ ID NO: 32258 - protein, 173 aa, Erwinia carotovora subsp; identical to SEQ ID NO: 2072

SEQ ID NO: 32259 - DNA, 522 bp, Erwinia carotovora subsp; identical to SEQ ID NO: 2073
  CDS (1)..(522)

SEQ ID NO: 32260 - protein, 173 aa, Erwinia carotovora subsp; identical to SEQ ID NO: 2074

SEQ ID NO: 32261 - DNA, 543 bp, Acinetobacter sp; identical to SEQ ID NO: 2075
  CDS (1)..(543)

SEQ ID NO: 32262 - protein, 180 aa, Acinetobacter sp; identical to SEQ ID NO: 2076

SEQ ID NO: 32263 - DNA, 633 bp, Bartonella quintana; identical to SEQ ID NO: 2077
  CDS (1)..(633)

SEQ ID NO: 32264 - protein, 210 aa, Bartonella quintana; identical to SEQ ID NO: 2078

SEQ ID NO: 32265 - DNA, 633 bp, Bartonella henselae; identical to SEQ ID NO: 2079
  CDS (1)..(633)

SEQ ID NO: 32266 - protein, 210 aa, Bartonella henselae; identical to SEQ ID NO: 2080

SEQ ID NO: 32267 - DNA, 525 bp, Staphylococcus aureus subsp; identical to SEQ ID NO: 2081
  CDS (1)..(525)

SEQ ID NO: 32268 - protein, 174 aa, Staphylococcus aureus subsp; identical to SEQ ID NO: 2082

SEQ ID NO: 32269 - DNA, 528 bp, Photobacterium profundum; identical to SEQ ID NO: 2083
  CDS (1)..(528)

SEQ ID NO: 32270 - protein, 175 aa, Photobacterium profundum; identical to SEQ ID NO: 2084

SEQ ID NO: 32271 - DNA, 612 bp, Parachlamydia sp; identical to SEQ ID NO: 2085
  CDS (1)..(612)

SEQ ID NO: 32272 - protein, 203 aa, Parachlamydia sp; identical to SEQ ID NO: 2086

SEQ ID NO: 32273 - DNA, 918 bp, Rhodopseudomonas palustris; identical to SEQ ID NO: 2087
  CDS (1)..(918)

SEQ ID NO: 32274 - protein, 305 aa, Rhodopseudomonas palustris; identical to SEQ ID NO: 2088

SEQ ID NO: 32275 - DNA, 612 bp, Rhodopseudomonas palustris; identical to SEQ ID NO: 2089
  CDS (1)..(612)

SEQ ID NO: 32276 - protein, 203 aa, Rhodopseudomonas palustris; identical to SEQ ID NO: 2090

SEQ ID NO: 32277 - DNA, 522 bp, Corynebacterium diphtheriae; identical to SEQ ID NO: 2091
  CDS (1)..(522)

SEQ ID NO: 32278 - protein, 173 aa, Corynebacterium diphtheriae; identical to SEQ ID NO: 2092

SEQ ID NO: 32279 - DNA, 543 bp, Desulfovibrio vulgaris; identical to SEQ ID NO: 2093
  CDS (1)..(543)

SEQ ID NO: 32280 - protein, 180 aa, Desulfovibrio vulgaris; identical to SEQ ID NO: 2094

SEQ ID NO: 32281 - DNA, 528 bp, Desulfovibrio vulgaris; identical to SEQ ID NO: 2095
  CDS (1)..(528)

SEQ ID NO: 32282 - protein, 175 aa, Desulfovibrio vulgaris; identical to SEQ ID NO: 2096

SEQ ID NO: 32283 - DNA, 555 bp, Thermus thermophilus; identical to SEQ ID NO: 2097
  CDS (1)..(555)

SEQ ID NO: 32284 - protein, 184 aa, Thermus thermophilus; identical to SEQ ID NO: 2098

SEQ ID NO: 32285 - DNA, 513 bp, Bacillus cereus; identical to SEQ ID NO: 2099
  CDS (1)..(513)

SEQ ID NO: 32286 - protein, 170 aa, Bacillus cereus; identical to SEQ ID NO: 2100

SEQ ID NO: 32287 - DNA, 531 bp, Mycobacterium paratuberculosis; identical to SEQ ID NO: 2101
  CDS (1)..(531)

SEQ ID NO: 32288 - protein, 176 aa, Mycobacterium paratuberculosis; identical to SEQ ID NO: 2102

SEQ ID NO: 32289 - DNA, 528 bp, Geobacter sulfurreducens; identical to SEQ ID NO: 2103
  CDS (1)..(528)

SEQ ID NO: 32290 - protein, 175 aa, Geobacter sulfurreducens; identical to SEQ ID NO: 2104

SEQ ID NO: 32291 - DNA, 540 bp, Leptospira interrogans; identical to SEQ ID NO: 2105
  CDS (1)..(540)

SEQ ID NO: 32292 - protein, 179 aa, Leptospira interrogans; identical to SEQ ID NO: 2106

SEQ ID NO: 32293 - DNA, 501 bp, Wolinella succinogenes; identical to SEQ ID NO: 2107
  CDS (1)..(501)

SEQ ID NO: 32294 - protein, 166 aa, Wolinella succinogenes; identical to SEQ ID NO: 2108

SEQ ID NO: 32295 - DNA, 561 bp, Porphyromonas gingivalis; identical to SEQ ID NO: 2109
  CDS (1)..(561)

SEQ ID NO: 32296 - protein, 186 aa, Porphyromonas gingivalis; identical to SEQ ID NO: 2110

SEQ ID NO: 32297 - DNA, 525 bp, Photorhabdus luminescens; identical to SEQ ID NO: 2111
  CDS (1)..(525)

SEQ ID NO: 32298 - protein, 174 aa, Photorhabdus luminescens; identical to SEQ ID NO: 2112

SEQ ID NO: 32299 - DNA, 534 bp, Gloeobacter violaceus; identical to SEQ ID NO: 2113
  CDS (1)..(534)

SEQ ID NO: 32300 - protein, 177 aa, Gloeobacter violaceus; identical to SEQ ID NO: 2114

SEQ ID NO: 32301 - DNA, 555 bp, Chromobacterium violaceum; identical to SEQ ID NO: 2115
  CDS (1)..(555)

SEQ ID NO: 32302 - protein, 184 aa, Chromobacterium violaceum; identical to SEQ ID NO: 2116

SEQ ID NO: 32303 - DNA, 576 bp, Synechococcus sp; identical to SEQ ID NO: 2117
  CDS (1)..(576)

SEQ ID NO: 32304 - protein, 191 aa, Synechococcus sp; identical to SEQ ID NO: 2118

SEQ ID NO: 32305 - DNA, 564 bp, Rhodopirellula baltica; identical to SEQ ID NO: 2119
  CDS (1)..(564)

SEQ ID NO: 32306 - protein, 187 aa, Rhodopirellula baltica; identical to SEQ ID NO: 2120

SEQ ID NO: 32307 - DNA, 558 bp, Prochlorococcus marinus subsp; identical to SEQ ID NO: 2121
  CDS (1)..(558)

SEQ ID NO: 32308 - protein, 185 aa, Prochlorococcus marinus subsp; identical to SEQ ID NO: 2122

SEQ ID NO: 32309 - DNA, 579 bp, Prochlorococcus marinus; identical to SEQ ID NO: 2123
  CDS (1)..(579)

SEQ ID NO: 32310 - protein, 192 aa, Prochlorococcus marinus; identical to SEQ ID NO: 2124

SEQ ID NO: 32311 - DNA, 573 bp, Prochlorococcus marinus; identical to SEQ ID NO: 2125
  CDS (1)..(573)

SEQ ID NO: 32312 - protein, 190 aa, Prochlorococcus marinus; identical to SEQ ID NO: 2126

SEQ ID NO: 32313 - DNA, 558 bp, Candidatus Blochmannia floridanus; identical to SEQ ID NO: 2127
  CDS (1)..(558)

SEQ ID NO: 32314 - protein, 185 aa, Candidatus Blochmannia floridanus; identical to SEQ ID NO: 2128

SEQ ID NO: 32315 - DNA, 636 bp, Bordetella bronchiseptica; identical to SEQ ID NO: 2129
  CDS (1)..(636)

SEQ ID NO: 32316 - protein, 211 aa, Bordetella bronchiseptica; identical to SEQ ID NO: 2130

SEQ ID NO: 32317 - DNA, 864 bp, Oryza sativa; identical to SEQ ID NO: 2131
  CDS (1)..(864)

SEQ ID NO: 32318 - protein, 287 aa, Oryza sativa; identical to SEQ ID NO: 2132

SEQ ID NO: 32319 - DNA, 471 bp, Bacillus cereus; identical to SEQ ID NO: 2133
  CDS (1)..(471)

SEQ ID NO: 32320 - protein, 156 aa, Bacillus cereus; identical to SEQ ID NO: 2134

SEQ ID NO: 32321 - DNA, 498 bp, Bacillus anthracis; identical to SEQ ID NO: 2135
  CDS (1)..(498)

SEQ ID NO: 32322 - protein, 165 aa, Bacillus anthracis; identical to SEQ ID NO: 2136

SEQ ID NO: 32323 - DNA, 522 bp, Chlamydophila caviae; identical to SEQ ID NO: 2137
  CDS (1)..(522)

SEQ ID NO: 32324 - protein, 173 aa, Chlamydophila caviae; identical to SEQ ID NO: 2138

SEQ ID NO: 32325 - DNA, 516 bp, Streptomyces avermitilis; identical to SEQ ID NO: 2139
  CDS (1)..(516)

SEQ ID NO: 32326 - protein, 171 aa, Streptomyces avermitilis; identical to SEQ ID NO: 2140

SEQ ID NO: 32327 - DNA, 636 bp, Nitrosomonas europaea; identical to SEQ ID NO: 2141
  CDS (1)..(636)

SEQ ID NO: 32328 - protein, 211 aa, Nitrosomonas europaea; identical to SEQ ID NO: 2142

SEQ ID NO: 32329 - DNA, 507 bp, Enterococcus faecalis; identical to SEQ ID NO: 2143
  CDS (1)..(507)

SEQ ID NO: 32330 - protein, 168 aa, Enterococcus faecalis; identical to SEQ ID NO: 2144

SEQ ID NO: 32331 - DNA, 540 bp, Coxiella burnetii; identical to SEQ ID NO: 2145
  CDS (1)..(540)

SEQ ID NO: 32332 - protein, 179 aa, Coxiella burnetii; identical to SEQ ID NO: 2146

SEQ ID NO: 32333 - DNA, 510 bp, Tropheryma whipplei; identical to SEQ ID NO: 2147
  CDS (1)..(510)

SEQ ID NO: 32334 - protein, 169 aa, Tropheryma whipplei; identical to SEQ ID NO: 2148

SEQ ID NO: 32335 - DNA, 468 bp, Shigella flexneri; identical to SEQ ID NO: 2149
  CDS (1)..(468)

SEQ ID NO: 32336 - protein, 155 aa, Shigella flexneri; identical to SEQ ID NO: 2150

SEQ ID NO: 32337 - DNA, 903 bp, Azoarcus evansii; identical to SEQ ID NO: 2151
  CDS (1)..(903)

SEQ ID NO: 32338 - protein, 300 aa, Azoarcus evansii; identical to SEQ ID NO: 2152

SEQ ID NO: 32339 - DNA, 522 bp, Lactobacillus plantarum; identical to SEQ ID NO: 2153
  CDS (1)..(522)

SEQ ID NO: 32340 - protein, 173 aa, Lactobacillus plantarum; identical to SEQ ID NO: 2154

SEQ ID NO: 32341 - DNA, 504 bp, Clostridium tetani; identical to SEQ ID NO: 2155
  CDS (1)..(504)

SEQ ID NO: 32342 - protein, 167 aa, Clostridium tetani; identical to SEQ ID NO: 2156

SEQ ID NO: 32343 - DNA, 909 bp, Bradyrhizobium japonicum; identical to SEQ ID NO: 2157
  CDS (1)..(909)

SEQ ID NO: 32344 - protein, 302 aa, Bradyrhizobium japonicum; identical to SEQ ID NO: 2158

SEQ ID NO: 32345 - DNA, 735 bp, Bradyrhizobium japonicum; identical to SEQ ID NO: 2159
  CDS (1)..(735)

SEQ ID NO: 32346 - protein, 244 aa, Bradyrhizobium japonicum; identical to SEQ ID NO: 2160

SEQ ID NO: 32347 - DNA, 528 bp, Bacteroides thetaiotaomicron; identical to SEQ ID NO: 2161
  CDS (1)..(528)

SEQ ID NO: 32348 - protein, 175 aa, Bacteroides thetaiotaomicron; identical to SEQ ID NO: 2162

SEQ ID NO: 32349 - DNA, 477 bp, Streptococcus mutans; identical to SEQ ID NO: 2163
  CDS (1)..(477)

SEQ ID NO: 32350 - protein, 158 aa, Streptococcus mutans; identical to SEQ ID NO: 2164

SEQ ID NO: 32351 - DNA, 513 bp, Streptococcus agalactiae; identical to SEQ ID NO: 2165
  CDS (1)..(513)

SEQ ID NO: 32352 - protein, 170 aa, Streptococcus agalactiae; identical to SEQ ID NO: 2166

SEQ ID NO: 32353 - DNA, 603 bp, Brucella suis; identical to SEQ ID NO: 2167
  CDS (1)..(603)

SEQ ID NO: 32354 - protein, 200 aa, Brucella suis; identical to SEQ ID NO: 2168

SEQ ID NO: 32355 - DNA, 912 bp, Thauera aromatica; identical to SEQ ID NO: 2169
  CDS (1)..(912)

SEQ ID NO: 32356 - protein, 303 aa, Thauera aromatica; identical to SEQ ID NO: 2170

SEQ ID NO: 32357 - DNA, 1300 bp, Arabidopsis thaliana; identical to SEQ ID NO: 2171
  CDS (113)..(1024)

SEQ ID NO: 32358 - protein, 303 aa, Arabidopsis thaliana; identical to SEQ ID NO: 2172

SEQ ID NO: 32359 - DNA, 903 bp, Arabidopsis thaliana; identical to SEQ ID NO: 2173
  CDS (1)..(903)

SEQ ID NO: 32360 - protein, 300 aa, Arabidopsis thaliana; identical to SEQ ID NO: 2174

SEQ ID NO: 32361 - DNA, 576 bp, Chlorobium tepidum; identical to SEQ ID NO: 2175
  CDS (1)..(576)

SEQ ID NO: 32362 - protein, 191 aa, Chlorobium tepidum; identical to SEQ ID NO: 2176

SEQ ID NO: 32363 - DNA, 492 bp, Streptococcus pyogenes; identical to SEQ ID NO: 2177
  CDS (1)..(492)

SEQ ID NO: 32364 - protein, 163 aa, Streptococcus pyogenes; identical to SEQ ID NO: 2178

SEQ ID NO: 32365 - DNA, 543 bp, Xanthomonas campestris; identical to SEQ ID NO: 2179
  CDS (1)..(543)

SEQ ID NO: 32366 - protein, 180 aa, Xanthomonas campestris; identical to SEQ ID NO: 2180

SEQ ID NO: 32367 - DNA, 543 bp, Xanthomonas axonopodis; identical to SEQ ID NO: 2181
  CDS (1)..(543)

SEQ ID NO: 32368 - protein, 180 aa, Xanthomonas axonopodis; identical to SEQ ID NO: 2182

SEQ ID NO: 32369 - DNA, 531 bp, Methanosarcina mazei; identical to SEQ ID NO: 2183
  CDS (1)..(531)

SEQ ID NO: 32370 - protein, 176 aa, Methanosarcina mazei; identical to SEQ ID NO: 2184

SEQ ID NO: 32371 - DNA, 516 bp, Thermoanaerobacter tengcongensis; identical to SEQ ID NO: 2185
  CDS (1)..(516)

SEQ ID NO: 32372 - protein, 171 aa, Thermoanaerobacter tengcongensis; identical to SEQ ID NO: 2186

SEQ ID NO: 32373 - DNA, 519 bp, Fusobacterium nucleatum; identical to SEQ ID NO: 2187
  CDS (1)..(519)

SEQ ID NO: 32374 - protein, 172 aa, Fusobacterium nucleatum; identical to SEQ ID NO: 2188

SEQ ID NO: 32375 - DNA, 528 bp, Methanosarcina acetivorans; identical to SEQ ID NO: 2189
  CDS (1)..(528)

SEQ ID NO: 32376 - protein, 175 aa, Methanosarcina acetivorans; identical to SEQ ID NO: 2190

SEQ ID NO: 32377 - DNA, 516 bp, Clostridium perfringens; identical to SEQ ID NO: 2191
  CDS (1)..(516)

SEQ ID NO: 32378 - protein, 171 aa, Clostridium perfringens; identical to SEQ ID NO: 2192

SEQ ID NO: 32379 - DNA, 573 bp, Ralstonia solanacearum; identical to SEQ ID NO: 2193
  CDS (1)..(573)

SEQ ID NO: 32380 - protein, 190 aa, Ralstonia solanacearum; identical to SEQ ID NO: 2194

SEQ ID NO: 32381 - DNA, 579 bp, Rhizobium meliloti; identical to SEQ ID NO: 2195
  CDS (1)..(579)

SEQ ID NO: 32382 - protein, 192 aa, Rhizobium meliloti; identical to SEQ ID NO: 2196

SEQ ID NO: 32383 - DNA, 7122 bp, Rhizobium loti; identical to SEQ ID NO: 2197
  CDS (1)..(7122)

SEQ ID NO: 32384 - protein, 2373 aa, Rhizobium loti; identical to SEQ ID NO: 2198

SEQ ID NO: 32385 - DNA, 612 bp, Rhizobium loti; identical to SEQ ID NO: 2199
  CDS (1)..(612)

SEQ ID NO: 32386 - protein, 203 aa, Rhizobium loti; identical to SEQ ID NO: 2200

SEQ ID NO: 32387 - DNA, 516 bp, Streptomyces coelicolor; identical to SEQ ID NO: 2201
  CDS (1)..(516)

SEQ ID NO: 32388 - protein, 171 aa, Streptomyces coelicolor; identical to SEQ ID NO: 2202

SEQ ID NO: 32389 - DNA, 843 bp, Arabidopsis thaliana; identical to SEQ ID NO: 2203
  CDS (1)..(843)

SEQ ID NO: 32390 - protein, 280 aa, Arabidopsis thaliana; identical to SEQ ID NO: 2204

SEQ ID NO: 32391 - DNA, 1623 bp, Bifidobacterium longum; identical to SEQ ID NO: 2205
  CDS (1)..(1623)

SEQ ID NO: 32392 - protein, 540 aa, Bifidobacterium longum; identical to SEQ ID NO: 2206

SEQ ID NO: 32393 - DNA, 525 bp, Buchnera aphidicola; identical to SEQ ID NO: 2207
  CDS (1)..(525)

SEQ ID NO: 32394 - protein, 174 aa, Buchnera aphidicola; identical to SEQ ID NO: 2208

SEQ ID NO: 32395 - DNA, 510 bp, Corynebacterium efficiens; identical to SEQ ID NO: 2209
  CDS (1)..(510)

SEQ ID NO: 32396 - protein, 169 aa, Corynebacterium efficiens; identical to SEQ ID NO: 2210

SEQ ID NO: 32397 - DNA, 525 bp, Haemophilus ducreyi; identical to SEQ ID NO: 2211
  CDS (1)..(525)

SEQ ID NO: 32398 - protein, 174 aa, Haemophilus ducreyi; identical to SEQ ID NO: 2212

SEQ ID NO: 32399 - DNA, 504 bp, Helicobacter hepaticus; identical to SEQ ID NO: 2213
  CDS (1)..(504)

SEQ ID NO: 32400 - protein, 167 aa, Helicobacter hepaticus; identical to SEQ ID NO: 2214

SEQ ID NO: 32401 - DNA, 552 bp, Oceanobacillus iheyensis; identical to SEQ ID NO: 2215
  CDS (1)..(552)

SEQ ID NO: 32402 - protein, 183 aa, Oceanobacillus iheyensis; identical to SEQ ID NO: 2216

SEQ ID NO: 32403 - DNA, 528 bp, Pasteurella multocida; identical to SEQ ID NO: 2217
  CDS (1)..(528)

SEQ ID NO: 32404 - protein, 175 aa, Pasteurella multocida; identical to SEQ ID NO: 2218

SEQ ID NO: 32405 - DNA, 522 bp, Photorhabdus luminescens; identical to SEQ ID NO: 2219
  CDS (1)..(522)

SEQ ID NO: 32406 - protein, 173 aa, Photorhabdus luminescens; identical to SEQ ID NO: 2220

SEQ ID NO: 32407 - DNA, 519 bp, Pseudomonas putida; identical to SEQ ID NO: 2221
  CDS (1)..(519)

SEQ ID NO: 32408 - protein, 172 aa, Pseudomonas putida; identical to SEQ ID NO: 2222

SEQ ID NO: 32409 - DNA, 519 bp, Pseudomonas syringae; identical to SEQ ID NO: 2223
  CDS (1)..(519)

SEQ ID NO: 32410 - protein, 172 aa, Pseudomonas syringae; identical to SEQ ID NO: 2224

SEQ ID NO: 32411 - DNA, 516 bp, Shewanella oneidensis; identical to SEQ ID NO: 2225
  CDS (1)..(516)

SEQ ID NO: 32412 - protein, 171 aa, Shewanella oneidensis; identical to SEQ ID NO: 2226

SEQ ID NO: 32413 - DNA, 519 bp, Staphylococcus epidermidis; identical to SEQ ID NO: 2227
  CDS (7)..(519)

SEQ ID NO: 32414 - protein, 170 aa, Staphylococcus epidermidis; identical to SEQ ID NO: 2228

SEQ ID NO: 32415 - DNA, 552 bp, Synechococcus elongatus; identical to SEQ ID NO: 2229
  CDS (1)..(552)

SEQ ID NO: 32416 - protein, 183 aa, Synechococcus elongatus; identical to SEQ ID NO: 2230

SEQ ID NO: 32417 - DNA, 519 bp, Vibrio parahaemolyticus; identical to SEQ ID NO: 2231
  CDS (1)..(519)

SEQ ID NO: 32418 - protein, 172 aa, Vibrio parahaemolyticus; identical to SEQ ID NO: 2232

SEQ ID NO: 32419 - DNA, 519 bp, Vibrio vulnificus; identical to SEQ ID NO: 2233
  CDS (1)..(519)

SEQ ID NO: 32420 - protein, 172 aa, Vibrio vulnificus; identical to SEQ ID NO: 2234

SEQ ID NO: 32421 - DNA, 522 bp, Wigglesworthia glossinidia brevipalpis; identical to SEQ ID NO: 2235
  CDS (1)..(522)

SEQ ID NO: 32422 - protein, 173 aa, Wigglesworthia glossinidia brevipalpis; identical to SEQ ID NO: 2236

SEQ ID NO: 32423 - DNA, 543 bp, Xylella fastidiosa; identical to SEQ ID NO: 2237
  CDS (1)..(543)

SEQ ID NO: 32424 - protein, 180 aa, Xylella fastidiosa; identical to SEQ ID NO: 2238

SEQ ID NO: 32425 - DNA, 22 bp, Artificial sequence
  (1)..(22): primer
atggtagcaaggcagcgcgctt

SEQ ID NO: 32426 - DNA, 25 bp, Artificial sequence
  (1)..(25): primer
ttagttgctttccagcatgtgaata

SEQ ID NO: 32427 - protein, 160 aa, Artificial sequence; identical to SEQ ID NO: 2905
  Variant (2)..(2): xaa in position 2 is any amino acid
  Variant (4)..(5): xaa in position 4 to 5 is any amino acid
  Variant (7)..(7): xaa in position 7 is any amino acid
  Variant (10)..(12): xaa in position 10 to 12 is any amino acid
  Variant (14)..(16): xaa in position 14 to 16 is any amino acid
  Variant (18)..(25): xaa in position 18 to 25 is any amino acid
  Variant (27)..(27): xaa in position 27 is any amino acid
  Variant (29)..(30): xaa in position 29 to 30 is any amino acid
  Variant (32)..(46): xaa in position 32 to 46 is any amino acid
  Variant (48)..(50): xaa in position 48 to 50 is any amino acid
  Variant (53)..(54): xaa in position 53 to 54 is any amino acid
  Variant (57)..(58): xaa in position 57 to 58 is any amino acid
  Variant (60)..(78): xaa in position 60 to 78 is any amino acid
  Variant (82)..(104): xaa in position 82 to 104 is any amino acid
  Variant (106)..(114): xaa in position 106 to 114 is any amino acid
  Variant (116)..(124): xaa in position 116 to 124 is any amino acid
  Variant (127)..(155): xaa in position 127 to 155 is any amino acid
  Variant (157)..(159): xaa in position 157 to 159 is any amino acid

SEQ ID NO: 32428 - protein, 26 aa, Artificial sequence
  Variant (2)..(2): xaa in position 2 is any amino acid
  Variant (3)..(3): xaa in position 3 is Met, Arg, Pro or Ala
  Variant (4)..(4): xaa in position 4 is Gly or Ala
  Variant (5)..(5): xaa in position 5 is Ala, Ser, Val, Cys or Thr
  Variant (8)..(8): xaa in position 8 is Ser or Thr
  Variant (9)..(9): xaa in position 9 is any amino acid
  Variant (10)..(10): xaa in position 10 is Ile, Val, Leu or Thr
  Variant (11)..(11): xaa in position 11 is Gly, Ala or Ser
  Variant (12)..(13): xaa in position 12 to 13 is any amino acid
  Variant (14)..(14): xaa in position 14 is Leu, Val, Ile or Met
  Variant (15)..(15): xaa in position 15 is Ala, Ser or Asp
  Variant (16)..(19): xaa in position 16 to 19 is any amino acid
  Variant (20)..(23): xaa in position 20 to 23 is any or no amino acid
  Variant (24)..(24): xaa in position 24 is Asp or Glu
  Variant (25)..(25): xaa in position 25 is any amino acid
  Variant (26)..(26): xaa in position 26 is Asp or Asn
GXXXXGKXXXXXXXXXXXXXXXXXXX

SEQ ID NO: 32429 - protein, 75 aa, Artificial sequence; identical to SEQ ID NO: 2904
  Variant (1)..(1): xaa in position 1 is Glu, Trp, Gln or Asp
  Variant (2)..(3): xaa in position 2 to 3 is any amino acid
  Variant (4)..(4): xaa in position 4 is Phe, Leu or Tyr
  Variant (5)..(5): xaa in position 5 is Arg or Leu
  Variant (6)..(7): xaa in position 6 to 7 is any amino acid
  Variant (9)..(11): xaa in position 9 to 11 is any amino acid
  Variant (12)..(12): xaa in position 12 is Leu, Ile, Val, Ala, Phe or Thr
  Variant (13)..(20): xaa in position 13 to 20 is any amino acid
  Variant (21)..(23): xaa in position 21 to 23 is any or no amino acid
  Variant (24)..(24): xaa in position 24 is Val, Ile, Leu or Thr
  Variant (25)..(25): xaa in position 25 is Leu, Ile or Val
  Variant (26)..(26): xaa in position 26 is Ala, Ser or Thr
  Variant (27)..(27): xaa in position 27 is Thr, Leu, Ala, Ser or Pro
  Variant (30)..(30): xaa in position 30 is Gly or Ser
  Variant (31)..(31): xaa in position 31 is any amino acid
  Variant (32)..(32): xaa in position 32 is Val, Ile, Phe, Pro, Tyr or Leu
  Variant (33)..(45): xaa in position 33 to 45 is any amino acid
  Variant (46)..(53): xaa in position 46 to 53 is any or no amino acid
  Variant (54)..(54): xaa in position 54 is Leu, Ile or Val
  Variant (55)..(63): xaa in position 55 to 63 is any amino acid
  Variant (64)..(64): xaa in position 64 is Arg, Asn or Asp
  Variant (65)..(69): xaa in position 65 to 69 is any amino acid
  Variant (70)..(73): xaa in position 70 to 73 is any or no amino acid
  Variant (74)..(74): xaa in position 74 is Arg, Lys or Leu
  Variant (75)..(75): xaa in position 75 is Pro or Gly

SEQ ID NO: 32430 - DNA, 1434 bp, Escherichia coli K12; identical to SEQ ID NO: 4679
  CDS (1)..(1434)

SEQ ID NO: 32431 - protein, 477 aa, Escherichia coli K12 [sequence omitted]

SEQ ID NO: 32432 - DNA, 1314 bp, Pyrococcus abyssi; identical to SEQ ID NO: 4681
  CDS (1)..(1314)

SEQ ID NO: 32433 - protein, 437 aa, Pyrococcus abyssi; identical to SEQ ID NO: 4682

SEQ ID NO: 32434 - DNA, 1425 bp, Chlamydia muridarum, Chlamydia trachomatis MoPn; identical to SEQ ID NO: 4683
  CDS (1)..(1425)

SEQ ID NO: 32435 - protein, 474 aa, Chlamydia muridarum, Chlamydia trachomatis MoPn; identical to SEQ ID NO: 4684

SEQ ID NO: 32436 - DNA, 1434 bp, Clostridium acetobutylicum; identical to SEQ ID NO: 4685
  CDS (1)..(1434)

SEQ ID NO: 32437 - protein, 477 aa, Clostridium acetobutylicum; identical to SEQ ID NO: 4686

SEQ ID NO: 32438 - DNA, 1431 bp, Yersinia pestis; identical to SEQ ID NO: 4687
  CDS (1)..(1431)

SEQ ID NO: 32439 - protein, 476 aa, Yersinia pestis; identical to SEQ ID NO: 4688

SEQ ID NO: 32440 - DNA, 1443 bp, Agrobacterium tumefaciens; identical to SEQ ID NO: 4689
  CDS (1)..(1443)

SEQ ID NO: 32441 - protein, 480 aa, Agrobacterium tumefaciens; identical to SEQ ID NO: 4690

SEQ ID NO: 32442 - DNA, 1479 bp, Nostoc sp. PCC 7120; identical to SEQ ID NO: 4691
  CDS (1)..(1479)

SEQ ID NO: 32443 - protein, 492 aa, Nostoc sp. PCC 7120; identical to SEQ ID NO: 4692

SEQ ID NO: 32444 - DNA, 1419 bp, Nostoc sp. PCC 7120; identical to SEQ ID NO: 4693
  CDS (1)..(1419)

SEQ ID NO: 32445 - protein, 472 aa, Nostoc sp. PCC 7120; identical to SEQ ID NO: 4694

SEQ ID NO: 32446 - DNA, 1431 bp, Haemophilus influenzae; identical to SEQ ID NO: 4695
  CDS (1)..(1431)

SEQ ID NO: 32447 - protein, 476 aa, Haemophilus influenzae; identical to SEQ ID NO: 4696

SEQ ID NO: 32448 - DNA, 1392 bp, Aquifex aeolicus; identical to SEQ ID NO: 4697
  CDS (1)..(1392)

SEQ ID NO: 32449 - protein, 463 aa, Aquifex aeolicus; identical to SEQ ID NO: 4698

SEQ ID NO: 32450 - DNA, 1371 bp, Pyrococcus horikoshii; identical to SEQ ID NO: 4699
  CDS (1)..(1371)

SEQ ID NO: 32451 - protein, 456 aa, Pyrococcus horikoshii; identical to SEQ ID NO: 4700

SEQ ID NO: 32452 - DNA, 1431 bp, Chlamydophila pneumoniae, Chlamydia pneumoniae; identical to SEQ ID NO: 4701
  CDS (1)..(1431)

SEQ ID NO: 32453 - protein, 476 aa, Chlamydophila pneumoniae, Chlamydia pneumoniae; identical to SEQ ID NO: 4702

SEQ ID NO: 32454 - DNA, 1452 bp, Lactococcus lactis subsp. lactis; identical to SEQ ID NO: 4703
  CDS (1)..(1452)

SEQ ID NO: 32455 - protein, 483 aa, Lactococcus lactis subsp. lactis; identical to SEQ ID NO: 4704

SEQ ID NO: 32456 - DNA, 1461 bp, Sinorhizobium meliloti; identical to SEQ ID NO: 4705
  CDS (1)..(1461)

SEQ ID NO: 32457 - protein, 486 aa, Sinorhizobium meliloti; identical to SEQ ID NO: 4706

SEQ ID NO: 32458 - DNA, 1425 bp, Chlamydia trachomatis; identical to SEQ ID NO: 4707
  CDS (1)..(1425)

SEQ ID NO: 32459 - protein, 474 aa, Chlamydia trachomatis; identical to SEQ ID NO: 4708

SEQ ID NO: 32460 - DNA, 1701 bp, Sulfolobus solfataricus; identical to SEQ ID NO: 4709
  CDS (1)..(1701)

SEQ ID NO: 32461 - protein, 566 aa, Sulfolobus solfataricus; identical to SEQ ID NO: 4710

SEQ ID NO: 32462 - DNA, 1566 bp, Methanococcus jannaschii; identical to SEQ ID NO: 4711
  CDS (1)..(1566)

SEQ ID NO: 32463 - protein, 521 aa, Methanococcus jannaschii; identical to SEQ ID NO: 4712

SEQ ID NO: 32464 - DNA, 1431 bp, Bacillus halodurans; identical to SEQ ID NO: 4713
  CDS (1)..(1431)

SEQ ID NO: 32465 - protein, 476 aa, Bacillus halodurans; identical to SEQ ID NO: 4714

SEQ ID NO: 32466 - DNA, 1455 bp, Vibrio cholerae; identical to SEQ ID NO: 4715
  CDS (1)..(1455)

SEQ ID NO: 32467 - protein, 484 aa, Vibrio cholerae; identical to SEQ ID NO: 4716

SEQ ID NO: 32468 - DNA, 1833 bp, Arabidopsis thaliana (mouse-ear cress); identical to SEQ ID NO: 4717
  CDS (1)..(1833)

SEQ ID NO: 32469 - protein, 610 aa, Arabidopsis thaliana (mouse-ear cress); identical to SEQ ID NO: 4718

SEQ ID NO: 32470 - DNA, 1461 bp, Thermotoga maritima; identical to SEQ ID NO: 4719
  CDS (1)..(1461)

SEQ ID NO: 32471 - protein, 486 aa, Thermotoga maritima; identical to SEQ ID NO: 4720

SEQ ID NO: 32472 - DNA, 1542 bp, Pseudomonas aeruginosa; identical to SEQ ID NO: 4721
  CDS (1)..(1542)

SEQ ID NO: 32473 - protein, 513 aa, Pseudomonas aeruginosa; identical to SEQ ID NO: 4722

SEQ ID NO: 32474 - DNA, 3078 bp, Arabidopsis thaliana (mouse-ear cress); identical to SEQ ID NO: 4723
  CDS (1)..(3078)

SEQ ID NO: 32475 - protein, 1025 aa, Arabidopsis thaliana (mouse-ear cress); identical to SEQ ID NO: 4724

SEQ ID NO: 32476 - DNA, 1434 bp, Streptococcus pneumoniae; identical to SEQ ID NO: 4725
  CDS (1)..(1434)

SEQ ID NO: 32477 - protein, 477 aa, Streptococcus pneumoniae; identical to SEQ ID NO: 4726

SEQ ID NO: 32478 - DNA, 2533 bp, Oryza sativa (rice); identical to SEQ ID NO: 4727
  CDS (114)..(1994)

SEQ ID NO: 32479 - protein, 626 aa, Oryza sativa (rice); identical to SEQ ID NO: 4728

SEQ ID NO: 32480 - DNA, 1818 bp, Zea mays (maize); identical to SEQ ID NO: 4729
  CDS (1)..(1818)

SEQ ID NO: 32481 - protein, 605 aa, Zea mays (maize); identical to SEQ ID NO: 4730

SEQ ID NO: 32482 - DNA, 1455 bp, Bacillus subtilis; identical to SEQ ID NO: 4731
  CDS (1)..(1455)

SEQ ID NO: 32483 - protein, 484 aa, Bacillus subtilis; identical to SEQ ID NO: 4732

SEQ ID NO: 32484 - DNA, 2168 bp, Manihot esculenta (cassava); identical to SEQ ID NO: 4733
  CDS (75)..(1901)

SEQ ID NO: 32485 - protein, 608 aa, Manihot esculenta (cassava); identical to SEQ ID NO: 4734

SEQ ID NO: 32486 - DNA, 2035 bp, Pisum sativum (garden pea); identical to SEQ ID NO: 4735
  CDS (82)..(1893)

SEQ ID NO: 32487 - protein, 603 aa, Pisum sativum (garden pea); identical to SEQ ID NO: 4736

SEQ ID NO: 32488 - DNA, 1476 bp, Synechocystis sp; identical to SEQ ID NO: 4737
  CDS (1)..(1476)

SEQ ID NO: 32489 - protein, 491 aa, Synechocystis sp; identical to SEQ ID NO: 4738

SEQ ID NO: 32490 - DNA, 1434 bp, Synechocystis sp; identical to SEQ ID NO: 4739
  CDS (1)..(1434)

SEQ ID NO: 32491 - protein, 477 aa, Synechocystis sp; identical to SEQ ID NO: 4740

SEQ ID NO: 32492 - DNA, 2868 bp, Zea mays (maize); identical to SEQ ID NO: 4741
  CDS (670)..(2868)

SEQ ID NO: 32493 - protein, 732 aa, Zea mays (maize); identical to SEQ ID NO: 4742

SEQ ID NO: 32494 - DNA, 2480 bp, Zea mays (maize); identical to SEQ ID NO: 4743
  CDS (58)..(2154)

SEQ ID NO: 32495 - protein, 698 aa, Zea mays (maize); identical to SEQ ID NO: 4744

SEQ ID NO: 32496 - DNA, 6027 bp, Zea mays (maize); identical to SEQ ID NO: 4745
  CDS (120)..(5144)

SEQ ID NO: 32497 - protein, 1674 aa, Zea mays (maize); identical to SEQ ID NO: 4746

SEQ ID NO: 32498 - DNA, 2991 bp, Zea mays (maize); identical to SEQ ID NO: 4747
  CDS (602)..(2470): n means a or g or c or t/u, s means g or c

SEQ ID NO: 32499 - protein, 622 aa, Zea mays (maize); identical to SEQ ID NO: 4748

SEQ ID NO: 32500 - DNA, 2360 bp, Solanum tuberosum (potato); identical to SEQ ID NO: 4749
  CDS (68)..(1993)

SEQ ID NO: 32501 - protein, 641 aa, Solanum tuberosum (potato); identical to SEQ ID NO: 4750

SEQ ID NO: 32502 - DNA, 2124 bp, Ipomoea batatas (sweet potato); identical to SEQ ID NO: 4751
  CDS (23)..(1849)

SEQ ID NO: 32503 - protein, 608 aa, Ipomoea batatas (sweet potato); identical to SEQ ID NO: 4752

SEQ ID NO: 32504 - DNA, 2287 bp, Sorghum bicolor (sorghum); identical to SEQ ID NO: 4753
  CDS (207)..(2033)

SEQ ID NO: 32505 - protein, 608 aa, Sorghum bicolor (sorghum); identical to SEQ ID NO: 4754

SEQ ID NO: 32506 - DNA, 4110 bp, Schizosaccharomyces pombe; identical to SEQ ID NO: 4755
  CDS (1)..(4110)

SEQ ID NO: 32507 - protein, 1369 aa, Schizosaccharomyces pombe; identical to SEQ ID NO: 4756

SEQ ID NO: 32508 - DNA, 1812 bp, Hordeum vulgare (barley); identical to SEQ ID NO: 4757
  CDS (1)..(1812)

SEQ ID NO: 32509 - protein, 603 aa, Hordeum vulgare (barley); identical to SEQ ID NO: 4758

SEQ ID NO: 32510 - DNA, 2161 bp, Solanum tuberosum (potato); identical to SEQ ID NO: 4759
  CDS (37)..(1860)

SEQ ID NO: 32511 - protein, 607 aa, Solanum tuberosum (potato); identical to SEQ ID NO: 4760

SEQ ID NO: 32512 - DNA, 2825 bp, Triticum aestivum; identical to SEQ ID NO: 4761
  CDS (162)..(2561)

SEQ ID NO: 32513 - protein, 799 aa, Triticum aestivum; identical to SEQ ID NO: 4762

SEQ ID NO: 32514 - DNA, 2771 bp, Triticum aestivum; identical to SEQ ID NO: 4763
  CDS (280)..(2550)

SEQ ID NO: 32515 - protein, 756 aa, Triticum aestivum; identical to SEQ ID NO: 4764

SEQ ID NO: 32516 - DNA, 4121 bp, Zea mays; identical to SEQ ID NO: 4765
  CDS (442)..(3954)

SEQ ID NO: 32517 - protein, 1170 aa, Zea mays; identical to SEQ ID NO: 4766

SEQ ID NO: 32518 - DNA, 3240 bp, Chlamydomonas reinhardtii; identical to SEQ ID NO: 4767
  CDS (138)..(2264)

SEQ ID NO: 32519 - protein, 708 aa, Chlamydomonas reinhardtii; identical to SEQ ID NO: 4768

SEQ ID NO: 32520 - DNA, 3049 bp, Chlamydomonas reinhardtii; identical to SEQ ID NO: 4769
  CDS (190)..(1920)

SEQ ID NO: 32521 - protein, 576 aa, Chlamydomonas reinhardtii; identical to SEQ ID NO: 4770

SEQ ID NO: 32522 - DNA, 2716 bp, Chlamydomonas reinhardtii; identical to SEQ ID NO: 4771
  CDS (93)..(2048)

SEQ ID NO: 32523 - protein, 651 aa, Chlamydomonas reinhardtii; identical to SEQ ID NO: 4772

SEQ ID NO: 32524 - DNA, 2325 bp, Ipomoea batatas; identical to SEQ ID NO: 4773
  CDS (155)..(2047)

SEQ ID NO: 32525 - protein, 630 aa, Ipomoea batatas; identical to SEQ ID NO: 4774

SEQ ID NO: 32526 - DNA, 1440 bp, Erwinia carotovora subsp; identical to SEQ ID NO: 4775
  CDS (1)..(1440)

SEQ ID NO: 32527 - protein, 479 aa, Erwinia carotovora subsp; identical to SEQ ID NO: 4776

SEQ ID NO: 32528 - DNA, 1497 bp, Bacillus thuringiensis serovar konkukian str; identical to SEQ ID NO: 4777
  CDS (1)..(1497)

SEQ ID NO: 32529 - protein, 498 aa, Bacillus thuringiensis serovar konkukian str; identical to SEQ ID NO: 4778

SEQ ID NO: 32530 - DNA, 1431 bp, Mycoplasma mobile; identical to SEQ ID NO: 4779
  CDS (1)..(1431): transl-table=4

SEQ ID NO: 32531 - protein, 476 aa, Mycoplasma mobile; identical to SEQ ID NO: 4780

SEQ ID NO: 32532 - DNA, 1815 bp, Hordeum bulbosum; identical to SEQ ID NO: 4781
  CDS (1)..(1815)

SEQ ID NO: 32533 - protein, 604 aa, Hordeum bulbosum; identical to SEQ ID NO: 4782

SEQ ID NO: 32534 - DNA, 1527 bp, Photobacterium profundum; identical to SEQ ID NO: 4783
  CDS (1)..(1527)

SEQ ID NO: 32535 - protein, 508 aa, Photobacterium profundum; identical to SEQ ID NO: 4784

SEQ ID NO: 32536 - DNA, 1569 bp, Methanococcus maripaludis; identical to SEQ ID NO: 4785
  CDS (1)..(1569)

SEQ ID NO: 32537 - protein, 522 aa, Methanococcus maripaludis; identical to SEQ ID NO: 4786

SEQ ID NO: 32538 - DNA, 1503 bp, Parachlamydia sp; identical to SEQ ID NO: 4787
  CDS (1)..(1503)

SEQ ID NO: 32539 - protein, 500 aa, Parachlamydia sp; identical to SEQ ID NO: 4788

SEQ ID NO: 32540 - DNA, 1452 bp, Rhodopseudomonas palustris; identical to SEQ ID NO: 4789
  CDS (1)..(1452)

SEQ ID NO: 32541 - protein, 483 aa, Rhodopseudomonas palustris; identical to SEQ ID NO: 4790

SEQ ID NO: 32542 - DNA, 1173 bp, Corynebacterium diphtheriae; identical to SEQ ID NO: 4791
  CDS (1)..(1173)

SEQ ID NO: 32543 - protein, 390 aa, Corynebacterium diphtheriae; identical to SEQ ID NO: 4792

SEQ ID NO: 32544 - DNA, 1578 bp, Ostreococcus tauri; identical to SEQ ID NO: 4793
  CDS (1)..(1578)

SEQ ID NO: 32545 - protein, 525 aa, Ostreococcus tauri; identical to SEQ ID NO: 4794

SEQ ID NO: 32546 - DNA, 1725 bp, Ostreococcus tauri; identical to SEQ ID NO: 4795
  CDS (1)..(1725)

SEQ ID NO: 32547 - protein, 574 aa, Ostreococcus tauri; identical to SEQ ID NO: 4796

SEQ ID NO: 32548 - DNA, 2022 bp, Ostreococcus tauri; identical to SEQ ID NO: 4797
  CDS (1)..(2022)

SEQ ID NO: 32549 - protein, 673 aa, Ostreococcus tauri; identical to SEQ ID NO: 4798

SEQ ID NO: 32550 - DNA, 2939 bp, Colocasia esculenta; identical to SEQ ID NO: 4799
  CDS (220)..(2634)

SEQ ID NO: 32551 - protein, 804 aa, Colocasia esculenta; identical to SEQ ID NO: 4800

SEQ ID NO: 32552 - DNA, 1554 bp, Thermoproteus tenax; identical to SEQ ID NO: 4801
  CDS (1)..(1554)

SEQ ID NO: 32553 - protein, 517 aa, Thermoproteus tenax; identical to SEQ ID NO: 4802

SEQ ID NO: 32554 - DNA, 1470 bp, Desulfovibrio vulgaris; identical to SEQ ID NO: 4803
  CDS (1)..(1470)

SEQ ID NO: 32555 - protein, 489 aa, Desulfovibrio vulgaris; identical to SEQ ID NO: 4804

SEQ ID NO: 32556 - DNA, 1323 bp, Thermus thermophilus; identical to SEQ ID NO: 4805
  CDS (1)..(1323)

SEQ ID NO: 32557 - protein, 440 aa, Thermus thermophilus; identical to SEQ ID NO: 4806

SEQ ID NO: 32558 - DNA, 1431 bp, Bacillus cereus; identical to SEQ ID NO: 4807
  CDS (1)..(1431)

SEQ ID NO: 32559 - protein, 476 aa, Bacillus cereus; identical to SEQ ID NO: 4808

SEQ ID NO: 32560 - DNA, 1476 bp, Treponema denticola; identical to SEQ ID NO: 4809
  CDS (1)..(1476)

SEQ ID NO: 32561 - protein, 491 aa, Treponema denticola; identical to SEQ ID NO: 4810

SEQ ID NO: 32562 - DNA, 1173 bp, Mycobacterium paratuberculosis; identical to SEQ ID NO: 4811
  CDS (1)..(1173)

SEQ ID NO: 32563 - protein, 390 aa, Mycobacterium paratuberculosis; identical to SEQ ID NO: 4812

SEQ ID NO: 32564 - DNA, 2486 bp, Phaseolus vulgaris; identical to SEQ ID NO: 4813
  CDS (39)..(2255)

SEQ ID NO: 32565 - protein, 738 aa, Phaseolus vulgaris; identical to SEQ ID NO: 4814

SEQ ID NO: 32566 - DNA, 2570 bp, Phaseolus vulgaris; identical to SEQ ID NO: 4815
  CDS (135)..(2309)

SEQ ID NO: 32567 - protein, 724 aa, Phaseolus vulgaris; identical to SEQ ID NO: 4816

SEQ ID NO: 32568 - DNA, 2444 bp, Phaseolus vulgaris; identical to SEQ ID NO: 4817
  CDS (78)..(2015)

SEQ ID NO: 32569 - protein, 645 aa, Phaseolus vulgaris; identical to SEQ ID NO: 4818

SEQ ID NO: 32570 - DNA, 1827 bp, Hordeum spontaneum; identical to SEQ ID NO: 4819
  CDS (1)..(1827)

SEQ ID NO: 32571 - protein, 608 aa, Hordeum spontaneum; identical to SEQ ID NO: 4820

SEQ ID NO: 32572 - DNA, 1248 bp, Gloeobacter violaceus; identical to SEQ ID NO: 4821
  CDS (1)..(1248)

SEQ ID NO: 32573 - protein, 415 aa, Gloeobacter violaceus; identical to SEQ ID NO: 4822

SEQ ID NO: 32574 - DNA, 3219 bp, Oryza sativa; identical to SEQ ID NO: 4823
  CDS (1)..(3219)

SEQ ID NO: 32575 - protein, 1072 aa, Oryza sativa; identical to SEQ ID NO: 4824

SEQ ID NO: 32576 - DNA, 2547 bp, Oryza sativa; identical to SEQ ID NO: 4825
  CDS (97)..(2022)

SEQ ID NO: 32577 - protein, 641 aa, Oryza sativa; identical to SEQ ID NO: 4826

SEQ ID NO: 32578 - DNA, 1242 bp, Streptomyces avermitilis; identical to SEQ ID NO: 4827
  CDS (1)..(1242)

SEQ ID NO: 32579 - protein, 413 aa, Streptomyces avermitilis; identical to SEQ ID NO: 4828

SEQ ID NO: 32580 - DNA, 2208 bp, Phaseolus vulgaris; identical to SEQ ID NO: 4829
  CDS (144)..(1991)

SEQ ID NO: 32581 - protein, 615 aa, Phaseolus vulgaris; identical to SEQ ID NO: 4830

SEQ ID NO: 32582 - DNA, 2748 bp, Oryza sativa; identical to SEQ ID NO: 4831
  CDS (1)..(2748)

SEQ ID NO: 32583 - protein, 915 aa, Oryza sativa; identical to SEQ ID NO: 4832

SEQ ID NO: 32584 - DNA, 1605 bp, Shewanella oneidensis; identical to SEQ ID NO: 4833
  CDS (1)..(1605)

SEQ ID NO: 32585 - protein, 534 aa, Shewanella oneidensis; identical to SEQ ID NO: 4834

SEQ ID NO: 32586 - DNA, 1173 bp, Corynebacterium efficiens; identical to SEQ ID NO: 4835
  CDS (1)..(1173)

SEQ ID NO: 32587 - protein, 390 aa, Corynebacterium efficiens; identical to SEQ ID NO: 4836

SEQ ID NO: 32588 - DNA, 2340 bp, Colocasia esculenta; identical to SEQ ID NO: 4837
  CDS (155)..(2086)

SEQ ID NO: 32589 - protein, 643 aa, Colocasia esculenta; identical to SEQ ID NO: 4838

SEQ ID NO: 32590 - DNA, 2409 bp, Hordeum vulgare; identical to SEQ ID NO: 4839
  CDS (1)..(2409)

SEQ ID NO: 32591 - protein, 802 aa, Hordeum vulgare; identical to SEQ ID NO: 4840

SEQ ID NO: 32592 - DNA, 2115 bp, Setaria italica; identical to SEQ ID NO: 4841
  CDS (142)..(1959)

SEQ ID NO: 32593 - protein, 605 aa, Setaria italica; identical to SEQ ID NO: 4842

SEQ ID NO: 32594 - DNA, 2081 bp, Triticum aestivum; identical to SEQ ID NO: 4843
  CDS (1)..(1800)

SEQ ID NO: 32595 - protein, 599 aa, Triticum aestivum; identical to SEQ ID NO: 4844

SEQ ID NO: 32596 - DNA, 1230 bp, Corynebacterium glutamicum; identical to SEQ ID NO: 4845
  CDS (1)..(1230)

SEQ ID NO: 32597 - protein, 409 aa, Corynebacterium glutamicum; identical to SEQ ID NO: 4846

SEQ ID NO: 32598 - DNA, 1356 bp, Pyrococcus furiosus; identical to SEQ ID NO: 4847
  CDS (1)..(1356)

SEQ ID NO: 32599 - protein, 451 aa, Pyrococcus furiosus; identical to SEQ ID NO: 4848

SEQ ID NO: 32600 - DNA, 2112 bp, Oryza sativa; identical to SEQ ID NO: 4849
  CDS (61)..(1887)

SEQ ID NO: 32601 - protein, 608 aa, Oryza sativa; identical to SEQ ID NO: 4850

SEQ ID NO: 32602 - DNA, 2496 bp, Oryza sativa; identical to SEQ ID NO: 4851
  CDS (1)..(2496)

SEQ ID NO: 32603 - protein, 831 aa, Oryza sativa; identical to SEQ ID NO: 4852

SEQ ID NO: 32604 - DNA, 1443 bp, Rhizobium loti; identical to SEQ ID NO: 4853
  CDS (1)..(1443)

SEQ ID NO: 32605 - protein, 480 aa, Rhizobium loti; identical to SEQ ID NO: 4854

SEQ ID NO: 32606 - DNA, 2100 bp, Pisum sativum; identical to SEQ ID NO: 4855
  CDS (6)..(1847)

SEQ ID NO: 32607 - protein, 613 aa, Pisum sativum; identical to SEQ ID NO: 4856

SEQ ID NO: 32608 - DNA, 3386 bp, Triticum aestivum; identical to SEQ ID NO: 4857
  CDS (251)..(2995)

SEQ ID NO: 32609 - protein, 914 aa, Triticum aestivum; identical to SEQ ID NO: 4858

SEQ ID NO: 32610 - DNA, 2919 bp, Oryza sativa; identical to SEQ ID NO: 4859
  CDS (165)..(2597)

SEQ ID NO: 32611 - protein, 810 aa, Oryza sativa; identical to SEQ ID NO: 4860

SEQ ID NO: 32612 - DNA, 2394 bp, Oryza sativa; identical to SEQ ID NO: 4861
  CDS (34)..(2118)

SEQ ID NO: 32613 - protein, 694 aa, Oryza sativa; identical to SEQ ID NO: 4862

SEQ ID NO: 32614 - DNA, 2903 bp, Oryza sativa; identical to SEQ ID NO: 4863
  CDS (86)..(2335)

SEQ ID NO: 32615 - protein, 749 aa, Oryza sativa; identical to SEQ ID NO: 4864

SEQ ID NO: 32616 - DNA, 1719 bp, Sulfolobus tokodaii; identical to SEQ ID NO: 4865
  CDS (1)..(1719)

SEQ ID NO: 32617 - protein, 572 aa, Sulfolobus tokodaii; identical to SEQ ID NO: 4866

SEQ ID NO: 32618 - DNA, 2270 bp, Perilla frutescens; identical to SEQ ID NO: 4867
  CDS (172)..(1986)

SEQ ID NO: 32619 - protein, 604 aa, Perilla frutescens; identical to SEQ ID NO: 4868

SEQ ID NO: 32620 - DNA, 1701 bp, Sulfolobus acidocaldarius; identical to SEQ ID NO: 4869
  CDS (1)..(1701)

SEQ ID NO: 32621 - protein, 566 aa, Sulfolobus acidocaldarius; identical to SEQ ID NO: 4870

SEQ ID NO: 32622 - DNA, 2793 bp, Triticum aestivum; identical to SEQ ID NO: 4871
  CDS (135)..(2531)

SEQ ID NO: 32623 - protein, 798 aa, Triticum aestivum; identical to SEQ ID NO: 4872

SEQ ID NO: 32624 - DNA, 5346 bp, Triticum aestivum; identical to SEQ ID NO: 4873
  CDS (29)..(4915)

SEQ ID NO: 32625 - protein, 1628 aa, Triticum aestivum; identical to SEQ ID NO: 4874

SEQ ID NO: 32626 - DNA, 2502 bp, Arabidopsis thaliana; identical to SEQ ID NO: 4875
  CDS (1)..(2379)

SEQ ID NO: 32627 - protein, 792 aa, Arabidopsis thaliana; identical to SEQ ID NO: 4876

SEQ ID NO: 32628 - DNA, 2592 bp, Sorghum bicolor; identical to SEQ ID NO: 4877
  CDS (59)..(1948)

SEQ ID NO: 32629 - protein, 629 aa, Sorghum bicolor; identical to SEQ ID NO: 4878

SEQ ID NO: 32630 - DNA, 1815 bp, Triticum turgidum subsp; identical to SEQ ID NO: 4879
  CDS (1)..(1815)

SEQ ID NO: 32631 - protein, 604 aa, Triticum turgidum subsp; identical to SEQ ID NO: 4880

SEQ ID NO: 32632 - DNA, 2575 bp, Manihot esculenta; identical to SEQ ID NO: 4881
  CDS (50)..(2305)

SEQ ID NO: 32633 - protein, 751 aa, Manihot esculenta; identical to SEQ ID NO: 4882

SEQ ID NO: 32634 - DNA, 2842 bp, Triticum aestivum; identical to SEQ ID NO: 4883
  CDS (89)..(2488)

SEQ ID NO: 32635 - protein, 799 aa, Triticum aestivum; identical to SEQ ID NO: 4884

SEQ ID NO: 32636 - DNA, 1818 bp, Triticum monococcum; identical to SEQ ID NO: 4885
  CDS (1)..(1818)

SEQ ID NO: 32637 - protein, 605 aa, Triticum monococcum; identical to SEQ ID NO: 4886

SEQ ID NO: 32638 - DNA, 2081 bp, Triticum aestivum; identical to SEQ ID NO: 4887
  CDS (120)..(1919)

SEQ ID NO: 32639 - protein, 599 aa, Triticum aestivum; identical to SEQ ID NO: 4888

SEQ ID NO: 32640 - DNA, 2591 bp, Triticum aestivum; identical to SEQ ID NO: 4889
  CDS (256)..(2199)

SEQ ID NO: 32641 - protein, 647 aa, Triticum aestivum; identical to SEQ ID NO: 4890

SEQ ID NO: 32642 - DNA, 1872 bp, Oryza sativa; identical to SEQ ID NO: 4891
  CDS (1)..(1872)

SEQ ID NO: 32643 - protein, 623 aa, Oryza sativa; identical to SEQ ID NO: 4892

SEQ ID NO: 32644 - DNA, 2028 bp, Triticum aestivum; identical to SEQ ID NO: 4893
  CDS (30)..(1754)

SEQ ID NO: 32645 - protein, 574 aa, Triticum aestivum; identical to SEQ ID NO: 4894

SEQ ID NO: 32646 - DNA, 3901 bp, Vigna unguiculata; identical to SEQ ID NO: 4895
  CDS (161)..(3604)

SEQ ID NO: 32647 - protein, 1147 aa, Vigna unguiculata; identical to SEQ ID NO: 4896

SEQ ID NO: 32648 - DNA, 3519 bp, Vigna unguiculata; identical to SEQ ID NO: 4897
  CDS (386)..(3010)

SEQ ID NO: 32649 - protein, 874 aa, Vigna unguiculata; identical to SEQ ID NO: 4898

SEQ ID NO: 32650 - DNA, 2221 bp, Phaseolus vulgaris; identical to SEQ ID NO: 4899
  CDS (30)..(1850)

SEQ ID NO: 32651 - protein, 606 aa, Phaseolus vulgaris; identical to SEQ ID NO: 4900

SEQ ID NO: 32652 - DNA, 2107 bp, Astragalus membranaceus; identical to SEQ ID NO: 4901
  CDS (96)..(1919)

SEQ ID NO: 32653 - protein, 607 aa, Astragalus membranaceus; identical to SEQ ID NO: 4902

SEQ ID NO: 32654 - DNA, 1389 bp, Bradyrhizobium japonicum; identical to SEQ ID NO: 4903
  CDS (1)..(1389)

SEQ ID NO: 32655 - protein, 462 aa, Bradyrhizobium japonicum; identical to SEQ ID NO: 4904

SEQ ID NO: 32656 - DNA, 1530 bp, Agrobacterium tumefaciens; identical to SEQ ID NO: 4905
  CDS (1)..(1530)

SEQ ID NO: 32657 - protein, 509 aa, Agrobacterium tumefaciens; identical to SEQ ID NO: 4906

SEQ ID NO: 32658 - DNA, 1449 bp, Bradyrhizobium japonicum; identical to SEQ ID NO: 4907
  CDS (1)..(1449)

SEQ ID NO: 32659 - protein, 482 aa, Bradyrhizobium japonicum; identical to SEQ ID NO: 4908

SEQ ID NO: 32660 - DNA, 1431 bp, Bacillus cereus; identical to SEQ ID NO: 4909
  CDS (1)..(1431)

SEQ ID NO: 32661 - protein, 476 aa, Bacillus cereus; identical to SEQ ID NO: 4910

SEQ ID NO: 32662 - DNA, 1458 bp, Bacillus stearothermophilus; identical to SEQ ID NO: 4911
  CDS (1)..(1458)

SEQ ID NO: 32663 - protein, 485 aa, Bacillus stearothermophilus; identical to SEQ ID NO: 4912

SEQ ID NO: 32664 - DNA, 1533 bp, Bordetella bronchiseptica; identical to SEQ ID NO: 4913
  CDS (1)..(1533)

SEQ ID NO: 32665 - protein, 510 aa, Bordetella bronchiseptica; identical to SEQ ID NO: 4914

SEQ ID NO: 32666 - DNA, 1428 bp, Chlamydophila caviae; identical to SEQ ID NO: 4915
  CDS (1)..(1428)

SEQ ID NO: 32667 - protein, 475 aa, Chlamydophila caviae; identical to SEQ ID NO: 4916

SEQ ID NO: 32668 - DNA, 1467 bp, Chlorobium tepidum; identical to SEQ ID NO: 4917
  CDS (1)..(1467)

SEQ ID NO: 32669 - protein, 488 aa, Chlorobium tepidum; identical to SEQ ID NO: 4918

SEQ ID NO: 32670 - DNA, 1449 bp, Clostridium perfringens; identical to SEQ ID NO: 4919
  CDS (1)..(1449)

SEQ ID NO: 32671 - protein, 482 aa, Clostridium perfringens; identical to SEQ ID NO: 4920

SEQ ID NO: 32672 - DNA, 1335 bp, Deinococcus radiodurans; identical to SEQ ID NO: 4921
  CDS (1)..(1335)

SEQ ID NO: 32673 - protein, 444 aa, Deinococcus radiodurans; identical to SEQ ID NO: 4922

SEQ ID NO: 32674 - DNA, 1386 bp, Fusobacterium nucleatum; identical to SEQ ID NO: 4923
  CDS (1)..(1386)

SEQ ID NO: 32675 - protein, 461 aa, Fusobacterium nucleatum; identical to SEQ ID NO: 4924

SEQ ID NO: 32676 - DNA, 1377 bp, Gloeobacter violaceus; identical to SEQ ID NO: 4925
  CDS (1)..(1377)

SEQ ID NO: 32677 - protein, 458 aa, Gloeobacter violaceus; identical to SEQ ID NO: 4926

SEQ ID NO: 32678 - DNA, 1440 bp, Lactobacillus plantarum; identical to SEQ ID NO: 4927
  CDS (1)..(1440)

SEQ ID NO: 32679 - protein, 479 aa, Lactobacillus plantarum; identical to SEQ ID NO: 4928

SEQ ID NO: 32680 - DNA, 1488 bp, Nitrosomonas europaea; identical to SEQ ID NO: 4929
  CDS (1)..(1488)

SEQ ID NO: 32681 - protein, 495 aa, Nitrosomonas europaea; identical to SEQ ID NO: 4930

SEQ ID NO: 32682 - DNA, 1434 bp, Oceanobacillus iheyensis; identical to SEQ ID NO: 4931
  CDS (1)..(1434)

SEQ ID NO: 32683 - protein, 477 aa, Oceanobacillus iheyensis; identical to SEQ ID NO: 4932

SEQ ID NO: 32684 - DNA, 1443 bp, Pasteurella multocida; identical to SEQ ID NO: 4933
  CDS (1)..(1443)

SEQ ID NO: 32685 - protein, 480 aa, Pasteurella multocida; identical to SEQ ID NO: 4934

SEQ ID NO: 32686 - DNA, 1506 bp, Prochlorococcus marinus; identical to SEQ ID NO: 4935
  CDS (1)..(1506)

SEQ ID NO: 32687 - protein, 501 aa, Prochlorococcus marinus; identical to SEQ ID NO: 4936

SEQ ID NO: 32688 - DNA, 1500 bp, Prochlorococcus marinus; identical to SEQ ID NO: 4937
  CDS (1)..(1500)

SEQ ID NO: 32689 - protein, 499 aa, Prochlorococcus marinus; identical to SEQ ID NO: 4938

SEQ ID NO: 32690 - DNA, 1452 bp, Prochlorococcus marinus subsp; identical to SEQ ID NO: 4939
  CDS (1)..(1452)

SEQ ID NO: 32691 - protein, 483 aa, Prochlorococcus marinus subsp; identical to SEQ ID NO: 4940

SEQ ID NO: 32692 - DNA, 1560 bp, Pseudomonas putida; identical to SEQ ID NO: 4941
  CDS (1)..(1560)

SEQ ID NO: 32693 - protein, 519 aa, Pseudomonas putida; identical to SEQ ID NO: 4942

SEQ ID NO: 32694 - DNA, 1455 bp, Pseudomonas syringae; identical to SEQ ID NO: 4943
  CDS (1)..(1455)

SEQ ID NO: 32695 - protein, 484 aa, Pseudomonas syringae; identical to SEQ ID NO: 4944

SEQ ID NO: 32696 - DNA, 1626 bp, Ralstonia solanacearum; identical to SEQ ID NO: 4945
  CDS (1)..(1626)

SEQ ID NO: 32697 - protein, 541 aa, Ralstonia solanacearum; identical to SEQ ID NO: 4946

SEQ ID NO: 32698 - DNA, 1446 bp, Rhizobium loti; identical to SEQ ID NO: 4947
  CDS (1)..(1446)

SEQ ID NO: 32699 - protein, 481 aa, Rhizobium loti; identical to SEQ ID NO: 4948

SEQ ID NO: 32700 - DNA, 1443 bp, Rhizobium tropici; identical to SEQ ID NO: 4949
  CDS (1)..(1443)

SEQ ID NO: 32701 - protein, 480 aa, Rhizobium tropici; identical to SEQ ID NO: 4950

SEQ ID NO: 32702 - DNA, 1524 bp, Rhodopirellula baltica; identical to SEQ ID NO: 4951
  CDS (1)..(1524)

SEQ ID NO: 32703 - protein, 507 aa, Rhodopirellula baltica; identical to SEQ ID NO: 4952

SEQ ID NO: 32704 - DNA, 1434 bp, Rhodobacter sphaeroides; identical to SEQ ID NO: 4953
  CDS (1)..(1434)

SEQ ID NO: 32705 - protein, 477 aa, Rhodobacter sphaeroides; identical to SEQ ID NO: 4954

SEQ ID NO: 32706 - DNA, 1434 bp, Salmonella typhimurium; identical to SEQ ID NO: 4955
  CDS (1)..(1434)

SEQ ID NO: 32707 - protein, 477 aa, Salmonella typhimurium; identical to SEQ ID NO: 4956

SEQ ID NO: 32708 - DNA, 1431 bp, Streptococcus mutans; identical to SEQ ID NO: 4957
  CDS (1)..(1431)

SEQ ID NO: 32709 - protein, 476 aa, Streptococcus mutans; identical to SEQ ID NO: 4958

SEQ ID NO: 32710 - DNA, 1425 bp, Synechococcus elongatus; identical to SEQ ID NO: 4959
  CDS (1)..(1425)

SEQ ID NO: 32711 - protein, 474 aa, Synechococcus elongatus; identical to SEQ ID NO: 4960

SEQ ID NO: 32712 - DNA, 1398 bp, Synechococcus sp; identical to SEQ ID NO: 4961
  CDS (1)..(1398)

SEQ ID NO: 32713 - protein, 465 aa, Synechococcus sp; identical to SEQ ID NO: 4962

SEQ ID NO: 32714 - DNA, 1542 bp, Synechococcus sp; identical to SEQ ID NO: 4963
  CDS (1)..(1542)

SEQ ID NO: 32715 - protein, 513 aa, Synechococcus sp; identical to SEQ ID NO: 4964

SEQ ID NO: 32716 - DNA, 1317 bp, Thermus caldophilus; identical to SEQ ID NO: 4965
  CDS (1)..(1317)

SEQ ID NO: 32717 - protein, 438 aa, Thermus caldophilus; identical to SEQ ID NO: 4966

SEQ ID NO: 32718 - DNA, 1458 bp, Vibrio parahaemolyticus; identical to SEQ ID NO: 4967
  CDS (1)..(1458)

SEQ ID NO: 32719 - protein, 485 aa, Vibrio parahaemolyticus; identical to SEQ ID NO: 4968

SEQ ID NO: 32720 - DNA, 1458 bp, Vibrio vulnificus; identical to SEQ ID NO: 4969
  CDS (1)..(1458)

SEQ ID NO: 32721 - protein, 485 aa, Vibrio vulnificus; identical to SEQ ID NO: 4970

SEQ ID NO: 32722 - DNA, 1425 bp, Xanthomonas axonopodis; identical to SEQ ID NO: 4971
  CDS (1)..(1425)

SEQ ID NO: 32723 - protein, 474 aa, Xanthomonas axonopodis; identical to SEQ ID NO: 4972

SEQ ID NO: 32724 - DNA, 1425 bp, Xanthomonas campestris; identical to SEQ ID NO: 4973
  CDS (1)..(1425)

SEQ ID NO: 32725 - protein, 474 aa, Xanthomonas campestris; identical to SEQ ID NO: 4974

SEQ ID NO: 32726 - DNA, 2345 bp, Antirrhinum majus; identical to SEQ ID NO: 4975
  CDS (10)..(1836)

SEQ ID NO: 32727 - protein, 608 aa, Antirrhinum majus; identical to SEQ ID NO: 4976

SEQ ID NO: 32728 - DNA, 2211 bp, Ipomoea batatas; identical to SEQ ID NO: 4977
  CDS (93)..(1919)

SEQ ID NO: 32729 - protein, 608 aa, Ipomoea batatas; identical to SEQ ID NO: 4978

SEQ ID NO: 32730 - DNA, 2988 bp, Pisum sativum; identical to SEQ ID NO: 4979
  CDS (140)..(2398)

SEQ ID NO: 32731 - protein, 752 aa, Pisum sativum; identical to SEQ ID NO: 4980

SEQ ID NO: 32732 - DNA, 2329 bp, Arabidopsis thaliana; identical to SEQ ID NO: 4981
  CDS (67)..(2025)

SEQ ID NO: 32733 - protein, 652 aa, Arabidopsis thaliana; identical to SEQ ID NO: 4982

SEQ ID NO: 32734 - DNA, 4127 bp, Solanum tuberosum; identical to SEQ ID NO: 4983
  CDS (143)..(3835)

SEQ ID NO: 32735 - protein, 1230 aa, Solanum tuberosum; identical to SEQ ID NO: 4984

SEQ ID NO: 32736 - DNA, 25 bp, Artificial sequence
  (1)..(25): primer
atgcaggttttacatgtatgttcag

SEQ ID NO: 32737 - DNA, 26 bp, Artificial sequence
  (1)..(26): primer
ttatttcaagcgatagtaaagctcac

SEQ ID NO: 32738 - protein, 974 aa, Artificial sequence
  Variant (2)..(2): xaa in position 2 is any amino acid
  Variant (5)..(5): xaa in position 5 is any amino acid
  Variant (10)..(10): xaa in position 10 is any amino acid
  Variant (14)..(14): xaa in position 14 is any amino acid
  Variant (18)..(108): xaa in position 18 to 108 is any or no amino acid
  Variant (119)..(119): xaa in position 119 is any amino acid
  Variant (123)..(124): xaa in position 123 to 124 is any amino acid
  Variant (126)..(151): xaa in position 126 to 151 is any or no amino acid
  Variant (153)..(153): xaa in position 153 is any amino acid
  Variant (155)..(155): xaa in position 155 is any amino acid
  Variant (160)..(160): xaa in position 160 is any amino acid
  Variant (162)..(171): xaa in position 162 to 171 is any amino acid
  Variant (173)..(178): xaa in position 173 to 178 is any amino acid
  Variant (179)..(209): xaa in position 179 to 209 is any or no amino acid
  Variant (211)..(216): xaa in position 211 to 216 is any amino acid
  Variant (217)..(218): xaa in position 217 to 218 is any or no amino acid
  Variant (221)..(223): xaa in position 221 to 223 is any amino acid
  Variant (227)..(227): xaa in position 227 is any amino acid
  Variant (229)..(229): xaa in position 229 is any amino acid
  Variant (231)..(232): xaa in position 231 to 232 is any amino acid
  Variant (234)..(234): xaa in position 234 is any amino acid
  Variant (235)..(262): xaa in position 235 to 262 is any or no amino acid
  Variant (264)..(264): xaa in position 264 is any amino acid
  Variant (266)..(268): xaa in position 266 to 268 is any amino acid
  Variant (272)..(275): xaa in position 272 to 275 is any amino acid
  Variant (279)..(280): xaa in position 279 to 280 is any amino acid
  Variant (281)..(406): xaa in position 281 to 406 is any or no amino acid
  Variant (420)..(420): xaa in position 420 is any amino acid
  Variant (424)..(425): xaa in position 424 to 425 is any or no amino acid
  Variant (427)..(429): xaa in position 427 to 429 is any or no amino acid
  Variant (431)..(442): xaa in position 431 to 442 is any or no amino acid
  Variant (446)..(446): xaa in position 446 is any amino acid
  Variant (456)..(456): xaa in position 456 is any amino acid
  Variant (457)..(464): xaa in position 457 to 464 is any or no amino acid
  Variant (466)..(475): xaa in position 466 to 475 is any or no amino acid
  Variant (477)..(491): xaa in position 477 to 491 is any or no amino acid
  Variant (493)..(514): xaa in position 493 to 514 is any or no amino acid
  Variant (523)..(524): xaa in position 523 to 524 is any or no amino acid
  Variant (529)..(529): xaa in position 529 is any amino acid
  Variant (537)..(537): xaa in position 537 is any amino acid
  Variant (540)..(540): xaa in position 540 is any amino acid
  Variant (542)..(549): xaa in position 542 to 549 is any or no amino acid
  Variant (551)..(551): xaa in position 551 is any or no amino acid
  Variant (553)..(553): xaa in position 553 is any or no amino acid
  Variant (557)..(557): xaa in position 557 is any or no amino acid
  Variant (560)..(560): xaa in position 560 is any amino acid
  Variant (561)..(567): xaa in position 561 to 567 is any or no amino acid
  Variant (569)..(569): xaa in position 569 is any amino acid
  Variant (577)..(578): xaa in position 577 to 578 is any amino acid
  Variant (579)..(579): xaa in position 579 is any or no amino acid
  Variant (583)..(584): xaa in position 583 to 584 is any amino acid
  Variant (586)..(587): xaa in position 586 to 587 is any or no amino acid
  Variant (589)..(607): xaa in position 589 to 607 is any or no amino acid
  Variant (609)..(612): xaa in position 609 to 612 is any or no amino acid
  Variant (614)..(641): xaa in position 614 to 641 is any or no amino acid
  Variant (643)..(645): xaa in position 643 to 645 is any or no amino acid
  Variant (647)..(647): xaa in position 647 is any or no amino acid
  Variant (651)..(652): xaa in position 651 to 652 is any amino acid
  Variant (656)..(656): xaa in position 656 is any amino acid
  Variant (658)..(663): xaa in position 658 to 663 is any or no amino acid
  Variant (668)..(668): xaa in position 668 is any amino acid
  Variant (673)..(674): xaa in position 673 to 674 is any amino acid
  Variant (682)..(683): xaa in position 682 to 683 is any amino acid
  Variant (686)..(687): xaa in position 686 to 687 is any amino acid
  Variant (690)..(692): xaa in position 690 to 692 is any amino acid
  Variant (693)..(704): xaa in position 693 to 704 is any or no amino acid
  Variant (715)..(715): xaa in position 715 is any amino acid
  Variant (716)..(729): xaa in position 716 to 729 is any or no amino acid
  Variant (732)..(733): xaa in position 732 to 733 is any or no amino acid
  Variant (735)..(736): xaa in position 735 to 736 is any amino acid
  Variant (738)..(739): xaa in position 738 to 739 is any amino acid
  Variant (740)..(740): xaa in position 740 is any or no amino acid
  Variant (742)..(743): xaa in position 742 to 743 is any amino acid
  Variant (745)..(748): xaa in position 745 to 748 is any or no amino acid
  Variant (750)..(752): xaa in position 750 to 752 is any or no amino acid
  Variant (754)..(754): xaa in position 754 is any or no amino acid
  Variant (756)..(758): xaa in position 756 to 758 is any amino acid
  Variant (762)..(762): xaa in position 762 is any amino acid
  Variant (764)..(764): xaa in position 764 is any amino acid
  Variant (782)..(844): xaa in position 782 to 844 is any or no amino acid
  Variant (847)..(847): xaa in position 847 is any amino acid
  Variant (858)..(859): xaa in position 858 to 859 is any amino acid
  Variant (864)..(864): xaa in position 864 is any amino acid
  Variant (868)..(868): xaa in position 868 is any amino acid
  Variant (870)..(871): xaa in position 870 to 871 is any amino acid
  Variant (872)..(892): xaa in position 872 to 892 is any or no amino acid
  Variant (894)..(894): xaa in position 894 is any or no amino acid
  Variant (897)..(897): xaa in position 897 is any amino acid
  Variant (900)..(901): xaa in position 900 to 901 is any amino acid
  Variant (903)..(905): xaa in position 903 to 905 is any amino acid
  Variant (907)..(908): xaa in position 907 to 908 is any amino acid
  Variant (911)..(911): xaa in position 911 is any amino acid
  Variant (915)..(916): xaa in position 915 to 916 is any or no amino acid
  Variant (918)..(942): xaa in position 918 to 942 is any or no amino acid
  Variant (944)..(945): xaa in position 944 to 945 is any or no amino acid
  Variant (947)..(952): xaa in position 947 to 952 is any or no amino acid
  Variant (955)..(956): xaa in position 955 to 956 is any amino acid
  Variant (961)..(962): xaa in position 961 to 962 is any amino acid
  Variant (965)..(966): xaa in position 965 to 966 is any amino acid
  Variant (968)..(969): xaa in position 968 to 969 is any amino acid
  Variant (972)..(973): xaa in position 972 to 973 is any amino acid
MXVLXVAAEXAPWXKTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLGDVVGALPXALAXXGXXXXXXXXXXXXXXXXXXXXXXXXXXHXVXVVLPXYXXXXXXXXXXVXXXXXXXXXXXXXXXXXXXXXXXXXXXXXXXXXXXXXVXXXXXXXXGVXXXFIDXPXFXXRXXXXXXXXXXXXXXXXXXXXXXXXXXXXXYXDXXXRFAXXXXAALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVHANDWHTALLPXYLKXXYXXXGXXXXXXXXXXXXKSVXTIHNLAYQGXXXXXXXXXLXXXXXXXXXXLXXXXXXXXXXXXXXXGXXXXXXXXXXXXXXXXXXXXXXINFLKAGIXXADRVXTVSPTYAXEIXTXXXXXXXXEXGXGLDXLLXXXXXXXXLXGIVNGIDXXXWNPXXDXXLXXXXXXXXXXXXXXXXXXXYXXXXLXXXXXXXXXXXXXXXXXXXXXXXXXXXXKXXXKXALQXXLGLXVXXXXXXPLIGXIGRLXXQKGVDLIXXAIXXLLXXXXXXXXXXXXXXXVQLVLLGTGDXXXXXXXXXXXXXXXLEXXLXXLXXXYXXKXXXXVXXXVXFXXXLAHXIXAGADILLMPSRFEPCGLXXXXXXXXXXXXXXXXXXXXXXXXXXXXXXXXXXXXXXXXXXXXXXXXXXXXXXXXXXXXXXXQLXAMRYGTVPIVXXTGGLXDTVXDXXXXXXXXXXXXXXXXXXXXXXXGXGFXFDXXDXXXLXXALXRALXXYXXXXXXXXXXXXXXXXXXXXXXXXXWXXLXXXXXXGMXXDFSWXXSAXXYXXLYXXL

SEQ ID NO: 32739 - protein, 56 aa, Artificial sequence; identical to SEQ ID NO: 6176
  Variant (1)..(1): xaa in position 1 is Gly or Ala
  Variant (2)..(4): xaa in position 2 to 4 is any amino acid
  Variant (5)..(5): xaa in position 5 is Ala, Ser or Cys
  Variant (6)..(7): xaa in position 6 to 7 is any amino acid
  Variant (8)..(8): xaa in position 8 is Val, Ile, Leu or Ala
  Variant (9)..(9): xaa in position 9 is any amino acid
  Variant (10)..(10): xaa in position 10 is Thr, Ala or Val
  Variant (13)..(14): xaa in position 13 to 14 is any amino acid
  Variant (15)..(15): xaa in position 15 is Tyr, Met or His
  Variant (16)..(16): xaa in position 16 is Ala, Ser, Leu, Lys or Val
  Variant (17)..(17): xaa in position 17 is any amino acid
  Variant (18)..(18): xaa in position 18 is Glu, Gln or Asp
  Variant (19)..(19): xaa in position 19 is Ile, Leu, Val or Glu
  Variant (20)..(28): xaa in position 20 to 28 is any amino acid
  Variant (29)..(43): xaa in position 29 to 43 is any or no amino acid
  Variant (44)..(44): xaa in position 44 is Gly, Val or Tyr
  Variant (45)..(45): xaa in position 45 is Ile or Val
  Variant (46)..(46): xaa in position 46 is any amino acid
  Variant (49)..(49): xaa in position 49 is Ile, Met, Val, Leu or Cys
  Variant (51)..(52): xaa in position 51 to 52 is any amino acid
  Variant (53)..(53): xaa in position 53 is any or no amino acid
  Variant (54)..(54): xaa in position 54 is Trp, Tyr, Phe or Leu
  Variant (55)..(55): xaa in position 55 is any amino acid
  Variant (56)..(56): xaa in position 56 is Pro or Glu

SEQ ID NO: 32740 - protein, 65 aa, Artificial sequence; identical to SEQ ID NO: 6177
  Variant (1)..(1): xaa in position 1 is Lys, Arg or Phe
  Variant (2)..(4): xaa in position 2 to 4 is any amino acid
  Variant (5)..(5): xaa in position 5 is Lys, Arg, Ala or Glu
  Variant (6)..(7): xaa in position 6 to 7 is any amino acid
  Variant (8)..(8): xaa in position 8 is Leu, Val or Ile
  Variant (9)..(11): xaa in position 9 to 11 is any amino acid
  Variant (12)..(12): xaa in position 12 is Leu, Val, Phe, Met or Thr
  Variant (13)..(13): xaa in position 13 is any amino acid
  Variant (14)..(14): xaa in position 14 is Leu, Ile, Phe or Val
  Variant (15)..(19): xaa in position 15 to 19 is any amino acid
  Variant (20)..(22): xaa in position 20 to 22 is any or no amino acid
  Variant (23)..(23): xaa in position 23 is Leu, Val, Ile or Met
  Variant (24)..(24): xaa in position 24 is Ile, Val, Phe, Leu, Tyr or Met
  Variant (25)..(26): xaa in position 25 to 26 is any amino acid
  Variant (27)..(27): xaa in position 27 is Ile or Val
  Variant (28)..(28): xaa in position 28 is Gly, Ser, Thr, Cys or Ala
  Variant (30)..(30): xaa in position 30 is Leu, Ile or Phe
  Variant (31)..(32): xaa in position 31 to 32 is any amino acid
  Variant (33)..(33): xaa in position 33 is any or no amino acid
  Variant (37)..(37): xaa in position 37 is any amino acid
  Variant (38)..(38): xaa in position 38 is Asp, His or Glu
  Variant (39)..(39): xaa in position 39 is any amino acid
  Variant (40)..(40): xaa in position 40 is Ile, Leu, Val, Met, Ala or Thr
  Variant (41)..(54): xaa in position 41 to 54 is any amino acid
  Variant (55)..(59): xaa in position 55 to 59 is any or no amino acid
  Variant (60)..(60): xaa in position 60 is Val, Ile, Ala, Leu or Tyr
  Variant (61)..(61): xaa in position 61 is Leu, Ile, Val, Met or Cys
  Variant (62)..(62): xaa in position 62 is Leu, Val, Ile or Ala
  Variant (64)..(64): xaa in position 64 is any amino acid
  Variant (65)..(65): xaa in position 65 is Gly, Ala, Ser, Pro or Cys

SEQ ID NO: 32741 - protein, 51 aa, Artificial sequence; identical to SEQ ID NO: 6178
  Variant (1)..(1): xaa in position 1 is Phe, Tyr, Leu or His
  Variant (2)..(5): xaa in position 2 to 5 is any amino acid
  Variant (6)..(6): xaa in position 6 is Ala, Ser, Ile or Val
  Variant (7)..(7): xaa in position 7 is His, Arg or Gln
  Variant (8)..(8): xaa in position 8 is any amino acid
  Variant (9)..(9): xaa in position 9 is Ile, Val, Leu, Met or Ala
  Variant (10)..(10): xaa in position 10 is any amino acid
  Variant (11)..(11): xaa in position 11 is Ala, Gly or Thr
  Variant (12)..(12): xaa in position 12 is Gly, Ala or Ser
  Variant (13)..(13): xaa in position 13 is any amino acid
  Variant (15)..(16): xaa in position 15 to 16 is any amino acid
  Variant (17)..(17): xaa in position 17 is Leu, Ile, Val, Ala, Met or Cys
  Variant (18)..(18): xaa in position 18 is Met, Ile, Val, His or Cys
  Variant (19)..(19): xaa in position 19 is Pro or Thr
  Variant (21)..(21): xaa in position 21 is any amino acid
  Variant (22)..(22): xaa in position 22 is Phe or Tyr
  Variant (24)..(24): xaa in position 24 is Pro or Ala
  Variant (25)..(25): xaa in position 25 is Cys, Phe or Leu
  Variant (27)..(27): xaa in position 27 is Leu or Ile
  Variant (28)..(28): xaa in position 28 is any amino acid
  Variant (29)..(29): xaa in position 29 is Gln, Asn or Pro
  Variant (30)..(30): xaa in position 30 is Leu, Met or Ile
  Variant (31)..(31): xaa in position 31 is any amino acid
  Variant (32)..(32): xaa in position 32 is Ala, Gly or Ser
  Variant (33)..(33): xaa in position 33 is Met, Leu or Gln
  Variant (34)..(34): xaa in position 34 is any amino acid
  Variant (35)..(35): xaa in position 35 is Tyr, Phe, Cys or Leu
  Variant (36)..(36): xaa in position 36 is Gly, Ala or Asn
  Variant (37)..(37): xaa in position 37 is Thr, Ser, Ala or Cys
  Variant (38)..(38): xaa in position 38 is Val, Ile, Leu, Pro or Ala
  Variant (39)..(39): xaa in position 39 is Pro, Cys or Val
  Variant (40)..(40): xaa in position 40 is Ile, Val, Leu or Ala
  Variant (41)..(41): xaa in position 41 is Val, Ala or Cys
  Variant (42)..(42): xaa in position 42 is Arg, His, Ala, Ser or Thr
  Variant (43)..(43): xaa in position 43 is any amino acid
  Variant (44)..(44): xaa in position 44 is Thr or Val
  Variant (47)..(47): xaa in position 47 is Leu or Ile
  Variant (48)..(48): xaa in position 48 is any amino acid
  Variant (49)..(49): xaa in position 49 is Asp or Glu
  Variant (50)..(50): xaa in position 50 is Thr, Ser or Val
  Variant (51)..(51): xaa in position 51 is Val or Ile

SEQ ID NO: 32742 - DNA, 1026 bp, Escherichia coli K12
  CDS (1)..(1026): transl_table=11
atgaaagcgttatccaaactgaaagcggaagagggcatctggatgaccgacgttcctgtaccggaactcgggcataacgatctgctgattaaaatccgtaaaacagccatctgcgggactgacgttcacatctataactgggatgagtggtcgcaaaaaaccatcccggtgccgatggtcgtgggccatgaatatgtcggtgaagtggtaggtattggtcaggaagtgaaaggcttcaagatcggcgatcgcgtttctggcgaaggccatatcacctgtggtcattgccgcaactgtcgtggtggtcgtacccatttgtgccgcaacacgataggcgttggtgttaatcgcccgggctgctttgccgaatatctggtgatcccggcattcaacgccttcaaaatccccgacaatatttccgatgacttagccgcaatttttgatcccttcggtaacgccgtgcataccgcgctgtcgtttgatctggtgggcgaagatgtgctggtttctggtgcaggcccgattggtattatggcagcggcggtggcgaaacacgttggtgcacgcaatgtggtgatcactgatgttaacgaataccgccttgagctggcgcgtaaaatgggtatcacccgtgcggttaacgtcgccaaagaaaatctcaatgacgtgatggcggagttaggcatgaccgaaggttttgatgtcggtctggaaatgtccggtgcgccgccagcgtttcgtaccatgcttgacaccatgaatcacggcggccgtattgcgatgctgggtattccgccgtctgatatgtctatcgactggaccaaagtgatctttaaaggcttgttcattaaaggtatttacggtcgtgagatgtttgaaacctggtacaagatggcggcgctgattcagtctggcctcgatctttcgccgatcattacccatcgtttctctatcgatgatttccagaagggctttgacgctatgcgttcgggccagtccgggaaagttattctgagctgggattaa

SEQ ID NO: 32743 - protein, 341 aa, Escherichia coli K12
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLAAIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 32744 - DNA, 1113 bp, Deinococcus radiodurans R1
  CDS (1)..(1113): transl_table=11
gtgacttctcccagctcgaccgcaacttccagcccgaccacgaccaccgcccccacccctgcccggatgcgggccctgagcaagcagcagcccggcgagggcatctggatgatcgaaaccgaggtgccgacgcccggtcccaacgacctgctgattcgaattcgcaaggggagcatctgtggaaccgacgtgcacatctacaagtgggacgactgggcgagccagacggtgccggtgccgatggtcgtcgggcacgaatacgtgggtgtggtcgcgggcatgggctcggaagtgcgcggcttcgaaatcggcgaccgggtgagcggcgagggccacgtcacctgcgggcactgccgcaactgccgcgccgggcgccgccacctgtgccgcaacacgcagggggtgggcgtcaaccgccccggctccttcgccgagtatctggtgctgcccgccttcaatgccttcaagctgcccgacgacattcccgacgatgtcgccgctattttcgaccccttcggcaacgcggtgcacacggcgctgagcttcgacctggtgggcgaggacgtgctgattaccggcgccgggcccatcggctgcatggccgccgccgtcgcccggcacgtgggcgcccgcaacgtggtgattaccgacgtgaatgactaccgtctcgacctcgcgcggcagatgggcgtgacccgcgccgtgaatgtggcccgcgaggacctctggacggtggcgacgcaggaactcgacatgcacgagggcttcgacgtgggcatggaaatgagcggctcggggcctgccttcgcgcagatggtcagcgtgatgaacaacggcggcaaagtcgcgctgctcggcattccctcgggcgaggtgcagatcgattggaacgccgtcatcttcaagatgctcaccatcaagggcatctatggccgcgagatgttcgaaacctggtacaagatggccgccctgattcagtcgggcctggacctcacgccggtcatcacccaccactacggcatcggcgactttcagcagggcttcgacgccatgctcagcgggcagagcggcaaagtgattctggactgggagacggaagagcaaagcgcctga

SEQ ID NO: 32745 - protein, 370 aa, Deinococcus radiodurans R1
MTSPSSTATSSPTTTTAPTPARMRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 32746 - DNA, 1062 bp, Bacillus subtilis subsp. subtilis str. 168
  CDS (1)..(1062): transl_table=11
atgactcacacagtacctcaaaacatgaaagcggctgttatgcacaacacaagagagatcaaaattgaaacattgcctgtgcctgatatcaatcatgatgaagtgttgattaaggtgatggctgtcggaatttgcggatctgatctgcattactatacaaatggccgaataggcaactatgttgtggaaaaaccatttatccttgggcatgaatgtgcgggtgaaattgccgctgtcggatcatctgtcgatcaattcaaggtgggagaccgcgtcgctgtagagccgggtgttacgtgcggacgctgtgaggcgtgcaaagaaggacgctataatctttgcccggatgtacagtttttggctacaccgccggtagacggtgcgtttgtccaatatattaaaatgcgtcaggactttgtttttttaatcccagactcactttcttatgaagaagctgctttgatcgagccgttttctgtcggtatccatgcggcggccagaacgaagctacagcccggatcaacgattgcgattatggggatgggccctgttgggttaatggctgttgccgcagctaaagcatttggggcaggcacaatcattgtcaccgacttagagccgctgcggttagaagctgcgaaaaaaatgggagcgactcacattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaacgtgccgtttattgcggataatgagattgatatttacgggatcttccgttatgccaatacgtatccaaagggaatcgaatttcttgcttcaggcattgtggacacgaagcatctagtaacggaccaatattcgctggagcagacgcaagatgcgatggagcgggcgcttcaatttaagaatgaatgtttaaaagtgatggtgtatccaaatcgctga

SEQ ID NO: 32747 - protein, 353 aa, Bacillus subtilis subsp. subtilis str. 168
MTHTVPQNMKAAVMHNTREIKIETLPVPDINHDEVLIKVMAVGICGSDLHYYTNGRIGNYVVEKPFILGHECAGEIAAVGSSVDQFKVGDRVAVEPGVTCGRCEACKEGRYNLCPDVQFLATPPVDGAFVQYIKMRQDFVFLIPDSLSYEEAALIEPFSVGIHAAARTKLQPGSTIAIMGMGPVGLMAVAAAKAFGAGTIIVTDLEPLRLEAAKKMGATHIINIREQDALEEIKTITNDRGVDVAWETAGNPAALQSALASVRRGGKLAIVGLPSQNEIPLNVPFIADNEIDIYGIFRYANTYPKGIEFLASGIVDTKHLVTDQYSLEQTQDAMERALQFKNECLKVMVYPNR

SEQ ID NO: 32748 - DNA, 1044 bp, Caenorhabditis elegans
  CDS (1)..(1044)
atgtctcaagacaatttatcagcggtactttatggcgtagatgatcttcgtctggagcaagttccaattccaaagcctgggccaaatcaggtgcttgttaaagttcacactgttggaatttgtggaagtgatgttcactattggacgcacggagcaatcgggccatttgtcgtaaaagaaccaatgatcgttggtcatgaaacgtctgggattgtttctgaagttggaaatgaggtgaaacatcttaaagttggtgacagaattgcaatggaaccaggccttccatgcaaactttgtgagcactgcaaaactggaagatacaatttgtgcccggaaatgagattctttgctactccaccagttcatggaaccctatccagatttgtggtgcacgacgctgatttttgcttcaaactcccagataacctttcatttgaagacggggctcttattgaaccactttccgttgcgattcatgcgtgtcgacgtggaaatgttcaaatgggacaccgagttcttgttctcggagccggtcctattggagttttaaacctcattaccgctaaagctgtaggagctggaaaagtagttattactgatttagatgatggcagacttgcgctcgcaaagaaacttggggcagatgcaacaattaacgttaaaggaaagtcattggacgcagttaaatcggagatcattaccgcactgggtgatcagcagccggatgtctgtattgagtgtactggcgcacagccgagtatcgagacagctataacgaccaccaaatcaggtggagtcatagttcttgtcggattgggagcagaccgagttgaaataccaataattgaatcagcaactagagaagttgacatgcgtgggattttcagatatgtaaactgctacccaacagcaatcgaactcatttcatctggaaaactaaatttgtcggggctaacacgtgctcactataaacttgaagaaacacaagaagcattcaaaagaacacagaaggctgatgtcatcaaagtatttattcaatgctga

SEQ ID NO: 32749 - protein, 347 aa, Caenorhabditis elegans
MSQDNLSAVLYGVDDLRLEQVPIPKPGPNQVLVKVHTVGICGSDVHYWTHGAIGPFVVKEPMIVGHETSGIVSEVGNEVKHLKVGDRIAMEPGLPCKLCEHCKTGRYNLCPEMRFFATPPVHGTLSRFVVHDADFCFKLPDNLSFEDGALIEPLSVAIHACRRGNVQMGHRVLVLGAGPIGVLNLITAKAVGAGKVVITDLDDGRLALAKKLGADATINVKGKSLDAVKSEIITALGDQQPDVCIECTGAQPSIETAITTTKSGGVIVLVGLGADRVEIPIIESATREVDMRGIFRYVNCYPTAIELISSGKLNLSGLTRAHYKLEETQEAFKRTQKADVIKVFIQC

SEQ ID NO: 32750 - DNA, 1047 bp, Pseudomonas putida
  CDS (1)..(1047): transl_table=11
atgctcgcgataaggaaaactaaagcagggccaggagggctatctgtcgatgatgtggccgcccctaaagaggcccacagtactgacgtgctggtgaaagttgaagcggccggtatctgtggtactgacttgttgatctataaatggggcgagttcgccaaaagaatgaaactccccactatcttgggtcatgaagttagcggggtgattgaacaggtcggatctgacgttaaaggtctaaggcctgggatgcgcgtcagtctggagagtcatctcccttgtggaacgtgctacacgtgtcgacgcggttgggcgcatgtttgtcctaagacgcggtatccgggggtcgactttgatggaggcttcgcgtctttcgttgtggttccggaaagcgtgtgttggccggtgccgtgcggaattcctccgctccaggcggcaatgatggagccgttcgggcttgcggtgcatgcaagtctggagggttctggggtttcgggattgaatgttcttgtttctggttgcggtccgatcggacttatgaacattgcagccgccaaagcactgggagcaagcaaggtcattgcaccggacattcatcctctgcgcctcactgcagcagccaaaatgggggcggatgaatgcattaatgcaactgaagagagcgtttataagactgtgcgttcgctgctcggtgagaggggagtagatgttgcaattgactattctgggcaagcagcggcgttaaaggagcttattcaatccatcacccatggtggtgagttgcgactgatgggcgtcccgtcacatgatattttgctcaacttagaggagtggcttttcaaaggccttattgtacgtggcctgcatggcaggcgtctgtatgaaagatgggagcgttcaactagcttattggttacagggcgtgttgatttgtcttcgctcgtatcgcatcgattgccactatcggcggcagaggatgcgttcgaaatggccctaaatggtcagtccttgaaaatcctgtttgagcccaatggctcatgtatctaa

SEQ ID NO: 32751 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPKTRYPGVDFDGGFASFVVVPESVCWPVPCGIPPLQAAMMEPFGLAVHASLEGSGVSGLNVLVSGCGPIGLMNIAAAKALGASKVIAPDIHPLRLTAAAKMGADECINATEESVYKTVRSLLGERGVDVAIDYSGQAAALKELIQSITHGGELRLMGVPSHDILLNLEEWLFKGLIVRGLHGRRLYERWERSTSLLVTGRVDLSSLVSHRLPLSAAEDAFEMALNGQSLKILFEPNGSCI

SEQ ID NO: 32752 - DNA, 1053 bp, Thermoanaerobacter tengcongensis MB4
  CDS (1)..(1053): transl_table=11
atgtctattatggatggacttatgaccgccgtggtaaaacaataccacaaagaaggggcagatatagtaaaaaaggaaataccaaagataggccctgatgaagttttgataaaagttaaagctacttctatttgcggcacagacgttcacatatacgtctggaatgaatgggcaaaaagtagaataaaacctccaaaaacgatgggacacgaatttgtaggagaggttgtagaaattggagaaaatgtcacatcagtaaaagtgggagacttagtaagcgcagaaactcatatagtatgcggaaagtgcagagcctgcagaaccggcaacgctcacatatgtgaaaataccctcattttaggcgttgacacagatggagcttttgcagaatacatcaaagttcctgaaagcaatgtgtggataaacgacaaaaacatacctctagagatactatccatacaggaacctcttggaaacgcagtccacactgttttttcaggagacgtagttggaaaatctgtagctgtcataggatgcggcccaataggaatgatggcaataccacttcttaaaagaacaggtgctgcagcaatattcgcgattgaacctgctgactacaggagagagttggctcacaagcttggtgcaacaagggttataaatcctctccgcgaagacgttgtcagcataataaaaagtgaaacagaaggctatggagcagatgtagttttggacttttcaggtaacccaaccgccataaggcagggtctagagtacattgcaaaaggtggcagaatgtctattctaggccttcctgacaatgaagttccaattgacatcacaaataatgtggtattcaaaggaataactatacaaggcataactggaagaagaatgtacgatacctggtacaccgtaaagggcttactaaaatcaggtcttgcagaagatttaaagccaataatcacccacacattccctcttaccgaataccagaagggaatggaactcatgataaaagggcagtgcggtaaagtcgtattatatccgtaa

SEQ ID NO: 32753 - protein, 350 aa, Thermoanaerobacter tengcongensis MB4
MSIMDGLMTAVVKQYHKEGADIVKKEIPKIGPDEVLIKVKATSICGTDVHIYVWNEWAKSRIKPPKTMGHEFVGEVVEIGENVTSVKVGDLVSAETHIVCGKCRACRTGNAHICENTLILGVDTDGAFAEYIKVPESNVWINDKNIPLEILSIQEPLGNAVHTVFSGDVVGKSVAVIGCGPIGMMAIPLLKRTGAAAIFAIEPADYRRELAHKLGATRVINPLREDVVSIIKSETEGYGADVVLDFSGNPTAIRQGLEYIAKGGRMSILGLPDNEVPIDITNNVVFKGITIQGITGRRMYDTWYTVKGLLKSGLAEDLKPIITHTFPLTEYQKGMELMIKGQCGKVVLYP

SEQ ID NO: 32754 - DNA, 1035 bp, Oceanobacillus iheyensis HTE831
  CDS (1)..(1035): transl_table=11
atgaaggcattagtgaaaacagagctagggcatggtaatctacacattcaaaatgttgaagaaccaagcgtatctagtcatcaagtgaaaataaaagtagcttatgcaggtatttgcggttcggatattcatacgtacgaaggtcattataaagtagctgctccggtaactttaggacatgagttttccggtcggattgtagaggttggtgaaggagttaccgattttaaagtcggtgatcgtgttacttcagaaacaactttttctatttgtggagaatgtcgctattgtcaaactggtgattataatttatgcaatcatcgtaaagggttaggtacgcagcaaaatggtggatttacgaattacttgattgctagagaagaaagtcttcaccatttgcccgacgaagtggatgatcgttctgcatccatgacagaaccattagcatgtacgtatcatgctattcaaaaaataaatattaagccaggagatttagtcgttgtgcttggaccaggtccaattggtttgttagcagctcaggttgctaaaagctatggagctaccgtcatgatgtccggactcgataatgacaaaattcgtctggataaagcgaaagaagttggcattgactacgttatcaacattcaagaagaagatataaaggaaaaaattgcagctttaacggatggttatggagtggatgtagtattagaatgttctggttcgattcatgctgctaatcaaggtctcgacttactacggaaaaaaggaagctacgcacaagtaggaatttttccagactcacatgtgaagtttgatatggaaaaagtcattcaaaaagaaatacatgttgtaggaagtagaagtcaaaaatcagcagattgggaaccatcacttcagttaatgaaagaaaagaaagtagatgcaaaagccttagtaacgcatgaattcactattgatcagtgggatgaagcataccaagcgataaaagacggagaggcaataaaagtactattaaaaccattacaagattaa

SEQ ID NO: 32755 - protein, 344 aa, Oceanobacillus iheyensis HTE831
MKALVKTELGHGNLHIQNVEEPSVSSHQVKIKVAYAGICGSDIHTYEGHYKVAAPVTLGHEFSGRIVEVGEGVTDFKVGDRVTSETTFSICGECRYCQTGDYNLCNHRKGLGTQQNGGFTNYLIAREESLHHLPDEVDDRSASMTEPLACTYHAIQKINIKPGDLVVVLGPGPIGLLAAQVAKSYGATVMMSGLDNDKIRLDKAKEVGIDYVINIQEEDIKEKIAALTDGYGVDVVLECSGSIHAANQGLDLLRKKGSYAQVGIFPDSHVKFDMEKVIQKEIHVVGSRSQKSADWEPSLQLMKEKKVDAKALVTHEFTIDQWDEAYQAIKDGEAIKVLLKPLQD

SEQ ID NO: 32756 - DNA, 1056 bp, Oceanobacillus iheyensis HTE831
  CDS (1)..(1056): transl_table=11
atgaaggcagcagtttggtatggtaaacacgatattcgtgtagagaataaggaagaacctataattaaacctggaaaggttaaaataaaagtagcatggacaggcatttgtggaagtgacctgcatgcttatcacggcgctgagggagtcgttcaagttggcgaacctcatcctgtaactggtgaaatggcaccattgacgcttgggcatgagttttctggtgtaattcatgaaattggtgaaggtgtaagcggtttatctgttggagatcgtgtagcgattgagccggctattaagtgtggcaagtgtgagaattgtgtacgaggaaactacaacttgtgtgaacacaatggctttgttggcttacaatctgacggtgcttttgctgagtatgcaattgttgatccacatatggttcacaagcttccagataatatatcgtttgaagaagctacagcaattgagcctacagctgtgtctttccacgcgcttaaattaagcaatatgaaagcaggcgatacggtagcggtctttggtgttggcccaattggtcttacggcgattctatgtgcgaaggcagctggtgcgtctcgtatttatgcgattgatgtttccaatgagcgtcttgagatggctcaaaagcttggcgcaactacggttattaatgcgatagaagagaatgcggcagaaaagatatatgctgaaacaggaagtggcgttactatcgcatttgattgtgcaggagctgaagcgactgtgaacagtgcaattgattcacttgctaaaggcggacaacttgtcattgtgtccattattccagaaccgatcaaagtaaatcttttgcaggcgaacttaaaagaaataaacattcttgcaactatcggttacagagatgtgtataaagacgttattgctatggtggaatcaggacagctggatcttaaaccgatcatcactaaaaaaatcggtttggatgatattatcgaagaaggcttccacgcccttacaaatgataagagccaagcaaaaattcttgtgagcccaacaggggtttaa

SEQ ID NO: 32757 - protein, 351 aa, Oceanobacillus iheyensis HTE831
MKAAVWYGKHDIRVENKEEPIIKPGKVKIKVAWTGICGSDLHAYHGAEGVVQVGEPHPVTGEMAPLTLGHEFSGVIHEIGEGVSGLSVGDRVAIEPAIKCGKCENCVRGNYNLCEHNGFVGLQSDGAFAEYAIVDPHMVHKLPDNISFEEATAIEPTAVSFHALKLSNMKAGDTVAVFGVGPIGLTAILCAKAAGASRIYAIDVSNERLEMAQKLGATTVINAIEENAAEKIYAETGSGVTIAFDCAGAEATVNSAIDSLAKGGQLVIVSIIPEPIKVNLLQANLKEINILATIGYRDVYKDVIAMVESGQLDLKPIITKKIGLDDIIEEGFHALTNDKSQAKILVSPTGV

SEQ ID NO: 32758 - DNA, 1041 bp, Rhodopirellula baltica SH 1
  CDS (1)..(1041): transl_table=11
atgaaggcattgttgctgaccgaatacaaaaacatgcaggtgacggatgtggatgagcccgaggtgggcccagatgacgttttggtccaagtcgaagcgtgtgggatctgcggcagtgacattcatggatacgatggcagcaccgggcgtcgtatcccgcctttggtgatggggcacgaggctgccggggtggtggttcaggtcggcgaaaacgtccgcgatttggaactcggagcccgcgtcacgtttgattcgatggtgtcctgcggaaactgtgagttttgtcgcgaagggcacgggaacctttgtgacaaccgaatggttctcggcgtttcctgtggtgattaccgacgtcatggtgcgttcgcggaacgcatctcggttccgcgtcggatagtctatcgattacccgacactttgcccttcgaacacgcagctttggtcgaagcggtcagcgtcgcggtccatgcagcggaagtcactccgatcaagctaggtgataccgccgttgtggttggtgctggcatgatcggattgttggctgtgcaagccgtgcgagcagcgggtgcgacgcaggtcatcgcggtggatctaaacgacaaacgcctggaaacagccggaacgttgggagccgacgtgttgttgcgagccgatcaagtggacgtgccggaaaaggttcgcgaactgaccggtggccgcggggcagacgtggcattggaagtcgtcggtgcgacgccgacggtcaaaacagcgattgaatccgttcgcaagggtggagcggtcacgttggtcggcaacgtctcgccgacgatcgaattgcctttgcagtcagtcgttacgcgagaaattcgattgcagggcacatgtggttgcaacggtgaatacccacagtgcatcgatttgatgaatcgcggcgtcatcaacgttgaacctttgatcacggccaaaatttctttggcggacggtcccaaatggtttgaccgcctgcacgccggtgatgcggagcaaatgaaggtgttggtttgtcctcgttcggagtga

SEQ ID NO: 32759 - protein, 346 aa, Rhodopirellula baltica SH 1
MKALLLTEYKNMQVTDVDEPEVGPDDVLVQVEACGICGSDIHGYDGSTGRRIPPLVMGHEAAGVVVQVGENVRDLELGARVTFDSMVSCGNCEFCREGHGNLCDNRMVLGVSCGDYRRHGAFAERISVPRRIVYRLPDTLPFEHAALVEAVSVAVHAAEVTPIKLGDTAVVVGAGMIGLLAVQAVRAAGATQVIAVDLNDKRLETAGTLGADVLLRADQVDVPEKVRELTGGRGADVALEVVGATPTVKTAIESVRKGGAVTLVGNVSPTIELPLQSVVTREIRLQGTCGCNGEYPQCIDLMNRGVINVEPLITAKISLADGPKWFDRLHAGDAEQMKVLVCPRSE

SEQ ID NO: 32760 - DNA, 1029 bp, Legionella pneumophila subsp. pneumophila str. Philadelphia 1
  CDS (1)..(1029): transl_table=11
atgacaatgaaatcattggttaaagcaaaaaaagagcctggaatttggatgcaggatattcctgttcctgaatatggagtaaacgatgttttaataaaaattaaaaggactgcaatttgtggtacagatatccatatttattcctgggatgaatgggcgcaagccacaattcctgttcctatgaccgtagggcatgaattttatggtgaaatagtagaggttggaaaagaagtacaaggtttgaaagttggacagagagtttctggtgaaggtcatattacctgtggtttttgcagaaattgtcgtgccggcaagcgtcatttatgtcgtaataccctgggagtgggggtgaatcgaccaggatgctttgctgagtatctggcgcttcctgctaccaatgtcatcgctctccctgacaacattacagaagagcaagcggctattctcgatccttttggaaatgctgctcattgtgcattggcatttgatgtagtaggcgaagacgttttgattactggtgcaggccccataggaataatggccgcagccatcgtaagacatattggcgcacggcatgttgttatcaccgatgttaacgatcatcgattggaactggccaggcaaatgggtgtcagccgagcggttaatgtcaaataccaaaaattaagtgatgtggctaatgagctaggaatgcttgagggttttgatgttggtctggaaatgtccgggaaccctatggcattaaacgatatgatgaaagcgatgaatcatggtggtcatgtggctttattgggtatcccaccacaagaaacccctatagattggaaccaggttatctttaaaggattggttattaagggtatttatggtcgagaaatgtttgaaacctggtataagatgattgctatgttacagagcggtttaaatatttctcccgttattactcataatttcccagtagatgaatatcagcacgcatttcaaattatggcatcgggccagtcagggaaagttatactgaactggtag

SEQ ID NO: 32761 - protein, 342 aa, Legionella pneumophila subsp. pneumophila str. Philadelphia 1
MTMKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 32762 - DNA, 984 bp, Photobacterium profundum SS9
  CDS (1)..(984): transl_table=11
atgaatgaagtagacaagcctgaaatgggccataatgatctacttattcgtattaagaaaaccgctatttgtggtacagatgtacatatctacaactgggatgaatggtcacaaaagacgattccagttccaatggttgtaggtcatgaatatgttggcgaagttgttggtattggccaagaagttcgtggttttacaatcggtgatcgtgtgtctggtgaaggtcatattacatgtggtcattgccgtaattgtcgtggtggtcgtacacacctttgtcgtaatacgacaggcgttggtgttaaccgtgatggcgcatttgctgagtttttggttattcctgcattcaatgcgttcaagatccctgcaggtatctctgacgatctagcatcaatcttcgacccgtttggcaatgctgttcatactgcattatcattcgatcttgttggtgaagatgtgctaattacaggtgctggtcctattggtattatggctgctgctgtcgctaaacacgttggtgcacgccatgttgtgattaccgatgtgaacgaataccgtctagatcttgctcgtaaaatgggcgtgactcgcgctgttaacgtagcaaacgaaaaacttgaagatgtaatgtctgaacttggcatgacagaaggttttgacgttggtttagaaatgtctggcgtaccatcagcatttaacggcatgctagctagcatgaaccacggtggtaaagtggcgttgttgggtattccaccatcagacatggcagtagattggacccaagttatctttaaaggtttggttattaaaggtatctacggccgtgaaatgtttgaaacttggtacaagatggcaagcttgattcaatcaggcttagatctaacaccaattatcacgcaccattacaaaattgatgatttccaaaaaggctttgacatgatgcgttcaggcatgtcaggtaaagttattctcgattgggaataa

SEQ ID NO: 32763 - protein, 327 aa, Photobacterium profundum SS9
MNEVDKPEMGHNDLLIRIKKTAICGTDVHIYNWDEWSQKTIPVPMVVGHEYVGEVVGIGQEVRGFTIGDRVSGEGHITCGHCRNCRGGRTHLCRNTTGVGVNRDGAFAEFLVIPAFNAFKIPAGISDDLASIFDPFGNAVHTALSFDLVGEDVLITGAGPIGIMAAAVAKHVGARHVVITDVNEYRLDLARKMGVTRAVNVANEKLEDVMSELGMTEGFDVGLEMSGVPSAFNGMLASMNHGGKVALLGIPPSDMAVDWTQVIFKGLVIKGIYGREMFETWYKMASLIQSGLDLTPIITHHYKIDDFQKGFDMMRSGMSGKVILDWE

SEQ ID NO: 32764 - DNA, 1044 bp, Silicibacter pomeroyi DSS-3
  CDS (1)..(1044): transl_table=11
atgcgatccaacacgatgaaagcgctggagaaatccaagcctgaggaagggttgtggatggtgcaggcaccggtgcccgagatcggccctgacgatgtgctgatcaagatcaagaagaccggcatttgcggcaccgatatccatatctggaactgggacgaatgggccgcgcacacggtgccggtgccgatgatcaccggccatgaatttgcgggcgagatcgtcgagctgggccgtgatgtcaccggcctcagcatcggtcagcgggtctcgggcgaggggcatctgatcggcaccgaaagccggcagagccgggcaggcaagttccacctggacccgggcacgcgcgggatcggtgtcaacgtgcagggggcctttgcgcaatatctgcgactgcccgccttcaacgtggtgccgctgcccgaggatatcccggacgagatcggcgccatcctcgacccgctgggcaatgcggtgcacaccgcgctgagtttcgacctcttgggcgaggatgtgctgatcaccggtgccgggccgatcggcatcatggcggcggcggtggccaaacatgccggcgcccgccatgtggtgatcaccgatatcaacgccgaccggctgaaactggcgcagcacgtggtgcccagggcgcggaccgtcgatgtcacgcgcgaggatctgggcgacgtggtccacgagcttggcctgaaacaggggttcgatgtcgggctggaaatgtcgggctcgcaagcggcgctcgaccagatggtcgaggcgctggtgatgggcggcaagatcgcgttgctgggtattccgccgggcaagtcgccggtggactggtcgcgcatcgtgttcaaggcgatcaccatcaagggtgtctatggccgcgagatgttcgagacctggtacaagatgatcgccatgttgcagaacgggctggatgtgagccgggtgatcacccatcgttttggcgtcgatgagttccgcgaagggtttgcggcgatgaaatcgggcctcagcggcaaggtggtgctggactggacctga

SEQ ID NO: 32765 - protein, 347 aa, Silicibacter pomeroyi DSS-3
MRSNTMKALEKSKPEEGLWMVQAPVPEIGPDDVLIKIKKTGICGTDIHIWNWDEWAAHTVPVPMITGHEFAGEIVELGRDVTGLSIGQRVSGEGHLIGTESRQSRAGKFHLDPGTRGIGVNVQGAFAQYLRLPAFNVVPLPEDIPDEIGAILDPLGNAVHTALSFDLLGEDVLITGAGPIGIMAAAVAKHAGARHVVITDINADRLKLAQHVVPRARTVDVTREDLGDVVHELGLKQGFDVGLEMSGSQAALDQMVEALVMGGKIALLGIPPGKSPVDWSRIVFKAITIKGVYGREMFETWYKMIAMLQNGLDVSRVITHRFGVDEFREGFAAMKSGLSGKVVLDWT

SEQ ID NO: 32766 - DNA, 1074 bp, Staphylococcus haemolyticus JCSC1435
  CDS (1)..(1074): transl_table=11
atgagtgaaactattccggagaaaatgaacgttgcattaatgcatgaaccttatgatattgaaattgtcgaaagagatatgccaaaagtaggacctaaagatgtcttaatcaagatgatggcagtaggtgtttgtggttctgacgttcactattatgcacatggtcgtgttggtgaattcgtagtcgaaaaaccaatcgtattaggacatgaatgtgctggtatggtagcacaagttggggatgaagtaacagactttaaagtaggagatcgtgttgctatcgaaccaggtgaaccttgccgtgaatgtgaatattgtaaatctggacaatataatttatgtccacatatggaatttatggcgacaccaccatacgatggtgcgttctgtgaatacgtaagccatccggcagacttcctttatcatttaccagactcagtgacttatgaacaagcaacccttgttgaaccattctcagtaggtttacaagcatgtaagcgtgcggatattaaaccaggatcaactgttgtgattatgggtatgggtccagttggtttaatggcagttgtagctgctaaagcttatggcgcaacaaacattatcgtttcagacttagaagataatcgtttagaagcggctaaacgtttaggggcaacaacagcaataaatattaaaaatgaagacgtcgttgaacgcattaaagaattaacagacggtcaaggtgttaactatgcaatcgaaacagcaggtaacccgatcgccttaagaagcgcattaaattcattaaaagatggcggtactttagctattgttggtttacctcaagaagatatgaacgaaatcaatgtgccatttattgcgaaccatgaaattaatattgtgggtgtcttcagatacgcgaatacgtacccacaaggcattcaaattttaagtacaacagatgctgatatcgactcattattcacacatcaattcgaactaaatgatacgaaagaagccatggaattaacacgtacaagtaaaggtgatgccttgaaagtaatggtgtacccaaacggtttcttagataaataa

SEQ ID NO: 32767 - protein, 357 aa, Staphylococcus haemolyticus JCSC1435
MSETIPEKMNVALMHEPYDIEIVERDMPKVGPKDVLIKMMAVGVCGSDVHYYAHGRVGEFVVEKPIVLGHECAGMVAQVGDEVTDFKVGDRVAIEPGEPCRECEYCKSGQYNLCPHMEFMATPPYDGAFCEYVSHPADFLYHLPDSVTYEQATLVEPFSVGLQACKRADIKPGSTVVIMGMGPVGLMAVVAAKAYGATNIIVSDLEDNRLEAAKRLGATTAINIKNEDVVERIKELTDGQGVNYAIETAGNPIALRSALNSLKDGGTLAIVGLPQEDMNEINVPFIANHEINIVGVFRYANTYPQGIQILSTTDADIDSLFTHQFELNDTKEAMELTRTSKGDALKVMVYPNGFLDK

SEQ ID NO: 32768 - DNA, 1026 bp, Colwellia psychrerythraea 34H
  CDS (1)..(1026): transl_table=11
atgaaatctttagctaaattaaaagcagaaccgggcatttggttaacgcgaaccgaaaaaccaaaactaggtcataatgatctgctaatcaaaattaaaaaaacggccatttgtggtacagatatccacatttataattgggatgaatgggcacaaaaaacagtgcctacgcctatggttgttggacatgagtacgcaggtgaagtggttggtatcggccaagaagttaaaggctttactttaggtgaccgggtttctggtgaaggccatattacttgtggtcattgccgtaattgtcgtggtggcagaactcatttatgtcgtaataccgttggtgttggggtcaatcgtgcggggtcatttgcagagtatctagtgatacctgcatacaatgcctttaaattacctgacgaaatttctgatgatttagcgtcaatttttgacccctttggtaatgcagttcataccgcattgtcatttgatttagtgggtgaggatgtattaatcaccggtgctggccctattggtattatggctgcagccgttgctaaacatgtaggtgctcgtcatgtcgttattaccgatattaacgaatatcgtcttgaccttgcaagaaaaatgggcgctactcgtgctgttgatgtgagtaaagaaagcttaaaagatgtcatgaccgatttggggatgaccgagggttttgatgttggtatggaaatgtcaggtgttccaatggcattcactagcatgttagaaagcatgaataatggtggtaaaattgccatgctgggtattcctggtagcgatatggctattgattggagccaagttatttttaaagggcttaccattaaaggtatttatggtcgtgaaatgttcgaaacttggtataagatggcaagtttgattcaatctggtttagatctcaccccgattattacccatcactacaatatcgatgactttcagcaaggctttgatatgatgcgttctggtcaatctggcaaggtcattttagattggacttaa

SEQ ID NO: 32769 - protein, 341 aa, Colwellia psychrerythraea 34H
MKSLAKLKAEPGIWLTRTEKPKLGHNDLLIKIKKTAICGTDIHIYNWDEWAQKTVPTPMVVGHEYAGEVVGIGQEVKGFTLGDRVSGEGHITCGHCRNCRGGRTHLCRNTVGVGVNRAGSFAEYLVIPAYNAFKLPDEISDDLASIFDPFGNAVHTALSFDLVGEDVLITGAGPIGIMAAAVAKHVGARHVVITDINEYRLDLARKMGATRAVDVSKESLKDVMTDLGMTEGFDVGMEMSGVPMAFTSMLESMNNGGKIAMLGIPGSDMAIDWSQVIFKGLTIKGIYGREMFETWYKMASLIQSGLDLTPIITHHYNIDDFQQGFDMMRSGQSGKVILDWT

SEQ ID NO: 32770 - DNA, 1071 bp, Staphylococcus saprophyticus subsp. saprophyticus ATCC 15305
  CDS (1)..(1071): transl_table=11
atggaaaaaaatataccagaaacaatgaatatctcattattaaataagccatttgatatggaaatgaaagaagttaaagtgccgaagataggcgcaacagatgtcttggtaaaagtgatggctgtaggggtatgtggctcagacgtacattattatgagcacggacgtgtaggtgaatttgtagttgaaaaacctctcattctaggacatgagtgttcaggtgtagtgaccgatgtaggtagtaatgtaacaagatttaaagtcggggatagagtagcgattgaacctggtgtgccttgtggtgaatgcgagtattgtaaatcaggaaaatacaatctatgtccggatgtagaatttcttgcaacaccgccagttgacggtgcatttagtcaatatatcagccatcctgagggctttttattccatataccagaagcattatcatacgaagaggcaacccttaatgaaccattttctgtaggtgtgcaagcttgtaaaagagccaatgttcaaccaggctcaacagtggttattatgggaatgggaccagtagggctcatggcagttgtggcagccaaggcatttggtgctacaaaaattattgtatctgatcttgaaaaaatacgtctagacgaagcattaaaattaggtgcaacacatgcaattaatattaaagaagaaggtgtggctacacgaattaatgaaattacaaaaggtaaaggtgttaattatgcatttgagacagcgggtaacccaattgctctacaaaatgctttagctgctttaaacaatggtggtacattagctattgttggtttacctcaacaagaaaatattgagttaaacattccttttatagcaaatcatgaaatcaatattgtaggtatttttagatacgcaaatacgtatgatatgggtctagaaatgttggcgtccacatcagcagatttaaacacgatgttcacggatgcttatgatttaaatgaggcaaaagaagcgatggaacaggcgagaacgaataagagtggatcattaaaagtaatggtttatcctaatggtaaacctgaataa

SEQ ID NO: 32771 - protein, 356 aa, Staphylococcus saprophyticus subsp. saprophyticus ATCC 15305
MEKNIPETMNISLLNKPFDMEMKEVKVPKIGATDVLVKVMAVGVCGSDVHYYEHGRVGEFVVEKPLILGHECSGVVTDVGSNVTRFKVGDRVAIEPGVPCGECEYCKSGKYNLCPDVEFLATPPVDGAFSQYISHPEGFLFHIPEALSYEEATLNEPFSVGVQACKRANVQPGSTVVIMGMGPVGLMAVVAAKAFGATKIIVSDLEKIRLDEALKLGATHAINIKEEGVATRINEITKGKGVNYAFETAGNPIALQNALAALNNGGTLAIVGLPQQENIELNIPFIANHEINIVGIFRYANTYDMGLEMLASTSADLNTMFTDAYDLNEAKEAMEQARTNKSGSLKVMVYPNGKPE

SEQ ID NO: 32772 - DNA, 1029 bp, Burkholderia vietnamiensis G4
  CDS (1)..(1029): transl_table=11
atgaaagcactggcaaagctcgaacgcgctccgggtctcacgttgacgcgcgtgaagcgtcccgaggtcggacacaacgacgtgctgatcaagatccgccgcacggcgatctgcggcaccgacatccatatctggaagtgggacgactgggcgcagaagacgatccccgtgccgatgcatgtcggccacgaatacgtcggcgagatcgtcgagatggggcaggaagtgcgcggcttcgcgatcggtgaccgcgtgtccggcgaagggcacatcacctgcggtttctgccgtaactgtcgtgcggggcgtcggcatctgtgccgcaataccgtcggcgtcggcgtgaaccgcgagggcgcgttcgccgaatatctggcgattcccgcattcaacgcgttcaagattccgccggagatctccgacgatctcgcgtcgatcttcgatccgttcggcaacgcgacgcatacggcgctgtcgttcaacctcgtcggcgaggacgtgttgatcaccggcgcggggccgatcggcatcatggccgtggcaatcgccaagcatgtcggcgcgcgcaatgtcgtgatcaccgacatcaacgactatcggctggagcttgcgcgcaagatgggcgcgacgcgtgctgtcaacgtcgcgcgcgagtcgctgcgcgacgtgatggccgagctgcgcatgactgaaggcttcgatgtcgggctcgagatgtcgggcgtgccgagcgcattcacgagcctgctcgaagcgatgaatcacggcggcaaggtcgcgctgctcggcattccgcccgcgcagacggcaatcgactggaatcaggtgatcttcaaggggctcgagatcaagggcatctacggccgcgaaatgttcgagacctggtacaagatggtcgcgatgctccagagtgggctcgacctgtcgccgatcgtcacgcatcgctttgccgtcgacgattacgagaaaggcttcgccgcgatgctgtccggtgaaagcggcaaggtgattctcgactggaccgcgtga

SEQ ID NO: 32773 - protein, 342 aa, Burkholderia vietnamiensis G4
MKALAKLERAPGLTLTRVKRPEVGHNDVLIKIRRTAICGTDIHIWKWDDWAQKTIPVPMHVGHEYVGEIVEMGQEVRGFAIGDRVSGEGHITCGFCRNCRAGRRHLCRNTVGVGVNREGAFAEYLAIPAFNAFKIPPEISDDLASIFDPFGNATHTALSFNLVGEDVLITGAGPIGIMAVAIAKHVGARNVVITDINDYRLELARKMGATRAVNVARESLRDVMAELRMTEGFDVGLEMSGVPSAFTSLLEAMNHGGKVALLGIPPAQTAIDWNQVIFKGLEIKGIYGREMFETWYKMVAMLQSGLDLSPIVTHRFAVDDYEKGFAAMLSGESGKVILDWTA

SEQ ID NO: 32774 - DNA, 1026 bp, Shewanella amazonensis SB2B
  CDS (1)..(1026): transl_table=11
atgaaagcacttgctaaactcaagcctgaagaaggcatttggatggttgatgcccccaagccggaaatgggccataacgatctgctgattaagatccgtaaaaccgccatttgtggcaccgacgtgcatatctacaactgggacgagtggtcgcaaaaaaccattcccgtgcctatggtagtaggtcacgaatatgtcggcgaagtggtgggaattggccaggaagtccgcggcttcaagattggcgaccgcgtatccggtgaaggccatatcacctgtggccattgccgtaactgccgcgccggccgcactcatctgtgccgcaataccacgggcgtgggtgtaaaccgtgaaggctcattcgccgagtatctggtgatcccagcctttaacgcgttcaaaatccccgatgatatcagtgacgatctggctgccatttttgacccattcggtaatgccgttcacacggcgctgtcattcgacctggtaggggaagacgtgcttatcacaggcgccggccccatcggtatcatggctgctgccgtgtgccgtcacgtgggcgcccgccatgtggtgatcaccgacgtgaacgaatatcgtctggaactggctcgaaagatgggtgctacccgtgcggtgaacgtggccaaggaaaacctcaaagacgtgatgaaagacctcggcatgaccgaaggcttcgacgttggcctggaaatgtccggcgtacctgccgccttccatgccatgctggataccatgaaccacggcggcaaaatcgccatgctgggtattcccggcggcgaaatggccatcgactggagcaaggtgatcttcaagggactcatcatcaagggcatctacggccgtgaaatgtttgagacctggtacaagatggccagcctgctgcaatcgggcctggacttgtcccccattgttacccaccacttcaaggtggacgacttccagcaaggcttcgacgccatgcgttccggtcagtccggtaaagtcatcctcagctgggattaa

SEQ ID NO: 32775 - protein, 341 aa, Shewanella amazonensis SB2B
MKALAKLKPEEGIWMVDAPKPEMGHNDLLIKIRKTAICGTDVHIYNWDEWSQKTIPVPMVVGHEYVGEVVGIGQEVRGFKIGDRVSGEGHITCGHCRNCRAGRTHLCRNTTGVGVNREGSFAEYLVIPAFNAFKIPDDISDDLAAIFDPFGNAVHTALSFDLVGEDVLITGAGPIGIMAAAVCRHVGARHVVITDVNEYRLELARKMGATRAVNVAKENLKDVMKDLGMTEGFDVGLEMSGVPAAFHAMLDTMNHGGKIAMLGIPGGEMAIDWSKVIFKGLIIKGIYGREMFETWYKMASLLQSGLDLSPIVTHHFKVDDFQQGFDAMRSGQSGKVILSWD

SEQ ID NO: 32776 - DNA, 1047 bp, Pseudomonas putida
  CDS (1)..(1047): transl_table=11
atgctcgcgataaggaaaactaaagcagggccaggagggctatctgtcgatgatgtggccgcccctaaagaggcccacagtactgacgtgctggtgaaagttgaagcggccggtatctgtggtactgacttgttgatctataaatggggcgagttcgccaaaagaatgaaactccccactatcttgggtcatgaagttagcggggtgattgaacaggtcggatctgacgttaaaggtctaaggcctgggatgcgcgtcagtctggagagtcatctcccttgtggaacgtgctacacgtgtcgacgcggttgggcgcatgtttgtcctaatacgcggtatccgggggtcgactttgatggaggcttcgcgtctttcgtcgtggttccggagagcgtgtgttggccggtgccgtgcggaattcctccgctccaggcggcaatgatggagccgttcgggcttgcggtgcatgcaagtctggaaggttctggggtttcgggattgaatgttcttgtttctggttgcggtccgatcggacttatgaacattgcagccgccaaagcactgggagcaagcaaggtcattgcaactgacattcatcctctgcgcctcactgcagcagccaaaatgggggcggatgaatgcattaatgcaactgaagagagcgtttataagactgtgcgttcgctgctcggtgagaggggagtagatgttgcaattgactattccgggcaagcagcggcgttaaaggagcttattcaatccatcacccatggtggtgagttgcgactgatgggcgtcccgtcacatgatattttgctcaacctagaggagtggctttttaaaggccttattgtacgtggcctgcatggcaggcgtctgtttgaaacatgggagcgttcaactagcttactggttacagggcgtgttgatttgtcttcgctcgtatcgcatcgattgccactatcggcggcagaggatgcgttcgaaatggccttaaatggtcagtccttgaaaatcctgtttgagcccaatggcacatgtatctaa

SEQ ID NO: 32777 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPNTRYPGVDFDGGFASFVVVPESVCWPVPCGIPPLQAAMMEPFGLAVHASLEGSGVSGLNVLVSGCGPIGLMNIAAAKALGASKVIATDIHPLRLTAAAKMGADECINATEESVYKTVRSLLGERGVDVAIDYSGQAAALKELIQSITHGGELRLMGVPSHDILLNLEEWLFKGLIVRGLHGRRLFETWERSTSLLVTGRVDLSSLVSHRLPLSAAEDAFEMALNGQSLKILFEPNGTCI

SEQ ID NO: 32778 - DNA, 1047 bp, Pseudomonas sp
  CDS (1)..(1047): transl_table=11
atgctcgcgataaggaaaactaaagcagggccaggagggctatctgtcgatgatgtggccgcccctaaagaggcccacagtactgacgtgctggtgaaagttgaagcggccggtatctgtggtactgacttgttgatctataaatggggcgagttcgccaaaagaatgaaactccccactatcttgggtcatgaagttagcggggtgattgaacaggtcggatctgacgttaaaggtctaaggcctgggatgcgcgtcagtctggagagtcatctcccttgtggaacgtgctacacgtgtcgacgcggttgggcgcatgtttgtcctaagacgcggtatccgggggtcgactttgatggaggcttcgcgtctttcgttgtggttccggaaagcgtgtgttggccggtgccgtgcggaattcctccgctccaggcggcaatgatggagccgttcgggcttgcggtgcatgcaagtctggagggttctggggtttcgggattgaatgttcttgtttctggttgcggtccgatcggacttatgaacattgcagccgccaaagcactgggagcaagcaaggtcattgcaacggacattcatcctctgcgcctcactgcagcagccaaaatgggggcggatgaatgcattaatgcagctgaagagagcgtttataagactgtgcgttcgctgctcggtgagaggggagtagatgttgcaattgactattctgggcaagcagcggcgttaaaggagcttattcaatccatcacccatggtggtgagttgcgactgatgggcgtcccgtcacatgatattttgctcaacttagaggagtggcttttcaaaggccttattgtacgtggcctgcatggcaggcgcctgtatgaaacatgggagcgttcaactagcttattggttacagggcgtgttgatttgtcttcgctcgtatcgcatcgattgccactatcggcggcagaggatgcgttcgaaatggccctaaatggtcagtccttgaaaatcctgtttgagcccaatggctcatgtatctaa

SEQ ID NO: 32779 - protein, 348 aa, Pseudomonas sp
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPKTRYPGVDFDGGFASFVVVPESVCWPVPCGIPPLQAAMMEPFGLAVHASLEGSGVSGLNVLVSGCGPIGLMNIAAAKALGASKVIATDIHPLRLTAAAKMGADECINAAEESVYKTVRSLLGERGVDVAIDYSGQAAALKELIQSITHGGELRLMGVPSHDILLNLEEWLFKGLIVRGLHGRRLYETWERSTSLLVTGRVDLSSLVSHRLPLSAAEDAFEMALNGQSLKILFEPNGSCI

SEQ ID NO: 32780 - DNA, 1047 bp, Pseudomonas putida
  CDS (1)..(1047): transl_table=11
atgctcgcgataaggaaaactaaagcagggccaggagggctatctgtcgatgatgtggccgcccctaaagaggcccacagtactgacgtgctggtgaaagttgaagcggccggtatctgtggtactgacttgttgatctataaatggggcgagttcgccaaaagaatgaaactccccactatcttgggtcatgaagttagcggggtgattgaacaggtcggatctgacgttaaaggtctaaggcctgggatgcgcgtcagtctggagagtcatctcccttgtggaacgtgctacacgtgtcgacgcggttgggcgcatgtttgtcctaatacgcggtatccgggggtcgactttgatggaggcttcgcgtctttcgtcgtggttccggagagcgtgtgttggccggtgccgtgcggaattcctccgctccaggcggcaatgatggagccgttcgggcttgcggtgcatgcaagtctggaaggttctggggtttcgggattgaatgttcttgtttctggttgcggtccgatcggacttatgaacattgcagccgccaaagcactgggagcaagcaaggtcattgcaactgacattcatcctctgcgcctcactgcagcagccaaaatgggggcggatgaatgcattaatgcaactgaagagagcgtttataagactgtgcgttcgctgctcggtgagaggggagtagatgttgcaattgactattccgggcaagcagcggcgttaaaggagcttattcaatccatcacccatggtggtgagttgcgactgatgggcgtcccgtcacatgatattttgctcaacctagaggagtggctttttaaaggccttattgtacgtggcctgcatggcaggcgtctgtttgaaacatgggagcgttcaactagcttactggttacagggcgtgttgatttgtcttcgctcgtatcgcatcgattgccactatcggcggcagaggatgcgttcgaaatggccttaaatggtgagtccttgaaaatcctgtttgagcccaatggcacatgtatctaa

SEQ ID NO: 32781 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPNTRYPGVDFDGGFASFVVVPESVCWPVPCGIPPLQAAMMEPFGLAVHASLEGSGVSGLNVLVSGCGPIGLMNIAAAKALGASKVIATDIHPLRLTAAAKMGADECINATEESVYKTVRSLLGERGVDVAIDYSGQAAALKELIQSITHGGELRLMGVPSHDILLNLEEWLFKGLIVRGLHGRRLFETWERSTSLLVTGRVDLSSLVSHRLPLSAAEDAFEMALNGESLKILFEPNGTCI

SEQ ID NO: 32782 - DNA, 1077 bp, Aspergillus niger
  CDS (1)..(1077)
atgagcacccagaacaccaacgctcagaatctttccttcgtcctcgagggaattcaccgcgtcaaattcgaagaccggccaatcccagagatcaacaatcctcacgacgtactggtgaatgtcaggttcacaggtatatgtggtagtgatgttcattattgggaacatggctccattggccaattcattgtcaaggatcccatggtcctgggacatgaatcttccggtgttgtcagcaaggttggctctgccgttaccagtctaaaggtaggagactgcgttgcaatggaaccaggaatcccatgtcgccgctgcgaaccatgcaaggcggggaaatataatctctgcgtgaaaatggctttcgcagcgacacctccatatgatggtaccttggccaagtattacgtcctgcccgaggacttttgctataagcttcctgaaagcatcaccctacaggagggtgcgatcatggagccccttagtgtcgccgtccatatcgttaaacaggctgggatcaacccgggtcaatcagtggtagtctttggtgctggccccgtcggacttctctgctgtgctgtggcgaaggcttacggtgcgtccaaggttatcgcggttgacattcaaaagggtaggctagactttgcgaagaagtatgcagcaactgccacgtttgagccagctaaagccgcagcgttggagaacgctcaacggataataaccgagaatgatctaggctcgggtgcagatgttgccattgacgcttcaggagcagagccctcggttcatacaggcattcacgttctgcgtgctgggggaacatatgtccagggcggtatgggtagaagcgaaatcacctttccaataatggcggcttgcaccaaagaactgaacgtcaagggcagcttccgttatgggagtggtgactataagcttgcagtctccttagtaagcgctggaaaggtgaacgtgaaggaattgatcacgggtgtcgtcaagttcgaggacgccgagcgagcattcgaagaagttagagctggaaagggcatcaaaacgcttattgctggtgtcgattcatag

SEQ ID NO: 32783 - protein, 358 aa, Aspergillus niger
MSTQNTNAQNLSFVLEGIHRVKFEDRPIPEINNPHDVLVNVRFTGICGSDVHYWEHGSIGQFIVKDPMVLGHESSGVVSKVGSAVTSLKVGDCVAMEPGIPCRRCEPCKAGKYNLCVKMAFAATPPYDGTLAKYYVLPEDFCYKLPESITLQEGAIMEPLSVAVHIVKQAGINPGQSVVVFGAGPVGLLCCAVAKAYGASKVIAVDIQKGRLDFAKKYAATATFEPAKAAALENAQRIITENDLGSGADVAIDASGAEPSVHTGIHVLRAGGTYVQGGMGRSEITFPIMAACTKELNVKGSFRYGSGDYKLAVSLVSAGKVNVKELITGVVKFEDAERAFEEVRAGKGIKTLIAGVDS

SEQ ID NO: 32784 - DNA, 1044 bp, Caenorhabditis briggsae
  CDS (1)..(1044)
atgtccgaagacaacctatcagctgtccttcatggggttgatgacctccgtctggagcaggttccaattccgaaaccaggatccaaacaggtcttggtccgagttcatactgtaggaatatgtggaagtgatgtgcattattggactcatggagccattggaccgtttgtggttaaagagccaatgattgttggccatgaaacatcaggagttgtatcagagatcggaagtgaggtgcaacacttgaaagttggtgatcgaattgcaatggaaccaggattgccatgcaaactttgtgagcattgtaaaactggaagatacaatttgtgtcctgaaatgagatttttcgccactcccccaatcaatggaacgctatccagatatgtcgtccatgatgctgacttttgcttcaagctacctgataatctctctttcgaagatggagctctgctagaaccactctcggttgctattcattcctgtcgtcgtggaaatgttcaaatgggtcatagagttttagtcctcggagctggtccgatcggtgttctaaatctgctaactgccaaatcagtgggagctggaaaagttgttatcaccgacctagacgacggtcgtctttccctcgccaagaagctgggagcagatgctacgattaatgtaaaaggcaagtcgttggaggccgtaagagcggagatcatcagcgcgttgggtggacagcagccacatgtctgtgtcgagtgtaccggtgcgcagccgagtattgagacggcgataactactaccaaatcaggtggagtcatagttcttgttggtctgggagccgatagagttgaaattccaattatcgaatcggccacaagagaggttgatatacgaggaatcttcagatatgttaattgttacccaactgccattgaacttcttagctctggaaaactggatctctcgggactgagtcgtgcccattacaaacttgaagagaccttggaagcctttaagagaactcaaaaagctgatgttatcaaagtctttattcaatgttaa

SEQ ID NO: 32785 - protein, 347 aa, Caenorhabditis briggsae
MSEDNLSAVLHGVDDLRLEQVPIPKPGSKQVLVRVHTVGICGSDVHYWTHGAIGPFVVKEPMIVGHETSGVVSEIGSEVQHLKVGDRIAMEPGLPCKLCEHCKTGRYNLCPEMRFFATPPINGTLSRYVVHDADFCFKLPDNLSFEDGALLEPLSVAIHSCRRGNVQMGHRVLVLGAGPIGVLNLLTAKSVGAGKVVITDLDDGRLSLAKKLGADATINVKGKSLEAVRAEIISALGGQQPHVCVECTGAQPSIETAITTTKSGGVIVLVGLGADRVEIPIIESATREVDIRGIFRYVNCYPTAIELLSSGKLDLSGLSRAHYKLEETLEAFKRTQKADVIKVFIQC

SEQ ID NO: 32786 - DNA, 1107 bp, Malus domestica
  CDS (1)..(1107)
atgggcaagggaggccaatcctgcaatggcatggttagagatgtcaaacctgtggagaaggaaaacatggctgcttggctcgttgatgttaacaccatcaagatcctacctttcaagctccccactattggaccgaatgatgttcaaattcgaattaaggctgtcggcatttgcggaagtgatgttcactacctcaagaccatgaaatgtgcggattttgaggttaaagagccgatggtgatcggacatcagtgtgctgggatcgtagacaaagttgggagcgaggtgaagcatctggtgcccggtgaccgagtggcggttgagcccggcatcagctgcgcacattgccagcagtgcaaaggaggccgctacaatctctgtcccgacatgaagtttttcgccaccccaccggttcacggtgccttggctaatcagattgtcgaccctgcagatctgtgctttaaactgcccgaaaacgtgagcttggaggaaggagcaatgtgtgagcccttgagtgttggggttcacgcttgtcggcgagccaatgttggtcccgaaacaactgttctgatcgtcggtgcagggccgattgggctggtttccgtgctcgctgctcgtgctttcggagcaccaagaattgtcatcgtagatatggatagtaagcgtttagccgtggccaagtctctgggagctgatggaaccgtcaaagtttcacgaaaaatggaggatttagatgacgaagttgccaagattaaagaaaccatgggagccgaagttgatgtgaccttcgactgtgtgggtttcaacaaaaccatgtctacgggcctcaatgctactcgtcccggcggcaaagtttgccttgtaggaatggggcacagcatgatgacagtccctctgacagccgctgcagccagggaggttgacgtggttggagttttccggtgtaagaacacatggcctctttgccttgagtttttgagaagcgggaagatcgacgtgaagccgcttattacccaccggtttggatttaccgagaaggaggtggaagaagcatttgcaaccagtgctcgtgggggtgacgccattaaagtcatgtttaatctatag

SEQ ID NO: 32787 - protein, 368 aa, Malus domestica
MGKGGQSCNGMVRDVKPVEKENMAAWLVDVNTIKILPFKLPTIGPNDVQIRIKAVGICGSDVHYLKTMKCADFEVKEPMVIGHQCAGIVDKVGSEVKHLVPGDRVAVEPGISCAHCQQCKGGRYNLCPDMKFFATPPVHGALANQIVDPADLCFKLPENVSLEEGAMCEPLSVGVHACRRANVGPETTVLIVGAGPIGLVSVLAARAFGAPRIVIVDMDSKRLAVAKSLGADGTVKVSRKMEDLDDEVAKIKETMGAEVDVTFDCVGFNKTMSTGLNATRPGGKVCLVGMGHSMMTVPLTAAAAREVDVVGVFRCKNTWPLCLEFLRSGKIDVKPLITHRFGFTEKEVEEAFATSARGGDAIKVMFNL

SEQ ID NO: 32788 - DNA, 1032 bp, Bacillus halodurans
  CDS (1)..(1032): transl_table=11
atgaaagcattagtaaaaacacaacatggcacgggccattttgccgtgcaagagaaacccgaaccaactccagggaaacatcaagtaaaaatcaaagtaaagtacacaggcgtttgtggttcagatattcatacctatgagggccattatcctgtagccgctccagtcacacttggtcatgaattttcaggtgagatcgttgaactcggtgaaggtgtaacaggctttaacgttggcgaccgagtaacatcagaaacgacctactcgatttgcggtaaatgctcatattgcacctcgggtgactataatctttgctctcaccggaaaggacttgggaatcagcaggatggcagttttgctaaatacgtaatcgcgcgacaagagagtttgcaccatctccctgctggtgtggatgatcgctcagcagccatgacagagcccctcgcatgtacacatcatgcgattgcaaaaaccagcatcaacaaaggggacttagttgtcgttactggtcctggtccgattggtttgttagcagctcaagttgcaaaaagtcacggtggaacagtgattattacaggtctatccaatgatcaagtccgattaaaaaaagcaaaggaagtcgggatcgattacgccatcgatacacaggaagtggacataaaagagcttgtctccgagcttacagacggctatggtgcagatgtcgttttagaatgttctggcgctgtgccagccgcaaaacaagggattgatcttttacgcaagaaaggacaatatgcccaagtcggcttatttgcccagcccgagatccaatttaattttgagaaaattattcaaaaagagatttccgtcgttgggagtagaagtcaaaaacctgcggattgggagcctgccctctcacttcttaatgaaaaaaaagtaaatgccaaaacactcgtcacccatgaatacacaatttctgaatgggataaggcctatcacgcgattaaaagtggtgaggctatcaaagtattattgacacctattgattag

SEQ ID NO: 32789 - protein, 343 aa, Bacillus halodurans
MKALVKTQHGTGHFAVQEKPEPTPGKHQVKIKVKYTGVCGSDIHTYEGHYPVAAPVTLGHEFSGEIVELGEGVTGFNVGDRVTSETTYSICGKCSYCTSGDYNLCSHRKGLGNQQDGSFAKYVIARQESLHHLPAGVDDRSAAMTEPLACTHHAIAKTSINKGDLVVVTGPGPIGLLAAQVAKSHGGTVIITGLSNDQVRLKKAKEVGIDYAIDTQEVDIKELVSELTDGYGADVVLECSGAVPAAKQGIDLLRKKGQYAQVGLFAQPEIQFNFEKIIQKEISVVGSRSQKPADWEPALSLLNEKKVNAKTLVTHEYTISEWDKAYHAIKSGEAIKVLLTPID

SEQ ID NO: 32790 - DNA, 1062 bp, Bacillus subtilis; identical to SEQ ID NO: 32746
  CDS (1)..(1062)

SEQ ID NO: 32791 - protein, 353 aa, Bacillus subtilis; identical to SEQ ID NO: 32747

SEQ ID NO: 32792 - DNA, 1044 bp, Bacillus subtilis
  CDS (1)..(1044): transl_table=11
atgcagagtggaaagatgaaagctctaatgaaaaaggacggggcgttcggtgctgtgctgactgaagttcccattcctgagattgataaacatgaagtcctcataaaagtgaaagccgcttccatatgcggcacggatgtccacatttataattgggatcaatgggcacgtcagagaatcaaaacaccctatgttttcggccatgagttcagcggcatcgtagagggcgtgggagagaatgtcagcagtgtaaaagtgggagagtatgtgtctgcggaaacacacattgtctgtggtgaatgtgtcccttgcctaacaggaaaatctcatgtgtgtaccaatactgctataatcggagtggacacggcaggctgttttgcggagtatgtaaaagttccagctgataacatttggagaaatcccgctgatatggacccgtcgattgcttccattcaagagcctttaggaaatgcagttcataccgtactcgagagccagcctgcaggaggaacgactgcagtcattggatgcggaccgattggtcttatggctgttgcggttgcaaaagcagcaggagcttctcaggtgatagcgattgataagaatgaatacaggctgaggcttgcaaaacaaatgggagcgacttgtactgtttctattgaaaaagaagacccgctcaaaattgtaagcgctttaacgagtggagaaggagcagatcttgtttgtgagatgtcgggccatccctcagcgattgcccaaggtcttgcgatggctgcgaatggcggaagatttcatattctcagcttgccggaacatccggtgacaattgatttgacgaataaagtggtatttaaagggcttaccatccaaggaatcacaggaagaaaaatgttttcaacatggcgccaggtgtctcagttgatcagttcaaacatgatcgatcttgcacctgttattacccatcagtttccattagaggagtttgaaaaaggtttcgaactgatgagaagcgggcagtgcggaaaagtaattttaattccataa

SEQ ID NO: 32793 - protein, 347 aa, Bacillus subtilis
MQSGKMKALMKKDGAFGAVLTEVPIPEIDKHEVLIKVKAASICGTDVHIYNWDQWARQRIKTPYVFGHEFSGIVEGVGENVSSVKVGEYVSAETHIVCGECVPCLTGKSHVCTNTAIIGVDTAGCFAEYVKVPADNIWRNPADMDPSIASIQEPLGNAVHTVLESQPAGGTTAVIGCGPIGLMAVAVAKAAGASQVIAIDKNEYRLRLAKQMGATCTVSIEKEDPLKIVSALTSGEGADLVCEMSGHPSAIAQGLAMAANGGRFHILSLPEHPVTIDLTNKVVFKGLTIQGITGRKMFSTWRQVSQLISSNMIDLAPVITHQFPLEEFEKGFELMRSGQCGKVILIP

SEQ ID NO: 32794 - DNA, 1032 bp, Burkholderia mallei
  CDS (1)..(1032): transl_table=11
atgaaagcgctggcgaaactcgaacgcgggccgggcctcacgctcacccgtgtgaaaaagccggaggtcggccacaacgacgtcctcatcaagatccgccgcaccgcaatctgcggcaccgacatccatatctggaagtgggacgactgggcgcagaagacgattccggtgccgatgcacgtcggccacgagtacgtcggcgagatcgtcgagatgggccaggaagtgcgcggcttctcgatcggcgatcgcgtatccggcgaaggccacatcacgtgcggcttctgtcggaactgccgcgcggggcggcgccatttgtgccgcaacacggtgggcgtcggcgtgaatcgcgaaggcgcgttcgccgagtacctcgcgattcccgcgttcaacgcgttcaagattccgcccgagatctccgacgatctcgccgcgatcttcgatccgttcggcaacgcgacgcacaccgcgctgtcgttcaacctcgtcggcgaggacgtgctgatcacgggtgcggggccgatcggcgtgatggcggtggcgatcgcgaagcacgtcggcgcgcgcaacgtcgtcatcaccgacatcaacgactatcgcctcgaactcgcgcgcaagatgggcgcgacacgcgcggtgaacgtgtcgcgcgaatcgctgcgcgacgtgatggccgacctgcacatgacggagggcttcgacgtcgggctcgagatgtccggcgtgccgagcgcgttcacgtcgctgctcgaatcgatgaatcacggcggcaaggtcgcgctgctcggcattccgcccgcgcagaccgcgatcgactggaaccaggtgatcttcaagggcctcgagatcaagggcatctatgggcgcgagatgttcgagacgtggtacaagatggtcgcgatgctgcaaagcgggctcgatctttcgccgatcatcacgcaccgcttcgccgtggacgactacgagaaaggtttcgctgcgatgctgtcgggcgaaagcggcaaggtgattctcgactgggccgacgcgtga

SEQ ID NO: 32795 - protein, 343 aa, Burkholderia mallei
MKALAKLERGPGLTLTRVKKPEVGHNDVLIKIRRTAICGTDIHIWKWDDWAQKTIPVPMHVGHEYVGEIVEMGQEVRGFSIGDRVSGEGHITCGFCRNCRAGRRHLCRNTVGVGVNREGAFAEYLAIPAFNAFKIPPEISDDLAAIFDPFGNATHTALSFNLVGEDVLITGAGPIGVMAVAIAKHVGARNVVITDINDYRLELARKMGATRAVNVSRESLRDVMADLHMTEGFDVGLEMSGVPSAFTSLLESMNHGGKVALLGIPPAQTAIDWNQVIFKGLEIKGIYGREMFETWYKMVAMLQSGLDLSPIITHRFAVDDYEKGFAAMLSGESGKVILDWADA

SEQ ID NO: 32796 - DNA, 1026 bp, Chromobacterium violaceum
  CDS (1)..(1026): transl_table=11
atgaaggcgcttgccaagctgaaggccgctcccggcctggaaatgaccgatgttccgctgccggaagtcggccacaacgatctgttgatcaagatcgtcaagaccgcgatctgcggcaccgacatccatatctggaactgggacgagtggtcgcagaagaccatcccggtgccgatgcacgtcgggcacgagtacgtcggcgtcgtcgccggcatgggttcggaagtgcagggcttcaagatcggccagcgcgtgtccggcgaaggccacatcacctgcggctattgccgcaactgccgcgccggccgccgccacctgtgccgcaacaccaccggcgtcggcgtcaaccgcgaaggcgcgttcgccgaatacctggtgattccggccttcaatgccttcccgatcccggacgacatctccgacgacctggcctccatcttcgacccgttcggcaatgccgtgcacaccgcgctgtcgttcaacctggtgggcgaggacgtgctgatcacaggcgccggcccgatcggcatcatggcggtggccatcgccaagcatgtcggcgcgcgccatgtcgtcatcaccgacgtcaacgactaccggctggagctggcgaagaagatgggcgccacccgtgccgtcaacgtcgcccgcgaggacctgaaggcggtgatgcaggagctgcacatgagcgagggcttcgacgtgggcctggaaatgtccggcaatccgcaggctttccgccagatgctggaaacgatgaaccacggcggcaaggtggcgctgctgggcattccgccgtccaataccgccatcgactggaaccaggtgatcttcaagggcctggaaatcaagggcatttacggccgcgagatgttcgagacctggtacaagatggtggccctgatccagtccggcctggacatcagtcctatcatcacccaccacttcaaggtggacgagttcgagcagggcttcgccgcgatgctgtccggccagagcggcaaggtgatcctggactggcgctga

SEQ ID NO: 32797 - protein, 341 aa, Chromobacterium violaceum
MKALAKLKAAPGLEMTDVPLPEVGHNDLLIKIVKTAICGTDIHIWNWDEWSQKTIPVPMHVGHEYVGVVAGMGSEVQGFKIGQRVSGEGHITCGYCRNCRAGRRHLCRNTTGVGVNREGAFAEYLVIPAFNAFPIPDDISDDLASIFDPFGNAVHTALSFNLVGEDVLITGAGPIGIMAVAIAKHVGARHVVITDVNDYRLELAKKMGATRAVNVAREDLKAVMQELHMSEGFDVGLEMSGNPQAFRQMLETMNHGGKVALLGIPPSNTAIDWNQVIFKGLEIKGIYGREMFETWYKMVALIQSGLDISPIITHHFKVDEFEQGFAAMLSGQSGKVILDWR

SEQ ID NO: 32798 - DNA, 1029 bp, Coxiella burnetii
  CDS (1)..(1029): transl_table=11
atgaaagtactttccaaactaaaaccagcccctggcctctggctccacaaggcaccaacgcctaaacccggccgggacgaagtattaattaaaattaaaaaaaccgccatttgcggcacggatttgcatatttataaatgggatgaatgggcgcaaaaaaccattcctgtccccatgcacgtcggccatgaatttgttggtgaaatcgtggaggtaggcgaggccgctagcgcgttggcggttggagatcgggtttcaggggaaggacacatcacgtgcggggattgtcgtaattgtcgcgccggtaagcgccatttgtgtcgctacaccgtaggcgttggcgtaaatcgtcccggcgcgtttgcggaatatttagttatccccgctaaaaatgcgtataaaattccggcaaaaattagcgatgatatcgctgccattttagatcctttcggcaacgccgcacattccgcgttggagtttgatttagtgggcgaagatgtattaattaccggcgcaggccccgtcggattgatgtcagcagccattgcgcggcacgtcggggcgcggcatgtagtgataacggatgtcaatgattaccgtttagctttagccgaaaaagtgggcgtaaccgctgccgttaactcgacaaaaactcccttaacggagacgatgaaaaatcttgggatgacagagggttttgatgtcggtcttgaaatgtcaggaaacgctgaggcttttcgcagcatgttaacggtaatgaataacggcgggaaaatcgcctttttgggtatcccaccggaaccgtttgcgattgattggaatcaagtcgttttcaaaagcttattgataaaagggatttatggacgccgcatgtttgagacgtggtataaaatgactaatttattactaagcgggttagacatttcacccatcatcacgcatgagtttccgatgaaggattttcaacaagcatttgatgtaatgctgtcgggtaaaacaggcaaagtgattttgaattgggagcaatga

SEQ ID NO: 32799 - protein, 342 aa, Coxiella burnetii
MKVLSKLKPAPGLWLHKAPTPKPGRDEVLIKIKKTAICGTDLHIYKWDEWAQKTIPVPMHVGHEFVGEIVEVGEAASALAVGDRVSGEGHITCGDCRNCRAGKRHLCRYTVGVGVNRPGAFAEYLVIPAKNAYKIPAKISDDIAAILDPFGNAAHSALEFDLVGEDVLITGAGPVGLMSAAIARHVGARHVVITDVNDYRLALAEKVGVTAAVNSTKTPLTETMKNLGMTEGFDVGLEMSGNAEAFRSMLTVMNNGGKIAFLGIPPEPFAIDWNQVVFKSLLIKGIYGRRMFETWYKMTNLLLSGLDISPIITHEFPMKDFQQAFDVMLSGKTGKVILNWEQ

SEQ ID NO: 32800 - DNA, 1047 bp, Deinococcus radiodurans
  CDS (1)..(1047)
atgcgggccctgagcaagcagcagcccggcgagggcatctggatgatcgaaaccgaggtgccgacgcccggtcccaacgacctgctgattcgaattcgcaaggggagcatctgtggaaccgacgtgcacatctacaagtgggacgactgggcgagccagacggtgccggtgccgatggtcgtcgggcacgaatacgtgggtgtggtcgcgggcatgggctcggaagtgcgcggcttcgaaatcggcgaccgggtgagcggcgagggccacgtcacctgcgggcactgccgcaactgccgcgccgggcgccgccacctgtgccgcaacacgcagggggtgggcgtcaaccgccccggctccttcgccgagtatctggtgctgcccgccttcaatgccttcaagctgcccgacgacattcccgacgatgtcgccgctattttcgaccccttcggcaacgcggtgcacacggcgctgagcttcgacctggtgggcgaggacgtgctgattaccggcgccgggcccatcggctgcatggccgccgccgtcgcccggcacgtgggcgcccgcaacgtggtgattaccgacgtgaatgactaccgtctcgacctcgcgcggcagatgggcgtgacccgcgccgtgaatgtggcccgcgaggacctctggacggtggcgacgcaggaactcgacatgcacgagggcttcgacgtgggcatggaaatgagcggctcggggcctgccttcgcgcagatggtcagcgtgatgaacaacggcggcaaagtcgcgctgctcggcattccctcgggcgaggtgcagatcgattggaacgccgtcatcttcaagatgctcaccatcaagggcatctatggccgcgagatgttcgaaacctggtacaagatggccgccctgattcagtcgggcctggacctcacgccggtcatcacccaccactacggcatcggcgactttcagcagggcttcgacgccatgctcagcgggcagagcggcaaagtgattctggactgggagacggaagagcaaagcgcctga

SEQ ID NO: 32801 - protein, 348 aa, Deinococcus radiodurans
MRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 32802 - DNA, 1086 bp, Erwinia carotovora subsp
  CDS (1)..(1086): transl_table=11
atgaaagcattggcaaaattgcgaccggaagaaggtatctggatgatggatgcccccatgccagaactcgggcataacgacatcatgattaaaatccgcaaaagcgcgatttgcggaacggatgtgcatatctataactgggacgaatggtcgcagaagaccattcctgttccgatggtcgtcgggcatgagtacgtgggtgaaattgtcgcgattggtcaggaagttaacggttttcatattggcgaccgggtttctggtgaggggcatattacctgtggctactgccgtaactgtcgcgctgggagacgtcacttatgccgcaatgccatcggtgtcggggtaaaccgtcccggttcgttcgcggaatatctggtgattcctgcctacaatgcatttcgcattcccgacaatatttctgacgaattggccgctattttcgaccctttcggtaacgccgtgcataccgcactttccttcgatttagtgggggaagatgtgttgattacaggggcagggccgataggcatgatggccgcggcggtgtgccgtcacgttggtgcaaggaatgtcgtgattaccgatgtgaatgcgtaccgtctggagctggctagtaaaatgggggcaacgcgtgccgtcaatgtggcagaggaaaagctgactgacgtgatgatagaactgggtatgaccgagggatttgatattgggttagaaatgtcgggcgcaccatcggcctttcgcgcgatgctgaaagcgatgaatcacggtgggcgaatcgccatgctgggcattccgcacgaaccgatgtcgattgactggggcgaagtgatttttaagggattgtttattaaaggcatctacggacgggaaatgttcgaaacctggtacaaaatgtctgcgctgattcagtccggactggatttgtccccgattatcacccaccgctttcacattgatgagtttcaaaaagggttcgatgccatgcgctcaggtcagtcgggcaaggttattctcaattgggatgaggcatatactcgtcatacttcgagttgcatgtgcgttgactgcgctactcggcatacttaa

SEQ ID NO: 32803 - protein, 361 aa, Erwinia carotovora subsp
MKALAKLRPEEGIWMMDAPMPELGHNDIMIKIRKSAICGTDVHIYNWDEWSQKTIPVPMVVGHEYVGEIVAIGQEVNGFHIGDRVSGEGHITCGYCRNCRAGRRHLCRNAIGVGVNRPGSFAEYLVIPAYNAFRIPDNISDELAAIFDPFGNAVHTALSFDLVGEDVLITGAGPIGMMAAAVCRHVGARNVVITDVNAYRLELASKMGATRAVNVAEEKLTDVMIELGMTEGFDIGLEMSGAPSAFRAMLKAMNHGGRIAMLGIPHEPMSIDWGEVIFKGLFIKGIYGREMFETWYKMSALIQSGLDLSPIITHRFHIDEFQKGFDAMRSGQSGKVILNWDEAYTRHTSSCMCVDCATRHT

SEQ ID NO: 32804 - DNA, 1056 bp, Francisella tularensis subsp
  CDS (1)..(1056): transl_table=11
atgaaagcattagctaaattaaaaaaacaaccaggtatatggataattaatgatgcgccaataccagaatatggctacaatgatgttttgattaaaattaaaaaaacggctatttgtggtactgatttacatatttataattgggataaatggtcgcaaaacaccattccagttccaatgattaccggacatgagtttgctggtgaagttgtagctaaaggagatggtgttacaagcgtagatatcggcgatagagtgtcaggtgagggtcatcttgtatgtgggcaatgccgtaattgcagagcaggtaaacgtcacctttgtagaaaaactataggtataggagtaaatgtacagggtgcatttgcagaatatctagttatgcctgcggttaatgtttttaagatccctgattctatcagtgatgatatcgctagtacttttgatcctatgggcaatgctattcacaccgcactttcttttaacttaacaggtgaggatgtccttataactggtgctggacctattggcttaatggctgtcaaaatagcaagattctgtggtgcacgcagaatagtaatcacagatattaatgagtatcgcctacaaatggctagggattttggtgcaactgttgctttgaatgttgctccatttaagaatcaagatgagttagtaaaacaaatgcgcaaagttatgtcagatatcggcatgacagaaggatttgatgttggtctagaaatgtctggaattaactctgcaatctcaatgatgcttgatgttatgaatcatggtggtaaactatcacttctaggcatatctgctggtgatatttctgttgattggggagctatattgtttaagggtctgactctcaagggtatatatggtagagaaatgtttgaaacatggtacttaatgactagtatgctccaagctggtatggatatgaaccctatcatcacacatcgacttcatattgatgagtttcaaaaaggatttgaaataatgaaaagtggtcaatgtggtaaagtaatactggattggagtagctag

SEQ ID NO: 32805 - protein, 351 aa, Francisella tularensis subsp
MKALAKLKKQPGIWIINDAPIPEYGYNDVLIKIKKTAICGTDLHIYNWDKWSQNTIPVPMITGHEFAGEVVAKGDGVTSVDIGDRVSGEGHLVCGQCRNCRAGKRHLCRKTIGIGVNVQGAFAEYLVMPAVNVFKIPDSISDDIASTFDPMGNAIHTALSFNLTGEDVLITGAGPIGLMAVKIARFCGARRIVITDINEYRLQMARDFGATVALNVAPFKNQDELVKQMRKVMSDIGMTEGFDVGLEMSGINSAISMMLDVMNHGGKLSLLGISAGDISVDWGAILFKGLTLKGIYGREMFETWYLMTSMLQAGMDMNPIITHRLHIDEFQKGFEIMKSGQCGKVILDWSS

SEQ ID NO: 32806 - DNA, 1026 bp, Idiomarina loihiensis
  CDS (1)..(1026): transl_table=11
atgaaagctttatcaaaactgcacgcaaaacccggcatttggatgaccgacgtggaaaagccggaatgcggttacaacgatttgctgattaaaattaagaaaaccgccatttgcggtaccgatgttcacatttataaatgggacgactggtcgcagaaaaccattccggtgcctatggtggtcggccacgagtacgtgggtgaagttgccgctatgggcgacggtgttcgtggctttgaaattggcgaccgcgtttccggagaaggtcacattacctgtggtcactgtcgtaactgtcgcgccggccgtcgtcacttatgccgcaatacctatggtgtgggtgtgaatcgtccgggtgcttttgcagaatacctggcactgccagctgaaaacgcttttaaacttccagatgacgttactgatgaaatggcagctgtatttgacccatttggtaatgcggttcacaccgccctggcttttgacctggtgggtgaagacgtgctgattaccggtgcgggtcctattggtattatggcagcagccgttgcccgtcacgttggcgcacgccacgtggttattaccgacgtcaacgaataccgcctggacttagctcgtaaaatgggcgttacccgcgcagtggacgttagcaaagagaagctgtccgacgtaatgactgaactaggcatgaaagaaggttttgatgtgggtctggaaatgtcaggtgtgccatcagctttctcacaaatgctggaaaccatgaaccatggcggcaaaattgccatgctgggcattccgcctgaaaatatcgctatagactggaaccaggttatttttaaaggtctggttattaaaggcatttatggccgcgagatgtttgaaacctggtacaaaatggccagcttgctgcagtccgggctggatatttcgcctattttaacgcacgaaatgcctattgatgactttgagaaaggctttgaaaccatgatttcaggccagtccggcaaagtcatactgaactgggattaa

SEQ ID NO: 32807 - protein, 341 aa, Idiomarina loihiensis
MKALSKLHAKPGIWMTDVEKPECGYNDLLIKIKKTAICGTDVHIYKWDDWSQKTIPVPMVVGHEYVGEVAAMGDGVRGFEIGDRVSGEGHITCGHCRNCRAGRRHLCRNTYGVGVNRPGAFAEYLALPAENAFKLPDDVTDEMAAVFDPFGNAVHTALAFDLVGEDVLITGAGPIGIMAAAVARHVGARHVVITDVNEYRLDLARKMGVTRAVDVSKEKLSDVMTELGMKEGFDVGLEMSGVPSAFSQMLETMNHGGKIAMLGIPPENIAIDWNQVIFKGLVIKGIYGREMFETWYKMASLLQSGLDISPILTHEMPIDDFEKGFETMISGQSGKVILNWD

SEQ ID NO: 32808 - DNA, 1023 bp, Legionella pneumophila
  CDS (1)..(1023): transl_table=11
atgaaatcattggttaaagcaaaaaaagagcctggaatttggatgcaggatattcctgttcctgaatacggagtaaatgatgttttaataaaaattaaaaggactgcaatttgtggtacagatatccatatttattcctgggatgaatgggcgcaagcgacaattcctgttcctatgacggtagggcatgaattttatggtgaaatagtagaggttggaaaagaagtccaaggtttgaaagttggacagagagtttctggtgaaggtcatattacctgtggtttttgcagaaattgtcgtgccggcaagcgtcatttatgtcgtaatactctgggagtgggggtgaatcgaccaggatgctttgctgagtatctggcacttcctgctaccaatgtcattgctctacctgacaacattacagaagagcaagcggctattctcgatccttttggaaatgctgctcattgtgcattggcatttgatgtagtaggcgaagacgttttgattactggtgcaggtcccataggaataatggccgcagccatcgtaagacatattggcgcacggcatgttgttatcaccgatgttaacgatcatcgattggaactggccaggcaaatgggtgtcagccgagcggttaatgtcaaataccaaaaattaattgatgtggctaatgagctgggaatgcttgagggttttgatgtgggtctggaaatgtccgggaaccctatggcattaaacgatatgatgaaggcgatgaatcatggtggtcatgtggctttattgggtatcccaccacaagaaacccctatagattggaaccaggttatctttaaaggattggttattaagggtatttatggtcgagaaatgtttgaaacctggtataagatgattgctatgttacagagcggtttaaatatttctcctgtcattactcataatttcccagtagatgaatatcagcacgcatttcaaattatggcatcgggccagtcagggaaagttatactgaactggtag

SEQ ID NO: 32809 - protein, 340 aa, Legionella pneumophila
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLIDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 32810 - DNA, 1023 bp, Legionella pneumophila subsp
  CDS (1)..(1023)
atgaaatcattggttaaagcaaaaaaagagcctggaatttggatgcaggatattcctgttcctgaatatggagtaaacgatgttttaataaaaattaaaaggactgcaatttgtggtacagatatccatatttattcctgggatgaatgggcgcaagccacaattcctgttcctatgaccgtagggcatgaattttatggtgaaatagtagaggttggaaaagaagtacaaggtttgaaagttggacagagagtttctggtgaaggtcatattacctgtggtttttgcagaaattgtcgtgccggcaagcgtcatttatgtcgtaataccctgggagtgggggtgaatcgaccaggatgctttgctgagtatctggcgcttcctgctaccaatgtcatcgctctccctgacaacattacagaagagcaagcggctattctcgatccttttggaaatgctgctcattgtgcattggcatttgatgtagtaggcgaagacgttttgattactggtgcaggccccataggaataatggccgcagccatcgtaagacatattggcgcacggcatgttgttatcaccgatgttaacgatcatcgattggaactggccaggcaaatgggtgtcagccgagcggttaatgtcaaataccaaaaattaagtgatgtggctaatgagctaggaatgcttgagggttttgatgttggtctggaaatgtccgggaaccctatggcattaaacgatatgatgaaagcgatgaatcatggtggtcatgtggctttattgggtatcccaccacaagaaacccctatagattggaaccaggttatctttaaaggattggttattaagggtatttatggtcgagaaatgtttgaaacctggtataagatgattgctatgttacagagcggtttaaatatttctcccgttattactcataatttcccagtagatgaatatcagcacgcatttcaaattatggcatcgggccagtcagggaaagttatactgaactggtag

SEQ ID NO: 32811 - protein, 340 aa, Legionella pneumophila subsp
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 32812 - DNA, 1029 bp, Parachlamydia sp
  CDS (1)..(1029): transl_table=11
atgaaaggtttagtcaagaaaatatcagctcccggtctttggatggaaaatctgccaataccgtcgcatgtgaaagatgatgaagttctgattaaaacaattaaaacatccatctgtggcaccgatgttcatatttataaatgggatgcttgggcgcagaaaaatgttcctgtgcctttggtgattggtcatgaatttatcggtgaaatagcagaatttggaaaaaatgttaaaggatttaaaattggagaacgagtatgcggggaaggacatatcgtttgtaatcaatgcccaaattgccgcatgggtcgtaagcatgtctgcatgcacacgaaagggctaggttatcatatttctggctgctttgctgaatattttgttcttcctgcagaaaatgttttttctctacccccttccatttctgatgatttaggcgccatcttcgacccttacggaaatgctgtccatactacgctcgcctttaatcttattggtgaagatgttcttattacaggtgctggcccaattggaatcatggcagccgccattgctaaacaagctggtgcaagacatattgtcatcacagatgtaaacgattatcgtctagaccttgcaagaactatgggtgtctcgcatgctattaatgttaatcgagaatctttagataattttatgcaatctctaggaatcaaatatggctttacagttggacttgagatgtctggccatcctgacggactaaaaactttaacggaaaaaattcgacatggaggaaacatcgcattacttggcattctcccaccagctacttctattgactggaatttagttatttttaaaatgttaactttaaaagggatttatggaagagaaattttctcaacctggtatcagatggttcaccttctggaaattggcttaaatttagctcctatcattacccatcatttttcagttgataattttgaaaaaggatttgaagtgatgttatcaggccaatcaggtaaagtgattcttgattgggtttaa

SEQ ID NO: 32813 - protein, 342 aa, Parachlamydia sp
MKGLVKKISAPGLWMENLPIPSHVKDDEVLIKTIKTSICGTDVHIYKWDAWAQKNVPVPLVIGHEFIGEIAEFGKNVKGFKIGERVCGEGHIVCNQCPNCRMGRKHVCMHTKGLGYHISGCFAEYFVLPAENVFSLPPSISDDLGAIFDPYGNAVHTTLAFNLIGEDVLITGAGPIGIMAAAIAKQAGARHIVITDVNDYRLDLARTMGVSHAINVNRESLDNFMQSLGIKYGFTVGLEMSGHPDGLKTLTEKIRHGGNIALLGILPPATSIDWNLVIFKMLTLKGIYGREIFSTWYQMVHLLEIGLNLAPIITHHFSVDNFEKGFEVMLSGQSGKVILDWV

SEQ ID NO: 32814 - DNA, 1026 bp, Photorhabdus luminescens subsp
  CDS (1)..(1026): transl_table=11
atgaaagcattgtcaaagttaaaagcagaagaaggcatctggatgatcgatgtgcccgagccagagctggggcacaatgatgtgatgatcaaaatccgtaaaacagcgatttgtggtacggatgtgcacatctataactgggatgattggtcacaaaaaaccattcctgtaccgatggttgtcggtcatgaatatgttggtgaagttgttgccattggtcaggaagtaaaaggttttaaaattggtgatcgggtgtctggcgaagggcatattacttgtggttactgccgtaactgtcgtggtggccgtactcacttatgccgtaataccattggcgtaggggtaaaccgcgctggttgttttgcacaatatctggttattcctgcatttaatgcgttcaaaattccagataacatctctgatgaactggctgctatttttgacccatttggcaatgctgttcataccgcgctttcgtttgatctggttggtgaagatgtgctggtttctggtgctggcccaattggtattatggcggcggcagtatgtaaacatgttggcgcgcgtcatgttgtcatcaccgacgttaacgaatatcgccttgagttggcacgtaaaatgggtgtcacccgtgcggtgaacgttagtcaggaaaatctgaccgatgtcatggcggaattgggcatgacggaaggttttgatgttggtttggaaatgtctggtgccccggcggcgtttcgtaccttattaaataccatgaatcacggcggccgtgttgcattgttgggcattcctccatcagatatggcaattgattggaatcaggtgatttttaagggattgtttatcaaaggtatttatggccgtgagatgtttgaaacctggtacaaaatggctacattaatccagtctggtttggatctgacacccattatcacccaccggttctctatcgatgatttccagaaaggctttgacatcatgcgttcagggcagtctggtaaagttattctgaactgggattaa

SEQ ID NO: 32815 - protein, 341 aa, Photorhabdus luminescens subsp
MKALSKLKAEEGIWMIDVPEPELGHNDVMIKIRKTAICGTDVHIYNWDDWSQKTIPVPMVVGHEYVGEVVAIGQEVKGFKIGDRVSGEGHITCGYCRNCRGGRTHLCRNTIGVGVNRAGCFAQYLVIPAFNAFKIPDNISDELAAIFDPFGNAVHTALSFDLVGEDVLVSGAGPIGIMAAAVCKHVGARHVVITDVNEYRLELARKMGVTRAVNVSQENLTDVMAELGMTEGFDVGLEMSGAPAAFRTLLNTMNHGGRVALLGIPPSDMAIDWNQVIFKGLFIKGIYGREMFETWYKMATLIQSGLDLTPIITHRFSIDDFQKGFDIMRSGQSGKVILNWD

SEQ ID NO: 32816 - DNA, 1032 bp, Photobacterium profundum
  CDS (1)..(1032)
atgaaaattaaagcgctgtcaaaactaaagcctgaagaaggcatctggatgaatgaagtagacaagcctgaaatgggccataatgatctacttattcgtattaagaaaaccgctatttgtggtacagatgtacatatctacaactgggatgaatggtcacaaaagacgattccagttccaatggttgtaggtcatgaatatgttggcgaagttgttggtattggccaagaagttcgtggttttacaatcggtgatcgtgtgtctggtgaaggtcatattacatgtggtcattgccgtaattgtcgtggtggtcgtacacacctttgtcgtaatacgacaggcgttggtgttaaccgtgatggcgcatttgctgagtttttggttattcctgcattcaatgcgttcaagatccctgcaggtatctctgacgatctagcatcaatcttcgacccgtttggcaatgctgttcatactgcattatcattcgatcttgttggtgaagatgtgctaattacaggtgctggtcctattggtattatggctgctgctgtcgctaaacacgttggtgcacgccatgttgtgattaccgatgtgaacgaataccgtctagatcttgctcgtaaaatgggcgtgactcgcgctgttaacgtagcaaacgaaaaacttgaagatgtaatgtctgaacttggcatgacagaaggttttgacgttggtttagaaatgtctggcgtaccatcagcatttaacggcatgctagctagcatgaaccacggtggtaaagtggcgttgttgggtattccaccatcagacatggcagtagattggacccaagttatctttaaaggtttggttattaaaggtatctacggccgtgaaatgtttgaaacttggtacaagatggcaagcttgattcaatcaggcttagatctaacaccaattatcacgcaccattacaaaattgatgatttccaaaaaggctttgacatgatgcgttcaggcatgtcaggtaaagttattctcgattgggaataa

SEQ ID NO: 32817 - protein, 343 aa, Photobacterium profundum
MKIKALSKLKPEEGIWMNEVDKPEMGHNDLLIRIKKTAICGTDVHIYNWDEWSQKTIPVPMVVGHEYVGEVVGIGQEVRGFTIGDRVSGEGHITCGHCRNCRGGRTHLCRNTTGVGVNRDGAFAEFLVIPAFNAFKIPAGISDDLASIFDPFGNAVHTALSFDLVGEDVLITGAGPIGIMAAAVAKHVGARHVVITDVNEYRLDLARKMGVTRAVNVANEKLEDVMSELGMTEGFDVGLEMSGVPSAFNGMLASMNHGGKVALLGIPPSDMAVDWTQVIFKGLVIKGIYGREMFETWYKMASLIQSGLDLTPIITHHYKIDDFQKGFDMMRSGMSGKVILDWE

SEQ ID NO: 32818 - DNA, 1038 bp, Propionibacterium acnes
  CDS (1)..(1038): transl_table=11
atgaaggccttggtcaagacccgcccggagccgggtctggagctggtggaggtccccgacccggtcgctggccccaacgacgtcatcgtcaaggtgatgcggacaggaatctgtggcaccgacgttcacatcgataaatgggacgggtgggccgccaagacggtgcacaccccgctggtcctcggccacgagttctgcggtgagattgttgaactcggttcggaggtcaatgatctggaggtcggacagttcgtctccggcgaggggcactatgtctgcggacgctgccgggcctgcctagcgggcaaacgtcacctgtgccgcaacacccaaggtattggatatgcggtcaacggtgcctactgccagtacttcgtcatgccggctggcaacgtctgggtacatcacatcccggaccttgaccccgacgtcgcggcgatctttgacccgttcggcaatgccgtacacaccgccttgcagttcccctgcctggccgaggatgtcctcgtttcaggtgctgggccgatcggcatcatggcggccctggtcgctcagttccaaggggcgcgcaatgtcgtcgttaccgacctgtccgacgagaggctggagctggctcagcaactgggcctgaagaacgccgtcaatgtttcccgcgaaggtttggagacggtctgggaccgattcgacatgaaggaggggtttgacatcggcctggagatgtccgggtcggggacagctttaacatccatgattgacaatatgactcatggtggacggattgcgttgctgggaaccccgagcactgacatcaccctcgacttttccaagatcatctttaacatgatcacaattcagggagtgaccgggcgtcagatcttcgaaacgtggtacaccatggcctccctcatccgttccggtctggacatctccggaatcatcaccgaccgataccccatcacggaattccgggaagcctttgacgtcgcaggctcgggccacggcggcaaggttgtcatgaactgggaatgcctcgactga

SEQ ID NO: 32819 - protein, 345 aa, Propionibacterium acnes
MKALVKTRPEPGLELVEVPDPVAGPNDVIVKVMRTGICGTDVHIDKWDGWAAKTVHTPLVLGHEFCGEIVELGSEVNDLEVGQFVSGEGHYVCGRCRACLAGKRHLCRNTQGIGYAVNGAYCQYFVMPAGNVWVHHIPDLDPDVAAIFDPFGNAVHTALQFPCLAEDVLVSGAGPIGIMAALVAQFQGARNVVVTDLSDERLELAQQLGLKNAVNVSREGLETVWDRFDMKEGFDIGLEMSGSGTALTSMIDNMTHGGRIALLGTPSTDITLDFSKIIFNMITIQGVTGRQIFETWYTMASLIRSGLDISGIITDRYPITEFREAFDVAGSGHGGKVVMNWECLD

SEQ ID NO: 32820 - DNA, 1047 bp, Pyrococcus abyssi
  CDS (1)..(1047): transl_table=11
atgtccgagaagatggtagctatcatgaagacgaaaccggcttacggcgctgagctcgtcgaggttgatgttccaaagccaggacctggggaggttctaataaaagttatagcgactagcatttgtggaacagacctacacatctatgagtggaacgagtgggcccaatcaaggataaagcccccacagataatgggtcatgaggttgccggtgaagtagttgaggtgggcccgggagttgagggaattgaggttggagattacgtaagcgttgaaacccacatagtttgtgggaaatgctacgcgtgtagaaggggacagtaccatgtttgtcaaaacacgaagatattcggtgtagacaccgatggtgtatttgctgagtacgcggtggttccagctcaaaacgtttggaagaatccaaagtcaattcctccggagtacgcaacccttcaagaaccacttggaaatgcagttgatactgttctggccgggccaatctctggaaagagcgttttgataactggagctggcccccttggcttacttggaattgcggtggcgaaggcctccggggcttatccggtgatagtttccgagccgagcgatttcaggagagagctagctaagaaggtcggtgcagattacgtgataaatccattcgaggaagacgtcgttaaggaagtcatggacataacggatggaaatggagttgacgtgttccttgagttcagcggagctcctaaggctttagaacagggacttcaggctgttacaccagctggaagagtatccctcctgggcctttacccagggaaggttagcatagacttcaacaatctgataatcttcaaggctctaactgtttatggaatcacaggtaggcacctctgggagacatggtacacagtttctaggctactccagagcggaaagcttaacttggacccaataataacccacaagtacaagggattcgacaagtacgaggaagccttcgagctaatgagggctggaaagacgggtaaggtagtcttcatgctcaagtga

SEQ ID NO: 32821 - protein, 348 aa, Pyrococcus abyssi
MSEKMVAIMKTKPAYGAELVEVDVPKPGPGEVLIKVIATSICGTDLHIYEWNEWAQSRIKPPQIMGHEVAGEVVEVGPGVEGIEVGDYVSVETHIVCGKCYACRRGQYHVCQNTKIFGVDTDGVFAEYAVVPAQNVWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVSIDFNNLIIFKALTVYGITGRHLWETWYTVSRLLQSGKLNLDPIITHKYKGFDKYEEAFELMRAGKTGKVVFMLK

SEQ ID NO: 32822 - DNA, 1047 bp, Pyrococcus furiosus
  CDS (1)..(1047): transl_table=11
atgtccgagaagatggttgctatcatgaagacaaaaccagagtacggtgcagagttagttgaagtagatgtaccaaaacctgggccaggggaagtcctaataaaaattcttgcaacaagcatatgtggaactgacctgcacatttatgaatggaatgaatgggctcagacaagaattaggccacctcagataatggggcatgaggttgcaggagaggttgtggaagttggtccaggtgtagagggaattgaagttggtgattacgtttctgttgagactcacatagtctgtggaaagtgttacgcatgtaaaagagggcaatatcacgtatgtcaaaacacaaagatatttggagtagatactgacggtgtttttgccgaatatgcagtagttccagcacaaaacgtctggaagaatccaaagaacatacctcccgaatatgctactctacaagagccattgggaaatgctgtggatacagtacttgctggcccaattgccggaaagagcgttctcattactggagcaggtcccctgggacttcttggaatagcagtggcaaaggcatccggagcctatcctgtgatagtttctgagccaagtgaatttagaagaaacttggcaaagaaggtgggtgcagactacgtaataaatccatttgaagaagatgttgtaaaggaggtaatggacataaccgacggaaacggagttgatgtgttcttggagttcagcggtgctccaaaggctcttgagcaaggactccaggcagtaactccagctggaagggtttctcttctcggactattcccaggaaaagtgagcatagactttaacaaccttataatattcaaggcattgacagtttacggaatcactgggagacacctttgggaaacttggtatacagtctctagactgctccaaagtggaaaattaaatatagacccaataataactcacaagtacaagggatttgacaagtatgaagaagcctttgagctaatgagggctggcaaaactggcaaagttgttttcatgcttaaatga

SEQ ID NO: 32823 - protein, 348 aa, Pyrococcus furiosus
MSEKMVAIMKTKPEYGAELVEVDVPKPGPGEVLIKILATSICGTDLHIYEWNEWAQTRIRPPQIMGHEVAGEVVEVGPGVEGIEVGDYVSVETHIVCGKCYACKRGQYHVCQNTKIFGVDTDGVFAEYAVVPAQNVWKNPKNIPPEYATLQEPLGNAVDTVLAGPIAGKSVLITGAGPLGLLGIAVAKASGAYPVIVSEPSEFRRNLAKKVGADYVINPFEEDVVKEVMDITDGNGVDVFLEFSGAPKALEQGLQAVTPAGRVSLLGLFPGKVSIDFNNLIIFKALTVYGITGRHLWETWYTVSRLLQSGKLNIDPIITHKYKGFDKYEEAFELMRAGKTGKVVFMLK

SEQ ID NO: 32824 - DNA, 1047 bp, Pyrococcus horikoshii
  CDS (1)..(1047): transl_table=11
atgtcagaaaagatggtagctatcatgaagacaaagcctgggtatggtgctgagcttgttgaggtggacgttccaaagcctggacctggagaagttctcattaaggttcttgcaaccagcatatgtggaactgatcttcatatatacgagtggaatgagtgggcacagagcaggattaagccacctcagataatggggcatgaagttgcgggagaagtcgttgaaatcgggccaggtgtggaaggaattgaagttggtgactacgtttccgttgaaacgcacatagtttgtggcaagtgttacgcctgcagaaggggccagtaccacgtctgccagaataccaagatatttggcgtcgatacagatggcgtattcgcagagtatgccgttgttccagcccaaaatatctggaagaatcctaaatcaattccaccagaatatgcaaccctccaggagcccttgggtaatgctgttgataccgttttggcaggaccaatttctggtaagagcgttttaataaccggagcggggccccttggattattgggaattgcagtggcaaaagcgtctggcgcataccctgtgatagtctcagaacctagtgacttcagaagggagttggccaagaaggtaggtgctgattacgttatcaatccattcgaagaggatgtcgttaaggaggtaatggatatcacagatggaaatggtgttgacgtatttctggaattcagtggagctcctaaggctctagagcagggtcttcaagcagttacacctgctggaagggtatctctcctgggtctatacccaggaaaggttaccattgactttaacaatctaataatcttcaaggcgctaacaatctatggaataactggaaggcacctctgggaaacttggtatacagtttcaaggctccttcagagcggaaagctcaacttagatcctattataactcataaatataagggattcgacaagtacgaggaagcctttgagctaatgagggccggcaaaacgggtaaagttgtttttatgcttaaatga

SEQ ID NO: 32825 - protein, 348 aa, Pyrococcus horikoshii
MSEKMVAIMKTKPGYGAELVEVDVPKPGPGEVLIKVLATSICGTDLHIYEWNEWAQSRIKPPQIMGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELMRAGKTGKVVFMLK

SEQ ID NO: 32826 - DNA, 1053 bp, Pyrococcus kodakaraensis
  CDS (1)..(1053): transl_table=11
atggccgagaaaatgcaggctattatgaagactaagccggcgtacggcgccgaacttgtagaagttgacgttccaaagcctgggccaggagaagtcctcattaaggttctcgcaacgagcatctgcggtacagacctccatatctacgagtggaacgaatgggcgcagagcaggataaagccgccccagataatgggccacgaagtggctggagaggtcgtcgaggtcggtcccggcgttgaggatctccaggttggagattacatcagcgttgaaactcatatcgtctgtggcaagtgctacgcgtgcaagcacaaccgctatcacgtctgccagaacaccaagatattcggagttgatatggacggtgtcttcgcccactacgcgatagttccggccaagaacgcctggaagaacccgaaggacatgccgccagagtacgcagcccttcaggagccgctcggaaacgccgtcgataccgttcttgcaggcccgattgctgggaggagcaccctcataaccggtgctggaccgctcggtcttctcggcatagcagttgccaaggcaagcggggcttatccagtcatcgttagcgagccgagtgagttcagaaggaagctcgccaagaaggtcggtgctgactacgtcgttaaccccttcgaggaagacccagtcaagttcgttatggacataaccgacggagcgggcgttgaagttttccttgagttcagtggtgcacctaaagcccttgagcagggcctcaaggcagtaacacccggaggacgcgtctcacttctcggcctcttcccgagagaggtcacgatagacttcaacaacctcataatcttcaaggcccttgaagtccacggcataaccggaaggcacctctgggaaacctggtacaccgtctcaagcctcatccagagcggcaagctgaacctcgatccgataatcacccacaagtacaagggcttcgacaagttcgaggaagcctttgagcttatgcgcgctggaaagaccggaaaggtcgtcttcttccctcacaagggatga

SEQ ID NO: 32827 - protein, 350 aa, Pyrococcus kodakaraensis
MAEKMQAIMKTKPAYGAELVEVDVPKPGPGEVLIKVLATSICGTDLHIYEWNEWAQSRIKPPQIMGHEVAGEVVEVGPGVEDLQVGDYISVETHIVCGKCYACKHNRYHVCQNTKIFGVDMDGVFAHYAIVPAKNAWKNPKDMPPEYAALQEPLGNAVDTVLAGPIAGRSTLITGAGPLGLLGIAVAKASGAYPVIVSEPSEFRRKLAKKVGADYVVNPFEEDPVKFVMDITDGAGVEVFLEFSGAPKALEQGLKAVTPGGRVSLLGLFPREVTIDFNNLIIFKALEVHGITGRHLWETWYTVSSLIQSGKLNLDPIITHKYKGFDKFEEAFELMRAGKTGKVVFFPHKG

SEQ ID NO: 32828 - DNA, 1035 bp, Rhizobium loti
  CDS (1)..(1035): transl_table=11
atgtcgaacatgatgaaggcgctggtgaaggccaaggccgaaccgggcatctggatggaagaggtgccggtgccggagatcggccccaacgacgtgctgatcaagatcaggaagacggcgatctgcggcaccgacgtgcacatctacaattgggaccagtgggcgcagaagaccgtgccggtgccgatggtgaccggccatgaatttgtcggcacggtggccgattttggcgccgcggtcaccgaatacaaggtcggccagcgcgtctcgggcgagggccacatcgtctgcggccactgccgcaactgccgcgccgggcgagggcatctctgccgcaacacgctcggcgtcggcgtcaaccgccccggcgccttcggcgagtatctggcgatcccgcaacacaatgtcgtgccgatccccgacgatgtgccggacgagatcgccgcgatcttcgatcccctgggcaatgcggtgcatacggcattatccttcgatcttgtcggcgaggacgtgctggtcaccggcgccgggccgatcggcatcatgggcgcgctcgttgcccaatgcgtgggcgcgcgaaaagtcgtcatcaccgatatcaacccggtgcggctggcgctggcgaagaaactcggtgtccagcatgtcgtcgacgcctcgaaggaaaagctgcgcgatgtcatgccagtgctcggcatgaccgagggttttgacgtcggcctcgaaatgtcgggcgccgcccccgccttccgcgacatgatcgacaccatgaacaatggcggcaagatcgccattctgggcatcgcgcccaccggcttcgagatcgactggaacaaggtcatcttcaagatgctgcatctcaaaggcatctacggccgcgaaatgttcgagacctggtacaagatgatcgcgctggtccagggtcctctggatgtttcgggcctgatcacgcaccgcatcggcatcgacgatttccaggaggggttcgatgcgatgcggagcggcagttccggcaaggtggtgatggattggtag

SEQ ID NO: 32829 - protein, 344 aa, Rhizobium loti
MSNMMKALVKAKAEPGIWMEEVPVPEIGPNDVLIKIRKTAICGTDVHIYNWDQWAQKTVPVPMVTGHEFVGTVADFGAAVTEYKVGQRVSGEGHIVCGHCRNCRAGRGHLCRNTLGVGVNRPGAFGEYLAIPQHNVVPIPDDVPDEIAAIFDPLGNAVHTALSFDLVGEDVLVTGAGPIGIMGALVAQCVGARKVVITDINPVRLALAKKLGVQHVVDASKEKLRDVMPVLGMTEGFDVGLEMSGAAPAFRDMIDTMNNGGKIAILGIAPTGFEIDWNKVIFKMLHLKGIYGREMFETWYKMIALVQGPLDVSGLITHRIGIDDFQEGFDAMRSGSSGKVVMDW

SEQ ID NO: 32830 - DNA, 1035 bp, Rhizobium meliloti
  CDS (1)..(1035): transl_table=11
atgaccaacatgatgaaggcactggtcaagacgaagccggaggtagggctctggatggagcgcgtgccggtgccggaaatcgggccgaacgacgtcctgatccgcgtcaggaaatcggcgatctgcggcaccgacgtccacatctggaactgggatcaatgggcggagaagacgatcccagtgccgatggtcgtcggacacgaattcatgggcgaggtcgtcgaggtcgggccggccgtcagcaagcatcatgtcggcgagcgggtttccggagaaggtcacatcgtctgcggcaaatgccgcaattgccgcgcgggcagggggcatctctgccgcaacacgctcggcgtcggcgtcaaccgccccggatccttcgccgagttcgtctgccttcccgaatataatgtcgtgtcgatccccgacgacgtgccggacgagatcgccgcaatcttcgatcccttcggcaacgccgtgcatacggcgctctccttcgatctcgtcggcgaggacgttctggtcaccggtgccgggccgatcggcatcatgggggcgatggtggccaagcgttgcggtgcccgcaaggtggtgatcaccgacatcaatcccgttcgtctcgatctcgcgcgcaagctcggcatcgaccacgtcgtcgacgcgtcgaaggaaaaacttgccgacgtcatgcgggtgatcggcatgaccgagggcttcgatgtggggctggaaatgtcgggcgcggcgcccgctttccgcgacatgatcgacaagatgaacaatggcggcaagattgcgatcctcggcattgcgccggcgggcttcgagatcgactggaacaaggtcatcttcaagatgctcaacctcaagggcatctacggtcgcgaaatgttcgagacctggtacaagatgatcgccttcgtccagggcgggctcgacctctcgccgataatcacccaccgtatcggcatcgacgattttcgcgacggcttcgaggcgatgcgctcgggcaattccggcaaggtggtgatggactggtag

SEQ ID NO: 32831 - protein, 344 aa, Rhizobium meliloti
MTNMMKALVKTKPEVGLWMERVPVPEIGPNDVLIRVRKSAICGTDVHIWNWDQWAEKTIPVPMVVGHEFMGEVVEVGPAVSKHHVGERVSGEGHIVCGKCRNCRAGRGHLCRNTLGVGVNRPGSFAEFVCLPEYNVVSIPDDVPDEIAAIFDPFGNAVHTALSFDLVGEDVLVTGAGPIGIMGAMVAKRCGARKVVITDINPVRLDLARKLGIDHVVDASKEKLADVMRVIGMTEGFDVGLEMSGAAPAFRDMIDKMNNGGKIAILGIAPAGFEIDWNKVIFKMLNLKGIYGREMFETWYKMIAFVQGGLDLSPIITHRIGIDDFRDGFEAMRSGNSGKVVMDW

SEQ ID NO: 32832 - DNA, 1026 bp, Shewanella oneidensis
  CDS (1)..(1026): transl_table=11
atgaaagcactaagcaagttaaaagccgaaaaaggcatttggttagtcgatgcgcctaagcctgaaatgggccataacgatctactgatcaagattaaaaagaccgccatttgcggcaccgacatgcacatctacaactgggacgaatggtcacaaaaaaccattcctgtgcctatggtggtaggtcacgagtatgtgggagaagtggttgatatcgggcaagaagttcgcggctttaacattggtgaccgtgtttctggcgaaggccatatcacctgcggccactgccgtaactgccgcgcgggtcgcacccacttatgccgtaacacctcaggtgtgggtgtaaaccgcgaaggttcatttgccgaatacttagtgatcccagcgtttaacgccttcaaaatccccgatgatatcagcgacgatttagcctctatctttgatccattcggtaacgcagtacacacggcactgtcattcgacttagtgggcgaagatgtgttgattactggcgcgggtcctatcggtattatggctgcggccgtatgtcgccacgttggtgcgcgccatgtagtgatcaccgacgttaacgaataccgtttagaactggcccgtaaaatgggtgccacacgtgccgtaaacgttgctcaagaaaacctcaaagacgtgatgaaagaactcggcatgaccgaagggtttgacgtcggcttagaaatgtctggcgtaccttctgccttccgtgccatgttagataccatgaaccacggtggcaaaatcgcgatgctcggtattccgggtggcgaaatggccattgattggagcaaagtgatcttcaaaggtttggtcattaaaggcatttacggtcgtgaaatgttcgaaacctggtacaagatggcaagccttatccaatctggcttagatatttcgcccatcattacccatcactacaaaattgatgatttccaaaaaggcttcgacgctatgggctcgggccaatcgggtaaagtcatcctcagctgggattaa

SEQ ID NO: 32833 - protein, 341 aa, Shewanella oneidensis
MKALSKLKAEKGIWLVDAPKPEMGHNDLLIKIKKTAICGTDMHIYNWDEWSQKTIPVPMVVGHEYVGEVVDIGQEVRGFNIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQENLKDVMKELGMTEGFDVGLEMSGVPSAFRAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 32834 - DNA, 1029 bp, Silicibacter pomeroyi
  CDS (1)..(1029)
atgaaagcgctggagaaatccaagcctgaggaagggttgtggatggtgcaggcaccggtgcccgagatcggccctgacgatgtgctgatcaagatcaagaagaccggcatttgcggcaccgatatccatatctggaactgggacgaatgggccgcgcacacggtgccggtgccgatgatcaccggccatgaatttgcgggcgagatcgtcgagctgggccgtgatgtcaccggcctcagcatcggtcagcgggtctcgggcgaggggcatctgatcggcaccgaaagccggcagagccgggcaggcaagttccacctggacccgggcacgcgcgggatcggtgtcaacgtgcagggggcctttgcgcaatatctgcgactgcccgccttcaacgtggtgccgctgcccgaggatatcccggacgagatcggcgccatcctcgacccgctgggcaatgcggtgcacaccgcgctgagtttcgacctcttgggcgaggatgtgctgatcaccggtgccgggccgatcggcatcatggcggcggcggtggccaaacatgccggcgcccgccatgtggtgatcaccgatatcaacgccgaccggctgaaactggcgcagcacgtggtgcccagggcgcggaccgtcgatgtcacgcgcgaggatctgggcgacgtggtccacgagcttggcctgaaacaggggttcgatgtcgggctggaaatgtcgggctcgcaagcggcgctcgaccagatggtcgaggcgctggtgatgggcggcaagatcgcgttgctgggtattccgccgggcaagtcgccggtggactggtcgcgcatcgtgttcaaggcgatcaccatcaagggtgtctatggccgcgagatgttcgagacctggtacaagatgatcgccatgttgcagaacgggctggatgtgagccgggtgatcacccatcgttttggcgtcgatgagttccgcgaagggtttgcggcgatgaaatcgggcctcagcggcaaggtggtgctggactggacctga

SEQ ID NO: 32835 - protein, 342 aa, Silicibacter pomeroyi
MKALEKSKPEEGLWMVQAPVPEIGPDDVLIKIKKTGICGTDIHIWNWDEWAAHTVPVPMITGHEFAGEIVELGRDVTGLSIGQRVSGEGHLIGTESRQSRAGKFHLDPGTRGIGVNVQGAFAQYLRLPAFNVVPLPEDIPDEIGAILDPLGNAVHTALSFDLLGEDVLITGAGPIGIMAAAVAKHAGARHVVITDINADRLKLAQHVVPRARTVDVTREDLGDVVHELGLKQGFDVGLEMSGSQAALDQMVEALVMGGKIALLGIPPGKSPVDWSRIVFKAITIKGVYGREMFETWYKMIAMLQNGLDVSRVITHRFGVDEFREGFAAMKSGLSGKVVLDWT

SEQ ID NO: 32836 - DNA, 1029 bp, Streptomyces avermitilis
  CDS (1)..(1029): transl_table=11
ttgaaggcgctggtcaaggagaaggcggagcccgggctctggctcatggacgtcccggagcccgagatcgggcccggcgacgtactgatcaaggtcctcaggaccgggatctgcggcaccgacctgcacatccggtcctgggacggctgggcgcagcaagccgtccgtaccccgctcgtgctcggtcacgagttcgtcggtgaggtcgtcgagaccggccgcgacgtcgtcgacatcaaggccggtgaccgggtcagcggcgagggccacctggtctgcggcaagtgccgcaactgccaggccggacgccgtcatctgtgccgtgcgacggtcgggctcggcgtcggccgggacggggcgttcgccgagtacgtggccctgcccgcggccaacgtctgggtgcaccgcgttcccgtcgacctcgacgtggccgcgatcttcgacccgttcggcaacgccgtgcacacggccctgtccttcccgctggtcggcgaggacgtgctcatcaccggggcgggcccgatcggcctgatggcggccgccgtggcccgtcacgccggcgcccgcaacgtcatgatcaccgacgtcagcgaggagcgcctggaactcgcccgcaagatcggcgtgagcctcgccctgaacgtcgccgacacgaccatcgccgacggccagcgcgcgctcggcctgcgcgagggcttcgacatcggtctggagatgtccggccgccccgaggccatgcgcgacatgatcgccaacatgacgcacggcggccgcatcgccatgctcggtctgccgtcccaggagttccccgtcgactgggcccggatcgtcacctccatgatcacgatcaagggcatctacggccgcgagatgttcgagacctggtacgcgatgtccgtcctcctcgaaggcggcctcgacctcgctcccgtgatcaccggccggtacggctaccgcgactacgaggcggcgttcgccgacgcggcgagcggccgcggcggcaaggtcatcctcgactggaccctctga

SEQ ID NO: 32837 - protein, 342 aa, Streptomyces avermitilis
MKALVKEKAEPGLWLMDVPEPEIGPGDVLIKVLRTGICGTDLHIRSWDGWAQQAVRTPLVLGHEFVGEVVETGRDVVDIKAGDRVSGEGHLVCGKCRNCQAGRRHLCRATVGLGVGRDGAFAEYVALPAANVWVHRVPVDLDVAAIFDPFGNAVHTALSFPLVGEDVLITGAGPIGLMAAAVARHAGARNVMITDVSEERLELARKIGVSLALNVADTTIADGQRALGLREGFDIGLEMSGRPEAMRDMIANMTHGGRIAMLGLPSQEFPVDWARIVTSMITIKGIYGREMFETWYAMSVLLEGGLDLAPVITGRYGYRDYEAAFADAASGRGGKVILDWTL

SEQ ID NO: 32838 - DNA, 1029 bp, Streptomyces coelicolor
  CDS (1)..(1029): transl_table=11
ttgaaggcgctggtcaaggagaacgcggagcccgggctgtggctcgcggacgtcccggagcccaccatcgggtccggtgacgtcctcatcaaggtgctgcgcaccggcatctgcggcaccgacctgcacatccgggcctgggacggctgggcgcagcaggccatccgcaccccgctcgtcgtcggccacgagttcgtcggcgaggtcgtcgacaccgggcgcgacgtcaccgacatcaaggccggcgaccgggtcagcggcgagggccacctggtctgcggcaagtgccgcaactgcctggccggccggcgccacctgtgccgcgccaccgtcggcctcggcgtcggccgggacggggcgttcgccgagtacgtggccctgcccgcgtccaacgtctgggtgcaccgcgtccccgtcgacctcgacgtcgccgcgatcttcgacccgttcggcaacgccgtgcacaccgcgctgtccttcccgctggtcggcgaggacgtcctcatcaccggcgccggaccgatcggcctgatggccgccgccgtggcccggcacgccggcgcccgcaacgtcgtcatcacggacgtgagcgaggagcggctggaactggcccgcaaggtcggcgccaccctcgccctgaacgtttcggacgccaccatcgccgacggacagcgcgaactgggcctgcgcgagggcttcgacatcggcctggagatgtccggccgtcccgaggccatgcgcgacatgatcgccaacatgacgcacggcggccggatcgccatgctcggcctgcccgccgaggagttcccggtcgactgggcccgcgtcgtcacctccatgatcaccgtcaagggcatctacggccgcgagatgttcgagacctggtacgccatgtccgtgctgctcgaaggcggcctcgacctcgcccccgtgatcaccggccgctactcccaccgcgacttcgaggccgcgttcgccgacgcggcgagcggccgcggcggcaaggtcatcctcgactggaccgcgtaa

SEQ ID NO: 32839 - protein, 342 aa, Streptomyces coelicolor
MKALVKENAEPGLWLADVPEPTIGSGDVLIKVLRTGICGTDLHIRAWDGWAQQAIRTPLVVGHEFVGEVVDTGRDVTDIKAGDRVSGEGHLVCGKCRNCLAGRRHLCRATVGLGVGRDGAFAEYVALPASNVWVHRVPVDLDVAAIFDPFGNAVHTALSFPLVGEDVLITGAGPIGLMAAAVARHAGARNVVITDVSEERLELARKVGATLALNVSDATIADGQRELGLREGFDIGLEMSGRPEAMRDMIANMTHGGRIAMLGLPAEEFPVDWARVVTSMITVKGIYGREMFETWYAMSVLLEGGLDLAPVITGRYSHRDFEAAFADAASGRGGKVILDWTA

SEQ ID NO: 32840 - DNA, 1056 bp, Symbiobacterium thermophilum
  CDS (1)..(1056): transl_table=11
gtggcagaaacgatgcgtgctttgcgaaaactggaagctggtcctggcgcgacactgcaggaggttccgatcccgaccatcggcccccgcgacgtcctggtgaaggtccgggcggcctcgatctgcggcacggactaccacatctacacctgggatccgtggtccgcgggccgggtgaagccgccgctcaccattgggcacgagctggccggtgaggtggtggccgtcggccgcgaggtcaccgcatgcaaggtgggcgactacgtctctgccgaaacgcacattgtttgcaaccgctgtccccgctgccacatgggggagtaccacctctgcgagaacacgaagatcctgggggtggacacggacggcgccttcgccgagtacgtcgcggtgccggagcagaacatctgggtgaacgacaaggacatcccctttgagctgcagtcgattcaggagccgctgggcaacgcggtccacacggccctgaacggcgacctcaccgcccggtccgtgctgatcaccggctgcggccccatcggcatcatgtcggtccccgtggccaagatggccggcgcggagatcgtgatggcgatggacatcaacgaataccggctgcagctggcgggccagctgggggccgacgtgctcatcaaccccacgaagcaggatccggtcgaggtggtgcgcagctacacccgcggctacggcgccgacgtggtgctggagatgtcgggtaaccccaccgccatccggcaggggctgaaggccgcccgcaacggcgcccgcatctcgctcctcggtctgcccggccggccgctggagctggacctggcagcggacgtgatcatgcggggcctggtgctgcagggcatcaccggccgccggatgtggcagacctggtatcaggtgcgttccctctaccgggccgggctggcggagcggctgcggccgctggtgacgcaccggatgccgctggagcagatcgacgccgccatggagctcatgggttccggccagagcggcaagatagtgctggtgcctgacctgaaggcgtga

SEQ ID NO: 32841 - protein, 351 aa, Symbiobacterium thermophilum
MAETMRALRKLEAGPGATLQEVPIPTIGPRDVLVKVRAASICGTDYHIYTWDPWSAGRVKPPLTIGHELAGEVVAVGREVTACKVGDYVSAETHIVCNRCPRCHMGEYHLCENTKILGVDTDGAFAEYVAVPEQNIWVNDKDIPFELQSIQEPLGNAVHTALNGDLTARSVLITGCGPIGIMSVPVAKMAGAEIVMAMDINEYRLQLAGQLGADVLINPTKQDPVEVVRSYTRGYGADVVLEMSGNPTAIRQGLKAARNGARISLLGLPGRPLELDLAADVIMRGLVLQGITGRRMWQTWYQVRSLYRAGLAERLRPLVTHRMPLEQIDAAMELMGSGQSGKIVLVPDLKA

SEQ ID NO: 32842 - DNA, 1032 bp, Thermus thermophilus
  CDS (1)..(1032): transl_table=11
atgcgcgctttggccaagctggccccggaggagggcctaaccctggtggaccgccccgtgcccgagccgggccccggggagatcctggtgcgggtggaggcggcgagcatctgcggcaccgacctccacatctggaagtgggacgcctgggcccgggggaggatcaggccccccctcgtcaccgggcacgagttcagcggggtggtggaggccgtgggccccggggtgaagcgcccccaggtgggggaccacgtgagcctagaaagccacgtggtctgccacgcctgccccgcctgccgcacggggaactaccacgtctgcttgaacacaaagatcctcggcgtggaccgggacggcggcttcgccgagtacgtggtggtgccggcggagaacgcctgggtgaaccccaaggaccttccctttgaggtggcggccatcctcgagcccttcggcaacgccgtgcacaccgtctacgcgggaagcggggtctcggggaagagcgtcctcatcacgggggcggggcccatcggcctcatggcggccatggtggcccgggcgagcggggcggggcccatcctcgtctccgacccgaacccctaccgcctggccttcgccaggccctacgccgaccggctggtgaaccccttggaggaggacctcctggaggtggtgcgccgggtgacgggaagcggggtggaggtgcttttggagttttctgggaacgaggccgccatccaccagggcctcatggccctcatccccgggggggaggcgaggatcttggggatcccttccgaccccatccgctttgacctcgccggggagctcgtgatgcgggggatcaccgccttcggcatcgccgggcggaggctctggcagacctggatgcagggcaccgccttggtctactcgggtagggtggacctaagccccctcatcacccaccgcctccccttgagccgctaccgggaggccttcggcctcctcgcctcgggccaggcggtgaaggtgatcctggacccgaaggcctaa

SEQ ID NO: 32843 - protein, 343 aa, Thermus thermophilus
MRALAKLAPEEGLTLVDRPVPEPGPGEILVRVEAASICGTDLHIWKWDAWARGRIRPPLVTGHEFSGVVEAVGPGVKRPQVGDHVSLESHVVCHACPACRTGNYHVCLNTKILGVDRDGGFAEYVVVPAENAWVNPKDLPFEVAAILEPFGNAVHTVYAGSGVSGKSVLITGAGPIGLMAAMVARASGAGPILVSDPNPYRLAFARPYADRLVNPLEEDLLEVVRRVTGSGVEVLLEFSGNEAAIHQGLMALIPGGEARILGIPSDPIRFDLAGELVMRGITAFGIAGRRLWQTWMQGTALVYSGRVDLSPLITHRLPLSRYREAFGLLASGQAVKVILDPKA

SEQ ID NO: 32844 - DNA, 1032 bp, Thermus thermophilus
  CDS (1)..(1032): transl_table=11
atgcgcgctttggccaagctggccccggaggagggcctgaccctggtggaccgccccgtgcccgagccgggccccggggagatcctggtgcgggtggaggcggcgagcatctgcggcaccgacctccacatctggaagtgggacgcctgggcccggggcaggatccgccctcccctcgtcaccgggcacgagttcagcggggtggtggaggccgtgggccccggggtgaggcgaccccaggtgggggaccacgtgagcctggaaagccacatcgtctgccacgcctgccccgcctgccgcacggggaactaccacgtttgcctcaacacccagatcctcggcgtggaccgggacggcggcttcgccgagtacgtggtggtgccggcggagaacgcctgggtgaaccccaaggaccttccctttgaggtggcggccatcctggagcccttcggcaacgccgtgcacaccgtctacgcgggaagcggggtttcggggaagagcgtcctcatcacgggggcggggcccatcggcctcatggcggccatggtggtccgggcgagcggggcggggcccatcctggtctccgacccgaacccctaccgcctggccttcgccaggccctacgccgaccggctggtgaaccccttggaggaggacctcctggaggtggtgcgccgggtgacgggaagcggggtggaggtgcttttggagttttctgggaacgaggccgccatccaccagggcctcatggccctcatccccgggggggaggcgaggatcttggggatcccttccgaccccatccgctttgacctcgccggggagctcgtcatgcgggggatcaccgccttcggcatcgccgggcgcaggctctggcagacctggatgcagggcaccgccttggtctactcgggtagggtggacctaagccccctcctcacccaccgcctccccttgagccgctaccgggaggccttcggccttctggcctcgggccaggcggtgaaggtgatcctggacccgaaggcctaa

SEQ ID NO: 32845 - protein, 343 aa, Thermus thermophilus
MRALAKLAPEEGLTLVDRPVPEPGPGEILVRVEAASICGTDLHIWKWDAWARGRIRPPLVTGHEFSGVVEAVGPGVRRPQVGDHVSLESHIVCHACPACRTGNYHVCLNTQILGVDRDGGFAEYVVVPAENAWVNPKDLPFEVAAILEPFGNAVHTVYAGSGVSGKSVLITGAGPIGLMAAMVVRASGAGPILVSDPNPYRLAFARPYADRLVNPLEEDLLEVVRRVTGSGVEVLLEFSGNEAAIHQGLMALIPGGEARILGIPSDPIRFDLAGELVMRGITAFGIAGRRLWQTWMQGTALVYSGRVDLSPLLTHRLPLSRYREAFGLLASGQAVKVILDPKA

SEQ ID NO: 32846 - DNA, 1044 bp, Thermoanaerobacter tengcongensis
  CDS (1)..(1044)
atggatggacttatgaccgccgtggtaaaacaataccacaaagaaggggcagatatagtaaaaaaggaaataccaaagataggccctgatgaagttttgataaaagttaaagctacttctatttgcggcacagacgttcacatatacgtctggaatgaatgggcaaaaagtagaataaaacctccaaaaacgatgggacacgaatttgtaggagaggttgtagaaattggagaaaatgtcacatcagtaaaagtgggagacttagtaagcgcagaaactcatatagtatgcggaaagtgcagagcctgcagaaccggcaacgctcacatatgtgaaaataccctcattttaggcgttgacacagatggagcttttgcagaatacatcaaagttcctgaaagcaatgtgtggataaacgacaaaaacatacctctagagatactatccatacaggaacctcttggaaacgcagtccacactgttttttcaggagacgtagttggaaaatctgtagctgtcataggatgcggcccaataggaatgatggcaataccacttcttaaaagaacaggtgctgcagcaatattcgcgattgaacctgctgactacaggagagagttggctcacaagcttggtgcaacaagggttataaatcctctccgcgaagacgttgtcagcataataaaaagtgaaacagaaggctatggagcagatgtagttttggacttttcaggtaacccaaccgccataaggcagggtctagagtacattgcaaaaggtggcagaatgtctattctaggccttcctgacaatgaagttccaattgacatcacaaataatgtggtattcaaaggaataactatacaaggcataactggaagaagaatgtacgatacctggtacaccgtaaagggcttactaaaatcaggtcttgcagaagatttaaagccaataatcacccacacattccctcttaccgaataccagaagggaatggaactcatgataaaagggcagtgcggtaaagtcgtattatatccgtaa

SEQ ID NO: 32847 - protein, 347 aa, Thermoanaerobacter tengcongensis
MDGLMTAVVKQYHKEGADIVKKEIPKIGPDEVLIKVKATSICGTDVHIYVWNEWAKSRIKPPKTMGHEFVGEVVEIGENVTSVKVGDLVSAETHIVCGKCRACRTGNAHICENTLILGVDTDGAFAEYIKVPESNVWINDKNIPLEILSIQEPLGNAVHTVFSGDVVGKSVAVIGCGPIGMMAIPLLKRTGAAAIFAIEPADYRRELAHKLGATRVINPLREDVVSIIKSETEGYGADVVLDFSGNPTAIRQGLEYIAKGGRMSILGLPDNEVPIDITNNVVFKGITIQGITGRRMYDTWYTVKGLLKSGLAEDLKPIITHTFPLTEYQKGMELMIKGQCGKVVLYP

SEQ ID NO: 32848 - DNA, 1032 bp, Vibrio cholerae
  CDS (1)..(1032): transl_table=11
atgaaaatcaaagcactttcaaaactgaaaccagagcagggcatctggatgaacgaagtggacatgcctgagcttggccacaacgacctgctgatcaaaattaagaaaactgccatttgtggcactgacgtacacatttataactgggatgagtggtcacaaaaaaccattccagtgcctatggtagtcggccatgaatatgtgggtgaagtggttgggattggccaagaagtgcgtggtttccaaattggagatcgcgtttctggtgaaggtcacatcacttgtggtcactgccgtaactgccgtggtggccgtacccacctgtgccgcaacaccattggtgtgggcgtaaaccgcacgggttgtttctctgaatacttagtgatcccagcgtttaacgcattcaagatcccggatggtatttcagatgatctggcgtctattttcgacccgtttggaaacgctgtacacactgcgctttcattcgacttagtgggtgaagatgttctgatcaccggtgctggcccaatcggcattatggccgcagctgttgcgaaacatgtaggtgcgcgccatgtggtgatcaccgatgtgaacgaataccgcctcgatttagcccgtaaaatgggcgtgactcgcgctgtgaacgttgctgagcaaaacctagaagacgtgatgaaagaactcggtatgaccgaaggttttgatgtgggcttagagatgtctggtgtaccgagtgcgtttagcgccatgctaaaaaccatgaaccacggtggccgcattgctctgttaggtattccaccgtcatcgatggcgattgattggaaccaagtgatcttcaaaggccttgttattaaagggatttatggaagggaaatgtttgaaacttggtataagatggcgagcctgatccaatcgggtctcgatatcagcccaattatcactcaccacttcaaagtggatgacttccaaaaaggcttcgacatcatgcgcagcggggcttctggcaaagttatcctcgattggcagtaa

SEQ ID NO: 32849 - protein, 343 aa, Vibrio cholerae
MKIKALSKLKPEQGIWMNEVDMPELGHNDLLIKIKKTAICGTDVHIYNWDEWSQKTIPVPMVVGHEYVGEVVGIGQEVRGFQIGDRVSGEGHITCGHCRNCRGGRTHLCRNTIGVGVNRTGCFSEYLVIPAFNAFKIPDGISDDLASIFDPFGNAVHTALSFDLVGEDVLITGAGPIGIMAAAVAKHVGARHVVITDVNEYRLDLARKMGVTRAVNVAEQNLEDVMKELGMTEGFDVGLEMSGVPSAFSAMLKTMNHGGRIALLGIPPSSMAIDWNQVIFKGLVIKGIYGREMFETWYKMASLIQSGLDISPIITHHFKVDDFQKGFDIMRSGASGKVILDWQ

SEQ ID NO: 32850 - DNA, 1032 bp, Vibrio fischeri
  CDS (1)..(1032): transl_table=11
atgaaaattaaagcgctttcaaaattaaaacctgaagaaggtatctggctaactgaggttgaaaaacctgagatgggtcataacgatcttcttatccgcattaagaaaactgccatctgtggtaccgatgtacatatctacaactgggacgaatggtcacaaaaaacaattccagtacctatggttgttggtcacgagtatgtaggtgaagttgttggtattggtcaagaagtgcgtggttttgaaattggagaccgcgtttcaggtgaaggtcacataacttgtggtcattgtcgtaactgtcgtggcggccgtactcacctttgtcgtaatacaacaggcgtaggtgtaaaccgtactggtgctttttctgaatacctagtgattcctgctttcaatgcatttaagatccctgctggcatttcagatgacttagcatcaatctttgacccatttggaaacgcagttcacactgctctatcatttgatttagttggtgaagacgttctaatcacgggtgctggtcctattggcatcatggcggcggctgttgcaaaacatgttggtgcacgtcacgtcgtgattactgatgtgaatgaataccgcttagatcttgctaagaaaatgggcgtaactcgtgccgtaaacgtaatgaacgagaagcttgaagatgtgatgtctgagcttggcatgacagaaggctttgatgtcggtttggaaatgtctggtaatccatcagcatttaatagcatgctaactaacatgaaccatggcggtaaaatatctcttctaggtattccaccatcagacatgactgttgattggaaccaagttatctttaaaggcttagtcatcaaaggcatttacggacgcgagatgtttgaaacttggtataagatggcaagcttaattcaatcaggcttagatctaacaccaattatcacgcaccactataagattgatgacttccaagcaggcttcgatatgatgcgctctggtatgtctggtaaagttattctagattgggaataa

SEQ ID NO: 32851 - protein, 343 aa, Vibrio fischeri
MKIKALSKLKPEEGIWLTEVEKPEMGHNDLLIRIKKTAICGTDVHIYNWDEWSQKTIPVPMVVGHEYVGEVVGIGQEVRGFEIGDRVSGEGHITCGHCRNCRGGRTHLCRNTTGVGVNRTGAFSEYLVIPAFNAFKIPAGISDDLASIFDPFGNAVHTALSFDLVGEDVLITGAGPIGIMAAAVAKHVGARHVVITDVNEYRLDLAKKMGVTRAVNVMNEKLEDVMSELGMTEGFDVGLEMSGNPSAFNSMLTNMNHGGKISLLGIPPSDMTVDWNQVIFKGLVIKGIYGREMFETWYKMASLIQSGLDLTPIITHHYKIDDFQAGFDMMRSGMSGKVILDWE

SEQ ID NO: 32852 - DNA, 1032 bp, Vibrio parahaemolyticus
  CDS (1)..(1032): transl_table=11
atgaaaattaaagcactatcaaagctaaagcctgaacaaggcatttggatgaccgaagtagacaaacctgaggttggccataacgacattctgatcaaaattaagaaaactgcgatttgtggtacagacgtacacatttacaactgggacgaatggtcacaaaaaaccattccagtacctatggttgtcggtcacgaatacgtgggtgaagtggtcgcgattggtcaggaagttcgtggctttgaaatcggtgaccgcgtatctggcgaaggtcacatcacgtgtggtcactgtcgtaactgtcgtggcggtcgtactcacttatgccgtaacactatcggtgtgggtgtaaaccgtgaaggcgcatttgcagaatacttggttatcccagcgttcaacgcgttcaagatcccagacgagatctctgacgatctagcgtctatctttgacccgtttggtaacgcagtacacaccgcactttctttcgaccttgtgggtgaagacgtgctgatcacaggtgctggcccaatcggcatcatggcggcagcggttgctaaacacgttggtgctcgtcatgtggttatcacagacgtaaacgaataccgtctagagcttgctcgtaaaatgggcgtaacacgtgcagtaaacgtggctgaagagaagcttgaagatgtaatggctgaactaggcatgacagaaggcttcgacgtaggtcttgaaatgtcgggtaacccagcggcattcaactcaatgctaacaacaatgaatcatggtggtcgtattgctctgttgggtattccgccatcagacatgggtatcgactggaaccaagtgatcttcaaaggtttggttatcaaaggcatttacggccgtgaaatgttcgaaacgtggtacaagatggcttcactgattcaatctggtttggatctatcgccaatcatcacgcaccactacaagattgatgatttccaagaaggctttgacgttatgcgctctggcatgtcgggcaaagttattcttgattgggaatag

SEQ ID NO: 32853 - protein, 343 aa, Vibrio parahaemolyticus
MKIKALSKLKPEQGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPDEISDDLASIFDPFGNAVHTALSFDLVGEDVLITGAGPIGIMAAAVAKHVGARHVVITDVNEYRLELARKMGVTRAVNVAEEKLEDVMAELGMTEGFDVGLEMSGNPAAFNSMLTTMNHGGRIALLGIPPSDMGIDWNQVIFKGLVIKGIYGREMFETWYKMASLIQSGLDLSPIITHHYKIDDFQEGFDVMRSGMSGKVILDWE

SEQ ID NO: 32854 - DNA, 1032 bp, Vibrio vulnificus
  CDS (1)..(1032): transl_table=11
atgaaaatcaaagcactatcaaagctaaagccagaagaaggcatttggatgaccgaagtggacaagcctgttcttggccacaacgatctgctgatcaaaattaagaaaaccgcgatttgtggtaccgacgtacacatctacaactgggacgaatggtcacaaaaaaccatcccagtacctatggtggttggccatgaatacgtgggtgaagtggttggcattggccaagaagttcgtggttttgagatcggtgaccgcgtttctggcgaaggtcacatcacttgtggccactgtcgtaactgccgtggtggccgcacgcacttgtgccgcaacaccattggtgtgggcgtaaaccgcacaggttgtttctctgaataccttgtgatcccagcgttcaacgcctttaaaatccctgcaaacatctctgatgatcttgcgtctatcttcgacccgtttggcaacgcagtacacactgcactgtcgttcgatctggttggtgaagatgtactgatcaccggcgctggcccaatcggcattatggcggctgcggtcgcgaagcacgttggtgcgcgccacgtcgtgatcaccgatgtgaacgaataccgtctagacctcgcacgcaaaatgggtgtgactcgcgcggtgaacgttgccgagcagaaacttgacgatgtgatggcagagctaggcatgacagaaggcttcgatgtgggcctggaaatgtcgggcaacccatcagcattcaactcaatgctgaaaaccatgaaccacggtggccgcattgcactgcttggcattccaccatcagacatgggcatcgattggaaccaagtgatcttcaaaggcttggtgatcaaaggtatctatggccgtgaaatgtttgaaacttggtacaagatggcaagcttgattcaatctggccttgacctaacaccaattatcactcaccacttcaaagtggatgatttccagcaaggcttcgacatcatgcgcagcggcatgtcaggcaaagtgatccttgattgggaataa

SEQ ID NO: 32855 - protein, 343 aa, Vibrio vulnificus
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMAELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 32856 - DNA, 1032 bp, Vibrio vulnificus
  CDS (1)..(1032): transl_table=11
atgaaaatcaaagcactatcaaagctaaagccagaagaaggcatttggatgaccgaagtggacaagcctgttcttggccacaacgatctgctgatcaaaattaagaaaaccgcgatttgtggtaccgacgtacacatctacaactgggacgaatggtcacaaaaaaccatcccagtacctatggtggttggtcatgaatacgtgggtgaagtggttggcattggccaagaagttcgtggttttgaaatcggcgaccgcgtttctggcgaaggtcacatcacttgtggccactgtcgtaactgccgtggtggccgcacgcacttgtgccgcaacacaattggtgtgggcgtaaaccgcacaggttgtttctctgaatatcttgtgatcccagcgttcaacgcttttaagatccctgcaaacatctctgatgatcttgcgtctatcttcgacccgtttggcaacgcagtacacactgcactgtcgttcgatctggttggtgaagacgtactgatcaccggcgctggcccaatcggcatcatggcggctgcggtagcgaagcacgttggtgcgcgccacgtcgtgatcaccgatgtgaacgaataccgtctagacctcgcacgcaaaatgggcgtgactcgcgcagtgaacgttgctgagcagaagcttgacgatgtgatggtagagctaggcatgacagaaggcttcgacgtgggcctagaaatgtcgggcaacccttcagcattcaactcaatgctgaaaaccatgaaccacggtggtcgtattgcactgctcggcattccaccatcagacatgggtatcgactggaaccaagtgatcttcaaaggcttggtgatcaaaggtatctatggccgtgaaatgtttgaaacttggtacaagatggcaagcttgattcaatctggccttgacctaacaccaattatcactcaccacttcaaagtggatgacttccagcaaggcttcgacatcatgcgcagcggcatgtcaggcaaagtgattcttgattgggaataa

SEQ ID NO: 32857 - protein, 343 aa, Vibrio vulnificus
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMVELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 32858 - DNA, 1023 bp, Xanthomonas campestris pv
  CDS (1)..(1023): transl_table=11
atgaaggcgctggtcaagcgcgaagcgagcaagggcatctggctggaacaggtccccgtgcccaccccgggcccgaatgaggtcctgatcaagctggaaaagaccgccatctgcggcaccgacctgcatatctacctgtgggatgagtggagccaacgcaccattacgccgggcctgaccatcggccacgagttcgtcggccgcgtggccgagctcggttcggcggtgaccggctaccaggtcggccagcgcgtgtcggccgaaggccacatcgtctgcgggcattgccgcaactgccgtggcggccgcccgcacctgtgccccaacacggtgggcatcggcgtcaacgtcaacggcgcctttgccgaatacatggtgatgccggccagcaacctgtggccgatccccgaccagatcccctccgagctggccgccttcttcgacccctacggcaacgccgcgcattgcgcgctggaattcgatgtcatcggcgaagacgtgctgatcaccggcgccggcccgatcggcatcattgccgccggcatctgcaagcacatcggtgcgcgcaatgtggtggtcaccgacgtcaacgacttccgcctcaagctggccgccgacctgggcgccacgcgcgtggtcaacgtgtccaagacctcgctcaaggacgtcatggccgacctgcacatggaaggcttcgacgtgggcctggaaatgagcggcaacccgcgcgcgttcaacgacatgctcgattgcatgtaccacggcggcaagatcgcgatgctcggcatcatgccgcgcggcgccggttgcgattgggacaagatcatcttcaagggcctcaccgtgcagggcatctacggacgcaagatgtacgagacctggtacaagatgacccagctggtgctatcgggttttccgctgcagaaagtgctgacccaccagttgtcgatcgacgagttccagaaggggttcgacctgatggaagaaggcaaggccggcaaggttgtgttgagctggaactga

SEQ ID NO: 32859 - protein, 340 aa, Xanthomonas campestris pv
MKALVKREASKGIWLEQVPVPTPGPNEVLIKLEKTAICGTDLHIYLWDEWSQRTITPGLTIGHEFVGRVAELGSAVTGYQVGQRVSAEGHIVCGHCRNCRGGRPHLCPNTVGIGVNVNGAFAEYMVMPASNLWPIPDQIPSELAAFFDPYGNAAHCALEFDVIGEDVLITGAGPIGIIAAGICKHIGARNVVVTDVNDFRLKLAADLGATRVVNVSKTSLKDVMADLHMEGFDVGLEMSGNPRAFNDMLDCMYHGGKIAMLGIMPRGAGCDWDKIIFKGLTVQGIYGRKMYETWYKMTQLVLSGFPLQKVLTHQLSIDEFQKGFDLMEEGKAGKVVLSWN

SEQ ID NO: 32860 - DNA, 1026 bp, Yersinia pestis
  CDS (1)..(1026): transl_table=11
atgaaagcactttctaaactgaaagcagaagaaggcatttggatgaccgatgtgccacagccagagctgggtcacaacgatatcatgatcaaaattcgcaaaacggctatctgtggtactgacgtacatatttataattgggatgaatggtcacaaaaaaccatccccgtacccatggtcgttggccatgaatatgtcggtgaagtggtggccattgggcaggaagttaaagggtttaatattggtgaccgggtgtctggtgaaggccatattacctgtggtcactgccgtaactgccgtggtggtcgtacccacctttgtcgtaatacggtgggtgttggcgtgaatcgccctggttcgtttgccgaatatttggtgatccctgcttttaacgcgttcaagatcccagacaatatttctgatgagcttgcggctatttttgaccccttcggcaatgcagttcataccgcgttatcttttgatttagtcggcgaggatgtgttggtctccggggctggcccaattggtattatggccgccgcagtctgtaagcatgtgggtgctcgtcatgttgtcatcgctgatgtgaatgaatatcgcctggatctggcccgtaaaatgggcgtgacccgtgccgttaacgtcagcaaagagaacctaaatgacgttatgacggaattgggcatgaccgaagggtttgatgtgggcttggagatgtcaggtgctcccccggctttccgttcattacttaattcaatgaatcatggtggtcgtatagcgatgctgggaataccgccgtctgatatgtcgatcgactggaatcaggttatctttaaggggctgtttataaaggggatttatggccgtgagatgttcgaaacctggtacaaaatggccgcgttgattcaatctggtttggacttaactccgatcattacccaccgtttccctattgatgaattccagcaagggtttgacgccatgcgttcgggtaaatcaggcaaagtggtattaagctgggattag

SEQ ID NO: 32861 - protein, 341 aa, Yersinia pestis
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVIADVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 32862 - DNA, 1026 bp, Yersinia pseudotuberculosis
  CDS (1)..(1026): transl_table=11
atgaaagcactttctaaactgaaagcagaagaaggcatttggatgaccgatgtgccacagccagagctgggtcacaacgatatcatgatcaaaattcgcaaaacggctatctgtggtactgacgtacatatttataattgggatgaatggtcacaaaaaaccatccccgtacccatggtcgttggccatgaatatgtcggtgaagtggtggccattgggcaggaagttaaagggtttaatattggtgaccgggtgtctggtgaaggccatattacctgtggtcactgccgtaactgccgtggtggtcgtacccacctttgtcgtaatacggtgggtgttggcgtgaatcgccctggttcgtttgccgaatatttggtgatccctgcttttaacgcgttcaagatcccagacaatatttctgatgagcttgcggctatttttgaccccttcggcaatgcagttcataccgcgttatcttttgatttagtcggcgaggatgtgttggtctccggggctggcccaattggtattatggccgccgcagtctgtaagcatgtgggtgctcgtcatgttgtcatcactgatgtgaatgaatatcgccttgatctggcccgtaaaatgggcgtgacccgtgccgttaacgtcagcaaagagaacctaaatgacgttatgacggaattgggcatgaccgaagggtttgatgtgggcttggagatgtcaggtgctcccccggctttccgttcattacttaattcaatgaatcatggtggtcgtatagcgatgctgggaataccgccatctgatatgtcgatcgactggaatcaggttatctttaaggggctgtttataaaggggatttatggccgtgagatgttcgaaacctggtacaaaatggccgcgttgattcaatctggtttggacttaactccgatcattacccaccgtttccctattgatgaattccagcaagggtttgacgccatgcgttcgggtaaatcaggcaaagtggtattaagctgggattag

SEQ ID NO: 32863 - protein, 341 aa, Yersinia pseudotuberculosis
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVITDVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 32864 - DNA, 25 bp, Artificial sequence
  (1)..(25): primer
atgaaagcgttatccaaactgaaag

SEQ ID NO: 32865 - DNA, 24 bp, Artificial sequence
  (1)..(24): primer
ttaatcccagctcagaataacttt

SEQ ID NO: 32866 - protein, 375 aa, Artificial sequence
  Variant (2)..(3): xaa in position 2 to 3 is any amino acid
  Variant (5)..(5): xaa in position 5 is any amino acid
  Variant (7)..(11): xaa in position 7 to 11 is any amino acid
  Variant (13)..(20): xaa in position 13 to 20 is any amino acid
  Variant (21)..(21): xaa in position 21 is any or no amino acid
  Variant (23)..(24): xaa in position 23 to 24 is any amino acid
  Variant (26)..(27): xaa in position 26 to 27 is any amino acid
  Variant (28)..(28): xaa in position 28 is any or no amino acid
  Variant (35)..(38): xaa in position 35 to 38 is any amino acid
  Variant (48)..(48): xaa in position 48 is any amino acid
  Variant (50)..(51): xaa in position 50 to 51 is any amino acid
  Variant (54)..(55): xaa in position 54 to 55 is any amino acid
  Variant (56)..(64): xaa in position 56 to 64 is any or no amino acid
  Variant (66)..(67): xaa in position 66 to 67 is any or no amino acid
  Variant (69)..(70): xaa in position 69 to 70 is any amino acid
  Variant (75)..(76): xaa in position 75 to 76 is any amino acid
  Variant (78)..(78): xaa in position 78 is any amino acid
  Variant (80)..(81): xaa in position 80 to 81 is any amino acid
  Variant (84)..(85): xaa in position 84 to 85 is any amino acid
  Variant (87)..(90): xaa in position 87 to 90 is any amino acid
  Variant (93)..(93): xaa in position 93 is any amino acid
  Variant (97)..(97): xaa in position 97 is any amino acid
  Variant (99)..(99): xaa in position 99 is any amino acid
  Variant (100)..(100): xaa in position 100 is any or no amino acid
  Variant (103)..(103): xaa in position 103 is any amino acid
  Variant (106)..(106): xaa in position 106 is any amino acid
  Variant (108)..(109): xaa in position 108 to 109 is any amino acid
  Variant (112)..(112): xaa in position 112 is any amino acid
  Variant (114)..(115): xaa in position 114 to 115 is any amino acid
  Variant (119)..(123): xaa in position 119 to 123 is any amino acid
  Variant (127)..(129): xaa in position 127 to 129 is any amino acid
  Variant (130)..(134): xaa in position 130 to 134 is any or no amino acid
  Variant (136)..(136): xaa in position 136 is any amino acid
  Variant (139)..(139): xaa in position 139 is any amino acid
  Variant (142)..(142): xaa in position 142 is any amino acid
  Variant (145)..(148): xaa in position 145 to 148 is any amino acid
  Variant (150)..(151): xaa in position 150 to 151 is any amino acid
  Variant (153)..(154): xaa in position 153 to 154 is any amino acid
  Variant (155)..(155): xaa in position 155 is any or no amino acid
  Variant (157)..(158): xaa in position 157 to 158 is any amino acid
  Variant (160)..(160): xaa in position 160 is any amino acid
  Variant (164)..(164): xaa in position 164 is any amino acid
  Variant (167)..(167): xaa in position 167 is any amino acid
  Variant (169)..(169): xaa in position 169 is any amino acid
  Variant (173)..(180): xaa in position 173 to 180 is any amino acid
  Variant (181)..(181): xaa in position 181 is any or no amino acid
  Variant (183)..(184): xaa in position 183 to 184 is any amino acid
  Variant (188)..(188): xaa in position 188 is any amino acid
  Variant (190)..(190): xaa in position 190 is any amino acid
  Variant (198)..(201): xaa in position 198 to 201 is any amino acid
  Variant (203)..(204): xaa in position 203 to 204 is any amino acid
  Variant (207)..(208): xaa in position 207 to 208 is any amino acid
  Variant (211)..(211): xaa in position 211 is any amino acid
  Variant (215)..(217): xaa in position 215 to 217 is any amino acid
  Variant (218)..(218): xaa in position 218 is any or no amino acid
  Variant (221)..(222): xaa in position 221 to 222 is any amino acid
  Variant (224)..(225): xaa in position 224 to 225 is any amino acid
  Variant (228)..(231): xaa in position 228 to 231 is any amino acid
  Variant (232)..(232): xaa in position 232 is any or no amino acid
  Variant (235)..(237): xaa in position 235 to 237 is any amino acid
  Variant (238)..(247): xaa in position 238 to 247 is any or no amino acid
  Variant (249)..(254): xaa in position 249 to 254 is any amino acid
  Variant (255)..(262): xaa in position 255 to 262 is any or no amino acid
  Variant (264)..(264): xaa in position 264 is any amino acid
  Variant (267)..(267): xaa in position 267 is any amino acid
  Variant (270)..(270): xaa in position 270 is any amino acid
  Variant (273)..(275): xaa in position 273 to 275 is any amino acid
  Variant (277)..(280): xaa in position 277 to 280 is any amino acid
  Variant (282)..(283): xaa in position 282 to 283 is any amino acid
  Variant (285)..(286): xaa in position 285 to 286 is any amino acid
  Variant (289)..(289): xaa in position 289 is any amino acid
  Variant (291)..(291): xaa in position 291 is any amino acid
  Variant (296)..(306): xaa in position 296 to 306 is any amino acid
  Variant (307)..(307): xaa in position 307 is any or no amino acid
  Variant (310)..(310): xaa in position 310 is any amino acid
  Variant (312)..(312): xaa in position 312 is any amino acid
  Variant (314)..(314): xaa in position 314 is any amino acid
  Variant (316)..(316): xaa in position 316 is any amino acid
  Variant (319)..(319): xaa in position 319 is any amino acid
  Variant (322)..(322): xaa in position 322 is any or no amino acid
  Variant (325)..(325): xaa in position 325 is any amino acid
  Variant (328)..(332): xaa in position 328 to 332 is any amino acid
  Variant (335)..(335): xaa in position 335 is any amino acid
  Variant (338)..(339): xaa in position 338 to 339 is any amino acid
  Variant (340)..(341): xaa in position 340 to 341 is any or no amino acid
  Variant (343)..(344): xaa in position 343 to 344 is any amino acid
  Variant (349)..(357): xaa in position 349 to 357 is any amino acid
  Variant (358)..(358): xaa in position 358 is any or no amino acid
  Variant (361)..(362): xaa in position 361 to 362 is any amino acid
  Variant (364)..(365): xaa in position 364 to 365 is any amino acid
  Variant (367)..(369): xaa in position 367 to 369 is any amino acid
  Variant (370)..(371): xaa in position 370 to 371 is any or no amino acid
MXXLXKXXXXXGXXXXXXXXXPXXGXXXDVLIKIXXXXICGTDVHIYXWXXWAXXXXXXXXXXXIXXPXXVGHEXXGXVXXVGXXVXXXXVGXRVSXEXXHIXCGXCXXCRXGXXHLCXXXXXVGVXXXXXXXXGXFAXYLXIPXXXXFXXPXXXIXXEXAAIXDPXGXAVHXXXXXXXXXGXXVLIXGXGPIGIMAXXXXKXXGAXXVVXTDVXXXXRLXXAXXMGXXXXXVNXXXXXXXXXXXXXLXXXXXXXXXXXXXXGXDVXLEXSGXXXAXXXXLXXMXXGGXIXLLGIXXXXXXXXXXXXVIXKXLXIXGIXGRXMFXTWXXXXXLLXSGXXXXLXXIITHXXXXXXXXXXGFXXMXXGXXXXXKVIL

SEQ ID NO: 32867 - protein, 11 aa, Artificial sequence
  Variant (6)..(7): xaa in position 6 to 7 is any amino acid
  Variant (9)..(10): xaa in position 9 to 10 is any amino acid
ICGTDXXIXXW

SEQ ID NO: 32868 - protein, 21 aa, Artificial sequence
  Variant (4)..(4): xaa in position 4 is any amino acid
  Variant (5)..(5): xaa in position 5 is Ala, Ser or Val
  Variant (7)..(7): xaa in position 7 is any amino acid
  Variant (8)..(8): xaa in position 8 is Ile or Val
  Variant (9)..(9): xaa in position 9 is any amino acid
  Variant (10)..(10): xaa in position 10 is Ala, Asp, Glu, Gly or Gln
  Variant (11)..(11): xaa in position 11 is Phe, Ile, Leu, Met or Val
  Variant (13)..(13): xaa in position 13 is any amino acid
  Variant (14)..(14): xaa in position 14 is Ala, Asp, Glu, Gly, Asn or Ser
  Variant (16)..(19): xaa in position 16 to 19 is any amino acid
  Variant (20)..(20): xaa in position 20 is Ile, Leu, Pro or Val
GHEXXGXXXXXGXXVXXXXXG

SEQ ID NO: 32869 - protein, 36 aa, Artificial sequence
  Variant (2)..(2): xaa in position 2 is any amino acid
  Variant (5)..(5): xaa in position 5 is Ile or Val
  Variant (7)..(8): xaa in position 7 to 8 is any amino acid
  Variant (9)..(9): xaa in position 9 is Ala, Cys, Gly, Asn or Ser
  Variant (10)..(12): xaa in position 10 to 12 is any amino acid
  Variant (13)..(13): xaa in position 13 is Ala, Cys or Val
  Variant (14)..(16): xaa in position 14 to 16 is any amino acid
  Variant (19)..(20): xaa in position 19 to 20 is any amino acid
  Variant (21)..(22): xaa in position 21 to 22 is any or no amino acid
  Variant (24)..(24): xaa in position 24 is any amino acid
  Variant (25)..(26): xaa in position 25 to 26 is any or no amino acid
  Variant (28)..(31): xaa in position 28 to 31 is any amino acid
  Variant (34)..(35): xaa in position 34 to 35 is any amino acid
GXGPXGXXXXXXXXXXGAXXXXIXXXDXXXXRLXXA

SEQ ID NO: 32870 - DNA, 1080 bp, Escherichia coli
  CDS (1)..(1080)
atgcaagcggcaactgttgtgattaaccgccgcgctctgcgacacaacctgcaacgtcttcgtgaactggcccctgccagtaaaatggttgcggtggtgaaagcgaacgcttatggtcacggtcttcttgagaccgcgcgaacgctccccgatgctgacgcctttggcgtagcccgtctcgaagaagctctgcgactgcgtgcggggggaatcaccaaacctgtactgttactcgaaggcttttttgatgccagagatctgccgacgatttctgcgcaacattttcataccgccgtgcataacgaagaacagctggctgcgctggaagaggctagcctggacgagccggttaccgtctggatgaaactcgataccggtatgcaccgtctgggcgtaaggccggaacaggctgaggcgttttatcatcgcctgacccagtgcaaaaacgttcgtcagccggtgaatatcgtcagccattttgcgcgcgcggatgaaccaaaatgtggcgcaaccgagaaacaactcgctatctttaataccttttgcgaaggcaaacctggtcaacgttccattgccgcgtcgggtggcattctgctgtggccacagtcgcattttgactgggtgcgcccgggcatcattctttatggcgtctcgccgctggaagatcgctccaccggtgccgattttggctgtcagccagtgatgtcactaacctccagcctgattgccgtgcgtgagcataaagccggagagcctgttggttatggtggaacctgggtaagcgaacgtgatacccgtcttggcgtagtcgcgatgggctatggcgatggttatccgcgcgccgcgccgtccggtacgccagtgctggtgaacggtcgcgaagtaccgattgtcgggcgcgtggcgatggatatgatctgcgtagacttaggtccacaggcgcaggacaaagccggggatccggtcattttatggggcgaaggtttgcccgtagaacgtatcgctgaaatgacgaaagtaagcgcttacgaacttattacgcgcctgacttcaagggtcgcgatgaaatacgtggattaa

SEQ ID NO: 32871 - protein, 359 aa, Escherichia coli
MQAATVVINRRALRHNLQRLRELAPASKMVAVVKANAYGHGLLETARTLPDADAFGVARLEEALRLRAGGITKPVLLLEGFFDARDLPTISAQHFHTAVHNEEQLAALEEASLDEPVTVWMKLDTGMHRLGVRPEQAEAFYHRLTQCKNVRQPVNIVSHFARADEPKCGATEKQLAIFNTFCEGKPGQRSIAASGGILLWPQSHFDWVRPGIILYGVSPLEDRSTGADFGCQPVMSLTSSLIAVREHKAGEPVGYGGTWVSERDTRLGVVAMGYGDGYPRAAPSGTPVLVNGREVPIVGRVAMDMICVDLGPQAQDKAGDPVILWGEGLPVERIAEMTKVSAYELITRLTSRVAMKYVD

SEQ ID NO: 32872 - DNA, 1098 bp, Francisella tularensis subsp. tularensis
  CDS (1)..(1098)
atgaatattctaaagattagtaaacaaactttaaggaataatattaaaattattcgagagtatattggcaacgctaagatgtgttttcctgtcaaggcaaatgcttatgggcatggtatagaagacatagtagaaaatacacatgatttagtcgatttctttgctgttgctaactctctagaggcttttagagtaacagctgttgctaaaaatccagtgctagtatttggagtaatatactatgaatatattgaaaaaatgatttcagaaaatatcagagttagcattcaagactatgaagatattgaaaagttagagcaaatagccaaagagcttgataaaaaagtatatgcccatattaatataaacacaggtatgaatcgcatgggcgtagattataatgatgcctgtagaactatacagcgagcttatgaatctgattggctaattttagaaggagtatatagtcatctagcatgtgctgataatagagatcatcctacaaatatcaaacaaaaaaatagatttgatagtattgtcaaatttactaaaggattatctcaagatattatttgtcatttgtctaattcttatggtttcttgggtcaaaaaggaatctgttatgatatggtaagacctggtattttaagttatggttttttaccagagttttacgttgatagagttataagagaaataaagcctatcgcaagattactatcaaaagtggttaagataattaccttgcaagagggcgaaggcgttggttattcattgatatatagaggctttgaagatgagcaattagctgtgattcctattggttatggcgatggttttcctcgtgagttaggtgatagagggttcgttaatattaatgatgtcatgtatcctatggctggtagaatgagtatggatggtctgacagtatcgttaggaattaatgaatacgatgtcaaagtaggcgatacagtagagctaatatcagctattccacgcaatcgaaatagtgcattttcaatagcaaaacaaacaaatactatcgaatatgatattatgagcacattaaatgatcgtattataagaaagatcatataa

SEQ ID NO: 32873 - protein, 365 aa, Francisella tularensis subsp. tularensis
MNILKISKQTLRNNIKIIREYIGNAKMCFPVKANAYGHGIEDIVENTHDLVDFFAVANSLEAFRVTAVAKNPVLVFGVIYYEYIEKMISENIRVSIQDYEDIEKLEQIAKELDKKVYAHININTGMNRMGVDYNDACRTIQRAYESDWLILEGVYSHLACADNRDHPTNIKQKNRFDSIVKFTKGLSQDIICHLSNSYGFLGQKGICYDMVRPGILSYGFLPEFYVDRVIREIKPIARLLSKVVKIITLQEGEGVGYSLIYRGFEDEQLAVIPIGYGDGFPRELGDRGFVNINDVMYPMAGRMSMDGLTVSLGINEYDVKVGDTVELISAIPRNRNSAFSIAKQTNTIEYDIMSTLNDRIIRKII

SEQ ID NO: 32874 - DNA, 1104 bp, Deinococcus radiodurans R1
  CDS (1)..(1104): transl_table=11
atgcgggtatattcgcagttttcctttcccggtcctatcctctttcccatgctgccccgcgccgtcgcccacatttccgccgctgcccttgaccacaacctgagcgccctcgcgcagcgcagcggcacccggctgctgctgcccgtcaaggccgacgcctacggacacggcatggaacttgtcgggcggctggcggcggcgcaccccgacgtgtggggactggcggtggcgacgccgcaggaggccgaaacgctcgcccgcctcgacctcggcaagccgctgctgctgctcacgccgcccgcgccggaggagctcggggcgctcgctgacctcggtgtgcggttgccggtcagcacgctcgccgaggtggaggcgctgcccgcccacgcgcaggcgcacctgaaggtggacaccggcatgaatcgcctcggggcgcggcctgccgacgcggtggcggtgggccgggcactggcggagcgcgggcaactggagggggtctacacccatttcgccacggcggacgagcctgacctgtcctttgccctgacccagttggtccgcttccgcagcgtgctggacgccttgccgcccgtcctcgcccactgcgccaacgggggcggcgtcctcagcttcgggcgcattgaggggatgagcctcgcccggcccggtttggcggcctacggctacgttcccgagcacctgcgccacgtctgtgccctgcgcccggtgatgacggtgcgcgcgcgggtcaaccagctgcatactgcctaccccggcgaaaccgtcagctacggcgccctgtggcgggcggagcgcgaaacgggggtggcggtggtcggcatgggctacgccgacggctacccccgcaacgcgacgggccgcgccgcagtcctcatcggcggcgagcggcgcccggtgctgggccgcatctgcatggaccagatgatggtggacgtgaccgggctggacgtgggggtcggcgactgggccgagctgtggggcgaaggcgacctcagcgtgacggacgtggcccgctggggtgacaccattgaatatgaggtgctgacggggctggggagccgggtggagcggcgggtggggtga

SEQ ID NO: 32875 - protein, 367 aa, Deinococcus radiodurans R1
MRVYSQFSFPGPILFPMLPRAVAHISAAALDHNLSALAQRSGTRLLLPVKADAYGHGMELVGRLAAAHPDVWGLAVATPQEAETLARLDLGKPLLLLTPPAPEELGALADLGVRLPVSTLAEVEALPAHAQAHLKVDTGMNRLGARPADAVAVGRALAERGQLEGVYTHFATADEPDLSFALTQLVRFRSVLDALPPVLAHCANGGGVLSFGRIEGMSLARPGLAAYGYVPEHLRHVCALRPVMTVRARVNQLHTAYPGETVSYGALWRAERETGVAVVGMGYADGYPRNATGRAAVLIGGERRPVLGRICMDQMMVDVTGLDVGVGDWAELWGEGDLSVTDVARWGDTIEYEVLTGLGSRVERRVG

SEQ ID NO: 32876 - DNA, 1227 bp, Mycobacterium tuberculosis CDC1551
  CDS (1)..(1227): transl_table=11
gtgaaacggttctgggagaatgtcggaaagccaaacgacacgacagatgggcggggcacgacttcgttggccatgacaccgatatcccagacacctggcctcctcgccgaggccatggtggatctgggcgctattgaacacaacgtgcgggtgctgcgtgagcacgccggccacgcgcagctgatggcggtggtcaaggccgacggctacggtcacggtgctacgcgcgtcgcccaaaccgccctgggagccggtgcggccgaactcggcgtcgccaccgtcgacgaggcgctagcgctgcgcgctgatggcattaccgcaccggtgctggcctggctgcatccgcccggcatcgacttcgggcccgcgctgctggccgacgtgcaggtcgcggtgtcctcgctgcgccaactcgacgaactgttgcacgcggtgcgccggaccggccggacggcgacggtgaccgtcaaggtggataccgggctgaaccgcaatggcgtgggaccggcacaattcccggccatgctgaccgcgttacgccaagccatggccgaggacgccgtccggctgcgggggctgatgtcgcatatggtttacgccgacaagcctgacgattccatcaacgatgttcaggcccaacggtttaccgcctttctggcgcaggcccgcgaacaaggggtgcggttcgaggtggcgcatctatcgaactcatcagcaactatggcgcgccccgacctgacgttcgacctggtgcggccgggcatcgcggtgtatgggctaagcccggtacccgccctcggtgacatggggctggtgccggcgatgaccgtgaaatgtgctgttgcgctggtgaaatcgattcgtgcgggggagggcgtgtcgtatgggcacacatggatcgcgccacgcgacaccaatctggcgctgctgccgatcggttacgcagacggcgtgttccggtcgctgggcgggcggctggaggtgctgatcaacggcagacgatgccccggtgtggggcggatctgcatggaccagttcatggtcgacctgggccccgggccgcttgatgtggccgaaggcgacgaggcgattttgttcgggccgggcatccggggtgagcccacggctcaggactgggccgatcttgtcggcaccatccactacgaagtggtcaccagcccgcgaggacgtatcaccaggacctatcgcgaggctgaaaaccgttga

SEQ ID NO: 32877 - protein, 408 aa, Mycobacterium tuberculosis CDC1551
MKRFWENVGKPNDTTDGRGTTSLAMTPISQTPGLLAEAMVDLGAIEHNVRVLREHAGHAQLMAVVKADGYGHGATRVAQTALGAGAAELGVATVDEALALRADGITAPVLAWLHPPGIDFGPALLADVQVAVSSLRQLDELLHAVRRTGRTATVTVKVDTGLNRNGVGPAQFPAMLTALRQAMAEDAVRLRGLMSHMVYADKPDDSINDVQAQRFTAFLAQAREQGVRFEVAHLSNSSATMARPDLTFDLVRPGIAVYGLSPVPALGDMGLVPAMTVKCAVALVKSIRAGEGVSYGHTWIAPRDTNLALLPIGYADGVFRSLGGRLEVLINGRRCPGVGRICMDQFMVDLGPGPLDVAEGDEAILFGPGIRGEPTAQDWADLVGTIHYEVVTSPRGRITRTYREAENR

SEQ ID NO: 32878 - DNA, 1125 bp, Streptococcus pneumoniae R6
  CDS (1)..(1125): transl_table=11
gtgtcattttggaggaaaatcatgaaagctagtccacatagaccaaccaaggctctgattcatctgggagctattcgacaaaatattcagcaaatgggggctcatatccctcaaggaacgctcaagttggctgtggttaaggccaatgcttatggtcatggagctgttgccgttgccaaggcaattcaagatgatgttgatggcttttgcgtttccaatatcgatgaagccattgaactcagacaagctggactcagcaagccaatcctcattttaggagtttctgaaatcgaagctgttgctctagctaaagaatatgacttcaccttgacagtggctggactggagtggattcaagcactcttagataaggaagtggacctaactggattgacagtccacctcaagattgattcagggatgggacggattggttttagagaggcaagtgaggttgagcaggctcaagatttgctccaacaacacggtgtttgtgttgaaggaatctttacccactttgctactgctgatgaggaatcagatgactattttaatgcccagttagaacggtttaaaactattttagctagtatgaaggaagttccagagctggttcatgctagcaattctgcaacgactctttggcatgtagagactattttcaatgcggttcgtatgggagatgccatgtatggtctcaatccaagtggagcggtcttggatttgccttatgatttgataccggccttgaccttggagtctgctctggttcatgtcaagacagttccagctggagcttgcatgggctatggagcaacttatcaagcggatagcgagcaagtcatcgcgaccgtgccaatcgggtatgcagatggatggacaagagacatgcaaaatttctctgtcttggtagatggccaagcttgcccaattgtcggcagggtttcgatggaccaaatcactattcgattgcctaagctttatccgctaggaaccaaggtaaccttgattggctccaatggggataaggaaatcactgcaactcaggtagcgacctaccgcgtaaccattaactatgaggtggtttgcctcctcagcgaccgtattccgagagaatattattag

SEQ ID NO: 32879 - protein, 374 aa, Streptococcus pneumoniae R6
MSFWRKIMKASPHRPTKALIHLGAIRQNIQQMGAHIPQGTLKLAVVKANAYGHGAVAVAKAIQDDVDGFCVSNIDEAIELRQAGLSKPILILGVSEIEAVALAKEYDFTLTVAGLEWIQALLDKEVDLTGLTVHLKIDSGMGRIGFREASEVEQAQDLLQQHGVCVEGIFTHFATADEESDDYFNAQLERFKTILASMKEVPELVHASNSATTLWHVETIFNAVRMGDAMYGLNPSGAVLDLPYDLIPALTLESALVHVKTVPAGACMGYGATYQADSEQVIATVPIGYADGWTRDMQNFSVLVDGQACPIVGRVSMDQITIRLPKLYPLGTKVTLIGSNGDKEITATQVATYRVTINYEVVCLLSDRIPREYY

SEQ ID NO: 32880 - DNA, 1206 bp, Nostoc sp. PCC 7120
  CDS (1)..(1206): transl_table=11
gtgataagggggagtgaaatgttaagtcgccaacaagcctcaagtatggcttctcatcaacaatgtgatacctatgcttggttttcacaacgcgcttgggtagaaattgacctagaggcgttgtcgcacaatgtccagcaacttaagcagtttttatcaccgcgtactcagttaatggcagtagttaaagcagatgcttatggtcatggtgctgtgacggtggcacagacagcattacaagcgggggctagttgtttgggtgtcgccactgttccagagggtattcaattgcgagaggccggtattcaagcgcccattttgattttaggggctacccatacaccagaacaaattcaggcgatcgctcaatggcaactccaagcaactattggtagtcccaaacaagctttaatattttccaataccttggaaaccatccagcatgattctcctatacctgtacatattaagttagatacgggtatgtctagactgggtactaactggcaacaagcaggggagtttgtacagttagtagagcgtttaccccatttggatattgctagtgtttactcccacctagcgaccgcagatagcccagatccagggattatggaagaacagcatagaagatttgaggaggcgatcgctcaaatcaaaactttgggtattaaaattcctagcctgcatttagcaaactcggctgcaaccctggcagatccgagattacactatgatatggtacgggtaggtttagccgtgtatggactctatccagcccctcatttacagaataaaatcagcctaaaaccagtcatccaagtccaagcgcgaattacccacgtcaaaacaattgctgccggtactggcgtaagctacggacaccaatttatagcccctcatgaaatgcgccttgccgttgtgagtattggttacgctgatggcgtaccgcgtaatctatccaacaaaatgcaggttttaattcgtggtcaacgagtgccacaaatcggtgctatcacgatggatcagttgatgatagatgctagtgctttaccagacctacaagaaggggaaattgtcaccttacttgggaaacaaggaaaggaaaaaatcacagccgatgattgggcagaagcgttaaacactatttcctgggaagttctttgtggatttaaacatcgcctacctcgtgtaggcgtgatgtga

SEQ ID NO: 32881 - protein, 401 aa, Nostoc sp. PCC 7120
MIRGSEMLSRQQASSMASHQQCDTYAWFSQRAWVEIDLEALSHNVQQLKQFLSPRTQLMAVVKADAYGHGAVTVAQTALQAGASCLGVATVPEGIQLREAGIQAPILILGATHTPEQIQAIAQWQLQATIGSPKQALIFSNTLETIQHDSPIPVHIKLDTGMSRLGTNWQQAGEFVQLVERLPHLDIASVYSHLATADSPDPGIMEEQHRRFEEAIAQIKTLGIKIPSLHLANSAATLADPRLHYDMVRVGLAVYGLYPAPHLQNKISLKPVIQVQARITHVKTIAAGTGVSYGHQFIAPHEMRLAVVSIGYADGVPRNLSNKMQVLIRGQRVPQIGAITMDQLMIDASALPDLQEGEIVTLLGKQGKEKITADDWAEALNTISWEVLCGFKHRLPRVGVM

SEQ ID NO: 32882 - DNA, 1200 bp, Brucella melitensis 16M
  CDS (1)..(1200): transl_table=11
atggttgagatgtctttacctttttctcaggatgagcgcgatctcgcggctggcggcatattgaccattgatctcgcagccctgcgccacaattattcagccatcgcaacccgcattgccccaacccgtacggccgctgtggtaaaggcagacgcctatggcctgggcgcaagccgggtcgcaccggctttctacgaggccggttgccgcgatttcttcgttgcacatcttggcgaagcagtggcgctgaagccctttttgaaacccgacgcaacactttatgtcctgaacggccttcagcccggaacggaagcagcctgtgcccgcgaaggcatcctgcctgttctcaattcgctggaacaggttgaaaactgggcagcactcgccacccggctgggcaaaaaactgcccgccctgctccagttcgataccggcatgtctcgtcttggcctgtcagccaaggaatttgaccgccttcttgagaacgtcacgctcctgagcaggatcgacatcaaattcgccatcagccatctggcaaacggcgacgagccgggaaatgcggtaaatgcccgtcagcttgccaagatgacggccttgctcgctcgcctgccgaaactgccggctgccttggccaattccggcggcaccttcctcggcaagacctattatttcgatctcgcccgccccggcatcgcgctatatggcatcgatccggagaggcagcatgacttttcggataaggtggcgcacgagaataagaaacccaagcattcgatccttcccgtcctcaccctttcggcgcgtgtcattcaggtgcgcgacgtcgacaagggagcgacagttggctatggcggcacctatgtcgccaacggcccgatgcggattgcgacgattgcggtcggctatgctgacggcttgttccgttccttgagtaacaagggcgcagcctttttcggcgatacgcgcctgcccatcatcgggcgcgtatcgatggattcgatcacgctcgacgtcacctcattgccggagggaacgctgaaactcggcagccttgtggaattgatcggcccgcatcagcgcctcgaagacgtggcgcgggactgcgacactatcccctatgaaattctgactgcgcttggcaaccgttatgcgcgcgtttacgtttacgtgaatggcggtggcaccagcacaacagcataa

SEQ ID NO: 32883 - protein, 399 aa, Brucella melitensis 16M
MVEMSLPFSQDERDLAAGGILTIDLAALRHNYSAIATRIAPTRTAAVVKADAYGLGASRVAPAFYEAGCRDFFVAHLGEAVALKPFLKPDATLYVLNGLQPGTEAACAREGILPVLNSLEQVENWAALATRLGKKLPALLQFDTGMSRLGLSAKEFDRLLENVTLLSRIDIKFAISHLANGDEPGNAVNARQLAKMTALLARLPKLPAALANSGGTFLGKTYYFDLARPGIALYGIDPERQHDFSDKVAHENKKPKHSILPVLTLSARVIQVRDVDKGATVGYGGTYVANGPMRIATIAVGYADGLFRSLSNKGAAFFGDTRLPIIGRVSMDSITLDVTSLPEGTLKLGSLVELIGPHQRLEDVARDCDTIPYEILTALGNRYARVYVYVNGGGTSTTA

SEQ ID NO: 32884 - DNA, 1053 bp, Clostridium perfringens str. 13
  CDS (1)..(1053): transl_table=11
atgagtaattatttttggtgcgatgtaaatttaaaaaatatagagaataatataaatgtaataagagatttaatacaaaataaaaagctgattgcagttataaagggagatgcttatggattaggcagtaaagaaattgctgaatttatagaagataaggttgacataatagcagtaggtaatattgatgaaagcttatgcttagataatattaataaggatatacttatcttatcacctttatgtacaaaagatgattttaaagatgaaagagataatttaatattaactttagataatgaggaaatattaaatgaattagataaggaaacaaagaaaagagtacatatatatgtagatacaggtatgaacagaatgggtataaagcctaacaagttagattcatttatagaaagagttaaaaatgaatttcctaaccttgaaatagatggtatctatactcatttacataatgctaaggatgttaattataccttaaaacaaatagaattatttaaatctacagttgaaaagtataaagataaagtaagaataatacactgcatggcgtcaagtgctgttgtaaatgatcaattaagaaaagcatgtgattttactacaggggcaagagccggtaatgtgctttatggatatataggctttaataaaggaattaaaaaaacttatgaatactatgcaaaaccagtaaatacctataaagtttcaaagggacaaactgtaggatatggttgtctttttaaggcagataaggatatggaaataggaataattgaatgtggtaatgttcatggcttaggcataagtagagaaattaaaaataatgttttctatgatatatttagaatgatttatagaagatttaaagagagaagtgtaatatttaataacaatgtacctgtaaaaatattaggaaaagtaaatatgaatataactattatttctatggaaaactgctctaaagattcagttttaaaagttgatatttcacctataatatcagattcaagcatagaaaaaagatatatttattag

SEQ ID NO: 32885 - protein, 350 aa, Clostridium perfringens str. 13
MSNYFWCDVNLKNIENNINVIRDLIQNKKLIAVIKGDAYGLGSKEIAEFIEDKVDIIAVGNIDESLCLDNINKDILILSPLCTKDDFKDERDNLILTLDNEEILNELDKETKKRVHIYVDTGMNRMGIKPNKLDSFIERVKNEFPNLEIDGIYTHLHNAKDVNYTLKQIELFKSTVEKYKDKVRIIHCMASSAVVNDQLRKACDFTTGARAGNVLYGYIGFNKGIKKTYEYYAKPVNTYKVSKGQTVGYGCLFKADKDMEIGIIECGNVHGLGISREIKNNVFYDIFRMIYRRFKERSVIFNNNVPVKILGKVNMNITIISMENCSKDSVLKVDISPIISDSSIEKRYIY

SEQ ID NO: 32886 - DNA, 1239 bp, Thermosynechococcus elongatus BP-1
  CDS (1)..(1239): transl_table=11
gtgatatacattgaatcacagactctcagtggctgtagggttagtcattccctacgcgggagttatggtgtgaggatagaaacaacaatgctcagtcaagaacagctcaccagttcccatgagtgtgagcgggcatggattgaaattgatttggcagcattggccgctaatacgcgcagcttgcgtcagtggctagcaccgacaacggaacttttagccgtggtgaaggcagatgcctatggtcatggtgcgctcactgtggcacagacggttttagcccacggtgcgacgtggctaggggtggcaacgattccggaagggattgctctacggcaggcagggattacagcgcctattttggtcttgggatccgtcaatttgcccgtccaagtccagatgatggcccagtggcagcttcagcctaccctctctacacccaagcaagccctgattttctccgactacgccgatcgcctgcgcgaaccccttgatgtccatttgatgattgatacgggtatgtctcgcttgggctgtccctggcaggatgcggtgggttttgtgcagtttgtgcagcggctacctcacctgcgcattcaggggatttactcccactttgccagtgccgatgatccggatgccagtttgatgcggcagcagcaggcctactttgaacaggtatgggaacaaatttccgccctgggtttaggccctgtgcgccgtcacatggccaattcggcagcaacattggccaaccgcagtagtcactacgacatggtgcgcattggtttgagcctctacggcgtgtatcctgcgtcccatttacggggtgtcgtgcccctgcgaccagtcatgcaggtgcgatcgcgcattaccctcttgaaagagattcccgctgggacaggcattagctacggtcatcaatttattgcccctcagccgatgaaaattgccgttgttggcattggctatgccgatggggtgccgcgtcttctttccaacaagctcgaagtcctagtccagggaaaacggctgcgccaagtgggggcaattacgatggatcaactcatgattgatgtcagtgatatggatggcttacaggagggagatgtggtcaccctccttggggaagatggcggcgactgcctgacggtggagacttgggcggaagccctcggcacaattacctgggaaattctctgcggcttcaagaaccgcttgccgcgtattcctgtctcctaa

SEQ ID NO: 32887 - protein, 412 aa, Thermosynechococcus elongatus BP-1
MIYIESQTLSGCRVSHSLRGSYGVRIETTMLSQEQLTSSHECERAWIEIDLAALAANTRSLRQWLAPTTELLAVVKADAYGHGALTVAQTVLAHGATWLGVATIPEGIALRQAGITAPILVLGSVNLPVQVQMMAQWQLQPTLSTPKQALIFSDYADRLREPLDVHLMIDTGMSRLGCPWQDAVGFVQFVQRLPHLRIQGIYSHFASADDPDASLMRQQQAYFEQVWEQISALGLGPVRRHMANSAATLANRSSHYDMVRIGLSLYGVYPASHLRGVVPLRPVMQVRSRITLLKEIPAGTGISYGHQFIAPQPMKIAVVGIGYADGVPRLLSNKLEVLVQGKRLRQVGAITMDQLMIDVSDMDGLQEGDVVTLLGEDGGDCLTVETWAEALGTITWEILCGFKNRLPRIPVS

SEQ ID NO: 32888 - DNA, 1101 bp, Streptococcus agalactiae 2603V/R
  CDS (1)..(1101): transl_table=11
atgatttcaagttatcatagaccaaccagagccttgatagatttagaggcgattgcaaataacgttaaatctgtacaagagcacattccaagtgataaaaaaacatttgctgtagttaaggctaatgcttatgggcatggtgctgttgaagtttcaaaatacattgagtctattgtagatggtttttgcgtatccaatttagatgaggctattgagctacgtcaagcaggaattgtaaaaatgatattggtattaggtgttgttatgcctgagcaggttatactagccaaaaatgaaaatattactctaacagttgctagcttggagtggttacgtttatgtcagacatcagcagtagatttatctggtctagaagtacatatcaaagttgatagtggaatgggacgtataggtgttcgccagttagatgaaggaaataagctaatttctgaattgggggaaagtggtgcctctgtcaaggggattttcacccattttgcaacagctgatgaagccgataactgtaaattcaatcaacaacttactttttttaaagactttatttcaggattagataattgtccggaccttgttcatgctagtaattctgctacaagcctttggcatagtgagacaatttttaatgccgttagattgggtgttgttatgtacggcttaaatccaagtggaactgatttagacttaccttaccctataaaccctgctttaagtttagagtctgagctagtacatgttaaacaactacacgatggttctcaagttggctatggcgcaacctatcaagttactggagacgaatttgttggaacagtaccgattggctacgctgatggatggacacgagatatgcaaggattttcagttatagtaaatggagaactttgtgaaattattgggcgtgtctcgatggatcaaatgactatccgtttacctcaaaaatatactatcggaactaaagtaaccttgattggtcaacaaggtagttgtaacattacaactacggacgtcgctcaaaaaagacagacgattaattatgaagtactttgtcttttaagcgatcgtattccgagatattattaa

SEQ ID NO: 32889 - protein, 366 aa, Streptococcus agalactiae 2603V/R
MISSYHRPTRALIDLEAIANNVKSVQEHIPSDKKTFAVVKANAYGHGAVEVSKYIESIVDGFCVSNLDEAIELRQAGIVKMILVLGVVMPEQVILAKNENITLTVASLEWLRLCQTSAVDLSGLEVHIKVDSGMGRIGVRQLDEGNKLISELGESGASVKGIFTHFATADEADNCKFNQQLTFFKDFISGLDNCPDLVHASNSATSLWHSETIFNAVRLGVVMYGLNPSGTDLDLPYPINPALSLESELVHVKQLHDGSQVGYGATYQVTGDEFVGTVPIGYADGWTRDMQGFSVIVNGELCEIIGRVSMDQMTIRLPQKYTIGTKVTLIGQQGSCNITTTDVAQKRQTINYEVLCLLSDRIPRYY

SEQ ID NO: 32890 - DNA, 1359 bp, Bifidobacterium longum NCC2705
  CDS (1)..(1359): transl_table=11
atgagcatgaacgcagcacctgaaatcgcattctcgtccgagcagggcaaggccaactatgcggccgcccgccgccaataccccgcacaggccatcgtggacctcaaaaccatgcgcgacaacatggcccacctggtctccgtggtcggcgggcccgcttccggcacggcggtgatgggtgtggtcaaggccgacgcctacggccacggactgctgcccgccgccctggccgcgctcgccggcggcgccacatggctcggcaccgcgcagtcgcacgaagcgttgctgctgcgcaagctcggcatcggccccgaccgctgccatattttgacttgggtatacaacggcaccgaagtcccgttcgacgagctgatcgccgccgacatcgacgtatcggtcggctccctgcccggcatcgacgcggtggccgccgccgcacgcaggctcggcaagcccgcccgcgtacacgtcaaggtcgattccggcttcggtcgcaacggtttcacgccggccggattcgacgccgcgctcgccaaactcgtgccgctcgccaaagagggcgtgttgcatattgtgggtcagtggagccatctcgccgtggccgattcgcctgatgtgcccgaattcgtgtcctccaccgaccgccagatcgaaacattcaaggacttcacgcgccgcatggaacaggccggcattccgccggagatccgtcacctggccaacacggcggccactttggaccgcccggagattcacttcgaacttacccgccccggcatcggcctgtacggctacgagcccgatcccgcgatgggcaccccgcgcgactggcatctgaccccggccatgcgcctgcaggcgcagctcggcacggtcaaggatgtggaggccggccatggcatctcttatggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccactgaaggtccgaagctctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtactgcccgccgccgacctcgccaagctcgaccccgccacgctgctataa

SEQ ID NO: 32891 - protein, 452 aa, Bifidobacterium longum NCC2705
MSMNAAPEIAFSSEQGKANYAAARRQYPAQAIVDLKTMRDNMAHLVSVVGGPASGTAVMGVVKADAYGHGLLPAALAALAGGATWLGTAQSHEALLLRKLGIGPDRCHILTWVYNGTEVPFDELIAADIDVSVGSLPGIDAVAAAARRLGKPARVHVKVDSGFGRNGFTPAGFDAALAKLVPLAKEGVLHIVGQWSHLAVADSPDVPEFVSSTDRQIETFKDFTRRMEQAGIPPEIRHLANTAATLDRPEIHFELTRPGIGLYGYEPDPAMGTPRDWHLTPAMRLQAQLGTVKDVEAGHGISYGRTYLTPDNTSTAIVPLGYADGIHRSASGFDMEGAKHVEKPGGPVRIMTTEGPKLYRVCGRVCMDQFIVDLHGSAAELGVHEGDTVELFGPGRGEDYVEPTADDWARAADTISYEIFTCLRNRIPRLYEHAAEVLPAADLAKLDPATLL

SEQ ID NO: 32892 - DNA, 1170 bp, Leptospira interrogans serovar Lai str. 56601
  CDS (1)..(1170): transl_table=11
ttgcaagacattaattctggtagtagttcaatgaaagatacctattcttcctggattgaaatttcgaaacgttctctgagtaacaatttagataactttcgatccattttacgtcccaactctacattgaccgcaattttaaaatccaacgcatacggtcacggtatcgaacctatgaccagactttgtattgaagcggggatttcacgcatcggagtcaactcaatcgaagaagcgcttcttatccgtaacatcgattctaaaattccaattttgatcatgggagaaattcaaaatccagaaaaaagaaaggacgtgttatctgatcccaatttctggatcgttttttcaagaccggaaacagctcgtatactttcttcctttttacccgctcctaaacttcatctcaaaattgataccggtatgggtagactagggagtcacggagaaactttaaaacagacgttaagcgaattgaagaacgtaggaattacacttggcggtatctgcacccattttgctagtacggaagacgtattagaacataaatattctcttatgcagactcaaaagttcgaagaagcaatttttcttgctaagtcctttggttataatcatttaatccgacatgcctgcgcctcagcttctacgatgttgtttccaaatgctcattttgatatggtacgaatcggtatctctttgtatggtctttggcctagtattcagaccagactctctttaaaccttactggaaataaaaactttcaactaaaccccattctttcttggaaatccagaatcgttcatatccaatatcatcctgcagacagttatatcggttacggctccacatttcaaacttcgtatcctacaaaagttgctatcgttcctgttggttattacgaaggtctggatcgaaaactttctagcaacggtgatatgttggttcttggtaaaaaagccagaattatcggtcgtatttgtatgaatatgactatgttagacgttactcatattcctggcgcggaagtaggtagtattgttacgattataggacaagacggagaagaatctatcaccgcagacgatttagcagatagaactcataccattaactacgaggtcatgaccagaatcagcgaatctattcccaggattgtagtagactag

SEQ ID NO: 32893 - protein, 389 aa, Leptospira interrogans serovar Lai str. 56601
MQDINSGSSSMKDTYSSWIEISKRSLSNNLDNFRSILRPNSTLTAILKSNAYGHGIEPMTRLCIEAGISRIGVNSIEEALLIRNIDSKIPILIMGEIQNPEKRKDVLSDPNFWIVFSRPETARILSSFLPAPKLHLKIDTGMGRLGSHGETLKQTLSELKNVGITLGGICTHFASTEDVLEHKYSLMQTQKFEEAIFLAKSFGYNHLIRHACASASTMLFPNAHFDMVRIGISLYGLWPSIQTRLSLNLTGNKNFQLNPILSWKSRIVHIQYHPADSYIGYGSTFQTSYPTKVAIVPVGYYEGLDRKLSSNGDMLVLGKKARIIGRICMNMTMLDVTHIPGAEVGSIVTIIGQDGEESITADDLADRTHTINYEVMTRISESIPRIVVD

SEQ ID NO: 32894 - DNA, 1077 bp, Shewanella oneidensis MR-1
  CDS (1)..(1077): transl_table=11
ttgaaaccttttccccgagcagaaattagcagtagtgcactgcaaaacaacctcgccgttttacgccagcaggcgagcagcagtcaagtcatggccgtggtgaaagccaatggatatggacatggattattaaatgttgccaaatgcttaaacaatgccgatggtttcggcttagctcgtttggaagaggcattagagctgcgcgcaggtagtgttaaggcgcgcttattattgcttgagggtttttttcgcagcaccgacttacctttgctggtggagcacgatattgatactgtggtgcatcacgaatcgcaaatcgagatgttagaacaggcgacactatcgaaaccagtgacagtatggttgaaagtcgattcggggatgcatcgtttaggggtcacgcctgaacagttctcagcggtttatgcgcgtttgacggcctgtaaaaatgtcgccaagcctatccatctgatgacccactttgcctgtgccgatgagcccgacaatcattacactcaagtgcaaatgcaaacctttaaccagttaactgcagatttacctgggtttagaaccttagcgaactcggcgggtgcgctttattggccgaagagccaaggtgattggatccgtccaggcattgcgatgtatggtgtgtcacccgttactggggattgcggcgcaaatcatggtttgatccctgcaatgaacttggtttcacgtttgatagcggtgcgcgagcacaaagcgaatcaacccgtaggttatggttgttactggaccgccaaacaagatactcgtcttggcgttgtcgcgattggttatggtgatggctatccacgtaatgcgccggaaggcacgcctgtatggataaatggccgcagagtgccgattgttggccgggtatctatggatatgttaacagtggatttaggccatgatgcaacagatcaagtcggtgatgatgttttgctttggggtcaggctttacctgttgaagaagtcgctgagcatattggtactatcgcctatgagttagtgactaagctgactccgagagtcgctgtttgcttagcatag

SEQ ID NO: 32895 - protein, 358 aa, Shewanella oneidensis MR-1
MKPFPRAEISSSALQNNLAVLRQQASSSQVMAVVKANGYGHGLLNVAKCLNNADGFGLARLEEALELRAGSVKARLLLLEGFFRSTDLPLLVEHDIDTVVHHESQIEMLEQATLSKPVTVWLKVDSGMHRLGVTPEQFSAVYARLTACKNVAKPIHLMTHFACADEPDNHYTQVQMQTFNQLTADLPGFRTLANSAGALYWPKSQGDWIRPGIAMYGVSPVTGDCGANHGLIPAMNLVSRLIAVREHKANQPVGYGCYWTAKQDTRLGVVAIGYGDGYPRNAPEGTPVWINGRRVPIVGRVSMDMLTVDLGHDATDQVGDDVLLWGQALPVEEVAEHIGTIAYELVTKLTPRVAVCLA

SEQ ID NO: 32896 - DNA, 1116 bp, Streptococcus mutans UA159
  CDS (1)..(1116): transl_table=11
atgattgctagttaccatcgtccgacgacagctttagttcatttagatcgtatcaaatttaatatcgaacaagttcaacaccatattccaaaatcagccaaaacttttgctgtggttaaagccaatgcctatggacatggtgctgttcaggtggctcaagccattcaaaagcaagttgacggtttttgtgtttctaatttagatgaggccttggaattgcgtcaggctggtctaaatgattttattttaattttgggtgtccttcttcctgaggaagttgccttggctaaaaaagaaaatattactattacagttgctgacttagattggtttgataaagtacagacagaaaacattgatttagctggtctttcagtacatgtaaaagtcgattctggtatgggaagaattggagttcgcagtactgcagaagcgaatcagcttattgcaggtttgcagaaggcgggagcgactgttaatggtatctttacccattttgcaacagcagatgaagcttctactgttaaattcagtcaacagttagagatgtttaccacccttatcagtcaattggattacaaacctcaaacagtacatgcttctaactctgctacaagtatttggcatagtgatacagtaatgaatgctgttcgcctgggaatagtgatgtatggactcaatcctagtggcaatgcacttgaattaccttatgaagtaaagccagcattagagttgacatccgctcttgttcaggtcaaagaagtgcaagctggtgatacagttggctatggtgcgacttatactgccagtcaggctgaaattattggaaccgtccctgttggttacgctgatggttggacaagagatttgcaaggttttcatgttttggtgaatggtcactattgtgaaattgtggggcgtgtgtccatggatcaaatcactattcgcttacccaaagcttatcctttagggaccaaagtcaccttaattgggcaggatggtcatgaaacgatttcagcaacagatgtcgctgaaaaacgagagacgattaattatgaagtgctctgtttgatcagtgaccgagttcctcgaaaatatgataaaaagttcagttaa

SEQ ID NO: 32897 - protein, 371 aa, Streptococcus mutans UA159
MIASYHRPTTALVHLDRIKFNIEQVQHHIPKSAKTFAVVKANAYGHGAVQVAQAIQKQVDGFCVSNLDEALELRQAGLNDFILILGVLLPEEVALAKKENITITVADLDWFDKVQTENIDLAGLSVHVKVDSGMGRIGVRSTAEANQLIAGLQKAGATVNGIFTHFATADEASTVKFSQQLEMFTTLISQLDYKPQTVHASNSATSIWHSDTVMNAVRLGIVMYGLNPSGNALELPYEVKPALELTSALVQVKEVQAGDTVGYGATYTASQAEIIGTVPVGYADGWTRDLQGFHVLVNGHYCEIVGRVSMDQITIRLPKAYPLGTKVTLIGQDGHETISATDVAEKRETINYEVLCLISDRVPRKYDKKFS

SEQ ID NO: 32898 - DNA, 1104 bp, Corynebacterium efficiens YS-314
  CDS (1)..(1104): transl_table=11
atgaatctgctcaccacccgcatcgatctggacgccatcgcccacaacacccgtctgctgaagaaccgggtgggcgcggcgaaactgatggcggtggtcaaggcggacgggtacaaccacggcatggaccgggtcgccccggtcatggcggccaacggtgcggatgcgttcggggtggccaccatcgccgaggccctggcattgcgcgccaccggcatcaccacgccgatcctgtgctggatctggtccccggaacaggactgggctgccgccgtcgaggcgggcatcgacctcgcggtgatctccccgcggcacgcccgggtgcttgtcgacgcaccccccacctcccgggccatccgcgtcagcgtcaaggtggacaccgcgctgcaccgttccggtgtggatgaacaggactgggacgcggtgttcaccctgctccgcgactgcgggcacatcgaggtcaccgggttgttcacccacctgtcctgcgccgatgaacccggcaacccggagaccgaccaccaggcggagaccttccggcgggccatcgaccgggcccgcgccctgggcctggaggtgccggagaaccacctgtgcaattccccggccacgctcacccgcccggatctgcacatggacatggtccgcccgggtgtggccctgtacggtctggaacccatcccgggcctggaccatggtctgcggccggcgatgacgtgggcgggggcgatcaccgtcgtcaagcccatcagaaagggtgaggggacctcctacgggctgacctggcgcgccgaggcggacgggttcgtggcggtggtgccggcaggctatgccgacggtgtgccccgtgcggcccaggatcacctgcgggtccacgtcaacggtcatgactacccacaggtggggcgggtgtgcatggatcagttcgtcatcttcctgggtgataatccccacggcgtgaccgccggtgatgaggcggtcatcttcggcggcaccggcatgtccgccaccgagcttgccgacgccctggccaccatcaactatgaggtcatctgccggcccaccggccgcacagtccgcgactacacaggagaaggcaaatga

SEQ ID NO: 32899 - protein, 367 aa, Corynebacterium efficiens YS-314
MNLLTTRIDLDAIAHNTRLLKNRVGAAKLMAVVKADGYNHGMDRVAPVMAANGADAFGVATIAEALALRATGITTPILCWIWSPEQDWAAAVEAGIDLAVISPRHARVLVDAPPTSRAIRVSVKVDTALHRSGVDEQDWDAVFTLLRDCGHIEVTGLFTHLSCADEPGNPETDHQAETFRRAIDRARALGLEVPENHLCNSPATLTRPDLHMDMVRPGVALYGLEPIPGLDHGLRPAMTWAGAITVVKPIRKGEGTSYGLTWRAEADGFVAVVPAGYADGVPRAAQDHLRVHVNGHDYPQVGRVCMDQFVIFLGDNPHGVTAGDEAVIFGGTGMSATELADALATINYEVICRPTGRTVRDYTGEGK

SEQ ID NO: 32900 - DNA, 1230 bp, Pseudomonas putida KT2440
  CDS (1)..(1230): transl_table=11
atgccctttcgccgtacccttctggctgcatccctggcacttctgatcaccggacaggcccccctgtatgcggcaccaccgttgtcgatggacaacggcaccaacaccctgaccgtgcaaaacagcaatgcctgggtcgaagtcagcgccagcgccctgcagcacaacatccgcacgctgcaggccgagctggccggcaagtccaagctgtgcgccgtgctcaaggccgatgcctatggccacggtatcggcctggtaatgccatcgatcatcgcccaaggcgtgccctgcgtggcggtggccagcaacgaggaggcccgcgtggtccgcgccagtggcttcaccgggcaactggtgcgggtacgcctggccagcctcagcgagctggaagatggcttgcagtacgacatggaagagctggtgggcagcgcggaatttgcccgccaggccgatgccatcgccgcgcgccatggcaagaccttgcgcattcacatggcgctcaactccagcggcatgagccgcaacggggtggagatggccacctggtccggccgtggcgaagcgctgcagatcaccgaccagaagcacctcaagctggtcgcgctgatgacccacttcgccgtggaagacaaggacgatgtacgcaagggcctggcggcattcaacgagcagaccgactggttgatcaagcacgccaggctggaccgcagcaagctcaccctgcacgccgccaactcgttcgctacgctggaagtgccggaagcgcgcctggacatggtacgaacgggtggcgcgctgttcggcgacaccgtgccggcgcgcaccgagtacaaacgtgcgatgcagttcaaatcgcacgtggcggcggtgcacagctatccggccggcaacaccgtgggctatgaccgcaccttcaccctggcccgtgattcgcggctggccaacattacggtcgggtactccgatggctaccgccgggtattcaccaacaagggccatgtgctgatcaacggccaccgtgtgccggtcgtgggcaaggtgtcgatgaacacgctgatggtcgatgtcaccgacttccctgatgtgaaggggggtaacgaagtggtgctgttcggcaagcaggccgggggcgaaatcacccaggccgagatggaagaaatcaacggcgcgttgctcgccgatttgtacaccgtatggggcaattccaacccgaagatactcgtcgactga

SEQ ID NO: 32901 - protein, 409 aa, Pseudomonas putida KT2440
MPFRRTLLAASLALLITGQAPLYAAPPLSMDNGTNTLTVQNSNAWVEVSASALQHNIRTLQAELAGKSKLCAVLKADAYGHGIGLVMPSIIAQGVPCVAVASNEEARVVRASGFTGQLVRVRLASLSELEDGLQYDMEELVGSAEFARQADAIAARHGKTLRIHMALNSSGMSRNGVEMATWSGRGEALQITDQKHLKLVALMTHFAVEDKDDVRKGLAAFNEQTDWLIKHARLDRSKLTLHAANSFATLEVPEARLDMVRTGGALFGDTVPARTEYKRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGGEITQAEMEEINGALLADLYTVWGNSNPKILVD

SEQ ID NO: 32902 - DNA, 1074 bp, Pseudomonas putida KT2440
  CDS (1)..(1074): transl_table=11
atgcgtcccgcccgcgccctgatcgacctccaggccctgcgccacaactaccgtctggcccgtgaactgacgggtgccaaagccctcgccgtgatcaaggccgatgcctacggccacggcgccgtgcgctgcgccctggccctcgaggccgaagccgacggctttgccgtggcctgcatcgaagaggcgctggaactgcgcgccgccggtatcaaagccccggtactgctgctggaaggtttttttgaagccagcgaactggcgctgatcgccgagcacgacctgtggtgcgtggtgcactcgctgtggcaactggaagccatcgagaaaaccccgctgcacaaaccgctcaacgtctggctgaagctggacagtggcatgcaccgcgttggcctgcaccccaaggactaccacgatgcctaccagcgactgctggccagcggcaaggtttcgcgcatcgtgttgatgacccacttcgctcgcgccgacgaactggacgctgacgctacctcccagcaaatcgccgtgttcgaagctgcccgacagggcctggccgccgaatgcagcctgcgtaactcgcccggcgtgctgggctggccgcaagcgcccagcgactgggtgcgcccaggcctgatgctgtacggcgccacgccgttcgaagtggcgcaggccgaggccgcacgcctgcaaccggtgatgaccctgcaatcgcgggtgatcagcgtgcgcgagctgcctgccggcgagccggttggctatggtgccaagttcgtcagccctcggccgacccgcgtgggtgtggtcgccatgggctatgccgatggctacccgcgccaggcgcctaacggcaccccggtgctggtcgctggcaagcgcacccagctgatcggccgggtgtcgatggacatgctcagcatcgacctcaccgacgtaccgcaagccactgtcggcagcccggtcgaattctggggcaagcaggtgctggccagtgaagtggccgcgcatgcgggcactattccctatcagatcttctgtaacctgaagcgggtaccacgggactacatcggcgaatga

SEQ ID NO: 32903 - protein, 357 aa, Pseudomonas putida KT2440
MRPARALIDLQALRHNYRLARELTGAKALAVIKADAYGHGAVRCALALEAEADGFAVACIEEALELRAAGIKAPVLLLEGFFEASELALIAEHDLWCVVHSLWQLEAIEKTPLHKPLNVWLKLDSGMHRVGLHPKDYHDAYQRLLASGKVSRIVLMTHFARADELDADATSQQIAVFEAARQGLAAECSLRNSPGVLGWPQAPSDWVRPGLMLYGATPFEVAQAEAARLQPVMTLQSRVISVRELPAGEPVGYGAKFVSPRPTRVGVVAMGYADGYPRQAPNGTPVLVAGKRTQLIGRVSMDMLSIDLTDVPQATVGSPVEFWGKQVLASEVAAHAGTIPYQIFCNLKRVPRDYIGE

SEQ ID NO: 32904 - DNA, 1272 bp, Bradyrhizobium japonicum USDA 110
  CDS (1)..(1272)
atgacaatggcgtccgacccgaaaatgaacccgcaatccggccttctctcagcggaggccaaccatgccgccgcgctcgctgccttcggcggcgtgctcaccgtcgacctcgacgccatcattgccaactggcgcaagctcgagaagacggcggtgccggccgaatgcgcggcggtgatcaaggccgatgcctatggctgcggcgccgcgcaggtcgcgcgtgccctccacaaggccggctgcaagaccttcttcgtcgccaccatcgaggaggcgcgcaaggtgcgcgccgccgtaccggagccgaccatctacgtgctcggcggctatttccagaacaccggcgagcactacgcccagatcaattgccgtccggtgatcggcgatctcaacgagctcgccgaatgggacgtgttctgccgccgcaccggctggaacggaggcgccgctgttcacatcgacaccggcatgaaccggctcgggctgacgcttgcggaagcacaggccatcatcccccgcatcaatgccggcgaccacggcatcacgctggtgatgagccatctggtctcggccgagcagctcaacagccccgtcaatgccaaacagctcgcttccttccgcggcatcgccagcgaattctccggcgtgccggcggcgctcgccaattcgtccggaatcttcctcggggcgccgttccagttcgacctggtgcggccgggcgccgcgctctacggcgtcaacccgacgccggaggccgataatccgatgcagccggtggtcgacctcaaggcgcgcatcgtgcagattcgcaatgtcgagcgcggcgagagcgtcggctatggcggcacctggaccgcgcgccggccgaccaagcttgcaatcatcgcggtcggctatgccgacggctatttccgcgccgccagttcaaacgacggcacgcgcggcgcagaggtgatcgttgccggcaaacgctgcccggttgcaggccgcgtctccatggacctgatcgcgatcgacatcaccgatctgccgccgaacgcggcacggcgcggccacctggtgacgctgatcggcgaaggcatcaccgtcgacgagctcgcgcatcatttcggcacgatcggctatgaggtgctgaccagcctcggccaccgctatgcccgcgtctacaagggcggcaatgtggtggagccgctggcaaagccggcagccgagcagccgtcctctccgccgccggtcgagcagccggcgagcccgccgccgctgccgagctaa

SEQ ID NO: 32905 - protein, 423 aa, Bradyrhizobium japonicum USDA 110
MTMASDPKMNPQSGLLSAEANHAAALAAFGGVLTVDLDAIIANWRKLEKTAVPAECAAVIKADAYGCGAAQVARALHKAGCKTFFVATIEEARKVRAAVPEPTIYVLGGYFQNTGEHYAQINCRPVIGDLNELAEWDVFCRRTGWNGGAAVHIDTGMNRLGLTLAEAQAIIPRINAGDHGITLVMSHLVSAEQLNSPVNAKQLASFRGIASEFSGVPAALANSSGIFLGAPFQFDLVRPGAALYGVNPTPEADNPMQPVVDLKARIVQIRNVERGESVGYGGTWTARRPTKLAIIAVGYADGYFRAASSNDGTRGAEVIVAGKRCPVAGRVSMDLIAIDITDLPPNAARRGHLVTLIGEGITVDELAHHFGTIGYEVLTSLGHRYARVYKGGNVVEPLAKPAAEQPSSPPPVEQPASPPPLPS

SEQ ID NO: 32906 - DNA, 1164 bp, Clostridium tetani E88
  CDS (1)..(1164): transl_table=11
atgtttaaacatttaagacctgtatgggcagaaatagatttagataaattagtttataatatgcaacaaattaaaaatatatgtaaaggtagagaaattatagcagtagttaaagctgatgcttatggtcatggagcattagatattgccccaattctattagaaaatggagctactagattagcagttgcagtattaaatgaagcaatagaacttagaagaggtggaatagatgcacctataatggtgctaggatttacccctgatagtttaattgaaacttctttgaaatataatatagagcaaactgtatatagctatgaaatagcaaaggaaatatctgaagttgctgtgaaatctaatagagtagctaaaattcatatagctttggatacaggcatgggtagaataggatttttaccagataaagaaagcatagataaaatttataaattaagtaaattgcctaatatacagatagagggaatattctctcactttgcctccgctgatgaacaagataaaacttatactaaactacaatttaataaatttctttgggtttgtaatagtttagaagaaagggggatagacataaaaataagacatattgcaaatagtgctgccattatagatatgccagaattacacctagaaggggtaagaccaggtatcataatgtatggatattatccatctagtgaagttaataagggaaaattggacttaaaaccagttatgtctttaaaaactactatagttcatattaaaaatatggaaaaagggaagtatataagttatggaagagaatttaaaacagaaaaggaaagtataatagccaccttaccagtaggatatgctgatggatatagtagatccttatatgataagggaggaaaaattatattaaaagaacaattagctccattagtaggaagaatatgcatggatcaatgtatgatagatgtaagccacatagaagatgtgaaaataggagatgaagtaattcttatgggagagaataaaggtataaaaatgacggcagaagaaataggaaatttattaggaacaattaattacgaagtaacctgcatgataagtaagagggtacctagggtatatatacgagatggaaatatagttggaataagaaattatgtataa

SEQ ID NO: 32907 - protein, 387 aa, Clostridium tetani E88
MFKHLRPVWAEIDLDKLVYNMQQIKNICKGREIIAVVKADAYGHGALDIAPILLENGATRLAVAVLNEAIELRRGGIDAPIMVLGFTPDSLIETSLKYNIEQTVYSYEIAKEISEVAVKSNRVAKIHIALDTGMGRIGFLPDKESIDKIYKLSKLPNIQIEGIFSHFASADEQDKTYTKLQFNKFLWVCNSLEERGIDIKIRHIANSAAIIDMPELHLEGVRPGIIMYGYYPSSEVNKGKLDLKPVMSLKTTIVHIKNMEKGKYISYGREFKTEKESIIATLPVGYADGYSRSLYDKGGKIILKEQLAPLVGRICMDQCMIDVSHIEDVKIGDEVILMGENKGIKMTAEEIGNLLGTINYEVTCMISKRVPRVYIRDGNIVGIRNYV

SEQ ID NO: 32908 - DNA, 1179 bp, Vibrio parahaemolyticus RIMD 2210633
  CDS (1)..(1179): transl_table=11
atgggccaaacagccgcacatgccgctcctctgctagttgattttgatgacagcgagcgcgaagagcgcgttcaggcgagcaacgcttggctggaaattgatactcaggcattttcaaataatattcagttgcttcagaaggatctaaagggcaacactcagatctgtgccatcatgaaggctgacgcgtacggtaacggtatcgcaggcctgatgcctagcatcatcgcgaacaacgttgcatgtgtgggtatcaccagtaatgaagaagctcgcgtagtgcgtgagcatggcttcgaaggcaagatcatgcgtgtccgtgcggctagccgcaacgaaattgaaaacggcgtacagtacgaaatcgaagagctgattggcactaaaatgcaggcggatcaaatcatcgagattgcatacaactacaataccgttattcctgttcaccttgctctgaatacttcaggcatgggtcgtaatggtctggatctgacaacgtatgaaggtcaggttgaaggtgtggaaatcgcaagcgatcctaacctaaaaatcgtaggtatgatgacccacttcccgaatgaaggtcttgatgaaatccgccgcaaggttgaccgtttcaaagtagaaacaaagtggctaatggacagcgcaggtctgaaacgtaaagacatcacactgcacgtggctaactcttacatcacgctaaatctgcctgaagcacatctggatatggttcgtcctggcggcatgctgtacggtgactaccctgcaaccctaccttacgagcgcatcgtgtctttcaaaacacgcatagcatcactgcacttcttccctgcaggcagcacaatcggctacggcagcactaaagttttagagcgtgactctatcctggctaacctacctatcggctactcagacggtttcgcccgttcactaagcaacaaagctgatgttctgatcaacggtcagcgtgctcgcgtaatgggtaaagcgtcaatgaacactactatggttgatgtcactgacatcattggtgtccaggcaaacgacgaagtagttgtatttggccgccaaggctttgaagaaatcacagcagaagaaaccgaagagaaaagcggtcgtattctgcctgagcactacactatctggggtgcaactaaccctcgcgtttaccgttaa

SEQ ID NO: 32909 - protein, 392 aa, Vibrio parahaemolyticus RIMD 2210633
MGQTAAHAAPLLVDFDDSEREERVQASNAWLEIDTQAFSNNIQLLQKDLKGNTQICAIMKADAYGNGIAGLMPSIIANNVACVGITSNEEARVVREHGFEGKIMRVRAASRNEIENGVQYEIEELIGTKMQADQIIEIAYNYNTVIPVHLALNTSGMGRNGLDLTTYEGQVEGVEIASDPNLKIVGMMTHFPNEGLDEIRRKVDRFKVETKWLMDSAGLKRKDITLHVANSYITLNLPEAHLDMVRPGGMLYGDYPATLPYERIVSFKTRIASLHFFPAGSTIGYGSTKVLERDSILANLPIGYSDGFARSLSNKADVLINGQRARVMGKASMNTTMVDVTDIIGVQANDEVVVFGRQGFEEITAEETEEKSGRILPEHYTIWGATNPRVYR

SEQ ID NO: 32910 - DNA, 1116 bp, Enterococcus faecalis V583
  CDS (1)..(1116): transl_table=11
atggtcgttggatggcatcgtcctacacggttacatatcgatacgcaagcaattactgaaaatgtccaaaaggaatgtcaacgtttgccagaaggaaccgctttatttgcggttgtaaaagcgaacggctatgggcatggcgccgtagaatccgccaaagcggcgaaaaaaggtggcgcgacaggtttttgtgtcgccttattggatgaagcaattgaattgagagaagcaggtgttcaggaccccattttaattttgagtgtggtagacttagcttatgtgcctttgttgattcaatatgatttgtctgtaacggtagctacacaagaatggttagaagctgctcttcaacaactaacgcctgagagtaacacgccattacgtgttcacttaaaagtcgatactggcatgggacggattggttttttaaccccggaagagactaagcaagcagtgcggtttgttcaatcccacaaagaatttttatgggaagggatttttactcatttttcaacagctgatgaaatcgatacaagctattttgaaaaacaagcagggcgttttaaggctgttctagcagttttagaagagttacctcggtatgtccatgttagcaatagtgcgacagcgttatggcatcctgatgtgccaggaaacatgattcgctatggggtagccatgtatggattgaacccttcaggtaataagctggccccaagctatgcgttaaagccggccttacggttgaccagtgaactcatccatgtaaaacgcttagcggctggtgaagggattggctatggcgaaacctacgtaactgaagctgaagaatggattgggacagtgccaatcggctatgcagatggctggttgcgtcatctccaaggatttacagtgctcgtgaatggtaagcgttgcgaaatcgtcggacgagtgtgtatggatcaatgtatgattcgtttagcagaagaagttcctgtcggctcagtcgttacattagttggaaaagatggcaatgaagaaaatacgttacaaatggtagccgaaaaattagaaaccattcattatgaagttgcatgtactttctcacaaagaatccccagagaatataactag

SEQ ID NO: 32911 - protein, 371 aa, Enterococcus faecalis V583
MVVGWHRPTRLHIDTQAITENVQKECQRLPEGTALFAVVKANGYGHGAVESAKAAKKGGATGFCVALLDEAIELREAGVQDPILILSVVDLAYVPLLIQYDLSVTVATQEWLEAALQQLTPESNTPLRVHLKVDTGMGRIGFLTPEETKQAVRFVQSHKEFLWEGIFTHFSTADEIDTSYFEKQAGRFKAVLAVLEELPRYVHVSNSATALWHPDVPGNMIRYGVAMYGLNPSGNKLAPSYALKPALRLTSELIHVKRLAAGEGIGYGETYVTEAEEWIGTVPIGYADGWLRHLQGFTVLVNGKRCEIVGRVCMDQCMIRLAEEVPVGSVVTLVGKDGNEENTLQMVAEKLETIHYEVACTFSQRIPREYN

SEQ ID NO: 32912 - DNA, 1095 bp, Coxiella burnetii RSA 493
  CDS (1)..(1095): transl_table=11
gtgaatcgtgcaaccgcgactattaacgtaacggcgttaaagcataatttatctcaaataaaagcattggcgccgaagtctcttgcctgggcgatgattaaaagcaatgggtatgggcacggattggtgagagtggccaaagcgttatcggacgcaaatgcatttggtgtggcgtgtattgatgaagcgttaactttaagagaagtaggcatcaaatcgcctatcattgtaatgaaaggattttataatgaagccgagttgtcccaatttgcccgacatcgattaggcgccgttattcactgctcggatcaagttagccttttagaaaagactaatttaacctcttctttatccgtatggttaaaaatcgatacgggaatgaatcgccttggattttctgtggaacaatcgcccgcggtttataatcaattaaaaacttcttcttccatccaaaaaccgattggactaatgacgcatttagcggatgcagacaacgagaataaaacgtttaccgaattacaaattaaacgctttttctcagttactgaaaagatgattggtcccaaaagtattgtgaattcagcagggttttttgcttatccgaacgccttggtcgattggattcgtcctggcatcatattatatggaatttcaccctttggaattaattataattcctttaaagaaaaaatcgaaaagaaattcagaccggtaatgactttatctgcaaaaataatagcgattaaaaatcgtcgacaaaacgatagcgttgggtacggttgtacttggtcatgtcctgaagatatgccgatagccattgttagcattggttatggcgatggttacccccgccacgcaccgagtggaacgcccgtgttgttgaacgggaaaatatgtcctttaatcgggcgagtatctatggacatgattgctattgacttacgctctcagccaaatgcacaggttggcgatgacgttattttatggggagaagggttgccagtagaaattatcgcagaaaaagcgggtaccatcgcttacgaattattgtgtaaaattacgcaacgcgttcaatttattgagatagaaaaatga

SEQ ID NO: 32913 - protein, 364 aa, Coxiella burnetii RSA 493
MNRATATINVTALKHNLSQIKALAPKSLAWAMIKSNGYGHGLVRVAKALSDANAFGVACIDEALTLREVGIKSPIIVMKGFYNEAELSQFARHRLGAVIHCSDQVSLLEKTNLTSSLSVWLKIDTGMNRLGFSVEQSPAVYNQLKTSSSIQKPIGLMTHLADADNENKTFTELQIKRFFSVTEKMIGPKSIVNSAGFFAYPNALVDWIRPGIILYGISPFGINYNSFKEKIEKKFRPVMTLSAKIIAIKNRRQNDSVGYGCTWSCPEDMPIAIVSIGYGDGYPRHAPSGTPVLLNGKICPLIGRVSMDMIAIDLRSQPNAQVGDDVILWGEGLPVEIIAEKAGTIAYELLCKITQRVQFIEIEK

SEQ ID NO: 32914 - DNA, 1170 bp, Bacillus cereus ATCC 14579
  CDS (1)..(1170): transl_table=11
atggaagaagcaccattttaccgtgacacttgggtggaagtggatttagatgccatttataacaacgttacacatattaaagagttcatcccaagtaatgtagagatttttgctgtagttaaagcaaacgcatatgggcacgattatgtaccggtggctaaaacggcattagaagcaggtgcaacaaggttagctgttgcttttttagatgaagctttagtgcttcggagggctggtattactgagccgattttagtgttaggtccctcgccgccgcgtgatgtaaatgtagctgctgaaaatgatgtagcgctaacggtttttcaaaaagaatgggtggacgaagcaattaaactttgggatggttcatctgtaatgaaattccatattaactttgatagtggtatggggagaattggaatacgtgaaagaaaagagctaaaagaatttttaaagagtttagagggtgcaccgtttttagagttagaaggagtatacacgcattttgcaacggcagatgaagttgagacttcgtattttgataagcaatataacacgttcttagagcagttaagttggttgaaagaattcggagtggatcctaagtttgttcatacagctaatagtgctgcgacgttacgttttcaagggattacatttaatgcagtgcgaattgggattgcaatgtatggattatctccttctgtagaaatacgtccttttttaccatttgaattagaaccggcgctatcacttcatacgaaagtcgctcatattaaacaggtaattaaaggtgatggaattagttataacgtcacctaccgaacgaaaactgaagaatggattgcgactgtagcgattggctatgcagatgggtggcttaggaggttacaaggatttgaagtgcttataaatggtaaaagggtaccgattgtagggcgagtaacaatggatcagttcatgattcatcttccttgtgaagtgccacttggtacgaaagttacgcttattggaaggcaaggagatgagtatattagcgctacagaggttgcggaatactcagggactattaattatgaaattattgcaacgatcagtttccgtgtgccgagaatatttatacggaatggtaaggttgtagagataattaattacttgaacaatatatag

SEQ ID NO: 32915 - protein, 389 aa, Bacillus cereus ATCC 14579
MEEAPFYRDTWVEVDLDAIYNNVTHIKEFIPSNVEIFAVVKANAYGHDYVPVAKTALEAGATRLAVAFLDEALVLRRAGITEPILVLGPSPPRDVNVAAENDVALTVFQKEWVDEAIKLWDGSSVMKFHINFDSGMGRIGIRERKELKEFLKSLEGAPFLELEGVYTHFATADEVETSYFDKQYNTFLEQLSWLKEFGVDPKFVHTANSAATLRFQGITFNAVRIGIAMYGLSPSVEIRPFLPFELEPALSLHTKVAHIKQVIKGDGISYNVTYRTKTEEWIATVAIGYADGWLRRLQGFEVLINGKRVPIVGRVTMDQFMIHLPCEVPLGTKVTLIGRQGDEYISATEVAEYSGTINYEIIATISFRVPRIFIRNGKVVEIINYLNNI

SEQ ID NO: 32916 - DNA, 1227 bp, Bacillus cereus ATCC 14579
  CDS (1)..(1227): transl_table=11
atgaaacgtgaaatagaatggaatgcaattattgagttaggagttagaccaatgagtttgaaatatggaagagatacaattgtagaaattgacttaaatgctgtaaaacataatgtaaaagaatttaaaaaacatgtaaatgatgaagaaattaagatgatggctgctgtaaaagcgaatgggtatggccatggggcagttgaagttgccaaagctgcaattgaagcaggaatacatcaacttgcagttgcatttgtagatgaagcaatagaattaagagaagcaggaattactgtgccgattttaattttaggatacacaccagtagcggctgtagaagatgtaattcaatatgacgttatgatgactgtttatagagtagaagatttacatggtataaatgaaattgcaaaccgtcttcaaaagaaagtacaaattcaagtgaaaattgatacaggaatgagtcgtatcggtttacaagaagaagaagttaaaccatttttagaagaattaaaccgtatggagtatgtagaggtagtagggatatttacgcattactctacggcagatgaaatcgataaatcatatacgaatatgcaaacaagtttatttgaaaaagctgttaatacagcgaaagaattaggaattcaaataccatatattcatagttcaaatagtgcgggatcaatggaattaagtaacacatttcaaaatatggtacgcgttggaataggagtgtacggtatgtatccgtcaaaagaagtggatcattcagtcgtttctttacagcctgcgttgtcgttaaaatcaaaagtagctcatattaaacatgcgaagaagaatcgtggtgtaagttatgggaatacgtatgtaacaactggtgaagaatggattgcgactgtaccaattggttatgctgatggttataatcgtcaattatctaataaaggctatgcgttaattaacggggttcgagtacctgttattggccgtgtttgtatggaccagttaatgttggatgtttcaaaagcgatgccagtacaagtaggagacgaagtagtattctacggtaaacaaggtgaagaaaatatcgcagtagaagaaatagcggatatgttaggtacaataaactatgaagttacatgtatgctagatagaagaattccgcgtgtctataaagaaaatgacgaaacaactgcagttgtaaatatattaagaaaaaactga

SEQ ID NO: 32917 - protein, 408 aa, Bacillus cereus ATCC 14579
MKREIEWNAIIELGVRPMSLKYGRDTIVEIDLNAVKHNVKEFKKHVNDEEIKMMAAVKANGYGHGAVEVAKAAIEAGIHQLAVAFVDEAIELREAGITVPILILGYTPVAAVEDVIQYDVMMTVYRVEDLHGINEIANRLQKKVQIQVKIDTGMSRIGLQEEEVKPFLEELNRMEYVEVVGIFTHYSTADEIDKSYTNMQTSLFEKAVNTAKELGIQIPYIHSSNSAGSMELSNTFQNMVRVGIGVYGMYPSKEVDHSVVSLQPALSLKSKVAHIKHAKKNRGVSYGNTYVTTGEEWIATVPIGYADGYNRQLSNKGYALINGVRVPVIGRVCMDQLMLDVSKAMPVQVGDEVVFYGKQGEENIAVEEIADMLGTINYEVTCMLDRRIPRVYKENDETTAVVNILRKN

SEQ ID NO: 32918 - DNA, 1089 bp, Nitrosomonas europaea ATCC 19718
  CDS (1)..(1089): transl_table=11
atgtcccggccgatccgcgccttcataaattgtgctgctttacggcacaacctcgccgtcgttcgcagacacgttcaccaggctcgtatcatggccgtcgtcaaggctgatgcctatggtcacggtttacttcgtgtcgcccgggcacttgatgctgtcgacggatttgcggtacttgaactggaagcggcgattcagttgagagaagccggattcagccagctcattctgctcctggaaggtttcttttcgatagaggaaattgaagcgatcaatcactacaggctgagcacggtaattcactgtcatgaacagctatcgatgctgctggcccataaaaaaacaggaaaaccggatatcttcctcaaaatcaataccgggatgaaccgtcttggtttcaggcctgaagaaggaaattctgtcttgaacaggctcagacaatggcatacagatatcagtatcacgctgatgacacattttgcctgcgccgatgatttactggaagcagatcatgttgatcagcaactgggcagttttgcacgactcgaggaaaaacgggaaggctgtataccccgaacattggccaattctgctgcaatcctgcgttatcccggaacacatgcagactgggtacgtcccggcataatactctatggcgcctcccctttaccggacaaaacaggtatcgaactcggattacaaccagtcatgactctgaccagccggatcatcgctgtacagcatcttgatttttcggatcgactgggatatggaggacagttcgttgccgatcagccgatgcgtgtcggagtcgttgcagcaggttacgcggacgggtacccgcgccatgctcctaccggaactccggtactggtcaacggccgacgcacacgcttgatcggacgtgtttcaatggatatgttgactgttgatctaagcgggatcaatgaagctggtgcagggagcctggtaaccctttggggtgaagggttaccggtagaagaagttgccagatcagcacaaactatcagttacgagctcctggctgcactttctccgagagtgcaaaccgtgagctctatcccctga

SEQ ID NO: 32919 - protein, 362 aa, Nitrosomonas europaea ATCC 19718
MSRPIRAFINCAALRHNLAVVRRHVHQARIMAVVKADAYGHGLLRVARALDAVDGFAVLELEAAIQLREAGFSQLILLLEGFFSIEEIEAINHYRLSTVIHCHEQLSMLLAHKKTGKPDIFLKINTGMNRLGFRPEEGNSVLNRLRQWHTDISITLMTHFACADDLLEADHVDQQLGSFARLEEKREGCIPRTLANSAAILRYPGTHADWVRPGIILYGASPLPDKTGIELGLQPVMTLTSRIIAVQHLDFSDRLGYGGQFVADQPMRVGVVAAGYADGYPRHAPTGTPVLVNGRRTRLIGRVSMDMLTVDLSGINEAGAGSLVTLWGEGLPVEEVARSAQTISYELLAALSPRVQTVSSIP

SEQ ID NO: 32920 - DNA, 1176 bp, Bacillus anthracis str. Ames
  CDS (1)..(1176): transl_table=11
atgagtttgaaatatggaagagatacaattgttgaagttgacttaaatgcagtaaaacataatgtaaaagaatttaaaaaacgtgtgaatgatgaaaatattgcaatgatggctgctgtaaaagcgaatgggtatggtcatggggcagttgaagttgcaaaagctgctattgaagcaggaataaatcagcttgcaattgcatttgtagatgaagcgatagagttaagagaagcaggaattaacgtgccgattttaattttaggctatacatcagtagcggctgcggaagaagcaattcaatatgacgttatgatgaccgtttatagaagtgaagatttacaaggtataaatgaaatcgcaaaccgtcttcaaaagaaagcgcaaattcaggtgaaaattgatacaggaatgagtcgcattggtttacaggaagaagaggttaaaccatttttagaggaattaaaacgtatggagtatgtagaggtagtgggaatgtttacacattactctacggcagatgaaatcgataaatcatatacgaatatgcaaacaagtttatttgagaaagctgtcaatacagcaaaagaattaggaattcatattccatatattcatagttcaaatagtgcaggttcaatggaacctagcaatacatttcaaaatatggttcgtgtaggtatcggaatttatggaatgtatccttcaaaagaggtaaatcattcagttgtttcgttacagcctgcgttgtcgttaaaatcaaaagtagcccatattaagcatgcgaagaaaaatcgcggtgtaagttatgggaatacgtatgtaacgactggtgaagaatggattgccaccgtaccgattggttatgctgatggttataatcgtcagttgtctaataaagggcatgcattaataaatggagttcgagtacctgttattggccgtgtttgtatggatcagctcatgttagacgtttcaaaagcaatgccagtacaagtgggagacgaagtagtattctacggtaaacaaggcgaagaaaacatcgcagtagaagaaatagcggatatgttaggtacaattaactatgaagttacatgtatgttagatagaagaattccacgtgtgtataaagaaaataatgaaacaactgctgttgtaaatatactaagaaaaaactga

SEQ ID NO: 32921 - protein, 391 aa, Bacillus anthracis str. Ames
MSLKYGRDTIVEVDLNAVKHNVKEFKKRVNDENIAMMAAVKANGYGHGAVEVAKAAIEAGINQLAIAFVDEAIELREAGINVPILILGYTSVAAAEEAIQYDVMMTVYRSEDLQGINEIANRLQKKAQIQVKIDTGMSRIGLQEEEVKPFLEELKRMEYVEVVGMFTHYSTADEIDKSYTNMQTSLFEKAVNTAKELGIHIPYIHSSNSAGSMEPSNTFQNMVRVGIGIYGMYPSKEVNHSVVSLQPALSLKSKVAHIKHAKKNRGVSYGNTYVTTGEEWIATVPIGYADGYNRQLSNKGHALINGVRVPVIGRVCMDQLMLDVSKAMPVQVGDEVVFYGKQGEENIAVEEIADMLGTINYEVTCMLDRRIPRVYKENNETTAVVNILRKN

SEQ ID NO: 32922 - DNA, 1242 bp, Helicobacter hepaticus ATCC 51449
  CDS (1)..(1242): transl_table=11
atgaatatatttaaaactggatttactaccctattacttatgggaatacttgctagtgcaaattttgcctcgcctatacttgttgagagcacaaatgtgaacaaaaacaatacaaactcttttatggaagttgatataaaagcctttaaaaataatatcaaagttgccaaaaaaatagcaggaaatgctaaagtttgtgcagttttaaaagccaatgcttatggggctggaataagcaaagtgttgcccactatcatagaagaaaaaatcccttgtgtggctattacaagcaatgaagaagcaagagttatccgcaaaatgaaatatacaggcgagattctacgaatacgaacagccacaatgggagaaataaaagatggtttaaaatataacatcacagaagttttgggaaatttagatcaagcaaaaaaagtagattctctagcaaagacgataggcaaaaaacttcccattcatatcaaactcaattcaggtggaatggatagaaatggtattgatttaagcactgataaaggcaaagaatctgcagttaagttagctactttgccacatcttaaaataaaagggctaatgacacattttccttatgatgatacctcaaaagtaaaggaaaatttaaaacattttgaagaagatacggattttctaataagtaaagcaaaacttgatagaaataaacttgtgctgcacgctgctgcctcatatgcagcagtgcaagtgcctcaatcaaggttagatatgatacgacccggaaagcttatttatggctatggtggaggagatgaaaatctacccatacaacaaattatgagtttaaaatctcaagtagcagttataaatgaatatccaaaagggagcaaagtaagctatgatggcactcacacacttacaagagattctaaactcgccaatattcctgtgggttattatgatggctatgcaaaatctttaagcaatcaaggaaaagtgcttattagagggcataaagtgccagtcgttgggagagttacaaaaaatacttttatggtagatgtaaccgattatccagatattaaagcaggcgatgaagtcgtgctctttggaaaacaatgcggcaatgaaatcactcaagccgaatttgaaaaaggaacgggcacgattctctctgaaacattaggatattggggaagtgcaaatcctatttttattaaaaattataaaatgaaagaagtatgcaaataa

SEQ ID NO: 32923 - protein, 413 aa, Helicobacter hepaticus ATCC 51449
MNIFKTGFTTLLLMGILASANFASPILVESTNVNKNNTNSFMEVDIKAFKNNIKVAKKIAGNAKVCAVLKANAYGAGISKVLPTIIEEKIPCVAITSNEEARVIRKMKYTGEILRIRTATMGEIKDGLKYNITEVLGNLDQAKKVDSLAKTIGKKLPIHIKLNSGGMDRNGIDLSTDKGKESAVKLATLPHLKIKGLMTHFPYDDTSKVKENLKHFEEDTDFLISKAKLDRNKLVLHAAASYAAVQVPQSRLDMIRPGKLIYGYGGGDENLPIQQIMSLKSQVAVINEYPKGSKVSYDGTHTLTRDSKLANIPVGYYDGYAKSLSNQGKVLIRGHKVPVVGRVTKNTFMVDVTDYPDIKAGDEVVLFGKQCGNEITQAEFEKGTGTILSETLGYWGSANPIFIKNYKMKEVCK

SEQ ID NO: 32924 - DNA, 1161 bp, Prochlorococcus marinus subsp. marinus str. CCMP1375
  CDS (1)..(1161): transl_table=11
ttggctaccacttctatgcctttaaataaaattgatccacgccagagagcttgggtagaggtgtccccagatgcaataaaggcaaatactcttgccattagaagtttattagatgaacagtgcttgttgatggcagttgttaaagcagatggttatgggcatggttctgaaactgttgccgaagctgctttggctggtggtgctactaatttaggagtggcaacattgcaggaagcattggagctaagaaaggcagggattgtttgtccgatacttgttcttggcaatttaattaatcccgaagatttagatgcttgcattcattgggatttaatgcccacattaagcagtgctagagaggccttattgtgcaatcaaattgctgaatctcacgacaaagagttttgtgtccatataaaagttgatacaggcatgacaaggctgggatgcgatttaaggcttgcctcagagctgattcaacttgttgacaaccttaaaaatctttctcttcgaggaatttatagtcatcttgctttggctgatgtagaagcaaatggtcaagcaaattcatttactagcaaacagaaagaaaaatttgaaacacttttgtcaagcgtgatgccaagaggaaagcctctttacaggcatctagctaattcagcaggaactcttagagacaaaggactacattttgatatggttcgagttggcttggctttgtatggttatagccctttaaaagatttaaggaataatttctctttgcagcctgctttggctgttagagcaaaagttactcttttgagagatgttccttctgacacaggagttagttatggccatacttttataacgcagcgccctagtagacttgcagttgtgggaattggatatgctgatggtataagtcgtgcgttatctgggaaaatgtctgtattaattgatggaaagttttatccacaagtgggttcaataacgatggatcaacttgttatagatatcactgaaagtcctcaaatacaaataggatcagttgttactctacttggggttgatggagattcagcgataacaccatatgattggagcgaaataagtggatctattccttgggagattttgtgtagttttaaataccggctgcccagagtggtaatttga

SEQ ID NO: 32925 - protein, 386 aa, Prochlorococcus marinus subsp. marinus str. CCMP1375
MATTSMPLNKIDPRQRAWVEVSPDAIKANTLAIRSLLDEQCLLMAVVKADGYGHGSETVAEAALAGGATNLGVATLQEALELRKAGIVCPILVLGNLINPEDLDACIHWDLMPTLSSAREALLCNQIAESHDKEFCVHIKVDTGMTRLGCDLRLASELIQLVDNLKNLSLRGIYSHLALADVEANGQANSFTSKQKEKFETLLSSVMPRGKPLYRHLANSAGTLRDKGLHFDMVRVGLALYGYSPLKDLRNNFSLQPALAVRAKVTLLRDVPSDTGVSYGHTFITQRPSRLAVVGIGYADGISRALSGKMSVLIDGKFYPQVGSITMDQLVIDITESPQIQIGSVVTLLGVDGDSAITPYDWSEISGSIPWEILCSFKYRLPRVVI

SEQ ID NO: 32926 - DNA, 1128 bp, Bordetella pertussis Tohama I
  CDS (1)..(1128): transl_table=11
atgccgcgtcccatatttgcttcgatctcccagtccgccctgcggcacaaccttgccaccgtgcgtcgtcatctcgatgacgtggcggccaaggcggacggcacgccgccctccatctgggcggtcatcaaggccaatgcctacggccatggcatcgaacaggcggtggccggtttctcggcggcccagggcctggccatgttggacctgcaggaggccgtgcgctgccgcgaagcgggctggggcggccctatcctgctgctcgaaggcttcttccagccgtccgacctggaaatcgtcgaccgctatcatctcgccaccaccgtgcatacgcgcgagcagttcgacatgctggcgcatgcgcggctgtcgcgccgcgtcgacatcatggtaaagctcaacagcggcatgaaccggctgggtttcgcgccggacgcctatgggtccgcctacgcgcgcgcgcagcagctgcatgagtacggcgtggtgggcggcatcggcaagatgacccatttcgcctgtgccgacgggccgcagggcgtgacccagcagatgaacgtcttcaacggcgccaccgcgcacctggccggggcgaccagcgtctgcaattcggccgccaccctgcgctatgccgacctggcggtcggccacgacggccagacccattgggtgcggccgggcatctgcctgtacggcgcctcgccgttcgccgatgcccaggccggggcgttcggattgattccggccatgacgctgcgctccgagctgatcgccatccaggatatcccggccggcgcggcggtgggttacggcgccattttccgcgccgaccggccgatgcgcatcggcgtggtggcgtgcggctatgccgacggctatccgcgccatgccggcaccggtacgcccctgaccgtgggcggcgtgcgcacgcggctggtcggccgcgtgtcgatggacatgctcatggtcgacctggatccggtgccggccgccggtatcggcacgcccgtggtgctgtggggcgaggacggcccgtcggtcgacgaagtggccgaggccgccggcaccatcggctacgaattgctgtgcgcgctggccccgcgcgtacccgtgcgccacgaaggctga

SEQ ID NO: 32927 - protein, 375 aa, Bordetella pertussis Tohama I
MPRPIFASISQSALRHNLATVRRHLDDVAAKADGTPPSIWAVIKANAYGHGIEQAVAGFSAAQGLAMLDLQEAVRCREAGWGGPILLLEGFFQPSDLEIVDRYHLATTVHTREQFDMLAHARLSRRVDIMVKLNSGMNRLGFAPDAYGSAYARAQQLHEYGVVGGIGKMTHFACADGPQGVTQQMNVFNGATAHLAGATSVCNSAATLRYADLAVGHDGQTHWVRPGICLYGASPFADAQAGAFGLIPAMTLRSELIAIQDIPAGAAVGYGAIFRADRPMRIGVVACGYADGYPRHAGTGTPLTVGGVRTRLVGRVSMDMLMVDLDPVPAAGIGTPVVLWGEDGPSVDEVAEAAGTIGYELLCALAPRVPVRHEG

SEQ ID NO: 32928 - DNA, 1164 bp, Bordetella pertussis Tohama I
  CDS (1)..(1164): transl_table=11
atgcccctcgcgtccgatcccttcgaagctccgattcccggcctccatgcctgcatcgacccgattgcggtggcccacaacctggaagtcctgcgccaacggctgggcgtgggcgtcgatggtccgcgcatatgggccaccgtcaaggccgatgcctatgggcacggactgcacaatgtcctgccgggcctgcgcgccgccgacggcatcgccgtccggcatctgcacgaagcccaccagtgccgccgtgtcggctggagcggtcccatcatggtctatgccgggctgacccacgaacgcgaggccgcgctcctgacgctgcaacagctgcacctggtcattaccgacatgacgcaactcgaatggctgccaggcaagcccttgtattcgtgcgcgccctggatatggctgcgctacatcggcgccacgcggctgggcgggctggacgccagcgagtatcggcgcgcctatgcgcgctgccgtgagctgcagcagcatggcgcgctgcgtggcgtgggccatctgaaccactacgcgaacgccgccagcgtcggcgatctcgaacgcgagcacgccgatttcgaggcctgcatccggggtctgccggggccggtttccacctgcaattcggcggccgcctgtgtcctgccgacgatggcggcgcgaaccgactgggtccgccccggtctggcactgtatggcgtaagccccattccgggccgcgccgggcgcgacctgggcctgcgccccgccatgaccttgcgcagcacattgtgcgcgacgcagaacctgcctgccggcgcctcggtcggctatggttgcacgttcgtggccgaccagccgatggcgctggggttggtgcgttgcgggtacggcgacggctacccgcacaatccacgagccagcttccctgtccaggtggacggcgtgctgacacggacggtgggcaggatttcgatggacctgatggctgtcgatctgcggccgatccccgccgcggcccggggcgcgcctgtcgtgctgtggggctcgccgcagctgccggtcgaacacatcgcgcacgcggcgggcaccatcgccgccgagttgctcaccgggctgacggcgcgcgtgcccctgatgcgagccgaccacgcggcgctgctgcgcgggccccctgcctag

SEQ ID NO: 32929 - protein, 387 aa, Bordetella pertussis Tohama I
MPLASDPFEAPIPGLHACIDPIAVAHNLEVLRQRLGVGVDGPRIWATVKADAYGHGLHNVLPGLRAADGIAVRHLHEAHQCRRVGWSGPIMVYAGLTHEREAALLTLQQLHLVITDMTQLEWLPGKPLYSCAPWIWLRYIGATRLGGLDASEYRRAYARCRELQQHGALRGVGHLNHYANAASVGDLEREHADFEACIRGLPGPVSTCNSAAACVLPTMAARTDWVRPGLALYGVSPIPGRAGRDLGLRPAMTLRSTLCATQNLPAGASVGYGCTFVADQPMALGLVRCGYGDGYPHNPRASFPVQVDGVLTRTVGRISMDLMAVDLRPIPAAARGAPVVLWGSPQLPVEHIAHAAGTIAAELLTGLTARVPLMRADHAALLRGPPA

SEQ ID NO: 32930 - DNA, 1188 bp, Prochlorococcus marinus subsp. pastoris str. CCMP1986
  CDS (1)..(1188): transl_table=11
ttgaataatcgaaaaattaattttgatactcttccaagttttgaaggagaaatagatccaactcaaagagcttggatagaagtcagtggtaaagcaatagagtcaaacgtaaggcaattaagatcaaaattaaaaaataattgtgaatttatggcagttgtcaaagctgatggatatggacatgatgcaaaagttgtatctgaaaaagcgattaaaggtggcgcttctcaattaggagtagcaaccttaaaggagggtataaagcttcgttcttttgggataaatgccccaattcttgtacttggtaatctttatacgaaaaaagatttattaatatgttttagaaatgatttgatgccaactattagtacatttagggagtgtttgatttgtaataacattggaaagagtaataatttaaaattctcgttgcatctaaaagttgatactgggatgtcaagattaggatttgaatgtgatcagtttgttcaacaatttaataatattaaatcacttgaaaatattgctgttaagggaatatatagtcatctcgcctgcgcagatgaaaagaatgctttgaatcctaaaagcagcactcaattacaaaaagaaaaatttcaagaattattgaaaattattgatattgataatacacaaaatattaagattcatcttgctaattctgctggcatggttcttggcaaagattttcattttgatatggtacgcgttggcctttctatgtatggctatgacccatcagtaaatataaatgaaaatttatttcttaaacctgctttatttttaaaggctaaagtgacttttgttcgaactattgaaaaaggtattggagtcagttatggaaataaatttgttagtgatagaaaaacaaagttagcagttttaagtattggttatgctgatggcatcattagaaatttatctggcaaaataagtttgattcataataaaagactttatcctcaagttggatctataacaatggatcaaatgatggtagatattacagactcaaatgatattgaagttggtagtaccatgctactactaggatctgaaggagataaatcaatttctccgattgactgggcagataaatgtaatagcattccttgggaaattctttgctcttttaaaaatagattaccaagagtccaagttgattag

SEQ ID NO: 32931 - protein, 395 aa, Prochlorococcus marinus subsp. pastoris str. CCMP1986
MNNRKINFDTLPSFEGEIDPTQRAWIEVSGKAIESNVRQLRSKLKNNCEFMAVVKADGYGHDAKVVSEKAIKGGASQLGVATLKEGIKLRSFGINAPILVLGNLYTKKDLLICFRNDLMPTISTFRECLICNNIGKSNNLKFSLHLKVDTGMSRLGFECDQFVQQFNNIKSLENIAVKGIYSHLACADEKNALNPKSSTQLQKEKFQELLKIIDIDNTQNIKIHLANSAGMVLGKDFHFDMVRVGLSMYGYDPSVNINENLFLKPALFLKAKVTFVRTIEKGIGVSYGNKFVSDRKTKLAVLSIGYADGIIRNLSGKISLIHNKRLYPQVGSITMDQMMVDITDSNDIEVGSTMLLLGSEGDKSISPIDWADKCNSIPWEILCSFKNRLPRVQVD

SEQ ID NO: 32932 - DNA, 1197 bp, Prochlorococcus marinus str. MIT 9313
  CDS (1)..(1197): transl_table=11
atgcgagacctgatcgccccacacggtgatctacctaggggcaaaaaccctgagcagattgcaaaagccgatccacgtcagcgcgcctgggtggaagttaaccccgcagctgtggaagccaattgccgcagccttcggagacacctttgtgaaagttgtgccctgatggccgtggtgaaagctgatggctatggccatggcgctttaaccgtagcccgagccgccttgcaaggaggagcaaaaagccttggagtagcaaccctccaagaagggattgagcttcgtcaagccggccacaatgccccagtgcttgtgctaggcaatctcacccatagcgaagacctgaaagcttgcctccattggcaactcatgcccaccctcagcagtatgcgagaggctctgctctgccaaaaccttgcagatggcagcggccggcaattcaggattcagctcaaaatcgatactgggatgacccgcctcggctgcgagctaaaggaagctcccatgctggtggaggcgataggccacctcaatcaactggaattaaagggtatctatagccatttagccctggcagatggggatctccaagggaaagccgcaatggtgacggatcagcagcagcaacactttgagacggtgctaagaacgctgccagagcaacacaatggatttacgcggcaccttgccaactccgccggcacccttcgcgatcgcggactccactacgacatggtgcgcgttggtcttgctctgtatggccacagccccaacctccaactacaaggaaaagtagaccttcagccagctctcagcgtcaaagcaagggtgacattgataagggatgtgcctgcaggtgtgggagtgagttacggccatcgcttcaccacacgacgccccagtcgcctagcagtcgtaggaatcggctatgccgacggggttagccgatccctatcaggccaaatctctgccatagccgatggtcagcttctcccacaggttggcgccatcaccatggatcaactcgtgcttgatgccacaaatcatcccgacctagaggtgggaagcatcgtgaccctcctaggcaaggacggtgacgcctgtattacaccacaacaatggagtgatctgagtggatcaattccatgggaggtgctctgcagcttcaaacatcgactacccagactggtgatttga

SEQ ID NO: 32933 - protein, 398 aa, Prochlorococcus marinus str. MIT 9313
MRDLIAPHGDLPRGKNPEQIAKADPRQRAWVEVNPAAVEANCRSLRRHLCESCALMAVVKADGYGHGALTVARAALQGGAKSLGVATLQEGIELRQAGHNAPVLVLGNLTHSEDLKACLHWQLMPTLSSMREALLCQNLADGSGRQFRIQLKIDTGMTRLGCELKEAPMLVEAIGHLNQLELKGIYSHLALADGDLQGKAAMVTDQQQQHFETVLRTLPEQHNGFTRHLANSAGTLRDRGLHYDMVRVGLALYGHSPNLQLQGKVDLQPALSVKARVTLIRDVPAGVGVSYGHRFTTRRPSRLAVVGIGYADGVSRSLSGQISAIADGQLLPQVGAITMDQLVLDATNHPDLEVGSIVTLLGKDGDACITPQQWSDLSGSIPWEVLCSFKHRLPRLVI

SEQ ID NO: 32934 - DNA, 1131 bp, Synechococcus sp. WH 8102
  CDS (1)..(1131): transl_table=11
atgtcggagctaagtccacgccagcgcgcctgggtggaggtctaccccacggccattgaggccaactgccgactgctgtgccgtcaacttgtcaccggctgccagctgatggccgtggtgaaagccgacggctatggccacggcgccgtgaccgtggcgagggcttccctacgcggcggggcatccagccttggggtggcaacccttcaggaaggcctggaactgcgggatgcaggcatcgaggcgccggttctgatcctcagcgccctgccaagcccggaggatctccgccactgcctggagcagcggctgatgccgaccctgagcagcctggatgaagcgaacacggccgctgcggtggctgctgaacgaggaaacgagcgctttcctgtgcagctgaaactcgatacagggatggccaggctcggtggcgaatggcaggagggagcccagctggtgcagtccatccgcaccctgcctcagctggaactagtaggcctatacagccatctcgcctgtgcggatgagcttggcgatcaactcacccacctgcagctgcagcgctttcgatccgtcattgaagccctgccggatggcggcagcggcctgtgctgccatctggccaattccgccggaaccctgcaggatccccgtttgcatctggacatggtgcgcgttggcctcgccttgtacggacaatccccagctgaccacctcggcctcgatttagcactacagcctgccttggcggtgaaggcacgcgtcagccttattcgggaggtgccgagcggtagcggcgtcagctacggccatcgctttgtcaccagtcgtccgtcacgcctggcggtgatcgccatcggttatgccgacggcgtggtccgcgcactgagcggccgcattgacgtcctgcatcgtggtcgccgggtgccgcaggtgggcaatatcaccatggaccagatcatcctcgacgccaccgatgtcgaggagctgacggtgggagacaacgtcacgctgctggggcaagacggagatgactgcatccgtccccaggactggagcgctcgctgcggctcgatcccctgggagattctctgtggtttcaaacaccgcctgccgcgggtcgagatctga

SEQ ID NO: 32935 - protein, 376 aa, Synechococcus sp. WH 8102
MSELSPRQRAWVEVYPTAIEANCRLLCRQLVTGCQLMAVVKADGYGHGAVTVARASLRGGASSLGVATLQEGLELRDAGIEAPVLILSALPSPEDLRHCLEQRLMPTLSSLDEANTAAAVAAERGNERFPVQLKLDTGMARLGGEWQEGAQLVQSIRTLPQLELVGLYSHLACADELGDQLTHLQLQRFRSVIEALPDGGSGLCCHLANSAGTLQDPRLHLDMVRVGLALYGQSPADHLGLDLALQPALAVKARVSLIREVPSGSGVSYGHRFVTSRPSRLAVIAIGYADGVVRALSGRIDVLHRGRRVPQVGNITMDQIILDATDVEELTVGDNVTLLGQDGDDCIRPQDWSARCGSIPWEILCGFKHRLPRVEI

SEQ ID NO: 32936 - DNA, 1071 bp, Chromobacterium violaceum ATCC 12472
  CDS (1)..(1071): transl_table=11
atgcgtccgttgatcgcgacgatacggctggaccatttgcggcataactatctgcaagcgcgcgccgcccacggcgaccgcgcgctggcggtgctgaaggccaacgcctacggccatggcgcggtccgttgcgcccaggcgctggccgacatcgccgacggcttcgccgtcgcctgcctggaggaggcgctggagctgcgcgccgccggcatcgccaaccccatcctgttgctggagggcgtgttcgacgccgaggaactgaaggcggtggacgagcatggcctgtggatggcggtgaccagcgaggagcaactgagcatggtcgagcagtcgaatccgtcgaggccgttcaatgtctggctgatgctggattccggcatgcaccgcgaaggcttcctgccggaaaattatcaccaggcttggcataggctgcaggccagcggcaaggcgggcggcatcaccaagatgactcacttcgcccgcgccgacgagcctgagatcccgatgaccttcgcgcagctggaggcgttcgacgccgcggtgcggggcctgccggccggcgacgagtcggtcgccaactcggccggcatcctgtgccacccgcgcgcgcagcgcaactggggccgcgtcggcatcgcgctgtacggcgtgacgccgctgccggccggattcgggcagggcgacgcgctgcgcccggtgatgcgtttctccagcaaggtgttcggcgtgcgcgagctgggcgtcggcgagcccatcggctacggcgacaacttcgtcaccgagcgcccgacgcgcgtcggcctggtggcctgcggctacgccgacggctacccgcggcgcgcttccagcggcagtccggcgttggtggatggacagcgcacgcggctgatcggccgggtgtcgatggacatgctgaccgtggatctgaccgatctgccggcagtcggcgtcggcagcgaggtcgagctgtggggggacggcgtgtcggtcaacgaggtggcggcccacgccggcaccataggctacgagcccttgtgcaacgtcaagcgcgcgcgcttcgtctaccgttga

SEQ ID NO: 32937 - protein, 356 aa, Chromobacterium violaceum ATCC 12472
MRPLIATIRLDHLRHNYLQARAAHGDRALAVLKANAYGHGAVRCAQALADIADGFAVACLEEALELRAAGIANPILLLEGVFDAEELKAVDEHGLWMAVTSEEQLSMVEQSNPSRPFNVWLMLDSGMHREGFLPENYHQAWHRLQASGKAGGITKMTHFARADEPEIPMTFAQLEAFDAAVRGLPAGDESVANSAGILCHPRAQRNWGRVGIALYGVTPLPAGFGQGDALRPVMRFSSKVFGVRELGVGEPIGYGDNFVTERPTRVGLVACGYADGYPRRASSGSPALVDGQRTRLIGRVSMDMLTVDLTDLPAVGVGSEVELWGDGVSVNEVAAHAGTIGYEPLCNVKRARFVYR

SEQ ID NO: 32938 - DNA, 1074 bp, Chromobacterium violaceum ATCC 12472
  CDS (1)..(1074): transl_table=11
atgacacgccctatccggctggagatttccctcccggccatccgccataatttcctgttcacccgccagcattcccaggcccgcagcctgttcgccgtgatcaaggcgaacgcctacggccacggcttattggacactgcaaaggcgttggccgatcaggccgacggttttgccctgctcaatatcgaagatgccgtgcgcctgcgcgaagcgggattcgatcaccccatctcgctgctggagggaccgttcgacgcggccgaagccgccgcgatggccgattaccgcctgggcggcgcggtccactcacaacaacagatggactggctggccaaaggttccgcggatcggcccatcgacgtctggctgaaaatcaacagcggcatgaaccggctgggtttccgcccgcaagaggccgccgccgcccaagcccggttgcaggcgctgcccggcgcgcggctgaccgcggtcatgacccacttcgccaccgccgatgaagattacggcgtcgccgagcaatgggcccgcttcgagccggtggccgtcgccagcggactgaaggtctgcgccgccaattccgccgcactgctgcgccatccgcatacccacggcgacatcggccgccccggcatcgtgctctacggcgcctcgccgttcgaaaacgaaaccggcgccggcctcggcctgatgccggcgatgacgctgtcggccgacatcatcgccgtgcaacagctgcaacccggcgacgcggtgggctacggccggcgtttcatcgccgaccgggccatgcgcatcggcgtggtcgcctgcggctacgccgacggctatcctcgcgtcgccgccaacggcgcgccggcggcggtggacggccaaccctgtcgactggcgggccgggtatcgatggacatgctgacggtggatatcagccatctgccccaggccggcgtcggcagccgggtggagctgtgggggccaaacgcgccgatagagaaagtggccgcggccgccggcaccatcagctacgagctgatgagcgcggtgatgccgcgggtaccgcgcgtcgtgcgcagctga

SEQ ID NO: 32939 - protein, 357 aa, Chromobacterium violaceum ATCC 12472
MTRPIRLEISLPAIRHNFLFTRQHSQARSLFAVIKANAYGHGLLDTAKALADQADGFALLNIEDAVRLREAGFDHPISLLEGPFDAAEAAAMADYRLGGAVHSQQQMDWLAKGSADRPIDVWLKINSGMNRLGFRPQEAAAAQARLQALPGARLTAVMTHFATADEDYGVAEQWARFEPVAVASGLKVCAANSAALLRHPHTHGDIGRPGIVLYGASPFENETGAGLGLMPAMTLSADIIAVQQLQPGDAVGYGRRFIADRAMRIGVVACGYADGYPRVAANGAPAAVDGQPCRLAGRVSMDMLTVDISHLPQAGVGSRVELWGPNAPIEKVAAAAGTISYELMSAVMPRVPRVVRS

SEQ ID NO: 32940 - DNA, 1029 bp, Wolinella succinogenes DSM 1740
  CDS (1)..(1029): transl_table=11
atggcagagctacgcatcaactctcaggctttttttcacaatcttaaactcttggcgaatcatgtcggctccaaagaaaaagtcgccgtggtgctcaaagacaatgcctatggacacgggcttttggagatggcgcttctgtgcaaggaggcgggaatcgcaagcgcgtttgtgaaaaatgaggccgaagcgataagaatcgccccctattttgagagtgtgacggcgctctatggagatgtggagtcaaagagccccgcgaatgtttgggttgcgcttcactctttggagcagattcgaagaatccctaagggtcgcagcgtggagctgaaagtggatacagggatgaatcgcaatggaatcatggaagaggagctctttgtagcgcttgaagccattcgtgctcaagggctgattctttgtggggtgatggcgcataatggctatggggatgagctggggagcgagtttttctctcagcagaggcgttttgagggggtgagggcaagagtggaggagtatgctagggagcatggcttgcctcgacctcgattccatgcgctcagctcctcgggggctttgcgaagtcggaatattcaagatgatctagtgcgctttggaatcgccatctatggctatctctgtgcgcatcctttggtggtgagcgagatagggcttaggcctgtgctctccctttgggcgagacgaatcaccaccaaatcccttcccaagggggcgagaatcggctatgggggcaagagcgagctggaggaggaggcgaagaaggtctcgacctatgatgtgggatatggagatggattctatcgactcaatgaacaccacaaacttctcaccgcccaaggagagcggattttgcctagggtttcgatggattgtctaagtgtggtgggcgagcgcgaggaggtctgtttgatggaggatgcgagcgagctggctaggctctttgatacgattccctatgaggtgctcacgagattttcaccctttttgaagcgtgtggtgatttag

SEQ ID NO: 32941 - protein, 342 aa, Wolinella succinogenes DSM 1740
MAELRINSQAFFHNLKLLANHVGSKEKVAVVLKDNAYGHGLLEMALLCKEAGIASAFVKNEAEAIRIAPYFESVTALYGDVESKSPANVWVALHSLEQIRRIPKGRSVELKVDTGMNRNGIMEEELFVALEAIRAQGLILCGVMAHNGYGDELGSEFFSQQRRFEGVRARVEEYAREHGLPRPRFHALSSSGALRSRNIQDDLVRFGIAIYGYLCAHPLVVSEIGLRPVLSLWARRITTKSLPKGARIGYGGKSELEEEAKKVSTYDVGYGDGFYRLNEHHKLLTAQGERILPRVSMDCLSVVGEREEVCLMEDASELARLFDTIPYEVLTRFSPFLKRVVI

SEQ ID NO: 32942 - DNA, 1146 bp, Gloeobacter violaceus PCC 7421
  CDS (1)..(1146): transl_table=11
gtggacgggtttgatgcgacgcgacgcgcctgggtggagatcgacctcgatgccctcaggcacaatgttcaacaaatcagacaaagattgcggtcccattgccgggtgatggcggtggtcaaagccgacgcctacggccacggcgccctgagtgccggccgcgccgccctggaggcgggggccgcctgcctgggggtggccaccctcgaagaaggtgcgcagttgcgcgagagcggcctgggttgtccgatcgtcgtcctgggacccatccacaccggcgccgaagttgccgcagtcgagcactggcggttggaaccgacgctttgcacgccgcgccaggtgctcgtctgtgcggaacacctgagtgctccccatccggtgcacctcaaaatcgacacgggcatgacccgcctgggcgcaccctggcaggatgccgtcgaatttgtgcgcctggcctaccggctaccccgcctgcaggtggcctcggtctactcgcacctggccaccgccgatgagccggactccgccgccctgggcgagcaacaccgccgcttcgagcgggtgctgggcgaactggaagccgccggggtgcgtcccgagtgtgtgcacctggccaattccgccgccgccctgggcgatcccggattgcactacgacctggtgcgcgtgggtgtggccctctacggcctctaccccgcccccgaattttatggagccgccgaactgcggccggtgatgcaggtcagggcgcgggtcacccaggtgcgggaagtgccggcggacaccggcgtgagctacggccacttctggcgtaccccgaccccgagccgcctggccaccgtcgccatcggctacgccgacggggtgccgcggcggctctcgggccaactgcaggtgctggtgcacgggagacgggctccccaggtaggtgcgatcaccatggaccagatcgtcatcgactgcacccacctgagcgcggtggaggagggcgatgtggtgacgctgctgggccgcgacggcaacgaagcaatcggcgccgccgactgggccgaccccctgggtaccattgcttacgaaattctttgcggttttaagcaccgcctgccacgggtggtgcgctccacggcaccggtatttaacgtttag

SEQ ID NO: 32943 - protein, 381 aa, Gloeobacter violaceus PCC 7421
MDGFDATRRAWVEIDLDALRHNVQQIRQRLRSHCRVMAVVKADAYGHGALSAGRAALEAGAACLGVATLEEGAQLRESGLGCPIVVLGPIHTGAEVAAVEHWRLEPTLCTPRQVLVCAEHLSAPHPVHLKIDTGMTRLGAPWQDAVEFVRLAYRLPRLQVASVYSHLATADEPDSAALGEQHRRFERVLGELEAAGVRPECVHLANSAAALGDPGLHYDLVRVGVALYGLYPAPEFYGAAELRPVMQVRARVTQVREVPADTGVSYGHFWRTPTPSRLATVAIGYADGVPRRLSGQLQVLVHGRRAPQVGAITMDQIVIDCTHLSAVEEGDVVTLLGRDGNEAIGAADWADPLGTIAYEILCGFKHRLPRVVRSTAPVFNV

SEQ ID NO: 32944 - DNA, 1089 bp, Photorhabdus luminescens subsp. laumondii TTO1
  CDS (1)..(1089): transl_table=11
atgccacgtccgatttcggcaacgatccatcttgatgcattggaaaataatttggcgattattcgtaataaggtcggtaatagtaaaatctgggctgttgttaaagcaaatgcttatgggcatggtctgcattgtatatggcggtctcttgatcaggctgatgggtttgctttacttgattttcatgaagcgattttattgcgggagcaggggtggcagggtgcaatcttactattggaagggtttttcaaacccgaagatttgccaataattgatgaatatcagttgacaacggtggtgcatagccattggcaacttgaagcaatagaagcggccaatttgagtaaacccatcaatatttatctcaaactcaacagcggtatgaatcgattgggatttcctgcggatcaatatagcgcggttttatcattagcaagagggatccggcaaattgggcaaataacgttaatgtcacattttgcgaatgcggataaggataataaggagatcagcgttactgaacaacttaacgttattcattcggtgagtcagggattggatatttctcaatgtttggcgaattcagccgcttccttgtggtatccacaaactcatagagattgggtacgtcccggtatcgtgctttatggtgcctcacccagtggaaagtggaaagatattgccgatattgggttgaaagcggtgatgagtctgcaaagtgagattattgctattcagaatctcaaggcaggagataaaataggttatggcagtgaatatacagcgccaggccctatgcgagtcggtaccgtcgcctgtggctatgctgatggttatccccgttgtgccatgacgggaacaccgattattgttgatggcgttaggacccaagtattaggtacggtatcaatggatatgttatcggtggatttaacgccttgtccgcaggcccaaattggcagccctgttgaattgtgggggcaaaatttaccggtggatgatgtggcggagagctctggaacaattggctatgaattattgtgcgcattggcaaatcgggtcccggtatctataccctatggattttga

SEQ ID NO: 32945 - protein, 362 aa, Photorhabdus luminescens subsp. laumondii TTO1
MPRPISATIHLDALENNLAIIRNKVGNSKIWAVVKANAYGHGLHCIWRSLDQADGFALLDFHEAILLREQGWQGAILLLEGFFKPEDLPIIDEYQLTTVVHSHWQLEAIEAANLSKPINIYLKLNSGMNRLGFPADQYSAVLSLARGIRQIGQITLMSHFANADKDNKEISVTEQLNVIHSVSQGLDISQCLANSAASLWYPQTHRDWVRPGIVLYGASPSGKWKDIADIGLKAVMSLQSEIIAIQNLKAGDKIGYGSEYTAPGPMRVGTVACGYADGYPRCAMTGTPIIVDGVRTQVLGTVSMDMLSVDLTPCPQAQIGSPVELWGQNLPVDDVAESSGTIGYELLCALANRVPVSIPYGF

SEQ ID NO: 32946 - DNA, 1080 bp, Photorhabdus luminescens subsp. laumondii TTO1
  CDS (1)..(1080): transl_table=11
atgaaagcggcaaccgcagttattgaccgccgcgcgctgcgacataacttgcaacgggtaagggagattgctcctaaaagcaatttgattgcagttgtgaaagcaaacgcttatggccacggtttactggagacagcacatacgctggacgatgccgattgtttcggtgtcgcgcgaattggtgaagcattgacgttgcgtcatggtggtatcgtcaaaccgattctgttactggaaggatgctttgatgcggctgacctgctagtactggttgctaaccatattgaaactgtggttcacagtgttgaacagttgcaagctctagaacaagctaagttatctcatccggtaaaagtatggatgaaattggatagcgggatgcatcgcttaggtgtaaggccggaagatgcggaagaattttatcaacggctgagtcgttgtaaaaatgtacagcagcctgtcaatattgtcagccattttggccgggctgatgaaccaacggtagacaccacttgccagcagatagcctgttttcaggctttctgtgctgacaaaccgggagaaaaatctattgatgcatcgggaggtatcctgttgtggccggaagtccatcaagattgggttcgtcccgggctgatgatgtatggtgtatcgccattatctgataaaacggccgtggattttaacctgatcccagcgatgactctaaaatcgagcttaattgctgttcgtaagcataaagctggcgaatcggttggctatggtgggatctgggtcagtgaacgtgatacttatcttggggttgtagctatcggttatggtgatggttatccgcggagtgcgccttcaggaacgccaatacatattaatggtcgtgaagtgccgattgctggccgtgtttcaatggatatgatctctgttgatttggggccagaggcgacagataaagtgggtgatgaagtggtgctctggggagatgtactgccagtggaacgggttgctaagcacactggtatcattacttatgagctggtgactaaactcacttccagagtggtgatggaatacttggacgaataa

SEQ ID NO: 32947 - protein, 359 aa, Photorhabdus luminescens subsp. laumondii TTO1
MKAATAVIDRRALRHNLQRVREIAPKSNLIAVVKANAYGHGLLETAHTLDDADCFGVARIGEALTLRHGGIVKPILLLEGCFDAADLLVLVANHIETVVHSVEQLQALEQAKLSHPVKVWMKLDSGMHRLGVRPEDAEEFYQRLSRCKNVQQPVNIVSHFGRADEPTVDTTCQQIACFQAFCADKPGEKSIDASGGILLWPEVHQDWVRPGLMMYGVSPLSDKTAVDFNLIPAMTLKSSLIAVRKHKAGESVGYGGIWVSERDTYLGVVAIGYGDGYPRSAPSGTPIHINGREVPIAGRVSMDMISVDLGPEATDKVGDEVVLWGDVLPVERVAKHTGIITYELVTKLTSRVVMEYLDE

SEQ ID NO: 32948 - DNA, 1149 bp, Corynebacterium diphtheriae NCTC 13129
  CDS (1)..(1149): transl_table=11
atgaacctgctcgaaactcgcatctcgtgcgacgccattgctgcgaacacgcgacgtttaaaagacatggttgctcccgctcagctcatgtgtgttgtaaaagctgacggctacaatcacggtgccccagaagttgctactgtgatggcgcgtaacggtgccgaccaatttggtgtcgcaacgcttgcggaagcacatcagctacgagacgcgggtatcactctccccatcctgtgctggatctggtcacccgagcaggacttttccgccgccattgaccgtgacatcgacttagccgccgtcagcatggatcacgttcgtgcactgatcgcagaggctatgcgtcgtcccgcaggtacccgagtgcgggtgaccgtgaaaattgacacggaacttcaccgatctggaattgacgaagcaaactggacagaagcctttgagcttcttcatgcttgcccccaagtcaacgtcacgggcgtatttagtcacttggcatgcgcagacgacttggaatcggactacaccgaccaccaagcagaggtatttcgcagggcgatttccgcaggtagaaacgtaggcctagaccttcctgttaatcatctagcggcatcgccagcaacactaacccgccccgacttgcactttgacatggtccgacctgggcttgccctctatggtcacgaaccgatagcagggctcgaccatgggctgcgcgaagccatgacatggattggttcagtaacagtggtcaaacccatcgcggcaggccaaggaaccagctacaacatgacatggcatgcgcccgcagatggctacctctgcgtggtgccggtgggctatgcggacggattaccgcgcaacgtacaaggacatttagaagtaacgatcgccggcacgcgctacccacaagtagggcgcgtttgtatggaccagattgtggtattccttggcgataattcccgcggtgttgcccctggtgatgaggcaattatttttggtccaagagatacccaagcgatgaccgtcacggagctggcctgcgctacgggaaccatcaactatgaaatcttgtgccgcccgaccggacgaagccatagaacctatagtgctcttgacgccgttgcgcccacgcaccctactgaaagctga

SEQ ID NO: 32949 - protein, 382 aa, Corynebacterium diphtheriae NCTC 13129
MNLLETRISCDAIAANTRRLKDMVAPAQLMCVVKADGYNHGAPEVATVMARNGADQFGVATLAEAHQLRDAGITLPILCWIWSPEQDFSAAIDRDIDLAAVSMDHVRALIAEAMRRPAGTRVRVTVKIDTELHRSGIDEANWTEAFELLHACPQVNVTGVFSHLACADDLESDYTDHQAEVFRRAISAGRNVGLDLPVNHLAASPATLTRPDLHFDMVRPGLALYGHEPIAGLDHGLREAMTWIGSVTVVKPIAAGQGTSYNMTWHAPADGYLCVVPVGYADGLPRNVQGHLEVTIAGTRYPQVGRVCMDQIVVFLGDNSRGVAPGDEAIIFGPRDTQAMTVTELACATGTINYEILCRPTGRSHRTYSALDAVAPTHPTES

SEQ ID NO: 32950 - DNA, 1242 bp, Rhodopseudomonas palustris CGA009
  CDS (1)..(1242): transl_table=11
atgcatatccttcccgatccgaacgccaccgtcgccgagttgttgacgccggaggcgggcaaagctgctgagttcgccgcggccaacgcggccgcgtccggcattctcaccatcgatctcgacgcgctggtcgcgaactggcgcaagctcgaaaagaccgccatcccctccgaatgcgccggtgtggtcaaaggcgacgcctatggctgcggcgccggccccgtcaccaaggcgctgctcgcggccggctgcaagaccttcttcgtcgcaacgctgagcgaagcactagtcgtgcgcgaagccgcgcccaacgcgacgctctacgtgctcgacgggttcttcccgaactcaggggacgaattcgccaagctgaattgccagccggtgatcggtgatctgtacgaactcgccgaatgggacgtgttctgccgccgcaccggttggcgtggcggcgcggcgcttcacatcgacaccggcatgagccggctcgggctgaccatcgtcgaggcgcaaggcatcgtgccgcggattgtcgccggtgaccacggcatcacgctggtgatcagccacctggcctgcgccgatctcgtcaaccatcagctcaatgccaagcaggccgcggcatttcgcgagatcgccggtcagttcaccggcgtgtcggcctcgctgtcggcttcgtcgggcatcttcctcgggtcgcagttcgcgttcgatctggtccgcccgggcgcggcgctgtacggcatcaaccccacgccggaagccgacaatccgatgcagccggtggtcgacctgaaggcacgtatcgtccaggtccgcagcgtcgagcgcggcgacaccgtcggctacggcgcgacctggagcgcacggcgtccgagcaagatcgcggtggtgtcggccggctatgcggacggttacttccgcgcggccggctcgagcgacggcacccgcggcgccgacgtgatcatcgccggtcaacgctgcccgatcgccggccggatctcgatggacctgctcgcggtcgacatcaccgacctgcccgccaacgccgcgcgccgcggcatgatggccaccctgatcggcgacggcatcaccgtcgacgaactcgggcatcacttcggcaccatcggctacgaagtgctgactagcctcggccggcgctacacccggatctacaaaggcggcgacgccaagccgctgaccgaaccggccccggtcgagccggtggctccggcgagctga

SEQ ID NO: 32951 - protein, 413 aa, Rhodopseudomonas palustris CGA009
MHILPDPNATVAELLTPEAGKAAEFAAANAAASGILTIDLDALVANWRKLEKTAIPSECAGVVKGDAYGCGAGPVTKALLAAGCKTFFVATLSEALVVREAAPNATLYVLDGFFPNSGDEFAKLNCQPVIGDLYELAEWDVFCRRTGWRGGAALHIDTGMSRLGLTIVEAQGIVPRIVAGDHGITLVISHLACADLVNHQLNAKQAAAFREIAGQFTGVSASLSASSGIFLGSQFAFDLVRPGAALYGINPTPEADNPMQPVVDLKARIVQVRSVERGDTVGYGATWSARRPSKIAVVSAGYADGYFRAAGSSDGTRGADVIIAGQRCPIAGRISMDLLAVDITDLPANAARRGMMATLIGDGITVDELGHHFGTIGYEVLTSLGRRYTRIYKGGDAKPLTEPAPVEPVAPAS

SEQ ID NO: 32952 - DNA, 1149 bp, Geobacter sulfurreducens PCA
  CDS (1)..(1149): transl_table=11
atggacagccggcccaccattgctgaagtcgatctcgccgccctccgccacaactacgaccttgtcgtccgtacgattccccgggggtgcggaatcctggcggtagtcaaggccgacgcctacggccacggtttcatggatatcgcccgcgagttggagacactgggagtgactgccttcggcgttgcctttctggccgagggaattcaactgcgcaagagcggaatcgatcgtcccgtcctgatcctgggaggggtttatcccggccaggaacgcaagtgtgtcgggttcaatctgtccacggccctgttcagcctggagcaggcgcgggttctggacgatgcggccggtcgcctgtatcgccgggccagggtccatgcgaagatcgataccggcatggggcgcctcggcatcccccacgaggaggcgtcggccttttttagcgccctgcgggagttgaagcacctggacctggaggggatcatctcccacttcgcctccgccgacgaactcgacgaggatggccggcgctactccgatctccaggcgagccggtttgccgcggcggtcgcggcggcccgccacgaggggttcgagcctcgctatgtccatatcgccaacagcgcggccgccttcgggatggacctgccgttctgcaacctcgtccggcccggcatcgtcctctacggcgcgctcccttccggcgacttcgaggggaagatggcgctcaagcccatcatgcgcctgcgcagttccatcgccatgctcaaatgggtggaaccgggcacaagcatcagctacgcccgccgcttcaccgctcccgaccggcgactcgtggccagtattccggttggctacgcagacggctacagccgttctctcaccaaccgtggggaggttgtcgtgcgcggccggcgcgctccggtcgtgggcaccgtctgcatggactggatcatggccgacgtgacccacgtctccggcgtgaccgttggcgacgaggtgacgcttctggggtgcgaccaggagggaaactgcgtccgtgccgaagaacttgccgagtgggccggtaccatcccctacgaaattttctgcggcatcagcaagcgggtgccgcgcgtctacctcaacccgtcgatcaggcacaggtga

SEQ ID NO: 32953 - protein, 382 aa, Geobacter sulfurreducens PCA
MDSRPTIAEVDLAALRHNYDLVVRTIPRGCGILAVVKADAYGHGFMDIARELETLGVTAFGVAFLAEGIQLRKSGIDRPVLILGGVYPGQERKCVGFNLSTALFSLEQARVLDDAAGRLYRRARVHAKIDTGMGRLGIPHEEASAFFSALRELKHLDLEGIISHFASADELDEDGRRYSDLQASRFAAAVAAARHEGFEPRYVHIANSAAAFGMDLPFCNLVRPGIVLYGALPSGDFEGKMALKPIMRLRSSIAMLKWVEPGTSISYARRFTAPDRRLVASIPVGYADGYSRSLTNRGEVVVRGRRAPVVGTVCMDWIMADVTHVSGVTVGDEVTLLGCDQEGNCVRAEELAEWAGTIPYEIFCGISKRVPRVYLNPSIRHR

SEQ ID NO: 32954 - DNA, 1131 bp, Lactobacillus johnsonii NCC 533
  CDS (1)..(1131): transl_table=11
atggttccaggaattcatcgtccagccgtagtaaaggtaaacttgggcgctattaaaagaaatctgaaaaatgagatggggcatctagagcccggtcaaaagatgcttgccgttgtaaaagcaaacggctacggacacggttcagtagaagtagctagagtggcagataaggtaggagcagccggattttgcgttgcaattttagatgaagcattagagttaagacgtgcagatattacaaaaccaattttagttttaggcgttgtttctcctgaatatgctccaattgctgctgtaaataacgtctcattgactgttccaaacttagaatggcttaaagaagcagagaagtatttaaaagatgcaaatttgcaattgaagattcatttaggtattgattccggaatgggaagaatcggatttaatgaagacgcagactttattactgctaatgagtttttagagaataacgataatttctttattgaaggaatgtttgcccattttgcttctgctgatagcagtgatgaaacttatttcaaacatcaatgtgaaaaatttaatcatatgaagagcttgcttactgtaaagccaaagtggattcatgttgataatacggcagcaagtatttttcatgacggaattaaaagtgatttagttagatttggtattggaatttatggtttaaatccttcttctaatcctaattctccagatttaaaatcaaatattaagttagaacctgccttgtcatttgaaagtgaattgactcatgttaagacaattcatcaaggtgatggtgttggatacggttcgacctttgttgcagatgaagatacaattattggaaccgtacctgttggttatgcggacggatttattagaaaatttcaaggtttcaaagttaaagtgggagatacatactgtccaattgttggccgaatttgtatggatcaatttatggttaagatgcctaaaaagatgccagtagggaccaaagtaactatcatttcttctaatcctaatgatcaaaataatattaaagctgcagctgattatgttgacacaattcattatgaagtggcttgcttattaaatgatcgtttaccacgtgtatattacgaaaattaa

SEQ ID NO: 32955 - protein, 376 aa, Lactobacillus johnsonii NCC 533
MVPGIHRPAVVKVNLGAIKRNLKNEMGHLEPGQKMLAVVKANGYGHGSVEVARVADKVGAAGFCVAILDEALELRRADITKPILVLGVVSPEYAPIAAVNNVSLTVPNLEWLKEAEKYLKDANLQLKIHLGIDSGMGRIGFNEDADFITANEFLENNDNFFIEGMFAHFASADSSDETYFKHQCEKFNHMKSLLTVKPKWIHVDNTAASIFHDGIKSDLVRFGIGIYGLNPSSNPNSPDLKSNIKLEPALSFESELTHVKTIHQGDGVGYGSTFVADEDTIIGTVPVGYADGFIRKFQGFKVKVGDTYCPIVGRICMDQFMVKMPKKMPVGTKVTIISSNPNDQNNIKAAADYVDTIHYEVACLLNDRLPRVYYEN

SEQ ID NO: 32956 - DNA, 1209 bp, Bdellovibrio bacteriovorus HD100
  CDS (1)..(1209): transl_table=11
atggaaatgtaccgtcgcacgtttgcggaaattaatctggatcatctgaagcacaatatccaagtgctgcagaaggcctttccgcaagccccttttctgtgtcccatggtcaaggccaatgcctatggccacggggacgtgcaattggcgcgtttccttgaaagtctgggcatcaagcacttgggtgtgtgtctgattgaagaaggtctgctgcttcgtcgttccggtgtgaatgctgaaattctggtcttccgcggttttgatcgcgaaggggcagaaaaaatcatcgaatacaacatgacaccggtggtgagttcctgggagcagattgatcatctggaggccgtggcctcggaccccgtggggattcacctgaaatttgacaccggcatgaatcgtctgggattccgtcccgaagaagcacaaaagctattcgatcgcctgtggcagaacaagaagatccgattgaaagccctggtgactcatctgtttaacggcgaagatgccacggattctcaaggcatcagtgcccgccagttgcgtgatctgaatcgggtcagcacggtgtttaagccttttaatattttctgccatgctttgaactcggccgggatcatgagtgccctgcagatgaaagacgccgggaacacgccggcggatcatccgctgttcatgcaaaactggggtctgcgcccggggctgatgatctatggttacaatccattgggtcagaacagcttcgggggcctaaaaccggtgatgagtttgaaatctcatgtggccacctacagacagcttcatatcggtgaaactgtttcttacggcggcacctggacggccaagcaggattctgtcattgctgtggtccccattggatatgccgatggttaccatcgtattttatccaaccagtcttctgtggtttttgcaggcaaaagggttccccttgtcggaagcatctgtatggattatctgatgctggatgtgacggaagtggtgcgcggaaaagatctgaaagactttaaggatcaggaagtgaccttgttcggatttgcttccgatggcagtttcctgtccccggaagagctggcggttcaggccaaaagcatcacctgggaaatgctgacaagtgtgggcgagcgcgtgccacgtatttactccggcctggatgtcggatttgtgtttgaggaaagcagaggccaacgatga

SEQ ID NO: 32957 - protein, 402 aa, Bdellovibrio bacteriovorus HD100
MEMYRRTFAEINLDHLKHNIQVLQKAFPQAPFLCPMVKANAYGHGDVQLARFLESLGIKHLGVCLIEEGLLLRRSGVNAEILVFRGFDREGAEKIIEYNMTPVVSSWEQIDHLEAVASDPVGIHLKFDTGMNRLGFRPEEAQKLFDRLWQNKKIRLKALVTHLFNGEDATDSQGISARQLRDLNRVSTVFKPFNIFCHALNSAGIMSALQMKDAGNTPADHPLFMQNWGLRPGLMIYGYNPLGQNSFGGLKPVMSLKSHVATYRQLHIGETVSYGGTWTAKQDSVIAVVPIGYADGYHRILSNQSSVVFAGKRVPLVGSICMDYLMLDVTEVVRGKDLKDFKDQEVTLFGFASDGSFLSPEELAVQAKSITWEMLTSVGERVPRIYSGLDVGFVFEESRGQR

SEQ ID NO: 32958 - DNA, 1140 bp, Treponema denticola ATCC 35405
  CDS (1)..(1140): transl_table=11
atgagagcgacaaaggctattatccatttggataacttacaatataacattaaagaaataaaaaagcggcttaacaagaatgtaaagatttgtcttccggtcaaggccgatgcctatgggcatggggctgtgagggttgcggttgcagcaataagggcaggcgtttcttatttggctgttgcctccattcaggaagctgtcgaattaagagaggccggtattgtagccccgattatttctttaagtcttcccgtgcttgaagaaattcctgagcttttaaaatacgatattgagcccttggttatagatgaggagtttataaacgatttaaaccgttttgcaaaaaaactaaataaaaaagcctgggttcatcttaaaatagataccggaatgcgcaggataggctgctcgcctatggaagccgttaaacttgcggtacagatagaccgtgcagaaaatcttgagctaaaaggagtgtgtacgcatttcgctgtttccgattctaccgatgaaaaaaatattaaatttacaaaaaaacagatttctgtttttaaggactcaataaaagaaataaaaaaagcggggattaatcccggattaattcatgccgcaaattcaggatctgttcttcaatatcccgaagcccagttcgatatggtgcgtccgggaatcttggtctacggttatgcaccctctccatccctaaattctttaatagatttaaagcctgtaatggagcttgttacacaggtagtgcttatcaaaaaaattgaaaaggatacaagcgtttcttatgatagatgttggacagccgaaaaagaaacatttgttgcaacccttcctataggctatgcggacggactcatgcgttcccttagcggattaaaagtgagaataggaaaagatttttttccgatcatcggacgcatttgtatggatcaatgtatgatagatataggcgcttctccatgggttcaaagatgggatgaggtttgtatcttcggtcctgtttcaaaagaacatcctaaaaataatacggcccaagatcttgcaaaaattgccggaactattccttatgagctgacatgcgatataaacaaaagagttccgcgtatttttattgatgaaaccatacaataa

SEQ ID NO: 32959 - protein, 379 aa, Treponema denticola ATCC 35405
MRATKAIIHLDNLQYNIKEIKKRLNKNVKICLPVKADAYGHGAVRVAVAAIRAGVSYLAVASIQEAVELREAGIVAPIISLSLPVLEEIPELLKYDIEPLVIDEEFINDLNRFAKKLNKKAWVHLKIDTGMRRIGCSPMEAVKLAVQIDRAENLELKGVCTHFAVSDSTDEKNIKFTKKQISVFKDSIKEIKKAGINPGLIHAANSGSVLQYPEAQFDMVRPGILVYGYAPSPSLNSLIDLKPVMELVTQVVLIKKIEKDTSVSYDRCWTAEKETFVATLPIGYADGLMRSLSGLKVRIGKDFFPIIGRICMDQCMIDIGASPWVQRWDEVCIFGPVSKEHPKNNTAQDLAKIAGTIPYELTCDINKRVPRIFIDETIQ

SEQ ID NO: 32960 - DNA, 1176 bp, Bacillus cereus ATCC 10987
  CDS (1)..(1176): transl_table=11
atgagtttgaaatatggaagagatacaattgttgaagttgacttaaatgcagtaaaacataatgtaaaagaatttaaaaaacgtgtgaatgatgaaaatattgcaatgatggctgctgtaaaagcaaatgggtatggccacggagcagttgaagttgcgaaagctgctattgaagcgggaataaaccagcttgcagttgcatttgtagatgaagcgatagagttaagagaagcaggaattaacgtgccgattttaattttaggctatacgtcagtagcggctgcggaagaagcaattcaatatgacgttatgatgactgtttatagaagtgaagatttacaaggtataaatgaaatcgcaaaccgtcttcaaaagaaagcgcaaattcaagtgaaaattgatacagggatgagtcgtatcggtttacaagaagaagaggttaaaccatttttagaagaattaaaacgtatggagtatgtggaggtagtaggaatgtttacacattactctacggcagatgaaatcgataaatcatatacgaatatgcaaacaagtttatttgagaaagctgtcaatgcagcaaaagaattaggaattcatattccgtatattcatagttcaaatagtgcaggttcaatggaacttagcaatacatttcaaaatatggttcgtgtaggtatcggaatttatggaatgtatccttcaaaagaggtagatcattcagttgtttctctacagcctgcgttgtcgttaaaatcaaaagtagcccatattaagcatgcgaagaaaaatcgcggtgtaagttatgggaatacgtatgtaacgactggtgaagaatggattgccactgtaccgattggttatgctgatggctataaccgtcagttatctaataaagggtatgcattaataaatggagttcgagtacctgttattggtcgtgtttgtatggatcagcttatgttagacgtttcaaaagcaatgccagtacaagtgggagacgaagtagtattctacggtaaacaaggcgaagaaaacatcgcagtagaagaaatagcggatatgttaggtacaattaactatgaagttacatgtatgttagacagaagaatcccgcgagtttataaagaaaataatgaaacgactgctattgtaaatatactaagaaaaaactga

SEQ ID NO: 32961 - protein, 391 aa, Bacillus cereus ATCC 10987
MSLKYGRDTIVEVDLNAVKHNVKEFKKRVNDENIAMMAAVKANGYGHGAVEVAKAAIEAGINQLAVAFVDEAIELREAGINVPILILGYTSVAAAEEAIQYDVMMTVYRSEDLQGINEIANRLQKKAQIQVKIDTGMSRIGLQEEEVKPFLEELKRMEYVEVVGMFTHYSTADEIDKSYTNMQTSLFEKAVNAAKELGIHIPYIHSSNSAGSMELSNTFQNMVRVGIGIYGMYPSKEVDHSVVSLQPALSLKSKVAHIKHAKKNRGVSYGNTYVTTGEEWIATVPIGYADGYNRQLSNKGYALINGVRVPVIGRVCMDQLMLDVSKAMPVQVGDEVVFYGKQGEENIAVEEIADMLGTINYEVTCMLDRRIPRVYKENNETTAIVNILRKN

SEQ ID NO: 32962 - DNA, 1122 bp, Methanococcus maripaludis S2
  CDS (1)..(1122): transl_table=11
atggtttcacatccgatatgggcagaaattgacttaagcgcaattaaaaacaatattaaagaaataagacgaattacaaaccccaaatcccaggtaatggcagtagtaaaagcaaatgcttacggacacggctcagtcgaggtttcaaaaatatgccttgaaaacggggccgataggttagcagttgcacgttcaacggaagctcttgaacttagggatgcaggaataacctgtccaatacttgtatttggatatgttaccgaagaagaaattttgaaaatggttgaaaatgatataactttaaccgtttattcacttgaaatcgcaaattcaatccaaaaaattgctgaaaaattgggaaaacattcaaaaatccatatcaaagtagacaccggaatgagtagacttggatttttgcccgagaaatcgtcggtagaaaccataaaaaaaatcagggaactggaaaacatcgaagttgaaggaatttacacgcattttgcagatgcagataattctgataaaacatacaccactatgcaattttctaaatttacgagttttttacacgatctcgaggaaaatggaattgatattccaataaaacacgcatcaaatagcgctgcaataattgaccacccggaaacacatctcaatatggtaagacccggaattattctatacgggctttacccttcagaactggtccacaaggaaagaattaatttacaacctgcaatgagtttgaaggtacttgtaacgcatgtaaaagacgttccagaaaatacaaaaataagttatggatgcacttttgaaaccaaaaaacaatcaaaaattgcatcacttccaatagggtatgccgatggattcacaagaatgttacgaaatgggaatgtcctgatccatggattgcgggttcctgttgttggcagaatctgcatggatcagtgcatgattgatgttacaagtattgaaaacgtaaacgttggagacgttgtcacagtatttggaaaagacggaactgaaaaaatctccattgaagagtttggtaataaattgggaaccataaattacgaacttgtttgcatggtatctgcaagagttccaagaatatatttacattaa

SEQ ID NO: 32963 - protein, 373 aa, Methanococcus maripaludis S2
MVSHPIWAEIDLSAIKNNIKEIRRITNPKSQVMAVVKANAYGHGSVEVSKICLENGADRLAVARSTEALELRDAGITCPILVFGYVTEEEILKMVENDITLTVYSLEIANSIQKIAEKLGKHSKIHIKVDTGMSRLGFLPEKSSVETIKKIRELENIEVEGIYTHFADADNSDKTYTTMQFSKFTSFLHDLEENGIDIPIKHASNSAAIIDHPETHLNMVRPGIILYGLYPSELVHKERINLQPAMSLKVLVTHVKDVPENTKISYGCTFETKKQSKIASLPIGYADGFTRMLRNGNVLIHGLRVPVVGRICMDQCMIDVTSIENVNVGDVVTVFGKDGTEKISIEEFGNKLGTINYELVCMVSARVPRIYLH

SEQ ID NO: 32964 - DNA, 1086 bp, Thermus thermophilus HB27
  CDS (1)..(1086): transl_table=11
atgcctgctggccctatagggctcgttgaggtggaagagcgggcctgggtggaggtggacctcgccgccctttgggcgaactaccggcttctcgccgggcgggcgggaggggaggtgatccccgtgctcaaggcggacgcctacggccacggggcccttcccctcgcccgcttcctggagggaaagggcgtggggcgcttcgccgtggccaccctggaggaggggaggcgcctccgggaagggggcatcaagggggaggtcctccttctcggaagcctccaccccctggaggcggaggaggccttggagcttggcctcgtgcccaccctctccaccctggaggcggcggaggccctttcccagagggcccgcgccctgggccttgtgccccgggcccacctcaaggtggacacgggcatgaaccgggtgggctttccctgggaggaggcggcttcggccctgcgggcggtggaggccttgggggtgagggtggagggcgtctacacccacctcgccaccgccggggaggacgcggccttcgtggagacgcagcggcgccgcttccaggaggtgcgccgcgccttgggggaggggtacttctaccacctggagaactccctgggcctcctccgccacggggccacggcgggggtgcgggtggggctcgccctctacggcctcgtccccggctttggcctcaggcccatcctccggatcctcgcccggcccaccctggtgaagcgcctgaaggcgggggaccgggtggggtacgggggggtctatgtggcccggggcggggagtggctcgccaccctgcccgtggggtacgccgacgggcttccctggggggcggtgcggttcgtgaaggggccggacggccgccttctggaggtggcgggccggatctccatggaccagaccaccgtccttctccccggccccgtgggcctcgaggccgtgtttgaggtgctctcggccgacttcggccccacgggcctcctcgcctgggccgaggcccggggcaccctcccttatgaggtggccgtccacctttcccggaggcttccccgccgctacctggagtag

SEQ ID NO: 32965 - protein, 361 aa, Thermus thermophilus HB27
MPAGPIGLVEVEERAWVEVDLAALWANYRLLAGRAGGEVIPVLKADAYGHGALPLARFLEGKGVGRFAVATLEEGRRLREGGIKGEVLLLGSLHPLEAEEALELGLVPTLSTLEAAEALSQRARALGLVPRAHLKVDTGMNRVGFPWEEAASALRAVEALGVRVEGVYTHLATAGEDAAFVETQRRRFQEVRRALGEGYFYHLENSLGLLRHGATAGVRVGLALYGLVPGFGLRPILRILARPTLVKRLKAGDRVGYGGVYVARGGEWLATLPVGYADGLPWGAVRFVKGPDGRLLEVAGRISMDQTTVLLPGPVGLEAVFEVLSADFGPTGLLAWAEARGTLPYEVAVHLSRRLPRRYLE

SEQ ID NO: 32966 - DNA, 1131 bp, Desulfovibrio vulgaris subsp. vulgaris str. Hildenborough
  CDS (1)..(1131): transl_table=11
atgcccatatcctacaacaaggcgagtgttgtcgtcagtctccaatccataatcgccaactatcgccggattcgtacggtggcacagcggcccatgcccgtcatcaagtccgatgcgtacggccacggccttgaagctgtgggcatggcccttgaggccgaaggtgcacgtgaatgcgccgtcggtacggtgggggagggggcgaagctgcgcaaggccggtttcggggcggatatcgtcgccctgcttggggccctcgacagagaggacgcccagttggcggcctcttccggcatcatccccaccgtccttgatatcgccgggcttgaacgccttgccgcgcagggtacccccgaaaggccggtgcgcgtggcgctcaagttcgatacgggcatggcccgtctcggcttcacggaacatgatgtgtctgccctttgcgagcgtctgcgcaccctgccttcggtgcggcccgtcatggcggtatcgcatctcgccgttgccgacgaccccacccagtcggccttcacgatggcgcagggggccgcattcgcgcgtatcatggcggggcttcgaagcaacttccccgatatcatggggtcgctgtcaaactccgcagccacgctggcgcacccgcaactgcactgggacgtgcagcgtcccggcatcgccctctatggttcgaatccccttcgcgggacggcccttgcacggcatggcgaagggctgttgcccgccatgtccgtctccgtgccggtgttgcaggtccatccgctgcccgcggggcgtagtatcagctacgggcggacgtacaccgccaccaaagatgcgaccgtggccatcatagccgccggatacgccgacaactacagccgcgccctgtcagggcgtggtgttgctgtagctggcgggcggcgtgtgcctgttcttggtcgcgtgtgcatgcagaccacggccatcgacgtcaccgacgtacccggcatcgccacgggagaccgtgtatggctgcttggtggccccggccccgccacggtctcggctgatgaactggccgacctgtgggggacgatatcctatgaagtgctgtgtctgcttggcatgaacccgcgcaggcatgacgactctgtggagtag

SEQ ID NO: 32967 - protein, 376 aa, Desulfovibrio vulgaris subsp. vulgaris str. Hildenborough
MPISYNKASVVVSLQSIIANYRRIRTVAQRPMPVIKSDAYGHGLEAVGMALEAEGARECAVGTVGEGAKLRKAGFGADIVALLGALDREDAQLAASSGIIPTVLDIAGLERLAAQGTPERPVRVALKFDTGMARLGFTEHDVSALCERLRTLPSVRPVMAVSHLAVADDPTQSAFTMAQGAAFARIMAGLRSNFPDIMGSLSNSAATLAHPQLHWDVQRPGIALYGSNPLRGTALARHGEGLLPAMSVSVPVLQVHPLPAGRSISYGRTYTATKDATVAIIAAGYADNYSRALSGRGVAVAGGRRVPVLGRVCMQTTAIDVTDVPGIATGDRVWLLGGPGPATVSADELADLWGTISYEVLCLLGMNPRRHDDSVE

SEQ ID NO: 32968 - DNA, 1107 bp, Listeria monocytogenes str. 4b F2365
  CDS (1)..(1107): transl_table=11
atggtgacaggctggcatcgtcctacatggattgagatagaccgcgcagcaattcgcgaaaatataaaaaatgaacaaaataaacttccagaaaatgtggatttatgggcagtagtcaaagctaatgcatatggtcacggaattatcgaagttgctagaacagcgaaagaagctggagcaaaaggtttctgtgttgccattttagatgaggcgttggctcttagagaagctgggtttcaagatgactttattcttgtacttggcgcaactagaaaagaagatgcaaatttagcggccaaaaaccacatttccctcactgtttttagagaggactggctagaggaactaaccttagaagcgccacttcgcattcatttaaaagtagatagcggtatggggcgtcttgggattcgtacaaccgacgaagcaaggcgaatcgaaacgacaattgctaaagacaatcaactacaactagaaggtatctacacgcattttgcgacagccgaccaacttgaaactagttatttcgaacaacaattagctaagttccaaaccattttaacgagtttaaaaaatcgcccaacgtatgttcatacagccaattcagctgcttcattattacagccacaaatcgggtttgatgcgattcgctttggtatatcgatgtacgggttaaccccttccaccgaaatcaaaactagcttaccatttgagcttaaaccagcccttgcactctataccgaaatggttcatgtgaaagaactcgcaccaggtgatagtgttagctacggagcaacctacactgcaacagaacgagaatgggttgcaacgttaccgattggctatgcagatgggttgattcgtcattacagcggatttcatgttttagtagacggggaactagccccaattataggacgcgtttgtatggatcaaaccatcataaaactaccgcgcgaatttcaaactggttcaaaagtaacgataattggcacggaccatggaaacacgataacagcagatgatgccgctcactatttagatacaataaattatgaggttacttgtttgttaaatgagcgtatacctagaaaatacatccattag

SEQ ID NO: 32969 - protein, 368 aa, Listeria monocytogenes str. 4b F2365
MVTGWHRPTWIEIDRAAIRENIKNEQNKLPENVDLWAVVKANAYGHGIIEVARTAKEAGAKGFCVAILDEALALREAGFQDDFILVLGATRKEDANLAAKNHISLTVFREDWLEELTLEAPLRIHLKVDSGMGRLGIRTTDEARRIETTIAKDNQLQLEGIYTHFATADQLETSYFEQQLAKFQTILTSLKNRPTYVHTANSAASLLQPQIGFDAIRFGISMYGLTPSTEIKTSLPFELKPALALYTEMVHVKELAPGDSVSYGATYTATEREWVATLPIGYADGLIRHYSGFHVLVDGELAPIIGRVCMDQTIIKLPREFQTGSKVTIIGTDHGNTITADDAAHYLDTINYEVTCLLNERIPRKYIH

SEQ ID NO: 32970 - DNA, 1119 bp, Bartonella quintana str. Toulouse
  CDS (1)..(1119): transl_table=11
atgaacaaatccatgaataataaagcaaacccattacttccttatacagctgtagcaaccatcgatgtgagtgccattgttgctaattataaaactttagcccaacgtgttgctccagctgaatgttcagcagttgtgaaagccaatgcttatgggctgggtgctgataaaattgccccggcactctatcgtgctggttgccgcattttttttgtagctcaaatcgaagaagcacttcaattaaaagacattttaccgtcaaatgttacacttgctcttcttaatggacctccacacgctacagaagagtttatagctcaagcaggtattgtccctgttctaaactcttggaatgccattgaaaattggcaaaaactttgtcaaaaaaaggataaaaaatttcccgcaatcattcaaatcgataccaatatgaatcgattaggacttgataaaaaagaattacaacaacttatcaaaaaaccgactatttttgaaaaagcagagataaaatatatcctcagtcaccttgcgaacggagatgatgccacacattcctccaattatacacaattggctgcttttaaaaccgtacttacacaattgcctacctgcagagcttcctttgccaattctggtggtatttttcttggtccagatttttattttgaccttgttcgcccaggcattgcactttacggaatcgatccccaaggaaaacatccaacccttttcaaacctgttttaaaacttgaagctcaagtcattcaaagccgctctattgaggcaggaatccccgttggttacgaagaaagtttcattaccagaagaccaagcactctcataaccatttctatcggctatgcagacggttggctacgcattctttcaaataaaggaaccgtttatttcaatgggcacaaactccctattgttggacgtatttcgatggattccatgacagtggatgctaccaatcttgataaaaaacctcaaagcggtgactgggtagagctcatcggacctcatcaaacacttaaaaaagtatcgatagatgccaacactattcctcatgaaattctgacttctttaggatctcgctatcaacgtatttatatttaa

SEQ ID NO: 32971 - protein, 372 aa, Bartonella quintana str. Toulouse
MNKSMNNKANPLLPYTAVATIDVSAIVANYKTLAQRVAPAECSAVVKANAYGLGADKIAPALYRAGCRIFFVAQIEEALQLKDILPSNVTLALLNGPPHATEEFIAQAGIVPVLNSWNAIENWQKLCQKKDKKFPAIIQIDTNMNRLGLDKKELQQLIKKPTIFEKAEIKYILSHLANGDDATHSSNYTQLAAFKTVLTQLPTCRASFANSGGIFLGPDFYFDLVRPGIALYGIDPQGKHPTLFKPVLKLEAQVIQSRSIEAGIPVGYEESFITRRPSTLITISIGYADGWLRILSNKGTVYFNGHKLPIVGRISMDSMTVDATNLDKKPQSGDWVELIGPHQTLKKVSIDANTIPHEILTSLGSRYQRIYI

SEQ ID NO: 32972 - DNA, 1176 bp, Bacillus thuringiensis serovar konkukian str. 97-27
  CDS (1)..(1176): transl_table=11
atgagtttgaaatatggaagagatacaattgttgaagttgacttaaatgcagtaaaacataatgtaaaagaatttaaaaaacgtgtgaatgatgaaaatattgcaatgatggctgctgtaaaagcgaatgggtatggtcatggggcagttgaagttgcaaaagctgctattgaagcaggaataaatcagcttgcagttgcatttgtagatgaagcgatagagttaagagaagcaggaattaacgtgccgattttaattttaggctatacatcagtagcatctgcggaagaagcaattcaatatgacgttatgatgactgtttatagaagtgaagatttacaaggtataaatgaaatcgcaaaccgtcttcaaaagaaagcgcaaattcaggtgaaaattgatacaggaatgagtcgcattggtttacaggaagaagaggttaaaccatttttagaagaattaaaacgtatggagtatgtagaggtagtaggaatgtttacacattactctacggcagatgaaatcgataaatcatatacgaatatgcaaacaagtttatttgagaaagctgtcaatacagcaaaagaattaggaattcatattccatatattcatagttcaaatagtgcaggttcaatggaacttagcaatacatttcaaaatatggttcgtgtaggtatcggaatttatggaatgtatccttcaaaagaggtagatcattcagttgtttcgttacagcctgcgttgtcgttaaaatcaaaagtagcccatattaagcatgcgaagaaaaatcgcggtgtaagttatgggaatacgtatgtaacgactggtgaagaatggattgccactgtacctattggttatgctgatggttataatcgtcagttatctaataaagggcatgcattaataaatggagttcgagtacctgttattggccgtgtttgtatggatcagctcatgttagacgtttcaaaagcaatgccagtacaagtgggagacgaagtagtattctacggtaaacaaggcgaagaaaacatcgcagtagaagaaatagcggatatgttaggtacaattaactatgaaattacatgtatgttagatagaagaattccacgtgtgtataaagaaaataatgaaacgactgctattgtaaatatactaagaaaaaactga

SEQ ID NO: 32973 - protein, 391 aa, Bacillus thuringiensis serovar konkukian str. 97-27
MSLKYGRDTIVEVDLNAVKHNVKEFKKRVNDENIAMMAAVKANGYGHGAVEVAKAAIEAGINQLAVAFVDEAIELREAGINVPILILGYTSVASAEEAIQYDVMMTVYRSEDLQGINEIANRLQKKAQIQVKIDTGMSRIGLQEEEVKPFLEELKRMEYVEVVGMFTHYSTADEIDKSYTNMQTSLFEKAVNTAKELGIHIPYIHSSNSAGSMELSNTFQNMVRVGIGIYGMYPSKEVDHSVVSLQPALSLKSKVAHIKHAKKNRGVSYGNTYVTTGEEWIATVPIGYADGYNRQLSNKGHALINGVRVPVIGRVCMDQLMLDVSKAMPVQVGDEVVFYGKQGEENIAVEEIADMLGTINYEITCMLDRRIPRVYKENNETTAIVNILRKN

SEQ ID NO: 32974 - DNA, 1149 bp, Staphylococcus aureus subsp. aureus MRSA252
  CDS (1)..(1149): transl_table=11
atgtcagataaatattatagatctgcgtatatgaatgtagatttaaacgctgttgcatcaaatttcaaagtattcagtacattgcatccaaataaaacagtgatggctgtcgttaaagccaatgcctatggactaggtagtgttaaagtagcacgtcatttaatggaaaatggtgccacattttttgctgtagcaacgttagatgaagcgatagaacttagaatgcatgggattactgctaaaattttagtcttaggtgtgttaccagctaaagatattgataaagcgatacaacaccgagttgccttaacggttccgtctaaacagtggttgaaagaagcaattaaaaacatttctggtgagcaagagaaaaagttatggttgcatattaaattagatacaggaatgggacgtttaggtattaaagatactaaaacgtatcaagaagtgattgaaatcattcaacaatatgagcaacttgtatttgaaggcgtgtttacacactttgcctgtgctgacgaaccaggagatatgacaactgaacaatatcaccgttttaaagatatggtcaatgaagcaattaaacctgaatatatacattgtcagaactcagcaggttctctattaatggattgccaattctgtaatgcaataagaccaggaatttccctttatggatattatccatcagagtatgtacagcaaaaagttaaagtacaccttaaaccaagtgtgcaattaattgctaatgtagttcaaacaaagacgctacaagcgggtgagtctgtaagttatggtgcaacttatacagctactgatccaacaacaatagcattgttacctattggatatgcagatggctatttacgcattatgcaaggtagctttgtaaatgtaaatggtcatcaatgcgaagttattggtcgcgtatgtatggatcagacaattgtaaaagtgccagatcaagttaaagctggagattcggtgattttaatagataatcatagagaaagtccacagtcggtagaggtggcagctgaaaagcaacatactattaattatgaagtgctttgtaacttgtcgagacgtttgccgcgaatctatcatgatggtgatcaacgttttgtaacaaatgaattgttaaaataa

SEQ ID NO: 32975 - protein, 382 aa, Staphylococcus aureus subsp. aureus MRSA252
MSDKYYRSAYMNVDLNAVASNFKVFSTLHPNKTVMAVVKANAYGLGSVKVARHLMENGATFFAVATLDEAIELRMHGITAKILVLGVLPAKDIDKAIQHRVALTVPSKQWLKEAIKNISGEQEKKLWLHIKLDTGMGRLGIKDTKTYQEVIEIIQQYEQLVFEGVFTHFACADEPGDMTTEQYHRFKDMVNEAIKPEYIHCQNSAGSLLMDCQFCNAIRPGISLYGYYPSEYVQQKVKVHLKPSVQLIANVVQTKTLQAGESVSYGATYTATDPTTIALLPIGYADGYLRIMQGSFVNVNGHQCEVIGRVCMDQTIVKVPDQVKAGDSVILIDNHRESPQSVEVAAEKQHTINYEVLCNLSRRLPRIYHDGDQRFVTNELLK

SEQ ID NO: 32976 - DNA, 1098 bp, Acinetobacter sp. ADP1
  CDS (1)..(1098): transl_table=11
atgccacgtccgattcaggctgttattcatcttgaagcacttgcgcacaatcttaagattgtgcgtgcatctgccccagaaagtcaagtctttgcagtagttaaagccaacgcttatgggcatggaattgaacgcgtttatcaggcatttaaacaggcagatggatttgcactgctggatattgaagaagccaaacgattacgcgctctgggctggacagggccgattttattgctcgaaggcattttttcgccgcaggatctatttgactgcgttcaataccagttgagctttactgtacatcatgatgttcagattgactggatcgaaggtcatcctgaagacgcccagttcgatatttttcttaaaatgaatagtggcatgaaccgtcttgggtttaaacctgtgcagtatcgtcatgcctggcagcgtttaaatgcactttcccaagtcagacacctgacgcatatgatgcatttttctgatgcggatggtgagcgttttggcgagtcgggaattacctatcaacatgatctgtttgaagacaccattcgtgatttgccaggaccaaaatcggtcagcaacagcgctgctattttacgccatccgttgcactccgatgtggtgcgtggcggaattatgctctatggcagttcacccgattatccaacacatggtcttcatgactggtcactcaaacccacgatgagcttgcgtagcgagattattgctatccagatgctggaacccaatgaaagtgtgggctatggctcaagttttgtggcagatcaaccgcttcggatcgggattgtggcatgtggctatgcagatggttatcaacgaatttctccgacaggaacgcctgtactggttgatggtattgaaacgagaaccattggacgtgtgagtatggacatgctcgccgttgatctgagcgcagttcctaaggcaagaattggttcggaggtggtgctttggggatactcctccacgggtgtgattttaccgattgatgatgtcgcggcagcatctggcaccgtcggttatgaactgatgtgtgctgtgaccgcacgtgttccttttacaattcaaacataa

SEQ ID NO: 32977 - protein, 365 aa, Acinetobacter sp. ADP1
MPRPIQAVIHLEALAHNLKIVRASAPESQVFAVVKANAYGHGIERVYQAFKQADGFALLDIEEAKRLRALGWTGPILLLEGIFSPQDLFDCVQYQLSFTVHHDVQIDWIEGHPEDAQFDIFLKMNSGMNRLGFKPVQYRHAWQRLNALSQVRHLTHMMHFSDADGERFGESGITYQHDLFEDTIRDLPGPKSVSNSAAILRHPLHSDVVRGGIMLYGSSPDYPTHGLHDWSLKPTMSLRSEIIAIQMLEPNESVGYGSSFVADQPLRIGIVACGYADGYQRISPTGTPVLVDGIETRTIGRVSMDMLAVDLSAVPKARIGSEVVLWGYSSTGVILPIDDVAAASGTVGYELMCAVTARVPFTIQT

SEQ ID NO: 32978 - DNA, 1083 bp, Erwinia carotovora subsp. atroseptica SCRI1043
  CDS (1)..(1083)
atgaaaacggcaactgccgtcattaaccggcgtgcgttacgccacaacctgcaacgaatccgccagttagcgcctggcagccagatcgttgccgtcgtgaaagccaacgcctacggccacggcatgatcgaatccgctcataccttctgcgatgctgactgttacggcgtcgcgcgactctccgaagcgctggcgctgcgtgccgcaggcatcaccaaacctatcgtcctgctggaaggctttttctccgccgacgatctcccgcttctggtggaacaccagctagaaaccgccgttcacagcctcgaacagcttgctgcgttggagcaagccacgttgccgcagccgatacgcgtgtggatgaagctcgatactggcatgcaccgccttggcgttctgccggaacatgccgacgcgttttggcaacgcctgaccgaatgtcggaatgtcgtgcagccggtcaatatcatgagccacttttgccgcgccgatgaacccgaggccggaaccaccgaacgccagttggcctgcttcgatgcctttacccaaggtaaacccggcgcacagtccatcgcggcttccggcggtattctactgtggccgcaagcgcaccgcgatcgcgtccgccccggcattatcctctatggcgtgtcgccgctggataacgaagacgccgcgcatttcggcttccagcctgccatgacctttacgtctcaccttatcgccgttcgtgaacacaaagcgggtgaaaccgtcggctatggcggcacttggaccagcccgcgcgatacccgtctgggcgtcgtcgctgtcggctacggcgatggctacccgcgttgcgcccccgcaggtacgcccgtgctcatcaacggtcgcgaagtaccgctttccggccgcgtatcgatggatatgattacggttgatttagggccggatgctcaggataaggtcggcgatgaagtcatcctttgggggccaacgctatcggttgaacgcattgcggcacacacgggtgccagcgcctacgagctgatcacccgtttaacacagcgcacggcgttggaatacgtcgacggtgagtaa

SEQ ID NO: 32979 - protein, 360 aa, Erwinia carotovora subsp. atroseptica SCRI1043
MKTATAVINRRALRHNLQRIRQLAPGSQIVAVVKANAYGHGMIESAHTFCDADCYGVARLSEALALRAAGITKPIVLLEGFFSADDLPLLVEHQLETAVHSLEQLAALEQATLPQPIRVWMKLDTGMHRLGVLPEHADAFWQRLTECRNVVQPVNIMSHFCRADEPEAGTTERQLACFDAFTQGKPGAQSIAASGGILLWPQAHRDRVRPGIILYGVSPLDNEDAAHFGFQPAMTFTSHLIAVREHKAGETVGYGGTWTSPRDTRLGVVAVGYGDGYPRCAPAGTPVLINGREVPLSGRVSMDMITVDLGPDAQDKVGDEVILWGPTLSVERIAAHTGASAYELITRLTQRTALEYVDGE

SEQ ID NO: 32980 - DNA, 1128 bp, Propionibacterium acnes KPA171202
  CDS (1)..(1128): transl_table=11
atgccacgttgtccatcgccttctcacgccattattgatctgtctgccatcgctgcgaacctcgccgtcgtgaggaaacgcgcaggcgaccgaaaggtcctctttgccgtcaaggccgacgcctatgggcatggggcagtggaagtctcgcgctatgtcgaaaaacaccggtatgccgactggctcgccgtcgccacggtcgctgaaggccaagagctggttgaagccggcatcaccctgcccatactcaaactctcccccgccgatccttgggacatggatgcagccattacgtccgggattcgtctcaccgtggtggatttcgacaccctggaggcggtaagcaaagccgctgtacgactaggaatcactgccaagattcatatcgctgttgatagcggcatgggacgcatcgggctgcgtcctgaatgccttgctgaactcactgctgccgctgaccgcgccaaaggcgtcgaagtcgaaggcgtcttcactcacctgcccattagcgatgtgccggagggggcggagttcacccgccgcgagatcgacactttcatgactgctgtctcgctgatagaaacacatcgtgggccgttcccccttgtgcacctggccaattccggcgccatcctcgggcacgatctggggaaaacctccatggtgcgcgccggcatcgttgggtacggatacgatcccaaccctcacgccgaccgtgccgacctacaccctgccctgtcctggatcagccacgtcaccttcgttaaaactgtcagtgtgggggataccatcggctacggcagaacatggacagccagcgaaacgacaaaaatcgccaccgtcccagtcggttacgccgacggactgtcccgaggactgtcaaataaaggacacgttctcattagagggtccgttcatcccatcgtcggtcggatctgcatggaccaattcatggtcgatcttggccccgattcgaacgtcacggtgggagatgaggtggtgctcattggaacccaggaggacgaaactctgaccgctgatgacatggccgaactcctcggaaccattagctacgagatcacttgcgccatttccaaacgcgtggatcggtactgggtcgggcagtga

SEQ ID NO: 32981 - protein, 375 aa, Propionibacterium acnes KPA171202
MPRCPSPSHAIIDLSAIAANLAVVRKRAGDRKVLFAVKADAYGHGAVEVSRYVEKHRYADWLAVATVAEGQELVEAGITLPILKLSPADPWDMDAAITSGIRLTVVDFDTLEAVSKAAVRLGITAKIHIAVDSGMGRIGLRPECLAELTAAADRAKGVEVEGVFTHLPISDVPEGAEFTRREIDTFMTAVSLIETHRGPFPLVHLANSGAILGHDLGKTSMVRAGIVGYGYDPNPHADRADLHPALSWISHVTFVKTVSVGDTIGYGRTWTASETTKIATVPVGYADGLSRGLSNKGHVLIRGSVHPIVGRICMDQFMVDLGPDSNVTVGDEVVLIGTQEDETLTADDMAELLGTISYEITCAISKRVDRYWVGQ

SEQ ID NO: 32982 - DNA, 1113 bp, Leifsonia xyli subsp. xyli str. CTCB07
  CDS (1)..(1113): transl_table=11
atgacgatcgtggacgccgtcgccgaaccactcccccgcgctgtggtcgatctggccgccctgcgccgcaatgtggcgacgctcacgcgcctgatcgcgcccgccgagaccatgctggcggtcaaggccgacgcctacgggcacggcctgctgccgatcgcggaagccggagtgcaggcgggcgccacctcgctcgccgtgctggagatctccgccggactagtgctgcgccgggccggggtgaccgtcccgctgctcgcctggctgcacggcaccggcaccgactggcgcgcgggcatcgagaacgacatccagctcggcatctccgcccgctggcagctggaggccatcgccgccgccgccgcggaccgcgccgcgatcgtgcacctgaaggtggacaccgggctcagccgcaacggcgccacccgcgaggagtggccggcgctggtggatgccgcgctcgcgctgcaggagaccggggtcgtgcgcctccgcgccgcctggtcacacctcgccgatgcctcgatcgccgacgacgaggccgctctcgcggagttccgggaagcggtcgccgaggccgaagcccgtggcgcccgcttcgagatgctgcacctcgccgcgagctcggcgggcatccggatgccggaggcccggttcgctctggtccgcttcggcatcgccgcctacgggctctcccccttcgacgacaccaccggcgccgagctcggcctgcggccggtcatgcggctggaggcgccggtcatcgctgtgcatgtcgacggcaccacgcacgtccgcctcggcatcggcttcgcggacggcgtccccactctcggcctcgcccggacctcggtcctgctggggggacggcgctgccccgtgatcgccgtggaggcggacgcaatgctggtggatgccggagcccagcgcgtcgagcggggcgacaccgccgtgctcttcggcccgggcgacagcggcgaggccacggccgaggagtatgcggaatgggccgggacgatcgccgacgagatggtcaccggcgtcgcggcgcgggttccgcgggtctacgtgggcgacgacgagggcgcggggctcaccggcacgcgcgggtaa

SEQ ID NO: 32983 - protein, 370 aa, Leifsonia xyli subsp. xyli str. CTCB07
MTIVDAVAEPLPRAVVDLAALRRNVATLTRLIAPAETMLAVKADAYGHGLLPIAEAGVQAGATSLAVLEISAGLVLRRAGVTVPLLAWLHGTGTDWRAGIENDIQLGISARWQLEAIAAAAADRAAIVHLKVDTGLSRNGATREEWPALVDAALALQETGVVRLRAAWSHLADASIADDEAALAEFREAVAEAEARGARFEMLHLAASSAGIRMPEARFALVRFGIAAYGLSPFDDTTGAELGLRPVMRLEAPVIAVHVDGTTHVRLGIGFADGVPTLGLARTSVLLGGRRCPVIAVEADAMLVDAGAQRVERGDTAVLFGPGDSGEATAEEYAEWAGTIADEMVTGVAARVPRVYVGDDEGAGLTGTRG

SEQ ID NO: 32984 - DNA, 1119 bp, Leifsonia xyli subsp. xyli str. CTCB07
  CDS (1)..(1119): transl_table=11
gtgagcgctcccttccgcgagctcgtcgtcgacctcgacgcggtgagcgcgaatgtcgtgcgcctgcgcgaacgggccgggaccccgcacctgatggcggtcgtgaaggcggacgcctacggccacggggccgtcgagtccgcttgcgccgcgctcgccgggggcgcggactggctcggcgtggccgatctctccgaggcgtcgcagctgcgggccgccgggatcgaagcgcccctgctcgcgtggctccacgacccggacgaggacttcgtcgcggccatcgcggccggagtggatattggggtctcctccctcgcccacctggaggccgcggcagcggccggtggcggcagcccggccttcgtccagctcaagctggagacggggctcagccgcaacggcctccccgaggagcagtgggaggctgtgttcgcccgcgcgcacgaactcgagaggagcgggcggatcgtggtccgcggcgtcttcagccacctctccaacgcttcgcctgcggaggaccgcgccgccatcgcagcctacgagcgcgggctcgcccgcgccgaggccgctggactcgcgccggagctgcggcacatcgctgcgagcgcggctgcgatcagcctgccggaggcgcggttcaccctggtccggctcgggctcgcgatctacggcctcagccctttcggcgccgcctccgccaccgagctcgggctgcgccccgcgctgacgctgcgggcgcgcgtcgccgccgtccgccgcgttcccgccgggaagggcgtttcctacgactacacgtaccgcaccgaacgcgagacgacgctcgcgcttgtgcccgtcggctacggcgacggccttccgcgtcacgcgtccaacctcggcccggtgtcgatcggcggcgagcgtttccgcgtctccgggcgcatcgcgatggaccagttcgtcgtggatgtcggcgacgcgccggtggccgtcggcgatgaggtcgttctgttcggcgatccggcccgcggcgtccccggtgcggacgactgggcggcggccgccgaaacgatcaactacgagatcgtcacgcgcctgggcggacggctccgccgcaccttccgcggcggcccggcgtga

SEQ ID NO: 32985 - protein, 372 aa, Leifsonia xyli subsp. xyli str. CTCB07
MSAPFRELVVDLDAVSANVVRLRERAGTPHLMAVVKADAYGHGAVESACAALAGGADWLGVADLSEASQLRAAGIEAPLLAWLHDPDEDFVAAIAAGVDIGVSSLAHLEAAAAAGGGSPAFVQLKLETGLSRNGLPEEQWEAVFARAHELERSGRIVVRGVFSHLSNASPAEDRAAIAAYERGLARAEAAGLAPELRHIAASAAAISLPEARFTLVRLGLAIYGLSPFGAASATELGLRPALTLRARVAAVRRVPAGKGVSYDYTYRTERETTLALVPVGYGDGLPRHASNLGPVSIGGERFRVSGRIAMDQFVVDVGDAPVAVGDEVVLFGDPARGVPGADDWAAAAETINYEIVTRLGGRLRRTFRGGPA

SEQ ID NO: 32986 - DNA, 1122 bp, Desulfotalea psychrophila LSv54
  CDS (1)..(1122): transl_table=11
atgaaacgaaattcctttaataatgtgactgtatgtcgttctgccttaagaaaaaattttaagaccatgcaggacaagatgggccagggtgggaagctgatggctatggtcaaggctgatgcctatggtcatggcgcagttgaggtggcaaaggccctgcaggatgttgcctgtagctcttttggcgtagctgagattcgagaggctgtcctcctgcgagatgctggtattaccggtgatatctttgttatgcttggctttgatctggatgcggtcggccttatgtttgactataggctaacccccgttgttcactgctatgaagatattgtggccctttctgtagagggggtgaaacgtggttatgaaataggttgtcatataaaggtcgatacaggtatgaggcgtctgggctttgagcctgagcaggtacttggcgtagcccataatatttcccgactttcaggggtctttgttgccggaatgttaagccatttccccgaggcagatgttgtcaattctccatcaagtcgtgatggtattcgtcgctttgcaagtttagatgtggttttaaaatctgaattttcaactgtttgtcatcttgcaaattccggtggcgtgcttaactttcccgagtctctttttgatatgggccgttcgggtattagtatttatggttatcatcctgcaggtgcgatagagggtggaggcacgagtccctttattcctgccatgagttttcgtagcagaattttacaggttaaaaaggtggccgccggaacaggcgtcagttacggtcatagctatattaccaaaaggccaacacttcttgctgttttgccaacggggtatgaggatggttatcgtaggtctctgtccaataaggccgaggttttgattcgtggtcagcgggctcctgtacgtgggcagatatgtatgaatgcctgtgttgtggacgttaccgatattgaaaatgtgacggcaggggatgaggtcgtactcctcggtgagcagggaaatgagagaattacagcggatgatattgccgaatgggcagataccattagctatgaaatactttgtatgctggggcatacaaacaatagattgtatgtagattga

SEQ ID NO: 32987 - protein, 373 aa, Desulfotalea psychrophila LSv54
MKRNSFNNVTVCRSALRKNFKTMQDKMGQGGKLMAMVKADAYGHGAVEVAKALQDVACSSFGVAEIREAVLLRDAGITGDIFVMLGFDLDAVGLMFDYRLTPVVHCYEDIVALSVEGVKRGYEIGCHIKVDTGMRRLGFEPEQVLGVAHNISRLSGVFVAGMLSHFPEADVVNSPSSRDGIRRFASLDVVLKSEFSTVCHLANSGGVLNFPESLFDMGRSGISIYGYHPAGAIEGGGTSPFIPAMSFRSRILQVKKVAAGTGVSYGHSYITKRPTLLAVLPTGYEDGYRRSLSNKAEVLIRGQRAPVRGQICMNACVVDVTDIENVTAGDEVVLLGEQGNERITADDIAEWADTISYEILCMLGHTNNRLYVD

SEQ ID NO: 32988 - DNA, 1230 bp, Yersinia pseudotuberculosis IP 32953
  CDS (1)..(1230): transl_table=11
atgcacgttcgttttcgtcatttattcttattaccattaataactttggtcgcttgtagccaacccgtatcaaaaaaccatcttagcctgacctcactatctgccaacgcccagcaacctgtagtaaataatgcgtggcttgaaatctctcaaggtgcgctggatttcaatactaaaaagatgcttacactgctggataataaatccacactttgtgcaatattaaaaggtgatgcctatggacatgacctgaccttagtcacaccggtgatgctaaaaaacaatgtgcaatgtattggggttgccagcaatcaggaactaaaaatggtacgtgatctaggatttacggggcagttgatacgggtcagaagtgcaacattaaaagaaatgcaacaagctatggcttacgatgttgaagaacttattggcgataaaaccgtcgctgagcagttaaataatattgcaaaactgaatggaaaagttctgcgtatccatctggcactgaactccgcagggatgtctcgtaatgggctggaggtcagtaaggcccgcggtttaaatgacgcaaagacaattgcaggtttaaaaaatctgacaatcgttggcatcatgtcgcactacccggtggaagatgctagcgaaatcaaagcagacttggctcgattccagcaacaagccaaagatgttatcgcggtcacggggctaaaacgtgaaaagattaagctccacgtcgccaatacattcgcgaccttagcggtgcctgattcatggttggatatggtccgtgtgggaggggtgttttatggtgacaccatcgccagcacagagtataagcgggtcatgaccttcaaatctaacatcgcatcgctgaacaactaccctaagggcggtactgttggctatgaccggacctatacattgaaacgtgattccctgctggcgaatatccccgtgggttatgccgatgggtatcgccgagtatttagtaatgcggggcatgtgattattcaaggtcagcgcctgcccgtattaggcaaaacatcaatgaatacggtcatagtagacgtcaccgatctgaaaaaagtgagtttaggtgatgaagttgtcttgttcggtaagcaaggcaatgcggaaattcaggcagaagaaattgaagatctcagtggcgcactctttaccgaaatgtcaattctgtggggcgcaaccaataagcgtattctggtagattaa

SEQ ID NO: 32989 - protein, 409 aa, Yersinia pseudotuberculosis IP 32953
MHVRFRHLFLLPLITLVACSQPVSKNHLSLTSLSANAQQPVVNNAWLEISQGALDFNTKKMLTLLDNKSTLCAILKGDAYGHDLTLVTPVMLKNNVQCIGVASNQELKMVRDLGFTGQLIRVRSATLKEMQQAMAYDVEELIGDKTVAEQLNNIAKLNGKVLRIHLALNSAGMSRNGLEVSKARGLNDAKTIAGLKNLTIVGIMSHYPVEDASEIKADLARFQQQAKDVIAVTGLKREKIKLHVANTFATLAVPDSWLDMVRVGGVFYGDTIASTEYKRVMTFKSNIASLNNYPKGGTVGYDRTYTLKRDSLLANIPVGYADGYRRVFSNAGHVIIQGQRLPVLGKTSMNTVIVDVTDLKKVSLGDEVVLFGKQGNAEIQAEEIEDLSGALFTEMSILWGATNKRILVD

SEQ ID NO: 32990 - DNA, 1101 bp, Borrelia garinii PBi
  CDS (1)..(1101): transl_table=11
atgagtagtaacaaaacaataataataaatttaaataatttagaacataacttaaatttaattaaaaataaaattggtgaaaaagaaatagtggctaccctaaaaggcgacgcatatggtcacggacttataaatatctttaaattttttaaagaaaaaaaaataaattattttggactttctaatattgaagatgctaaaacacttaaaaaaattgataaaaatataaaaatattgatgtacattaaagtagataaaaaagaaattaaaaatttgattaaacttgagttattaccatttgttgcagattttgaatatctatttttaatagaaaaagaatgtgcattccaaaaaaagaaaataaaagttcacttaaaaattgatattggcatgaatagatatggaataagaatagatagtgcccttgaaatagctacatatattcaaaattcacaatttctagaactagaagggatctgctcacatcttccggcaacagaaaactttaaaactacacaaaaacaaatagaaaaatttttattggttttggaaacacttaaacaaaaaaatataaatccaaaatttatccatatttctaattcggggcacattatcaactacaaactaaatccacaatttaatatggtaagaccgggtcttattctttacggttattgtcaatcactaaaaaacaaaaaaactaccctaaatttcaaacccgtattaaatttattttcaaaagtaatatttatcaaaaatgtaaaaaaaggggaaaaaatttcatattcgggcatatttcaagccaaagaggatatgaaaataggaattattccaatcggatattttgatggaatacctcaaaatataaataataatttttattttttaataaacaatcaaaaatgtaaaataaagggaaaggtctgcatgaacctaacaatagtagaaattcctaaaaacttaaaagttagaataggttcaaaagtagaaattgtatcagaaaaattaagtatagataaaatgagtaaattttctaaaagaagtcattatgaattactatgtaatataggaaaatatgagaaaagaaaatacttagattaa

SEQ ID NO: 32991 - protein, 366 aa, Borrelia garinii PBi
MSSNKTIIINLNNLEHNLNLIKNKIGEKEIVATLKGDAYGHGLINIFKFFKEKKINYFGLSNIEDAKTLKKIDKNIKILMYIKVDKKEIKNLIKLELLPFVADFEYLFLIEKECAFQKKKIKVHLKIDIGMNRYGIRIDSALEIATYIQNSQFLELEGICSHLPATENFKTTQKQIEKFLLVLETLKQKNINPKFIHISNSGHIINYKLNPQFNMVRPGLILYGYCQSLKNKKTTLNFKPVLNLFSKVIFIKNVKKGEKISYSGIFQAKEDMKIGIIPIGYFDGIPQNINNNFYFLINNQKCKIKGKVCMNLTIVEIPKNLKVRIGSKVEIVSEKLSIDKMSKFSKRSHYELLCNIGKYEKRKYLD

SEQ ID NO: 32992 - DNA, 1134 bp, Symbiobacterium thermophilum IAM 14863
  CDS (1)..(1134): transl_table=11
atggatctggacggcatgcgcccgacgtgggcggaggtcgatctgaacgcggtccgggcgaacatccgggcgttgaagcggatctcgaaggctcctcgactgatggcggtggtgaaggcgaatggctacgggcacggcgccgtgcccgtggcgacggcggccatcgaggccggggcggactggctgggcgtcgcgtcggtggaggagggcgtgaccctgcgtcgccacggcatctccgcgcccatcctggtgctgggttacgtgtcccccggccaggccgaggccgtgctgacggaggggctgcgggtagccctcttcgacggcgaactggggcaggccctgaaccgggaggggcgcaggctgggccgctgggcccgcgtccacctgaaggtggacaccggcatggggcgcatcggcctgcagcccgccgaggtgggccgcctcggccgcgaactggccaggctggaccatgtggaggtggagggggtcttcacccacctggcgaccgccgatgagccggggaacccgtacacccgtctgcagctggagcggtacgaggcggccctggcggagctggcggcggcgggtgtccggcccgccatccggcacgccgccaacagcgcggggctcatgctccacccggaggcgcactacgacatggtgcgcagcggcatcgcggtggtggggctgcccccggcgccgggcgtggcgtggcccgtgaagctcgcccccgccctcacctggaagacccgggtggggctggtgaagtggctggaggccggccactcgatctcctacggctgcacctacacgaccgcccgccgcgagcagatcgcaaccttgccggtgggctacgcggacggctacccccggagactctccaaccgggcgcaggtcttgatccggggccggcggtgccccgtggtcggtgtggtgaccatggaccagatgatggtccgggtgccggacgatctgccggtccgggtcggggacgaggtggtgctgatcgggcggcagggcggcgaggagatcacggcgacggagctggccgggctggcggacacgatcagctacgagatcgtctgcggcatctcgcggcgggtgccccgtttttacggcggggagaccgcgtga

SEQ ID NO: 32993 - protein, 377 aa, Symbiobacterium thermophilum IAM 14863
MDLDGMRPTWAEVDLNAVRANIRALKRISKAPRLMAVVKANGYGHGAVPVATAAIEAGADWLGVASVEEGVTLRRHGISAPILVLGYVSPGQAEAVLTEGLRVALFDGELGQALNREGRRLGRWARVHLKVDTGMGRIGLQPAEVGRLGRELARLDHVEVEGVFTHLATADEPGNPYTRLQLERYEAALAELAAAGVRPAIRHAANSAGLMLHPEAHYDMVRSGIAVVGLPPAPGVAWPVKLAPALTWKTRVGLVKWLEAGHSISYGCTYTTARREQIATLPVGYADGYPRRLSNRAQVLIRGRRCPVVGVVTMDQMMVRVPDDLPVRVGDEVVLIGRQGGEEITATELAGLADTISYEIVCGISRRVPRFYGGETA

SEQ ID NO: 32994 - DNA, 1170 bp, Bacillus cereus ZK
  CDS (1)..(1170): transl_table=11
atggaagaagcaccattttaccgtgacacttgggtggaagtggatttagatgccatttataacaacgttacacatattaaagaatttatcccgagtgatgtagaaatttttgccgttgttaaagggaatgcatatgggcacgattatgtaccggtggctaaaacagcattagaagcgggggcgacaaggttagcagttgcgttcttagatgaagctttagtgcttcgaagagctggtattactgcaccaattttggtgttaggtccttctcctcctcgtgatataaatgtagctgctgaaaatgatgtagcattaactgtttttcaaaaggaatgggtagatgaagcaatcaaactttgggatggttcgtctacgatgaaataccatattaatttcgatagtggtatggggagaattggaatacgtgaacgtaaagaattaaaaggatttttaaaaagcttagaaggtgcaccattcttagaattggaaggagtttatacgcattttgcaacagcagatgaggtggagacttcttactttgataagcaatataacacatttttggagcagttaagttggttgaaagaattcggagtgaatcctaagtttgttcatacagctaatagtgctgcaacgctacgttttcaagggattacatttaatgcagtacgaattggcattgcgatgtatgggttatctccatctgtagaaatacgcccttttttaccgtttaaattagaaccagcgctatcattgcatacgaaagttgctcatattaaacaggtgattaaaggggatggaattagttataacgtcacttatcgaacgaaaactgaagaatggattgcgaccgttgcaattggttatgcagatggctggcttagaagattacaaggatttgaagtacttgtaaatggtaaaagggtaccgattgtagggcgagtaacgatggatcaattcatgattcaccttccttgtgaagtgcctcttggtacgaaagttacactcattggaaggcaaggagatgaatatattagcgctacagaggttgcggaatattcagggactattaattatgaaattattacgacgatcagttttcgtgtgccgagaatatttatacggaatggaaaagttgtggaagtaattaattatttgaacgatatatag

SEQ ID NO: 32995 - protein, 389 aa, Bacillus cereus ZK
MEEAPFYRDTWVEVDLDAIYNNVTHIKEFIPSDVEIFAVVKGNAYGHDYVPVAKTALEAGATRLAVAFLDEALVLRRAGITAPILVLGPSPPRDINVAAENDVALTVFQKEWVDEAIKLWDGSSTMKYHINFDSGMGRIGIRERKELKGFLKSLEGAPFLELEGVYTHFATADEVETSYFDKQYNTFLEQLSWLKEFGVNPKFVHTANSAATLRFQGITFNAVRIGIAMYGLSPSVEIRPFLPFKLEPALSLHTKVAHIKQVIKGDGISYNVTYRTKTEEWIATVAIGYADGWLRRLQGFEVLVNGKRVPIVGRVTMDQFMIHLPCEVPLGTKVTLIGRQGDEYISATEVAEYSGTINYEIITTISFRVPRIFIRNGKVVEVINYLNDI

SEQ ID NO: 32996 - DNA, 1074 bp, Mannheimia succiniciproducens MBEL55E
  CDS (1)..(1074): transl_table=11
atgaaaccagcaacagtaaaaatcagttcagttgcactgaaacataatattcaaataattaaacagaaagcaccgcacagtaaaatcatcgctgtggtgaaagcaaatgcttacggacacggcgttgaatttgtctcttctaccttagagaatttagttgatggttttggtgtggcgcgtttagccgaagcccttagcgtccgttctaacggcgtaaccaaaccgatccttttgttggaaggttttttctctcctaaagatttacccattctttccgtcaataatattcaaaccgtcgtacataaccaggatcaattggatgcaattaaacgggcgaatcttgaaaatccgataaaagtctggctgaaaattgatacgggcatgcaccgtttaggtgttagtctggaagaggtggattattactataacgaattgatgaattgtccgaatgtggatgaagtggggtttgtaagccatttcagccgcgctgacgaaaccgacagcgattataccaatattcagttaaaccgctttttggatgccacaaaaaacaaaaaaggcaaccgcactattgcggcttccggcggcattttattttgggaagattcccatttggaatatattcgtccggggatcattatgtatggcgtatcgccgattaatattccgagcagtgaatacggtttgatcccggtgatgaccttgacctcttcactaattgccgtgcgtgatcataaaaaaggcgagcctgtgggttacggcggtatttgggtgagcgagcgggatacgaaaatcggcgtggtggcgattggctacggtgacggttatccccgcaatgtgccggcaggtacaccgatttatattaatggacgccgggtgccgattgtcggccgtgtatctatggacatggttacggtggatctcggtcccgattgtaaagacaaagtaggcgatgaagcggttctttgggggaaagaattgccaatcgaggaagtggcggaaattaccggtctgctaagttatgaattaatgaccaaattaacgccgcgggttcttacggaatatgttgattaa

SEQ ID NO: 32997 - protein, 357 aa, Mannheimia succiniciproducens MBEL55E
MKPATVKISSVALKHNIQIIKQKAPHSKIIAVVKANAYGHGVEFVSSTLENLVDGFGVARLAEALSVRSNGVTKPILLLEGFFSPKDLPILSVNNIQTVVHNQDQLDAIKRANLENPIKVWLKIDTGMHRLGVSLEEVDYYYNELMNCPNVDEVGFVSHFSRADETDSDYTNIQLNRFLDATKNKKGNRTIAASGGILFWEDSHLEYIRPGIIMYGVSPINIPSSEYGLIPVMTLTSSLIAVRDHKKGEPVGYGGIWVSERDTKIGVVAIGYGDGYPRNVPAGTPIYINGRRVPIVGRVSMDMVTVDLGPDCKDKVGDEAVLWGKELPIEEVAEITGLLSYELMTKLTPRVLTEYVD

SEQ ID NO: 32998 - DNA, 1182 bp, Bacillus licheniformis DSM 13
  CDS (1)..(1182): transl_table=11
atgaaaaagctttgccgtgaagtttgggtagaggtaaatcttgatgcgatcaaaaaaaatttgcgcgcgtttcggcggcatattccgaaaaagagcaaaattatggctgtcgtaaaagcgaatgcttatggtcacggatcggtggaagttgcacgccatgcacttgaacatggtgcgagtgagctcgccgttgcctcggtggaggaagcggtcgttttacgaaaagcggggattaaagcgccgatccttgtgcttggtttcaccccgctgagctgtgtgaaagaagcggcagcttggaatatatcgttatcagcttttcaagttgactggattaaagaagcgaacgagatattggaaaatgaagcagatcctaaccggctggctgttcatatcaatgtggataccggcatggggcgtttaggtgtacgaacaaaggaaaagcttttagcaatcgtggaagcgctgacggcaagtgaaaacctcgaatgggaaggaatttttacgcatttttccacagctgacgaaccggatactgagctaaccatgattcaacacgaaaagtttatcagctttcttcgctttctgaaagaacaaggctttaagctgcctacggtgcatatgaacaatacggccgcggcgatcgcttttccggaattcagcgctgatatgattcgcttaggcatcggaatgtatggattatatccttccgattatatcaggcagcttaatctcgttaagcttgtgcctgcactaagcttgaaggcgcgaatcgcttatgtgaaaaccatgttgactgaaccgcggacggttagttatggtgctacatatgttgcagagcgcggggaagtcattgccacaattccggtcggctatgctgacggctattcccgtgaactttccaaccgcggttttattcttcatcgaggaagacgagtgccggtggcgggaagagtaacaatggatatgataatggtcagtctgggagagggtgaaggtaaacaaggagaggaagtcgtgatttacggccggcaaaagggagcagagatatctgttgatgaaattgcggaaatgcttgatacgatcaactatgaagtggtatctaccataagctggcgcgtccctcgtttttatataagagacggcgagatttttaaaaagtcgaccccgctgttatacgtgtag

SEQ ID NO: 32999 - protein, 393 aa, Bacillus licheniformis DSM 13
MKKLCREVWVEVNLDAIKKNLRAFRRHIPKKSKIMAVVKANAYGHGSVEVARHALEHGASELAVASVEEAVVLRKAGIKAPILVLGFTPLSCVKEAAAWNISLSAFQVDWIKEANEILENEADPNRLAVHINVDTGMGRLGVRTKEKLLAIVEALTASENLEWEGIFTHFSTADEPDTELTMIQHEKFISFLRFLKEQGFKLPTVHMNNTAAAIAFPEFSADMIRLGIGMYGLYPSDYIRQLNLVKLVPALSLKARIAYVKTMLTEPRTVSYGATYVAERGEVIATIPVGYADGYSRELSNRGFILHRGRRVPVAGRVTMDMIMVSLGEGEGKQGEEVVIYGRQKGAEISVDEIAEMLDTINYEVVSTISWRVPRFYIRDGEIFKKSTPLLYV

SEQ ID NO: 33000 - DNA, 1074 bp, Legionella pneumophila subsp. pneumophila str. Philadelphia 1
  CDS (1)..(1074): transl_table=11
gtgtcaagacctacacgtttagtgatagagcccagtgctttattgcataatttatctcaaatcaagcatttagctccaggcaaaaaagttatcgctatggtaaaagccaacgcctatggctgtggagtcagggaagttgcccctgtccttgatgggcgtattgaggcttttggagtagcctgccttgaggaggctctggctattcgagctttaggtgttgaaaccccgtgcattctctttcagggcgtctttagttctgatgaattgtcagtagccgttgagaatgatttcgcctgtgttcttcatcacgcacagcagttggaatggctaatcaagactccgttgccttacccgataaaagtatgggtgaaggtaaacacaggcatgcacagactgggatttaaaatccatgaattgcaaaaagtgatgggggcattgcaaacctgtacctgggttgataaaagtatagggttaatgactcatttggcttgcgcagatgaacctcatcgtcctgagaatcaacaacagatctctttgtttcaggagatatccatacctgggtttcgccaacgcagtatcgctaattcggcggcaattatttcattccctgattcgcaggctgatgtggtgaggcccgggattatgttgtatggtgtttccccatttgcaaatcaaaatgcccatgatttaggtttaatccctgtcatgcgttttatgtcagccatcagcgcgattcatgataacccatcttttgcccaggtaggctatggtggaacctggaaaagtgataaaccttcgcgaattggtgttgttgcagcaggttatggcgatgggtacccacggcatatttccgagaaaacaccggtttgggttagagggagggaggtgtctattgttggcagagtttctatggatatgctgaccatcgatttgacagagcaccctgatattgagatcggcgatgaagttgagctttggggaacacatgttttagtagagcgcattgccaaatcagcaggtacagtaggatacgaattattatgtcaaatttcggagagagtacgttacaaataa

SEQ ID NO: 33001 - protein, 357 aa, Legionella pneumophila subsp. pneumophila str. Philadelphia 1
MSRPTRLVIEPSALLHNLSQIKHLAPGKKVIAMVKANAYGCGVREVAPVLDGRIEAFGVACLEEALAIRALGVETPCILFQGVFSSDELSVAVENDFACVLHHAQQLEWLIKTPLPYPIKVWVKVNTGMHRLGFKIHELQKVMGALQTCTWVDKSIGLMTHLACADEPHRPENQQQISLFQEISIPGFRQRSIANSAAIISFPDSQADVVRPGIMLYGVSPFANQNAHDLGLIPVMRFMSAISAIHDNPSFAQVGYGGTWKSDKPSRIGVVAAGYGDGYPRHISEKTPVWVRGREVSIVGRVSMDMLTIDLTEHPDIEIGDEVELWGTHVLVERIAKSAGTVGYELLCQISERVRYK

SEQ ID NO: 33002 - DNA, 2547 bp, Bacteroides fragilis YCH46
  CDS (1)..(2547): transl_table=11
gtgccgattggcgcttcaataaatgtgcaaatatgccaatgctttaatattatgtcatatacaattgaatcaatcgttgaaaaaataggtgcacggcgtctgggaaacaagcctgctgccatcgactggctactgactgacagccgttcgttatgttttccggaagagaccctcttttttgccattcccaccaaaaggaacaacggcgcacgctacatccctgacctttatgaacggggagtgcgcaattttgtagtcacaagcgaagatttcaaagggctcaccatggacagtgagcaactaaaagtgacaatggctcaggaatgcaatttccttattgtccccaatactttaaaagcacttcagaaattggccgaacaacaccgtggttccttccagattccggtagtcggcattacgggcagcaatggaaagaccattgtaaaagaatggcttcaccaattgctcagccccgaccgggttatcgtgcgttcaccgcgcagctacaattcgcaaatcggtgtcccgctgtcagtctggcaaatgaacgaggaatccgaactgggcattttcgaagccggcatttcggaaatgggcgaaatgcgtccgttacagaatatgattaagccgacaataggcatcctgaccaacattggcggagcacatcaggaaaacttcttttcactgcaagagaagtgcatggaaaaactaagcctgtttaaagattgcgacgtagtcatttacaatggcgacaacgaaatgataagcaactgcgtaggaaagtcaatgctgactgcccgtgaaatcgcatggagcatgagggatatcgaacgtccgctctatatcagcagggttgagaagaaagaagatcataccgtcatctcctaccgctatctggagatggacaatacattctgtattccctttatcgatgatgcttccatagagaactcactgaactgcctcgctgcctgcctgtacctgatggtaccggccgaccagatcaccgaacgaatggccaggctcgaacctgtagcgatgcgccttgaagtaaaagacggaaagaacaactgtatcttgatcaatgacagttataattcggaccttgcttcgctggatatcgctctcgactttctttaccggcgttcgcagtcaaaaggcctaaagcgcactttgatcctttcggatatcctggaaaccggacaaagcacgacaacactctaccgcaaagtggcacaactggttcacagccgcggcattgaaaagattatcggtgtaggtgccgaaatatcctcatgcgcatcaaagtttgatatagaaaaatatttcttccccgataccaaggcacttctggcatcagatgtaattaagaaactcagaaatgaaatcatcctgataaaaggctcccgcaacttcggtttcgacctcgtttcggaagaactggaactgaaagtacacgaaaccatcctggaagtaaacctgggagctatggtagccaacctgaatcactaccgctcgatgctcaaaccggaaactaaaatggtgtgcatggtgaaagcgtctgcttatggagcaggttcgtacgaaatagccaaaacccttcaggagcatcacgctgactatctggcagtggccgtagccgatgaaggttccgaccttcgcaaagcagggatcacagcctccattatcatcatggatcccgaactgaccgctttcaaaaccatgttcgactataaactggaaccggaagtatacaatttccatttactcgacgcattgataaaagccgccgaaaaagaaggtatcaccaacttccccattcacgtaaaactggatacgggtatgcaccgattgggattcgaagagaaagacatcccgcaactgattcgccggttaaagaaccagaatgcactgattccccgctctgtcttttcccatttcgtaggcagtgattctgcccagttcgacgcttttacccggcagcaaatagaacgatatgaaaagatgtcaaaggaactgcaagatgcattcccgcacaaaatactgcgccatatctgcaacacagccggtatcgaacgcttccccggtgcacagttcgacatggttcgtcttggcatcggattgtatggaatcagtccgatcgataactcaatcatcaacaacgtgagtaccttgaaaacaacgattctccaaatacgggacgtggcggaagaagatactgtaggttatagccgcaaagggcatctgatacgtccctcacgtatcgctgctatacccatcggatatgccgacggcctgaaccgccatttgggatgcggacatggctattgccttgttaatggcaaaaaagccccatacgtaggaaatatctgcatggatgtgtgcatgatcgacgtaacggatattgattgtagagaaggtgatcaagctatcatcttcggtgacgaattaccgattaccgccttatcggatgcgctcgaaaccatcccttatgaagtattgacaggtatttcaacccgggtcaagagagtatattatcaagattaa

SEQ ID NO: 33003 - protein, 848 aa, Bacteroides fragilis YCH46
MPIGASINVQICQCFNIMSYTIESIVEKIGARRLGNKPAAIDWLLTDSRSLCFPEETLFFAIPTKRNNGARYIPDLYERGVRNFVVTSEDFKGLTMDSEQLKVTMAQECNFLIVPNTLKALQKLAEQHRGSFQIPVVGITGSNGKTIVKEWLHQLLSPDRVIVRSPRSYNSQIGVPLSVWQMNEESELGIFEAGISEMGEMRPLQNMIKPTIGILTNIGGAHQENFFSLQEKCMEKLSLFKDCDVVIYNGDNEMISNCVGKSMLTAREIAWSMRDIERPLYISRVEKKEDHTVISYRYLEMDNTFCIPFIDDASIENSLNCLAACLYLMVPADQITERMARLEPVAMRLEVKDGKNNCILINDSYNSDLASLDIALDFLYRRSQSKGLKRTLILSDILETGQSTTTLYRKVAQLVHSRGIEKIIGVGAEISSCASKFDIEKYFFPDTKALLASDVIKKLRNEIILIKGSRNFGFDLVSEELELKVHETILEVNLGAMVANLNHYRSMLKPETKMVCMVKASAYGAGSYEIAKTLQEHHADYLAVAVADEGSDLRKAGITASIIIMDPELTAFKTMFDYKLEPEVYNFHLLDALIKAAEKEGITNFPIHVKLDTGMHRLGFEEKDIPQLIRRLKNQNALIPRSVFSHFVGSDSAQFDAFTRQQIERYEKMSKELQDAFPHKILRHICNTAGIERFPGAQFDMVRLGIGLYGISPIDNSIINNVSTLKTTILQIRDVAEEDTVGYSRKGHLIRPSRIAAIPIGYADGLNRHLGCGHGYCLVNGKKAPYVGNICMDVCMIDVTDIDCREGDQAIIFGDELPITALSDALETIPYEVLTGISTRVKRVYYQD

SEQ ID NO: 33004 - DNA, 1071 bp, Burkholderia mallei ATCC 23344
  CDS (1)..(1071): transl_table=11
atgccgcgcccgatttccgccacgatccacaccgcagctctcgcgaacaacctctccgtcgtgcgccgccacgccgcccagtcgaaggtctgggcgatcgtcaaggcgaacgcgtacgggcacggtctcgcgcgcgtctttcccgggctgcgcggcaccgacggcttcggcctgctcgacctcgacgaggccgtgaagctgcgcgaactgggctgggcggggccgatcctgctgctcgagggcttcttccggtcgaccgacatcgacgtgatcgaccgctacagcctgacgaccgcggtgcacaacgacgagcagatgcgcatgctcgagaccgcgcggctgtcgaagcccgtgaacgtccagctgaagatgaacagcggcatgaaccggctcggctacacgcccgagaagtaccgggccgcctgggagcgcgcgcgcgcatgcccgggcatcggccagatcacgttgatgacccatttttcggacgccgacggcgaacgcggcgtggccgagcagatggcgacgttcgagcgcggcgcgcaaggcatcgccggcgcgcgcagcttcgcgaactcggccgccgtgctctggcacccgtcggcgcacttcgactgggtgcggcccggcatcatgctgtacggcgcgtcgccgtccggccgtgcggcggacatcgccgaccggggcctgaagccgacgatgacgctcgcctccgagctgatcgccgtgcagacgctcgcgaaagggcaggcggtcggctacggatcgatgttcgtcgccgaggacacgatgcgcatcggcgtcgtcgcgtgcggctatgcggacggctatccgcggatcgcgcccgagggcacgcccgtcgtcgtcgacggcgtgcgcacgcggatcgtcggccgcgtgtcgatggacatgctgaccgtcgatctcacgcccgtgccgcaggcgggcgtcggcgcgcgcgtcgagctgtggggcgagacgctgccgatcgacgacgtcgccgcgcgttgcatgacggtcggctacgagctgatgtgcgcggtcgcgccgcgcgtgcccgtgcgtgccgagtaa

SEQ ID NO: 33005 - protein, 356 aa, Burkholderia mallei ATCC 23344
MPRPISATIHTAALANNLSVVRRHAAQSKVWAIVKANAYGHGLARVFPGLRGTDGFGLLDLDEAVKLRELGWAGPILLLEGFFRSTDIDVIDRYSLTTAVHNDEQMRMLETARLSKPVNVQLKMNSGMNRLGYTPEKYRAAWERARACPGIGQITLMTHFSDADGERGVAEQMATFERGAQGIAGARSFANSAAVLWHPSAHFDWVRPGIMLYGASPSGRAADIADRGLKPTMTLASELIAVQTLAKGQAVGYGSMFVAEDTMRIGVVACGYADGYPRIAPEGTPVVVDGVRTRIVGRVSMDMLTVDLTPVPQAGVGARVELWGETLPIDDVAARCMTVGYELMCAVAPRVPVRAE

SEQ ID NO: 33006 - DNA, 1125 bp, Burkholderia pseudomallei K96243
  CDS (1)..(1125): transl_table=11
atgcctcgccccatcgtcgcccgcattcatcccgacgccgtcgcgcacaatcttgcaatcgtccggcaaaaggcgccgaacgcgcgtatctggtcggtcgtcaaggcgaacgcgtacggccacggcatcgagcatgtctatccggcgctcgccggcgcggacggcatcgcgctgctcgacctagacgaagcggtgcgcgtgcgcgagctcggctggacgaagcccgtgctgctgctcgaaggcatcttcgaggcggccgatgtcgagatcgcggatcgccatcggctgacggtcgccgtgcacggcgacgagcagttgaaactgctcaccgccgcgaagacgacgcgcccgatcgacatccaactgaagatgaactccgggatgaaccggctcggctaccggccgcacgcgttgcgcgccgcgtgggaacgcgcggccgccgcgccgtcgatcggccgcatcgcgctgatgatgcatttcgcgaacgccgacgaaggcgagatcgactggcagatgagcgtgttcgacgcggcgacgcagggcctgcccggcgagcgcacgctgtcgaactcggccgccgtgctgtggcatccgcgcgcgcaccgcgactgggtgcgccccggcacgatcctgtacggcgcgtcgcccacgggcgcgagccgccacgtcgccgacgtaccgctgcgggccgcgatgacggtcacgagccggatcatcggcgtgcaaacgctgacgccgggcgagacggtcggctacgggcgctgcttcgcggccgagcgcgagatgcgcatcggcgtcgtcgcctgcggctacgcggacggctatccgcgccacgcgcccaccggcacgccgatcgcggtcgacggcgtgcgcacgcaagtggtcgggcgcgtgtcgatggacatgctgaccgtcgacctcacgccgtgtccgaacgcgggcgtcggctcggccgtcgagctgtggggcgagcaggtgcgcgtcgacgacgtcgccgaagccgcgggcacgatcggctacgagctgatgtgcgcgctcgcgcggcgcgtgccggtcaccgtcgatccgtcgcccgccgcggccgcgctcgcccagccggtgcgcaccggaagctacgggcgctga

SEQ ID NO: 33007 - protein, 374 aa, Burkholderia pseudomallei K96243
MPRPIVARIHPDAVAHNLAIVRQKAPNARIWSVVKANAYGHGIEHVYPALAGADGIALLDLDEAVRVRELGWTKPVLLLEGIFEAADVEIADRHRLTVAVHGDEQLKLLTAAKTTRPIDIQLKMNSGMNRLGYRPHALRAAWERAAAAPSIGRIALMMHFANADEGEIDWQMSVFDAATQGLPGERTLSNSAAVLWHPRAHRDWVRPGTILYGASPTGASRHVADVPLRAAMTVTSRIIGVQTLTPGETVGYGRCFAAEREMRIGVVACGYADGYPRHAPTGTPIAVDGVRTQVVGRVSMDMLTVDLTPCPNAGVGSAVELWGEQVRVDDVAEAAGTIGYELMCALARRVPVTVDPSPAAAALAQPVRTGSYGR

SEQ ID NO: 33008 - DNA, 1080 bp, Methylococcus capsulatus str. Bath
  CDS (1)..(1080): transl_table=11
gtggtgcccgcagcccgtgccgtcctggacatggcggccttcgcccacaatttcgcctggattcgcgccgccgcgccggattcgaaaatcatggccgtgatcaaggccaacgcctacgggcacggactgatccgggccgcgcgagcgctgccggcagcggatgcgtttgccgtggcgcgggtggaagagggcatcgttctgcgtcaggccggtatcgctcaacgcatcgccgtgttgcagggttatggcgacgaagaagggatgaggctgagcgcccgccatggtctcgaaccggtgatccattccggcttccagcttgatctgctggagcggctcgatacttccgtcccaatgggggtgtggctcaaggcggacagcgggatgcatcggctgggtctggccgacgaggagttcgcccgggcgcggttgcggctggcgcggatgcctcaggtgcgccagccggtgcctgtcatgacccatctggccaatgccgacgccaccgatgatccgaccaccgaaatccagctgcgttgttttgggcggatggcaggcgggcggggcgaattcagcatcggcaactcggcggggttgatggcctgggcggcggcccgcagtgcctgggtcaggcccggcatcctgctgtatggcgtatcgccgtttcctggacggagcggaccggaagaaggtttgatgccggtcatgaccttgcagagccgcctgatcgcggtcaagcaactgaagaccggcgatgcggttggatacggcggcgacttcatctgccgccgcccgacccgcatgggcatcgcggccataggctacggcgatggttacccccgccgcgcggccaccggcacgccggtgctggtccggggcaggcgcgtgccgctgatcggccgggtctcgatggacatgatatcggtcgatctgaccgactgcccgtcggcggaaatcggcgataccgtgacgctatggggacaagggctgccggtggaggaaatcgcgcttcacgccgacaccattccctacgtgttactgtgcaatgtcacccagcgggtgaacatggtggagacagtcgcctga

SEQ ID NO: 33009 - protein, 359 aa, Methylococcus capsulatus str. Bath
MVPAARAVLDMAAFAHNFAWIRAAAPDSKIMAVIKANAYGHGLIRAARALPAADAFAVARVEEGIVLRQAGIAQRIAVLQGYGDEEGMRLSARHGLEPVIHSGFQLDLLERLDTSVPMGVWLKADSGMHRLGLADEEFARARLRLARMPQVRQPVPVMTHLANADATDDPTTEIQLRCFGRMAGGRGEFSIGNSAGLMAWAAARSAWVRPGILLYGVSPFPGRSGPEEGLMPVMTLQSRLIAVKQLKTGDAVGYGGDFICRRPTRMGIAAIGYGDGYPRRAATGTPVLVRGRRVPLIGRVSMDMISVDLTDCPSAEIGDTVTLWGQGLPVEEIALHADTIPYVLLCNVTQRVNMVETVA

SEQ ID NO: 33010 - DNA, 1146 bp, Nocardia farcinica IFM 10152
  CDS (1)..(1146): transl_table=11
gtggcaggatcgggagacgtgagtgcccaagtggaggccgtggtcgacctcgatgcgattgcccataatgtgcgggtcctgcgtgagtacgcgggcgatgcggcgatgatggtcgtcgtcaaggcggacggctacaaccacggggcggtggaggtggcgcgcacggcgctggcggcgggggcgcgggaactgggcgtgaccaccgtggccgaggcgctgcgactgcgcgaggcggggatcacggcaccggtgctgtgctggctgaacaccctgtccgccgattacgccgccgcggtcgccgccgacatcgagatcggcgtctccggcaccgagcaactgcgcgccgtcgccaccgcggcccgcgccaccggccgcaccgccaccgtgacgctcaaagtcgacaccggactcaaccgcaacggcatcgccgccgacgagctgccgaccgtgctcgacctgctcggtgagctggtcgaggagaagacggtgcgattgcgcgcgatgttctcccacctggcccacgccgacgagcccaaacacccgttcctcgacgaacagcgcgaccgcttcaccgccgcggccgccgcggccaccgcccgcgggctgcgtcccgaactgctgcacctggccaactccgccgccaccgtgacccggcccgacctggccttcgacatggtgcggcccggcatcgccgtctacggcctgagccccgtgcccgaactcggcgatttcgggctgcggcccgccatgaccttccaggcgcaggtcgcgctggtcaaacgcgtcgccgagggcgagggcgtctcctacggccaccagtggatcgctccccgtgacaccaccgtcgcgctgatacccgccgggtatgccgacggcgtgttccggccgctcagcggccgcttcgacgtgtggctcggcggtacccgccgccccaacgtcggccgggtctgcatggaccagttcgtcgtcgacctcggcgacgacgccgcgggcgtggcggcgggcgacaccgccgtgctgttcggcggtgggcccggcgtgccgggtgcccaggagtgggccgacctgctcggcaccatccactacgaggtggtctgctcgccgcgcggccgggccgtccgccggtacgtcggaacgggccgctga

SEQ ID NO: 33011 - protein, 381 aa, Nocardia farcinica IFM 10152
MAGSGDVSAQVEAVVDLDAIAHNVRVLREYAGDAAMMVVVKADGYNHGAVEVARTALAAGARELGVTTVAEALRLREAGITAPVLCWLNTLSADYAAAVAADIEIGVSGTEQLRAVATAARATGRTATVTLKVDTGLNRNGIAADELPTVLDLLGELVEEKTVRLRAMFSHLAHADEPKHPFLDEQRDRFTAAAAAATARGLRPELLHLANSAATVTRPDLAFDMVRPGIAVYGLSPVPELGDFGLRPAMTFQAQVALVKRVAEGEGVSYGHQWIAPRDTTVALIPAGYADGVFRPLSGRFDVWLGGTRRPNVGRVCMDQFVVDLGDDAAGVAAGDTAVLFGGGPGVPGAQEWADLLGTIHYEVVCSPRGRAVRRYVGTGR

SEQ ID NO: 33012 - DNA, 1080 bp, Photobacterium profundum SS9
  CDS (1)..(1080): transl_table=11
atgaaagcggcgacagcttatatcaataccgacgcgctaacacataacattcgacagctgcatttacaggcaccgaatagtaaattattagccgtagtgaaagcgaatggatacggacatggcttgctgcatgtagcaaaaagtttacccgatgctgatgcatttggtgttgcgcgtattgaggaagcgttaacgttacgtgcgggtggagtcgttaaacctatcttattattagaaggtttttatggcgcgtctgatttgcctgttatcgtgacgaataatattcatactgtcgtccattccattgagcaactagaggcgctagaatcggctgaattagacaatcaagcggttgtttggttgaagattgatacaggaatgcaccgcttaggtgtgcgacctgaacagctcgatgacgtcgtgcaacgcttacatgcctgcgataatgtcgccaaaccattgagatatatgagtcactttggttgtgctgatgatctggcgagcaatgtcactaaccagcaaattaataccttcctatcattaactgaaggctgccgtggtgagcgttctctagctgcttcagcgggaatactggcttggcccgatagccagcttgaatggattcgtcctggcattattatgtatggtgtctctccatttactgaaccagaccgttcagcggaagcctttaatatgcagccggtaatgacgctaacctctagcttgattgctgttcgcgacgtgaaagaaggtgagcaagtcggttatggtggtatatggaccagtgagcgcgatacaaaagtcggtgttattgcgattggttacggtgatggctacccgcgcacagcaccgaatggcaccccagttttagttaacggtcgtatcgtacccatggctgggcgtgtatcgatggatatgctgactgtcgatcttggacctaacgcgcaagataaagtcggtgatgaagcaattttgtggggcaatggtttacctgcagaagttgtcgctgagcatattggcacgatcgcgtacgagctagtgactaagctgacatcacgtgttgatatgacctatttataa

SEQ ID NO: 33013 - protein, 359 aa, Photobacterium profundum SS9
MKAATAYINTDALTHNIRQLHLQAPNSKLLAVVKANGYGHGLLHVAKSLPDADAFGVARIEEALTLRAGGVVKPILLLEGFYGASDLPVIVTNNIHTVVHSIEQLEALESAELDNQAVVWLKIDTGMHRLGVRPEQLDDVVQRLHACDNVAKPLRYMSHFGCADDLASNVTNQQINTFLSLTEGCRGERSLAASAGILAWPDSQLEWIRPGIIMYGVSPFTEPDRSAEAFNMQPVMTLTSSLIAVRDVKEGEQVGYGGIWTSERDTKVGVIAIGYGDGYPRTAPNGTPVLVNGRIVPMAGRVSMDMLTVDLGPNAQDKVGDEAILWGNGLPAEVVAEHIGTIAYELVTKLTSRVDMTYL

SEQ ID NO: 33014 - DNA, 1215 bp, Photobacterium profundum SS9
  CDS (1)..(1215): transl_table=11
ttgaaactgaaacttagcctagttgctcttgccctaatgggtcaaactaccgccaatgccgcccctctgctggtcgatttcgataataacgagcgcgaagaacgcgttcagtcaagcaatgcatggctggaaatcgatacccaagcattttctggcaacattcagttacttcaaaaccagctaaaagccgatacaaaaatctgcgctatcatgaaagccgacgcttacggtaatggtatcgcaggcctaatgccatccatcatcgccaaccaagtgccatgtgttgggatcaccagcaacgaagaagctcgtgtggtacgtaagcacggtttcattggcaaaatcatgcgagtacgtgccgcgagcaaaaatgaaattgaaggcggcctgcaataccagatggaagaattaatcggtaccaaggcacaagccgatcaaatcatcgaaatcgcccgagcaaacggcacaactatcccggttcacctagcactgaatacctcaggcatggggcgtaacggtctggatctgacaacttatgaaggtcaggtagaaggtgtcgaaatcgctggcgatcccaatctggaaatcgtaggcatgatgacccacttcccgaacgaaggccttgacgaaatcaagcgcaaggtaaagcgcttcaaggtagaaacgaaatggctgatggacagcaccgatctaaagcgtaaggacgtcaccctacatgttgccaactcttacattacgctgaacttacccgaagctcacctagacatggttcgcccaggcggcatgctttacggcgattacccagcaacagcaccataccagcgcatcgtttcattcaaaacacatgttgcgtcactgcaccacttcccagcaggcagcaccatcggctacggcagtaccgcggtactagagcgcgattctgtactggcaaaccttcctatcggctactcagacggctttgcccgctctctgggtaacaaggcagaggtactgatcaacggccagcgtgctcgcgtgatgggcatggtatcaatgaacaccaccatggtcgatgtcacagacatcgtcgacgtacagaccaacgaggaagtggttatttttggccgtcaaggctttgaagaaatcactggcgaagagaccgaagagaaaagcaatcgtattctgccagaacattacactgtttggggtgcaaccaacccacgtatctaccgttaa

SEQ ID NO: 33015 - protein, 404 aa, Photobacterium profundum SS9
MKLKLSLVALALMGQTTANAAPLLVDFDNNEREERVQSSNAWLEIDTQAFSGNIQLLQNQLKADTKICAIMKADAYGNGIAGLMPSIIANQVPCVGITSNEEARVVRKHGFIGKIMRVRAASKNEIEGGLQYQMEELIGTKAQADQIIEIARANGTTIPVHLALNTSGMGRNGLDLTTYEGQVEGVEIAGDPNLEIVGMMTHFPNEGLDEIKRKVKRFKVETKWLMDSTDLKRKDVTLHVANSYITLNLPEAHLDMVRPGGMLYGDYPATAPYQRIVSFKTHVASLHHFPAGSTIGYGSTAVLERDSVLANLPIGYSDGFARSLGNKAEVLINGQRARVMGMVSMNTTMVDVTDIVDVQTNEEVVIFGRQGFEEITGEETEEKSNRILPEHYTVWGATNPRIYR

SEQ ID NO: 33016 - DNA, 1218 bp, Photobacterium profundum SS9
  CDS (1)..(1218): transl_table=11
atgaattttaaaatgacgctattatcattggcgattacttttccatcattttctatttacagtgcgccactagtcattgatcaaaacctaccaagtgagcaatcaattcaacaatcaaattcttggctagaagtaagcttgggtcagtttaaatccaatatagaacagttcaaatcacacattaaagctgatactaaaatttgtgctgtgatgaaggccgatgcttatgggaatggcatatttggcttaatgccaaccattcttgaacaacagattccttgcgtggcgattgcgagtaatgcagaagctcgagcagtacgagaaagcggctttaaagggcagttgctccgtgttcgctctgcaagtttaggagagatcaaacagagtttagatctcaacatcgaagagttgattggtagccaccaacaagcaaaattcattgctgagttaggagtagagcgcaatcaaaaaatcaacgtccatttggcattgaatgacggtggaatgggtcgaaatggtattgacatgtccactgagcaaggaaaagcagaagctcttgatattgcaacgcaagctaacttaaacattgtcggcataatgacgcacttcccaaactacaatgctgataaagtacgagtaaaattaaaggactttcaaacaaattcatcttggctcatcaaacaagctgatttaaaacgtgacgagttaactcttcacgtggctaattcttatgtttcgataaatgtacctgaagcgcaactagatatggtgcgccctggcggtgtattgtatggcgatctacctactaatccagaatacccatcgattgtttctttcaaaactcgaattgcttctatacaccaactccctgccagccagaccgtgggctatgacagtacgtatataaccaagcgagatagcgtacttgcaaaccttcccgttggctattcagatggttaccctcgtagaatgggaaatcaggccgacgtcattatcaatggacaacgtgcgaaagtcgtcggtgtcacatcaatgaatacctccattgttgatatcacagacataaaaggagtgaaacaaggtcaagaagttacactatttggcaaacaaaaaaacgtacagattagtgtggctgaaatggaagattactcaaaattgattttccctgagttatataccatgtgggggcaagcaaaccctcgttattacttaaaatag

SEQ ID NO: 33017 - protein, 405 aa, Photobacterium profundum SS9
MNFKMTLLSLAITFPSFSIYSAPLVIDQNLPSEQSIQQSNSWLEVSLGQFKSNIEQFKSHIKADTKICAVMKADAYGNGIFGLMPTILEQQIPCVAIASNAEARAVRESGFKGQLLRVRSASLGEIKQSLDLNIEELIGSHQQAKFIAELGVERNQKINVHLALNDGGMGRNGIDMSTEQGKAEALDIATQANLNIVGIMTHFPNYNADKVRVKLKDFQTNSSWLIKQADLKRDELTLHVANSYVSINVPEAQLDMVRPGGVLYGDLPTNPEYPSIVSFKTRIASIHQLPASQTVGYDSTYITKRDSVLANLPVGYSDGYPRRMGNQADVIINGQRAKVVGVTSMNTSIVDITDIKGVKQGQEVTLFGKQKNVQISVAEMEDYSKLIFPELYTMWGQANPRYYLK

SEQ ID NO: 33018 - DNA, 1050 bp, Rhodobacter sphaeroides 2.4.1
  CDS (1)..(1050)
atggccaccgcgaccctcaccatcgacctggacgccatcgccgccaactggcgcgcgctcgaccagatgaccgcctccgactgccagaccggcgccgtcgtgaaggctgacagctacgggctcggcgcggccaaggtcgcccatgccctcgcgcgggccggtgcccgccgcttcttcgtcgccacctgcgaggaaggggccgacgtgcgccgcgcgctcggctccgggccgcagatctgcgtcttctcggggcatatggagggcgacaccgccctcatccgcgatttcgacctgacgccgatgctgaactcgatcgaccagctcacccggcatttcgaggcgctgggcggccagcccttcggcctgcagctcgacagcgggatgaaccggctcgggctcgagcccggcgaatgggaggccgtggccggcttcgcgctcgaggcgggaccggaactgctgatgagtcacctcgcctgttcggacgatcccgaccatccgatgaatgccgagcagctcggcgccttccgggccatgaccgacggcaccggcgtgccgcgctcgctctcggccacgggcggcatcctgctgggccccgcctggcatttcgagctgacccgccccggcatcggcctctacggcggccgcccgttcgagaatgcgcgcccggtggtgcggctctcgctgccggtgatccaggtgcgcgaggtcgagatcggcgagcccgtgggctattccaacacctggacggccgaacatacctcgaccatcgccacggtcgccgcgggctatgccgacgggctgccgcgcacgctgtcctcgcgcgccacgctttatgcgggccgggtgccctgcccgctggtgggccgggtgtcgatggatctcatcacggtggatgtgagccacctgcccgaagtgcccgagacgctcgacatcctcgggccgcaccagacgccggacgatctggccgacacggcgggaaccatcggctacgagatcctgacgagcctcggccgccgctaccagcgccgctacggggccctcgcggcgtga

SEQ ID NO: 33019 - protein, 349 aa, Rhodobacter sphaeroides 2.4.1
MATATLTIDLDAIAANWRALDQMTASDCQTGAVVKADSYGLGAAKVAHALARAGARRFFVATCEEGADVRRALGSGPQICVFSGHMEGDTALIRDFDLTPMLNSIDQLTRHFEALGGQPFGLQLDSGMNRLGLEPGEWEAVAGFALEAGPELLMSHLACSDDPDHPMNAEQLGAFRAMTDGTGVPRSLSATGGILLGPAWHFELTRPGIGLYGGRPFENARPVVRLSLPVIQVREVEIGEPVGYSNTWTAEHTSTIATVAAGYADGLPRTLSSRATLYAGRVPCPLVGRVSMDLITVDVSHLPEVPETLDILGPHQTPDDLADTAGTIGYEILTSLGRRYQRRYGALAA

SEQ ID NO: 33020 - DNA, 1131 bp, Lactobacillus gasseri
  CDS (1)..(1131)
atggttccaggtattcatcgtccagctgtggttaaagtcaatttgggcgcaattaagagaaatattgaaaatgaaatgcagcatcttgaaccaggccaaaagatgcttgctgttgtaaaagctaacggttatggccatggtgcagtagaagtagcaaaagtagcagatcaaattggagccgctggattctgtgttgcaattttagatgaggcgctagaattaaggcgtgcagatattactaagacgatcttagtcttaggtgtcgtttctcctgaatatgctcctattgctgcagcgaatgatatttcactgactgttccaaatttagaatggcttaaagaagcagaaaaatatttagaaaattcagacttacaattgaaaattcatttgggcattgattcaggaatgggtcgaattggatttaatgaggataaggactttattgctgctaataagtttttagaaaataatgataatttttatattgaaggaatgtttgcacattttgcttcagctgatagtagcgatgaaacttactttaagcaccaatgtgaaaaatttaaccatatgaagagtttgcttacagtaaagccaaagtggattcatgttgataatactgcagcaagcatttttcataatggaattaagagtgatttagttagattcggaattggaatttatggcttaaatccttcgtctaatcctaattcacctgatttgaagtcaaagattgccttagatccagctttatcatttgagagtgagttaacgcacgtgaagacaattcatcagggtgatggagttggatatggttcgacatttgttgccgataaggatacgattattggaacagtgccagttggttacgcagatggttttattagaaaattccaaggtttcaaagttaaagtaggtaatacatattgtccaattgttggtcgtatttgcatggaccagtttatggttgaaatgccaaaggaaatgccgcttggaactaaagtagtaattatttctgataatcctgatgatttaaataatattaaagcagcagctgattatgttgatacgatccattatgaagttgcttgtttattgaatgatcgcttaccgcgtgtttattacgaagactaa

SEQ ID NO: 33021 - protein, 376 aa, Lactobacillus gasseri
MVPGIHRPAVVKVNLGAIKRNIENEMQHLEPGQKMLAVVKANGYGHGAVEVAKVADQIGAAGFCVAILDEALELRRADITKTILVLGVVSPEYAPIAAANDISLTVPNLEWLKEAEKYLENSDLQLKIHLGIDSGMGRIGFNEDKDFIAANKFLENNDNFYIEGMFAHFASADSSDETYFKHQCEKFNHMKSLLTVKPKWIHVDNTAASIFHNGIKSDLVRFGIGIYGLNPSSNPNSPDLKSKIALDPALSFESELTHVKTIHQGDGVGYGSTFVADKDTIIGTVPVGYADGFIRKFQGFKVKVGNTYCPIVGRICMDQFMVEMPKEMPLGTKVVIISDNPDDLNNIKAAADYVDTIHYEVACLLNDRLPRVYYED

SEQ ID NO: 33022 - DNA, 1113 bp, Leuconostoc mesenteroides subsp. mesenteroides ATCC 8293
  CDS (1)..(1113)
atggtagaggcaataacacgtccaacacgtcttgaagtttccaagagcgctgttgaacataatataacgaccgttaaaaatgtatcaggtgcagacaaagtctttttgaccgttaagtcaaatgcctatggatttggtttgattcctatggctcaagctgctgtggcaggaggtatttatggcttaggtgtagctgttcttgatgaagctattgcactgcggcatgagcgcataaccgcaccaattttaattttaggtatttcacaggtaaagtatgttgaactaatggctgtccagcatatcatggcaactgttgtttcattggactggctggagaaagcagaacatcagttaactggtgaacagcgattacctgttacactaggtatcgatactggcatgggtagaattgggtttagagatcgtgaaactttatcgaaagcgatacagtttgttttggatcatgctgataagtttgaatatgttggactatcgacgcactttgccgaatctgattcatcagataccaggtacttccaaaagcaattaacacgttggcatcaattgacggatgacttgccaaaaccaaagtattatcatgttgctaattcgggtgctgcaatgtatcacgcagaagaggttccccatgaggttgtccgcgtaggaacggtgctttatgggattgagccctctcgtggtgaactagcagatggacgtaacctgaaacccgtcatggcccttcggagcgaggtgaattttgttaaacgcttacctgctggtgaaggtattagttattcacacaaatatacgacaactcaaaacgagtggataggcactgttcctattggttatggggatggttggctacgcaaattaatggggtttaaggttattattgacggtcaatacgcccctattgtagggcaagtagcaatggatcagttaatgatacgtttgcctcgtgaatatccagaaggtacaacggtaacctttattggtcaagatggagacttagagaatacaatcgaggacgttgcacagtttgcaggtttggcgccctgggaaatcacaacaggactacaagatagaatacatcgtattttagtagattag

SEQ ID NO: 33023 - protein, 370 aa, Leuconostoc mesenteroides subsp. mesenteroides ATCC 8293
MVEAITRPTRLEVSKSAVEHNITTVKNVSGADKVFLTVKSNAYGFGLIPMAQAAVAGGIYGLGVAVLDEAIALRHERITAPILILGISQVKYVELMAVQHIMATVVSLDWLEKAEHQLTGEQRLPVTLGIDTGMGRIGFRDRETLSKAIQFVLDHADKFEYVGLSTHFAESDSSDTRYFQKQLTRWHQLTDDLPKPKYYHVANSGAAMYHAEEVPHEVVRVGTVLYGIEPSRGELADGRNLKPVMALRSEVNFVKRLPAGEGISYSHKYTTTQNEWIGTVPIGYGDGWLRKLMGFKVIIDGQYAPIVGQVAMDQLMIRLPREYPEGTTVTFIGQDGDLENTIEDVAQFAGLAPWEITTGLQDRIHRILVD

SEQ ID NO: 33024 - DNA, 1122 bp, Leuconostoc mesenteroides subsp. mesenteroides ATCC 8293
  CDS (1)..(1122)
atgaactataatgcaccacatcgacatgctgtaattgagttgtcgcaatcagcagttgtgcataatttaaaagtgattaaagagaacacgcatgccaaagagattatggctgttttgaaagctaatgctttttcgcatggattacctgagatggcctctttgagtattacagctggggctacccgctttggcatggccatgctcgatgaagctttgatattacgtgatttgggctatatacaaccaattgatgtactcggattaacagatccacgctatgcgcgattggctgctgaacgtaatattacgctagcttttagtactaaggagtcaataaaagcagcagctgaacagttagctggtacaggattgacattaaaggtatcgttacccgttgacacgggcttaaaccgtattggttttaaaagtcgtgaagatttagtggcagcaattcaagaggtatcagcgcaagatacactcatttttcaaagtatgtggacgcattttgctactgcagatacaccaaatgttgactatgtggattttcaaatttccgaatggcagcgcttgacacatgatttaccagtagaaccaaatgaaaagcattttgcgaatacgggtattgctacttggtatcccgaaaaaattaatacggatattgttcgtttgggtattggattatttggcattaacggttctgtgccaataatgtcgatgccattcgagttgataccagctttatcattgaaagctaaggttgttaacagcaagccactgaaaaaaggtgatgcggtcggctatggggcagaatatcatgcaccaaatgatgggtatttgattactattccaattggacattctgacggttatccgttcaatgggagtggcatgcgtgctctggttgcggatggacaaattggtcatattgtcgggggcgtagccatggatcaatcaatgatccttgttactaatccagttgcagttggcactacggtgaccttaattggtcgtgttggtgatcaaagtataacgatgcaggatttggctgagcatacacaaagtagtattgtggcgttaatgaatgattttgcaccgagactgcaacgaataattgtttcataa

SEQ ID NO: 33025 - protein, 373 aa, Leuconostoc mesenteroides subsp. mesenteroides ATCC 8293 [sequence omitted]

SEQ ID NO: 33026 - DNA, 1086 bp, Azotobacter vinelandii
  CDS (1)..(1086)
atgcgccccgcccgtgccctgatcgatctcgccgccttgcggcacaactaccgcctggcccgcgagctgggcggcgcccgcgccctggcggtggtcaaggccgacgcctacgggcacggcgcagtgcgctgtgcccgcgccctggaggcggaggccgacggtttcgcggtggcctgcatcgaggaggcgctggagctgcgcgaggccggcatcgccgcgccgatcctactgctggagggcttcttcgagagcgccgagctggagccgatccagcgccacgacctgtggtgcgtggtgcattcgccgtggcaactggaggccatcgaacgtaccgcgctgacgcgtcccttgacctgctggctgaagctcgactccggcatgcaccgggtcggcttcgcgccggccgactaccgggcggcccacgcgcgcctcatggccagcggcaaggtggcgaggatcgtcgccatgagccatttcgcacgcgccgacgaactcgactgcccgcgggtcgccgagcaactggcgcagttcgagacggcgaccgccggcctcgtggcggagttcagcctgcgcaactccccggcgctgctcggctggccgcagtttttccggcatggccatggggacgaatggctgcggccggggatcatgctctacggggccacgcccttcgagcgctatcaggagcaggcggcgcaactgcgaccggtaatgaccctggagtccaggatcatcggcgtgcgcgagctgccggccggcgagccggtgggttatggcgcgcgtttcgtcgcctcgcggccgacccgcgtcggagtggtggccatgggctatgcggacggctacccgcggcatgcgccgaacggcaccccggtcgccgtcgatggtcggccggcgcaactgatcggccgggtatcgatggacatgctcaccgtggacctcaccgacctgccccaggccggactcggtagccgggtcgagctgtggggcgcccaggtgccggccagcgaggtggcggcagcggccggtaccatcgcctatcaattgttctgcaacgtgcggcgggtcgcccgttcctggctggactga

SEQ ID NO: 33027 - protein, 361 aa, Azotobacter vinelandii
MRPARALIDLAALRHNYRLARELGGARALAVVKADAYGHGAVRCARALEAEADGFAVACIEEALELREAGIAAPILLLEGFFESAELEPIQRHDLWCVVHSPWQLEAIERTALTRPLTCWLKLDSGMHRVGFAPADYRAAHARLMASGKVARIVAMSHFARADELDCPRVAEQLAQFETATAGLVAEFSLRNSPALLGWPQFFRHGHGDEWLRPGIMLYGATPFERYQEQAAQLRPVMTLESRIIGVRELPAGEPVGYGARFVASRPTRVGVVAMGYADGYPRHAPNGTPVAVDGRPAQLIGRVSMDMLTVDLTDLPQAGLGSRVELWGAQVPASEVAAAAGTIAYQLFCNVRRVARSWLD

SEQ ID NO: 33028 - DNA, 1113 bp, Desulfitobacterium hafniense DCB-2
  CDS (1)..(1113)
atggaaaatagacgaccggtttggacagagatcaacttacaagcgctgcagaggaattatgaccggattcaggccttgactgaaagtgaaatcatgcccatagtcaaagctgatgcatacggacatggagccttacaagcagtagaagcattttatgaaagaggtgcccgtcgtttcggagttgccttattgaatgaagctttggagcttagaagagcgtatccggatatcaaagtcatgctcatcggttctttacccgaagaatccatagagacagttgttaaagaagatattatttgcggggtgtatcagttagatcaagcagtaattttagcgaaagaagcagagagacagggcaagaaggcagtaattcatcttaaagtggatacaggaatggggcgcattggcttcagagaagaggattgggaagaacttttcggctgtaccaagctgcctggtctttacatagagggaatttatactcattttgccacggcggatcatagtgatctgaggtttgcccgggagcaactgaggaaatttttagtgatgtgtgataaaatcaaagcccagggaattcatatccctatccggcatgcggccaacagcggagctctgctgcagctgccggaggctcatctggacatggtgcggccggggattattctctatggacttcctccctcccagcatgtgggcaatgatttaggtttggagcccgtactttcctggaaagccaagatcagccatatcaaggtggtcccccaaggggaaaccatcagctatggcagaaccttcagaaccgcctatcccacccgggtggcgacgattcccctcggttatgccgatggtctgcgccggaatctatccaataagggtgaagttttaattaaaggcagaagaaccaccatgattgggagagtctgtatggatcagaccatgctggatgtcacgaaaataccggaggtgcaggtaggggatgtggttaccctactcggcatggatggttatgaacggatcgatgccacggaaatggccggttggttggatacgataaattatgagattgtctgtggaatatcgaagcgggttccacgggtgtatattaaataa

SEQ ID NO: 33029 - protein, 370 aa, Desulfitobacterium hafniense DCB-2
MENRRPVWTEINLQALQRNYDRIQALTESEIMPIVKADAYGHGALQAVEAFYERGARRFGVALLNEALELRRAYPDIKVMLIGSLPEESIETVVKEDIICGVYQLDQAVILAKEAERQGKKAVIHLKVDTGMGRIGFREEDWEELFGCTKLPGLYIEGIYTHFATADHSDLRFAREQLRKFLVMCDKIKAQGIHIPIRHAANSGALLQLPEAHLDMVRPGIILYGLPPSQHVGNDLGLEPVLSWKAKISHIKVVPQGETISYGRTFRTAYPTRVATIPLGYADGLRRNLSNKGEVLIKGRRTTMIGRVCMDQTMLDVTKIPEVQVGDVVTLLGMDGYERIDATEMAGWLDTINYEIVCGISKRVPRVYIK

SEQ ID NO: 33030 - DNA, 1188 bp, Nostoc punctiforme PCC 73102
  CDS (1)..(1188)
atgttaagtcgcaaagaaatccctggtgtagttcctaatcagcagtgcgacacctacgcgtggttttcgcaacgagcttgggtagaaattgatttgggggcgttgtcgtacaatgtacagcaattggtgcagtttttatcgccgcgtacccagttgatggcagtagtaaaagctgatgcttatggacatggagcgctaacagtcgcccaaactgtaattcaatcaggagctagttggctgggagtcgctacagttccagaagctattcaattgcgagaaggcgggattgaagcgcccattttgattttaggagcaactcatacaccagaacagattcatgcgatcgcacaatggaatcttcagcccacactctgtagccctaaacaagctttggtattttctaatatcctggaatccatgaatcatggttcgccagtgcccgtacacatcaaattagacacgggtatgtctaggttaggaactaattggcagcaagctggtgaatttgtgcaattagtgcagcgcttaccacatctatccattgccagtatttattctcatttggcaacagcagacgatcctgatacaacggcaatggaagaacagcatagacgatttgaggaagcgatcgctcaaatcaaagcaatggaaattgaagcgccttgcttgcacttggcaaactcagcagctgcactcacagatccggcattgcattacgatattgtacgtgtaggtttagccgtttacggactttacccagcaccgcatttacaaaatgcgatcgatctcaagcccgttttgcaacttaaagcacgagtcacccaagttaaaacaattgcggcaggaactgctgttagctacgggcataaatttattgccccgcgtgaacttcgcctcgctgttgtcggaattggttatgctgatggcgttcctcgtagtctttctaacaaaatgcaggcgttaattcacggtcagagagtgtcgcaaatcggcacaattacaatggatcagttgatgctggatgtaagtgccatacccaatatccaagaaggagaagtagtcaccttactaggaaagcagggaaaagaacaaatttccgcagacgattgggcagaacaactaaacactatttcttgggaaattctctgcgggttcaagcatcgtctgcctcgtgttgcagtcatgtaa

SEQ ID NO: 33031 - protein, 395 aa, Nostoc punctiforme PCC 73102
MLSRKEIPGVVPNQQCDTYAWFSQRAWVEIDLGALSYNVQQLVQFLSPRTQLMAVVKADAYGHGALTVAQTVIQSGASWLGVATVPEAIQLREGGIEAPILILGATHTPEQIHAIAQWNLQPTLCSPKQALVFSNILESMNHGSPVPVHIKLDTGMSRLGTNWQQAGEFVQLVQRLPHLSIASIYSHLATADDPDTTAMEEQHRRFEEAIAQIKAMEIEAPCLHLANSAAALTDPALHYDIVRVGLAVYGLYPAPHLQNAIDLKPVLQLKARVTQVKTIAAGTAVSYGHKFIAPRELRLAVVGIGYADGVPRSLSNKMQALIHGQRVSQIGTITMDQLMLDVSAIPNIQEGEVVTLLGKQGKEQISADDWAEQLNTISWEILCGFKHRLPRVAVM

SEQ ID NO: 33032 - DNA, 1359 bp, Bifidobacterium longum DJO10A
  CDS (1)..(1359)
atgagcatgaacgcagcacctgaaatcgcattctcgtccgagcagggcaaggccaactatgcggccgcccgccgccaataccccgcacaggccatcgtggacctcaaaaccatgcgcgacaacatggcccacctggtctccgtggtcggcgggcccgcttccggcacggcggtgatgggtgtggtcaaggccgacgcctacggccacggactgctgcccgccgccctggccgcgctcgccggcggcgccacatggctcggcaccgcgcagtcgcacgaagcgttgctgctgcgcaagctcggcatcggccccgaccgctgccatattttgacttgggtatacaacggcaccgaagtcccgttcgacgagctgatcgccgccgacatcgacgtatcggtcggctccctgcccggcatcgacgcggtggccgccgccgcacgcaagctcggcaagcccgcccgcgtacacgtcaaggtcgattccggcttcggtcgcaacggtttcacaccggccggattcgacgccgcgctcgccaaactcgtgccgctcgccaaagagggcgtgttgcatattgtgggtcagtggagccatctcgccgtggccgattcgcccgatgtgtccgaattcgtgtcctccaccgaccgccagatcgaaacattcaaggacttcacgcgccgcatggaacaggccggcattccgccggagatccgtcacctggccaacacagcggccactttggaccgcccggagattcacttcgaactcacccgccccggcatcggcctgtacggctacgagcccgatcccgcgatgggcaccccgcgcgactggcatctgaccccggccatgcgcctgcaggcgcagctcggcacggtcaaggatgtggaggccggccacggcatctcctacggccgcacctacctgaccctggacaacacctcgaccgctattgtgccgctgggctacgccgatggcatccaccgctccgcttccggtttcgatatggaaggtgccaagcacgtggagaagccgggcggcccggtgcgcatcatgaccaccgaaggcccgaagatctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtgctgcccgccgccgacctcgccaaactcgaccccgccacgctgctataa

SEQ ID NO: 33033 - protein, 452 aa, Bifidobacterium longum DJO10A
MSMNAAPEIAFSSEQGKANYAAARRQYPAQAIVDLKTMRDNMAHLVSVVGGPASGTAVMGVVKADAYGHGLLPAALAALAGGATWLGTAQSHEALLLRKLGIGPDRCHILTWVYNGTEVPFDELIAADIDVSVGSLPGIDAVAAAARKLGKPARVHVKVDSGFGRNGFTPAGFDAALAKLVPLAKEGVLHIVGQWSHLAVADSPDVSEFVSSTDRQIETFKDFTRRMEQAGIPPEIRHLANTAATLDRPEIHFELTRPGIGLYGYEPDPAMGTPRDWHLTPAMRLQAQLGTVKDVEAGHGISYGRTYLTLDNTSTAIVPLGYADGIHRSASGFDMEGAKHVEKPGGPVRIMTTEGPKIYRVCGRVCMDQFIVDLHGSAAELGVHEGDTVELFGPGRGEDYVEPTADDWARAADTISYEIFTCLRNRIPRLYEHAAEVLPAADLAKLDPATLL

SEQ ID NO: 33034 - DNA, 1074 bp, Pseudomonas syringae pv. syringae B728a
  CDS (1)..(1074)
atgcgtccagcccgcgcctttatcgatcttcaggcactgcgtcacaactaccaattggcccgtgaaagcagcggcggcaaagcgctcgccgtcgtcaaggccgatgcctacggccacggcgcggtgcgcgtcgcgcaggcactggaagcgcaggccgacggttttgcagtggcttgcatcgaagaggcgctagagctgcgtgcggcaggtatccgtgcgcccgtcctgctgctcgaaggctttttcgaagccgacgagctggcgctgattgtcgagcatgacctgtggaccgttgtacacgcgacctggcaactggaagctatcgagcaggcgcgcctgggcaagccgataaccgtctggctcaagctcgacaccggcatgcaccgtgtcggcctgcatcctcacgagtaccaggcgggttatcagcgtctgctggcaaccggcaaagtggccaggatcgtgctgatgagccacttctcccgcgccgatgagctgaacagcggctgcagtgatgagcagctcgcggtattcgagacctttcgcaaggggctggcagcagaaaccagtctgaaaaactccccggcggtgctgggctggccacagattccgagcgactggtcgcgcccgggcatcatgctctacggtgctacgccgtttgatcaggtgcacccgctggcggatcgcctgcaaccggtgatgaccctggaatcgaagatcatcagcgtgcgtgaactgcccgttggtgagcccgtgggctatggcgcgacatttgtctgtgaccggccgttgcgtatcggtgtagtggcgatggggtacgccgacggctatccgcgtcacgcgccgaccggcacgcccgtgcagatcgatggccagccatccaggctgctcggacgcgtgtccatggacatgctctgcgtggacctcaccgaggtgccgcaggccgggctcggcagccgcgtcgagctgtggggcaagcaggtgctcgccagtgaagtggcccagcgcgcagaaaccattccctacgaaatcttctgcaatctgcgtcgcgttccgcgcatctattccgaggactga

SEQ ID NO: 33035 - protein, 357 aa, Pseudomonas syringae pv. syringae B728a
MRPARAFIDLQALRHNYQLARESSGGKALAVVKADAYGHGAVRVAQALEAQADGFAVACIEEALELRAAGIRAPVLLLEGFFEADELALIVEHDLWTVVHATWQLEAIEQARLGKPITVWLKLDTGMHRVGLHPHEYQAGYQRLLATGKVARIVLMSHFSRADELNSGCSDEQLAVFETFRKGLAAETSLKNSPAVLGWPQIPSDWSRPGIMLYGATPFDQVHPLADRLQPVMTLESKIISVRELPVGEPVGYGATFVCDRPLRIGVVAMGYADGYPRHAPTGTPVQIDGQPSRLLGRVSMDMLCVDLTEVPQAGLGSRVELWGKQVLASEVAQRAETIPYEIFCNLRRVPRIYSED

SEQ ID NO: 33036 - DNA, 1032 bp, Actinobacillus pleuropneumoniae serovar 1 str. 4074
  CDS (1)..(1032)
atgatcaaagcgaatgcttacgggcaaggattattgcctgccgccgacacgctcgccgatttggttgaaggattcggggtcgcacgtttaagggaagcgctcgaaattcaagaaaccggttacaccggcaagattttattaatcgaaggattctttgatcgagaagaattactgaagaccctttccagacgattcgataccgttatacattgccaagaacaacttgaacttctcgaacaagttgccgaagaatggcaacaagaacaacaaaaaggcttttggaaacgcaaggcgaaaatttattttccgattaatgtttggttaaaaattgataccggtatgcaccgcctcggcgtacatcccgaacaggttgatatgttctatcaacgcttaaaggcctgtccgttagtggaaagtattagctttgtcagccattttagccgagcggacgaaccggattgcggttataccgaaaaacaaatcgccatatttgaagcggcgacctctccttatcctacacacgaacgcagtatttccgcttcgagcggtattttatattggaaacaggcgcattatgactgggttcgtcccggtattattatgcacggtatttctccgcactatacgccgattaccgatttaggttttaaaccggtaatgaccctctcatcttctttaattgcggtgagaacgcataaagcgggagaaccggtcggttacggcggtacttggattagtgataaagataccaaattaggtgtggtggcaatgggttacggtgatggctatcctcgcaatgcaccggaaggcacaccggttttagtaaacggacgaatcgtaccgattgtcggacgagtgtcgatggatatgctgacggttgatcttggtgctgacagtcaagataaagtcggtgatgaagtgattttctggggcaaagatctgttaattgaggaagtcgcacaacatatcggggtaatcagctatgaattgattaccaaacttaccccacgggtaatttttgaatacgaataa

SEQ ID NO: 33037 - protein, 343 aa, Actinobacillus pleuropneumoniae serovar 1 str. 4074
MIKANAYGQGLLPAADTLADLVEGFGVARLREALEIQETGYTGKILLIEGFFDREELLKTLSRRFDTVIHCQEQLELLEQVAEEWQQEQQKGFWKRKAKIYFPINVWLKIDTGMHRLGVHPEQVDMFYQRLKACPLVESISFVSHFSRADEPDCGYTEKQIAIFEAATSPYPTHERSISASSGILYWKQAHYDWVRPGIIMHGISPHYTPITDLGFKPVMTLSSSLIAVRTHKAGEPVGYGGTWISDKDTKLGVVAMGYGDGYPRNAPEGTPVLVNGRIVPIVGRVSMDMLTVDLGADSQDKVGDEVIFWGKDLLIEEVAQHIGVISYELITKLTPRVIFEYE

SEQ ID NO: 33038 - DNA, 1068 bp, Rickettsia sibirica 246
  CDS (1)..(1068): transl_table=11
atgagcttgtgtactgtagaaataaatctatctacaataaaaaataattaccttttattacaagatatttgcaaaacctcattagtcggtgctgccgttaaagctaacggttacggtcttggagcagtacaaatttctaaagctttaatagaagcaaattgtaggcatttttttgtggcctcaagtgaagaaggagtgaatttacgcaacgctttaggattagatgttaatattttagttcttaacggcgtttttgaacatgatgctttagagctgatagaatataatttaacacctgtcctaaataacttaaaacaaatagaaatttggcaaaaatttagtaatttgaaaaaccgattattgccttgttatttacatttcaatacggggattaatcgtcttggcttgagctctgatgagatagagcagctcattaatgatcgtgatttgttaaaagggctagatttacaatatattataagccatctagctatatccgaggaaatagataatccttataatctagaacaattaaacagatttaaagcttatttacaatatttcccaaacgtcaaagcaagccttgctaattccggcggcatatttttaggacaggattaccattttgatttagcaagaccaggggcagccttatatggtcttaatcccttaacaaagaatcccgtaaccttaaaagctcctataattcacttacagaatttgacactagatagccatatcggttataatatgacttttacaactaagcgtgatagtgtcattgcaacgttaccgcttggttatgccgatgggtttagtcgtaattttagcaatcaaggcgaagtatttattaacagtcgcagcgttcctatagtagggcgagtatcgatggatttaataaatatcgatgttaccgatctaccaccatccgagatttttctagggcaggaagcggaaattatcggaaattattgcacgcccgataaaatagcgagtattataggtactatcgggtatgaggtattaactaaccttggtagtagatataaaagaaagtatatcgggtag

SEQ ID NO: 33039 - protein, 355 aa, Rickettsia sibirica 246
MSLCTVEINLSTIKNNYLLLQDICKTSLVGAAVKANGYGLGAVQISKALIEANCRHFFVASSEEGVNLRNALGLDVNILVLNGVFEHDALELIEYNLTPVLNNLKQIEIWQKFSNLKNRLLPCYLHFNTGINRLGLSSDEIEQLINDRDLLKGLDLQYIISHLAISEEIDNPYNLEQLNRFKAYLQYFPNVKASLANSGGIFLGQDYHFDLARPGAALYGLNPLTKNPVTLKAPIIHLQNLTLDSHIGYNMTFTTKRDSVIATLPLGYADGFSRNFSNQGEVFINSRSVPIVGRVSMDLINIDVTDLPPSEIFLGQEAEIIGNYCTPDKIASIIGTIGYEVLTNLGSRYKRKYIG

SEQ ID NO: 33040 - DNA, 1107 bp, Psychrobacter sp. 273-4
  CDS (1)..(1107)
atgcgcacaatcactattaaacctgccgccattactcataatcttaatcaagttaaaaaatttgcaccagaaaccaaagtccttgctatggtaaaagccaatgcctatggacatggggttgctgctgtcttgccagcgctgcaacaagccaatggggttggtgtagcaaccttgatagaggcgctggaagcaaggcagttgggctgggacaaaacgattgctctgattgaaggagcatttactgtcgatgaatggcgacaagctattgagcacgatatcagttgcgtgattcatcatgcgccgcaattgacatgggcgttagagcatacgccacctgttcattgcgcaactcgtgtcgtttggctaaaatacaatacaggtatgaaccgcttgggctttaatgccgatggcgttattgtcgcggctcagcgtttacatgaagcaggctaccagctgattttgaccacccactttgccaacgctgacgaccagacgcatccattaaatgccatgcaaatccagcgttttaatgacatgcttagcactttgcaagaaaccgtcagcgcagatgttcaaggctcattatgcaattctgctggtattgttaatttccccacacatcatcatgattgggtacgcccaggcatcatgctatatggcagtacacctgtcattgaccaaagtgcgtatgagctagacttgcaagcagccatggaatttagtgctcaaattattgcactgcaaactgtcaatgcaggtgagggaatcggttatggtagtcgctggctggcacaacaagataccagaaccgcactggtgagtgtcggctatggtgatggctatccacgtgtgattgccgataagacttacgttactgtcattgataccatcaaccatcaaagctatccatgtactgtgattgggcgagtagcaatggatatgattgtcattgatgttagcaacgtaccagagggcactgcattaaatagcaaagtaatactatggggtaatgcgccacgtgtcgatgaagtcgctactcatgcaggtacgattagttatgagttgctgtgccgcttaagcttacgccctcaacgactacagggataa

SEQ ID NO: 33041 - protein, 368 aa, Psychrobacter sp. 273-4
MRTITIKPAAITHNLNQVKKFAPETKVLAMVKANAYGHGVAAVLPALQQANGVGVATLIEALEARQLGWDKTIALIEGAFTVDEWRQAIEHDISCVIHHAPQLTWALEHTPPVHCATRVVWLKYNTGMNRLGFNADGVIVAAQRLHEAGYQLILTTHFANADDQTHPLNAMQIQRFNDMLSTLQETVSADVQGSLCNSAGIVNFPTHHHDWVRPGIMLYGSTPVIDQSAYELDLQAAMEFSAQIIALQTVNAGEGIGYGSRWLAQQDTRTALVSVGYGDGYPRVIADKTYVTVIDTINHQSYPCTVIGRVAMDMIVIDVSNVPEGTALNSKVILWGNAPRVDEVATHAGTISYELLCRLSLRPQRLQG

SEQ ID NO: 33042 - DNA, 1188 bp, Anabaena variabilis ATCC 29413
  CDS (1)..(1188)
atgttaagtcgccaacaagcctcaagtatggctgctcatcaacagtgtgatacctatgcttggttttcacaacgcgcttgggtggaaattgacctagaggcgttgtcgcacaatgtccagcaactgaagcagtttttatcaccgcgtactcagttaatggcggtagtcaaagcagatgcttatggtcatggtgctgtaacggtggcgcagacagcattacaagcaggtgctagttgtttgggtgtcgccactgttccggagggtattcaactgcgagaggcgggtatgcaagcgcccattttgattttaggggctacccatacaccagaacaaattcaggcgatcgctcaatggcaactacaaccaactattggtagtcctaaacaagctttaatattttccaataccttggagactatccagcatgattctcctgtacccgtacatattaagttagatacagggatgtctagacttgggactaactggcaacaagcaggggaatttgtacagttagtagagcgtttaccccatttgaatattgctagcgtttactcccacctagcaacagcagatagcccagatccagggattatggaagaacagtatagaagatttgaggaggcgatcgctcaaatcaaagctttgagtattaaaattccctgcctgcatttagcaaactcggctgcaaccttggcagatccaagattacactacgatatggtacgggtaggtttagctgtgtatggactctatccagcccctcatttacagaagaaaatcagcctaaaaccagtcatccaagttcaggcgcgagttacccacgtcaaaacaattgctgcgggtactggtgtaagttacggacatcaatttattgccccccatgaaatgcgccttgctgttgtcggtattggttacgctgatggaataccgcgtaatttatccaacaaaatgcaggttttaattcgtggtcagcgagtaccacaaatcggtgctatcacgatggatcagttgatgatagatgttagtgctttaccagacctacaagaaggggaaattgtcaccttacttgggaaacaaggaaaagaaaaaatcaccgccgatgattgggcagaagagttaaatactatttcctgggaaattctctgtggatttaaacatcgcctacctcgtgtaggagtgatgtaa

SEQ ID NO: 33043 - protein, 395 aa, Anabaena variabilis ATCC 29413
MLSRQQASSMAAHQQCDTYAWFSQRAWVEIDLEALSHNVQQLKQFLSPRTQLMAVVKADAYGHGAVTVAQTALQAGASCLGVATVPEGIQLREAGMQAPILILGATHTPEQIQAIAQWQLQPTIGSPKQALIFSNTLETIQHDSPVPVHIKLDTGMSRLGTNWQQAGEFVQLVERLPHLNIASVYSHLATADSPDPGIMEEQYRRFEEAIAQIKALSIKIPCLHLANSAATLADPRLHYDMVRVGLAVYGLYPAPHLQKKISLKPVIQVQARVTHVKTIAAGTGVSYGHQFIAPHEMRLAVVGIGYADGIPRNLSNKMQVLIRGQRVPQIGAITMDQLMIDVSALPDLQEGEIVTLLGKQGKEKITADDWAEELNTISWEILCGFKHRLPRVGVM

SEQ ID NO: 33044 - DNA, 1215 bp, Synechococcus elongatus PCC 7942
  CDS (1)..(1215)
atgaaaccgattgatccccaaccaactccgcgttggccagcgcgacggttagagcaactttcctatcagcgggcttgggtcgaagttgatcagggggcgatcgcggccaacacgcgtcagatccgccagttcctcgcacccagttgtgaattgatggcagtcgtcaaagcggatgcctatggtcacggcgctgttgcgatcgccagtacggttttaggtgctggagccactgccttgggagttgccacgatcccggaaggagtacggttgcgggaggcggggatcactgcaccgattctgctgctgggatcgatccatagccccgacgaagtgcaagcgatcgctcattggcagatccagcccagtctcagcacccccaagcaggcattaatctgtgcggaagtattagatcgcttgggacagtctctccctgtccatctcaaacttgataccggcatgtcccgcctcggagcaccttggcaaactgcggtcgagttcctgcagctcgttcatggtttgccgtcgctccagcttgccagtctctactcgcacttcgcaacggcagacagcccagatcgcgcgccgctccagcaacaacatgcagcatttgaacaggcgatcgcccaaatccaagcagaaggattgccagtccctaagcttcacattgctaactcagcagcgacgctattggattcgagccttcactacgaccaagtccgtgttgggctagcgctgtatgggctttaccccgcaccgcaccttggcgatcgtctgtctttatatccagctttatcggtcaaagcacgggtgactcacgtcacgaccctgcctgcaggccaaggcgttagctacggccatcgctacgtgactcaacgggaaacgccgatcgccgttgttgggatcggttatgccgatggtgtgccgcgtgccctgtctaatcagatggaggtgctctaccgcggtcagcggctgccacagattggggcgatcacaatggaccagatgatgatcgacatctctgccatgccccaattggcaccgggagatgttgtcaccctgttggggcgatcggggtcagaacagattaccgctgacgattgggccgatcgcgccaatacgattagctgggaaattctctgcggctttaaagatcggctgccacgctttgccgtcgccgcggattggtcatccaatcaagtcactgtcaggtcttaa

SEQ ID NO: 33045 - protein, 404 aa, Synechococcus elongatus PCC 7942
MKPIDPQPTPRWPARRLEQLSYQRAWVEVDQGAIAANTRQIRQFLAPSCELMAVVKADAYGHGAVAIASTVLGAGATALGVATIPEGVRLREAGITAPILLLGSIHSPDEVQAIAHWQIQPSLSTPKQALICAEVLDRLGQSLPVHLKLDTGMSRLGAPWQTAVEFLQLVHGLPSLQLASLYSHFATADSPDRAPLQQQHAAFEQAIAQIQAEGLPVPKLHIANSAATLLDSSLHYDQVRVGLALYGLYPAPHLGDRLSLYPALSVKARVTHVTTLPAGQGVSYGHRYVTQRETPIAVVGIGYADGVPRALSNQMEVLYRGQRLPQIGAITMDQMMIDISAMPQLAPGDVVTLLGRSGSEQITADDWADRANTISWEILCGFKDRLPRFAVAADWSSNQVTVRS

SEQ ID NO: 33046 - DNA, 1122 bp, Ralstonia eutropha JMP134
  CDS (1)..(1122)
atgccaagaccgatccacgccgtcatccatcaacccgccattgcgaacaaccttgaggtcgtccgccgtcacgcccccggttcccgcgtatgggccgtcatcaaggccaatgcctatggccatgggatccgccgtgtgttcgccggcctgcgtggaacggacggcttcgggctgctcgacctgaacgaagccgtgcagctgcgcgacctcggctggcaaggcccgatcctgttgctggaggggtttttccaaccgcaggacgtgccgctccttgaacaataccggctcaccaccgcggtgcattgcgacgagcagctccggatgctggagagcgcacgcccgaagggtccgctggcgatccagctcaaactcaatacggggatgaaccgcctgggcttccacccgtcgcaataccgcacggcgtgggagcgcgcacgcgccatgccctgcgtgggcagtatcgtccacatgacgcacttttccgatgccgacaccccgcgtggcatcgcccaccagatcgaggccttcgacaaagccacggccaacctgccaggtgaggccagcctgtcgaactccgcggcggtcctgtggcatcccgaagcgcaccgcgcatgggtgaggcccggtgtcatcctgtatggcgcatcgccgaccggccgcgaggccgacattgcgggcgtcggcctgcagccggccatgtcgctgcacagcgagctgattgcggtccaggacctgcagcctggcgatacggtcggctacggttccatgttcaccgccgaccggccgatgcgcatcggcgtggtggcctgtggctatgcagatggctacccgcggcatgcaacgggttggggcgaacaccgcgcccccgtgctggtggacggcgtgcgcacccaactcgtgggccgcgtgtcgatggacatgctgtgcgtagacctggggccatgcccgaaggcgaggatcggcagtcctgtcacgttgtggggccagggcctgccgatcgacgatgtcgcgcaggccagcggcacggtgggttacgaactgatgtgcgcgctggcgccgcgcgtgccgaccacggtggcaaccattacggcgccggacagcgcctcgccgctgctggcctga

SEQ ID NO: 33047 - protein, 373 aa, Ralstonia eutropha JMP134
MPRPIHAVIHQPAIANNLEVVRRHAPGSRVWAVIKANAYGHGIRRVFAGLRGTDGFGLLDLNEAVQLRDLGWQGPILLLEGFFQPQDVPLLEQYRLTTAVHCDEQLRMLESARPKGPLAIQLKLNTGMNRLGFHPSQYRTAWERARAMPCVGSIVHMTHFSDADTPRGIAHQIEAFDKATANLPGEASLSNSAAVLWHPEAHRAWVRPGVILYGASPTGREADIAGVGLQPAMSLHSELIAVQDLQPGDTVGYGSMFTADRPMRIGVVACGYADGYPRHATGWGEHRAPVLVDGVRTQLVGRVSMDMLCVDLGPCPKARIGSPVTLWGQGLPIDDVAQASGTVGYELMCALAPRVPTTVATITAPDSASPLLA

SEQ ID NO: 33048 - DNA, 1074 bp, Methylobacillus flagellatus KT
  CDS (1)..(1074)
atgcgtgcgaccacagcgacgattgacctgggcgcgctgcgccataacctgaatctcgtacgccagcgtgcgccgggctccagggtgctggcggtggtcaaggcggatgcctacggacacggcctgctgcgggttgcgccggggctggcggaggccgacggttttggcgtattgcgcctggaagaggccctggcattgcgagaggcgggctatcgccaacgcctgctactgctggaaggaatattcagcatggatgagctgggcgccgccgcccagcacggcatcagtgttgtcgtgcacaacgcacagcagctcgccatgttcgaggcaatggcagctgcctccgtcaagcctatctcggtattcctcaaaatgaacagcggcatgaatcgactgggattcaagtctcaggcctacaaacaagcgttgcagcggctggaggcttgtcctgtggtagcagacgtcagcttgatgacgcatttcgccacagcggatgaagagcggggcattgccgaccagctcaaggagttcgatgctgtgacggcaggctggcaccatcccgtcagcctggccaattctgccgcaatcttgcgtttcccggaggctcatcgcgattgggtgagacccggcatcatattgtatggcgcatccccggtttcaggcgtcagtgcggccagtttcgggctgcggcccgctatgcgtttcactagcgaagtgatcgcagtgcaaacgctggaggccggggatatcctcggatacggtgcgcgtttcaccgctacgcaggcaaccagggtcgcgattgtcgcctgcggatatgcggacggctatccgcgccatgcgcccaacggtacgcctatcgccatcgacgggcatcgcacccaaaccctgggacgcgtctccatggacatgctgtttgccgacatcagccagttgcccgatgccgatgtcggcagccaggtggaactctggggcgaggttgtgcctgtggatgccgttgccgaagccgcgggtacggtagggtacgagttgttgtgcgcggtggcgccgcgcgtggtgttcaaggtgacaggctga

SEQ ID NO: 33049 - protein, 357 aa, Methylobacillus flagellatus KT
MRATTATIDLGALRHNLNLVRQRAPGSRVLAVVKADAYGHGLLRVAPGLAEADGFGVLRLEEALALREAGYRQRLLLLEGIFSMDELGAAAQHGISVVVHNAQQLAMFEAMAAASVKPISVFLKMNSGMNRLGFKSQAYKQALQRLEACPVVADVSLMTHFATADEERGIADQLKEFDAVTAGWHHPVSLANSAAILRFPEAHRDWVRPGIILYGASPVSGVSAASFGLRPAMRFTSEVIAVQTLEAGDILGYGARFTATQATRVAIVACGYADGYPRHAPNGTPIAIDGHRTQTLGRVSMDMLFADISQLPDADVGSQVELWGEVVPVDAVAEAAGTVGYELLCAVAPRVVFKVTG

SEQ ID NO: 33050 - DNA, 1098 bp, Rubrobacter xylanophilus DSM 9941
  CDS (1)..(1098)
ttggaggtgccgggacgcgtctgggccgaggtggacctcggcgccgtccgccacaacgtgcggaccctccgccgccgctcccgggccccgcgcctgatggccgtggtgaaggccgacgcctacggccacggggcggtgccggtcgcccgggcggcgctcgcgggcggggccgacagcctcgccgtggccaccgccggggagggcgccgagctgcgccgggccgggatccgggcgcccgtcctcgtcttcggggacctcaccccggaggggctgcgggccgccgctcgcgagcggctggcggtgagcgcccactccgtgccctccgcccgccgcatcgccgcctccggcctcgacctggaagtgcaccttaaggtggataccggcatgaaccggtgggggctcgagcccggcgaggtcggggcggcgctcaaggccctggggagaacccccgacggggtctacacccacctggcctgcgccgactccgacccggaggccaccgggcggcagctcgccctcttcgactccgtgctcgccgcgcaccccttcggcggggcgctcgcgcacgccgccaactcggccggcaccctctggcacccgggctcgcactacggctgcgtgcgccccggcatagccctctacgggctccaccccgccggggacgccggagacccggcggcggagggcctccggcccgcgctcgcgctcaagagctacgtcgccgcggtccggcgcctcgagcccggagagggcgtctcctacgggctgaccttccgcgccccggagccgatgctcgccgccaccgtgcccgtggggtacgccgacggctaccggcgggcgctctccggcagggccgaggcgctcatccgcggccgccggcggccgctgctcgggcgggtctcgatggacgcctgcgtcttcgcggcggatagggaggtgcgggtgggggacgaggtcgtgctcctcggcgagcagggaggtggggcggtccgggccgaggagctcgccgcccgcgccggcacgataaactacgagataacaaccggcctgaacccccggcgtgtggagaggagctacgcagatgttcaaggatcttga

SEQ ID NO: 33051 - protein, 365 aa, Rubrobacter xylanophilus DSM 9941
MEVPGRVWAEVDLGAVRHNVRTLRRRSRAPRLMAVVKADAYGHGAVPVARAALAGGADSLAVATAGEGAELRRAGIRAPVLVFGDLTPEGLRAAARERLAVSAHSVPSARRIAASGLDLEVHLKVDTGMNRWGLEPGEVGAALKALGRTPDGVYTHLACADSDPEATGRQLALFDSVLAAHPFGGALAHAANSAGTLWHPGSHYGCVRPGIALYGLHPAGDAGDPAAEGLRPALALKSYVAAVRRLEPGEGVSYGLTFRAPEPMLAATVPVGYADGYRRALSGRAEALIRGRRRPLLGRVSMDACVFAADREVRVGDEVVLLGEQGGGAVRAEELAARAGTINYEITTGLNPRRVERSYADVQGS

SEQ ID NO: 33052 - DNA, 1158 bp, Mesorhizobium sp. BNC1
  CDS (1)..(1158)
atgacagcggccaagcgagcgggggctttcctgacggtcgatctcgaggccgtcaccgcgaactggttgctgctggccggtagggccgctggcgcagagtgcgctgcggtcgtaaaggccgatgcgtatgggctaggcgctgcggaagtcgctactgccctgcaggatgccggatgcaggacctttttcgtcgcgcatcttgaggaagggttgtcactccggcgcacactgggttccggctccagaatatttgttctcaatggaacgccgccggacacacaagaagagttcgggcaagctgcgctgacgccggtggtcggtacgatcaacgaacttcaggcgtggcgtaagcatgcggcgacgaagcgtgggcccattccagtcgcgcttcaactggatactggaatgtcacgcttgggactatcgcctagcgatgtatcgggcatcgcggcagatactaccctgctgagaggcattcatatcgaactcgtcatgagccacctcgcatgcgccgacgaacccgggcattccgctaatgaatcgcaaaggtccaggttccaacggctccgacgaatgcttcctcaagcgccggcttctattgcgaactcatcgggaacattcctcggcaaaggattccatttttccatgatccggccgggtgctgccctgtacgggatcaatcctacgccttaccaacccaatccgatgtgtcaggtcgtcaaagtcgcggcccgcgtcctgcaggtgcgccaggcaagagcgggaactggaatcggctatggccacgcggcgcgtgctcgccgcctatcaatgctagccaccatcgcactgggctacgcggatggctggccctgccaagcgagcggagcagcgtactatcgcggccaacgacttccattcattggccgagtgtcgatggacagcattatcctcgatgtgactggatgctccaatccgccgcgggaaggagatctcgtggagtttatctgcccatcgcagacggttgatgaaattggcaggctggcgggaagcatcggctacgaggtgctaacgcggctggggagaaggtttcaccgccgctatatccgccccaatatatcaccggcgcagagcacacgcagcggatcccccctgctggcagatgatacagcagaatga

SEQ ID NO: 33053 - protein, 385 aa, Mesorhizobium sp. BNC1
MTAAKRAGAFLTVDLEAVTANWLLLAGRAAGAECAAVVKADAYGLGAAEVATALQDAGCRTFFVAHLEEGLSLRRTLGSGSRIFVLNGTPPDTQEEFGQAALTPVVGTINELQAWRKHAATKRGPIPVALQLDTGMSRLGLSPSDVSGIAADTTLLRGIHIELVMSHLACADEPGHSANESQRSRFQRLRRMLPQAPASIANSSGTFLGKGFHFSMIRPGAALYGINPTPYQPNPMCQVVKVAARVLQVRQARAGTGIGYGHAARARRLSMLATIALGYADGWPCQASGAAYYRGQRLPFIGRVSMDSIILDVTGCSNPPREGDLVEFICPSQTVDEIGRLAGSIGYEVLTRLGRRFHRRYIRPNISPAQSTRSGSPLLADDTAE

SEQ ID NO: 33054 - DNA, 1059 bp, Exiguobacterium sp. 255-15
  CDS (1)..(1059)
atgagttcaagaactgtcgttaccattgatcgggaagcggtgcggcataatgtcgcatcggttttcgcccggtctaacaagcagatttttgccgtggtcaaaaacaatgcttacaacttagggatgattgaaatggtcgccacattgatggaagccggtgtccggcatttcgcagtggcggaagtctatgaagcaattgaaatcaaaacgaattttccagacagttatgtcctggcgatgaatccggcatcggattttaaagaggtccgcttgcatggagtagcgctcggaattccttcgctcgattggctgacacgtcatcaggcggatttatcgggaattgaactgcatctaaaaataaatgtcgggatgaaccgttttggtgtcagttcgctcgaagaagcattagcggtgcttgaaaccgtacgggagcaagagctgacgttaacagggctctacacgcatttcccgcttgccgatgaaccgggagccgatcacgacggtcaggttgaacggttccttgaaatcggaaatccgttacaggcgaaacatagctttacttatatccatgccgaaaacagtgcaacgatcgtcaagcatgatccgcgcctcgcctgttgcaattacgtccggcccggtatattcctgtttggctattcgccgatcgaaaaaatggattggctcgtcccctcactccggatgacgacggaagtcgttgagattcgtcaagtggaagcaggggaacatgtcggctacggtacgtcgtatacggcaccgacagcgattcgtgtcgccgttctgccggtcggctacggggacggggttgtccgcggacggtcgtcactgccggtcatcatcaacggaaaacgttatccgatcatcagtaagttatttatgagtcatacgttcatcgccgtcgattcgacggtggaaatcggtgataaagttgttctgtacggagacggcatcgaaattgatgacatcacccggaccgggacagccaataattcggaacagatgtgtgcccgttcgtggcgtttaacacatcgttatttataa

SEQ ID NO: 33055 - protein, 352 aa, Exiguobacterium sp. 255-15
MSSRTVVTIDREAVRHNVASVFARSNKQIFAVVKNNAYNLGMIEMVATLMEAGVRHFAVAEVYEAIEIKTNFPDSYVLAMNPASDFKEVRLHGVALGIPSLDWLTRHQADLSGIELHLKINVGMNRFGVSSLEEALAVLETVREQELTLTGLYTHFPLADEPGADHDGQVERFLEIGNPLQAKHSFTYIHAENSATIVKHDPRLACCNYVRPGIFLFGYSPIEKMDWLVPSLRMTTEVVEIRQVEAGEHVGYGTSYTAPTAIRVAVLPVGYGDGVVRGRSSLPVIINGKRYPIISKLFMSHTFIAVDSTVEIGDKVVLYGDGIEIDDITRTGTANNSEQMCARSWRLTHRYL

SEQ ID NO: 33056 - DNA, 1113 bp, Dechloromonas aromatica RCB
  CDS (1)..(1113)
atgaaaacatcgcgtcccatccgcgcacgcattgcgccggcggcgattttgcacaactatcgtctggctaaacgtcacgctccccagtccaaggcttgggccgtgatcaaggccaatgcctacggacatggccaatggcgtgccgttgatgccttgcgcggcgaggccgatggttttgcgctgctcgaatgtgaaaacgcggttgccctgcgtgaggctggcgttactcaacccatcctgatgctggagggaatattcagtgcccgtgacgtgcgggccgttatcgaataccggctgaccagcgtcattcattgcctcgaacaattggaactactcgtccgcaatggccggttcgacacaccgatctctgtgtgcctgaagctgaatacagggatgaaccgcctgggttttacggccgcgaccttgccccgcgcctgggagatactccagcaattgccgcaggttgatgtcaccttgatgactcactttgccgacgccgatggtgagcggggcgtaacttggcaattggagcgctttcatgacctggccggagattgggcggggccggtgagtctcggtaattcggcagccattctgagccaccccaaggcgcacggcgactgggtgcggccgggcatcatgctttatggcgccagcccgtttgctgatcaaagtgcagttgatctgggtttgcgaccggtcatgacgctggagagtgccgtcatcggcatccaggatctggcagcgggggagcgggttggttatggcggaacttttactgccgatcggccgatgcggattggcgtcgtcgcctgtggatatgccgacggttacccgcgtcacgcaccgaccggcacacccatagcagtcatgggccgccggacgcgtacgataggccgggtatcgatggacatgctggcctgtgatctgactgatgttccggaggcgggtatcggctcgccggtgacgctgtgggggctgggtatagccggcgctgtgccggccgacgaagtggccgctgcggccggtactgttgcctatgagctcttctgtgccgtggcgccgcgtgtaccggtggtggtggatgacgctgtcgcggcagggcgcccataa

SEQ ID NO: 33057 - protein, 370 aa, Dechloromonas aromatica RCB
MKTSRPIRARIAPAAILHNYRLAKRHAPQSKAWAVIKANAYGHGQWRAVDALRGEADGFALLECENAVALREAGVTQPILMLEGIFSARDVRAVIEYRLTSVIHCLEQLELLVRNGRFDTPISVCLKLNTGMNRLGFTAATLPRAWEILQQLPQVDVTLMTHFADADGERGVTWQLERFHDLAGDWAGPVSLGNSAAILSHPKAHGDWVRPGIMLYGASPFADQSAVDLGLRPVMTLESAVIGIQDLAAGERVGYGGTFTADRPMRIGVVACGYADGYPRHAPTGTPIAVMGRRTRTIGRVSMDMLACDLTDVPEAGIGSPVTLWGLGIAGAVPADEVAAAAGTVAYELFCAVAPRVPVVVDDAVAAGRP

SEQ ID NO: 33058 - DNA, 1116 bp, Magnetospirillum magnetotacticum MS-1
  CDS (1)..(1116)
atgaccgaccttgcccgcgccaccgccctgctgaccatcgatgtggcggccatcgtcgccaactggaagcggctttccgccctggttgcccccgccgaggcttccgccgtggtcaaggcggattgctatgggctgggtatggaacacattgcaccggccctctccgccgctggatgccagtccttcttcgtggcctgcgtcaatgaaggcatcgcccttcgccggatcctgcccgccgcggtgatccatgtgctgagcggacctttgggcggcgatgagggcgagttcgccgcccataatctgatcccggtcctgaactccctggcccagatcaccggctgggccggttttgccaagaagggcagcggcgcaccggcggcggccatccatatcgacaccggcatgaaccgcctcggcttatccgagaccgagttggaacgcctggccgccaagccggaaatcaccgccgccatccgccccattctggtcatgagccacctggcctgcgccgatgacgccgattcgcccatgaatgcccggcagctgacgacgctgcggcggctggcatcccatcttcccgccctgccccaatccatcgccgcctcgtcgggcatcttcctgggccgcggctttcacttagggttggtgcgccctggcgccgccctctatgggctgaaccccatgccgggccgccccaatcccatgagccaagtggttaaactgcaaggaaaaatcgtccaggtccgtgacgttgacagcccccagaccgttggctatggtgccacccaccgtgtcgaggggaagcgaaagctggcggtcgtggcggtcggttatgccgatggctggttccggtccctctccaatcgcggacatggcatgatcgggggaatgaaggtgccggtggccggacggatttccatggatttgaccaccttcgacgtcaccgacgtcccggcggagcatgcccatcccggcgcctggatcgagttgatcggcccggatctcagcccggatcgtgtcgcggacgaagccggtaccatcggctacgagatcctcacctccctggggcgccgccatcatcgccgctggaccggcacggagacggcaaaatcatga

SEQ ID NO: 33059 - protein, 371 aa, Magnetospirillum magnetotacticum MS-1
MTDLARATALLTIDVAAIVANWKRLSALVAPAEASAVVKADCYGLGMEHIAPALSAAGCQSFFVACVNEGIALRRILPAAVIHVLSGPLGGDEGEFAAHNLIPVLNSLAQITGWAGFAKKGSGAPAAAIHIDTGMNRLGLSETELERLAAKPEITAAIRPILVMSHLACADDADSPMNARQLTTLRRLASHLPALPQSIAASSGIFLGRGFHLGLVRPGAALYGLNPMPGRPNPMSQVVKLQGKIVQVRDVDSPQTVGYGATHRVEGKRKLAVVAVGYADGWFRSLSNRGHGMIGGMKVPVAGRISMDLTTFDVTDVPAEHAHPGAWIELIGPDLSPDRVADEAGTIGYEILTSLGRRHHRRWTGTETAKS

SEQ ID NO: 33060 - DNA, 1071 bp, Burkholderia cepacia R18194
  CDS (1)..(1071)
atgccgcgcccgatctccgccaccatccataccgccgctctcgcgaacaatctctccgtcgtccgccgctttgccggcccgtccaaggtctgggcggtcgtcaaggccaacgcgtacggtcacggtctcgcccgcgcgtttcctggcctgcgcggcaccgacggcttcggcctgctcgacctagacgaggccgtcaagctgcgcgagctcggctgggccggcccgatcctgttgctcgaagggttcttccgctcgactgacatcgacgtgatcgaccgctacagcctgacgacgaccgtccacaacgacgagcagatgcggatgctggagacggcgcggctgtcgaagcccgtcaacgtgcagctcaagatgaacagcgggatgaaccggctcggctacctgccggaaaaataccgcgccgcatgggagcgcgcccgcgcgtgccacggcatcggccagatcacgttgatgacccatttttcggatgcggacaacgagcgcggcgtcgccgagcagctcgcgacgttcgagcgcggcgcggaaaacattgccggtgcgcgcagcctcgcgaactccgcagccgtgctgtggcatccggacacgcacttcgattgggtgcgcccggggatcgtgctgtacggcgcgtcgccgtccgggttgtcgtccgacatcgccgataccgggctgaagcctgcgatgacgctcgcgtccgagctgatcgcggtgcagacgatcgcgaagggccaggccatcggctatggctcgacgttctccgcgcaggcgccgatgcggatcggcgtggtcgcgtgcggttacgcggacggctatccgcgggtcgcgcccgaaggcacgcccgtgatcgtcgacggcatccgcacgcggatcgtcggtcgcgtatcgatggacatgatcaccgtcgacctgtccccgtgcccgcaggccggtgtcggcgcgcgcgtcgagctgtggggcaacgcgctgccgatcgacgacgtcgcccgccattgcggcacgatcggttacgagctgatgtgcgcggtcgccggccgcgtgcccgtgcgcgcggaataa

SEQ ID NO: 33061 - protein, 356 aa, Burkholderia cepacia R18194
MPRPISATIHTAALANNLSVVRRFAGPSKVWAVVKANAYGHGLARAFPGLRGTDGFGLLDLDEAVKLRELGWAGPILLLEGFFRSTDIDVIDRYSLTTTVHNDEQMRMLETARLSKPVNVQLKMNSGMNRLGYLPEKYRAAWERARACHGIGQITLMTHFSDADNERGVAEQLATFERGAENIAGARSLANSAAVLWHPDTHFDWVRPGIVLYGASPSGLSSDIADTGLKPAMTLASELIAVQTIAKGQAIGYGSTFSAQAPMRIGVVACGYADGYPRVAPEGTPVIVDGIRTRIVGRVSMDMITVDLSPCPQAGVGARVELWGNALPIDDVARHCGTIGYELMCAVAGRVPVRAE

SEQ ID NO: 33062 - DNA, 1104 bp, Rubrivivax gelatinosus PM1
  CDS (1)..(1104)
atgccgcgccccatcgaagccctgatccacgccgaggccctgacgcacaacctggcccgcgcccgagcggccgttcccgacgcgcgggtgtgggcggtggtcaaggcccatgcctacggccacggcatcgcgcgtgtcttcgaggcgctccgtgcggccgacggcttcgcgctgctcgatctggccgaggcgcagcaactgcgcgacctggggtggcgcggcccgatcctgctgctcgagggcgtgttcgaaccgcgcgacctggagctttgctcgcgcctgaacctctggcacacggtgcactgcgaggcgcagatcgactggctggcgatgcacaagacccaccagccgcaccgggtgttcctgaagatgaacagcggcatgaaccggctgggcttccggcccgcggcgttccgcgcggcgtggacgcggctccatgcgctgccgcaggtcgacgagatctcgctgatgagtcacttctcggacgccgacggcggccgcggcatcgccgcggcgatgcaggtcttcgacgacgccacgcgcgacctgccgggcgaacgcagcctctgcaacagcgcggccacgctgcgccacggcgccgacgctgcggtgcgtgccgactgggtgcgcgccggcatcatgctgtatggctccgcgcccgatttcccctcgcacgacatcgcccactgggacctgcagccgacgatgacgctgcgcgcgcgactgatcggcacgcaggatctgcaggccggcgacacggtgggctatggcagccgcttcaccgccgaggcgccgatgcgcatcggcgtggtggcctgtggctatgcggacggctacccgcgtcacgcgccgagcggcacgccggtgctggtcgatggcgtgcgcacgcggctggtcgggcgggtgtcgatggacatggtgaccgtcgacctgggcgggctgccccaggccgcgcgcggcagcgaggtcacgctgtggggtcgggcgtcgtccggcgcggtgctgccgatcgatgaggtcgcccacgcggccggcacggtggggtacgaaccgatgtgcgcgctggccgcgcgcgtgccggtgcggctggacgccgccggctga

SEQ ID NO: 33063 - protein, 367 aa, Rubrivivax gelatinosus PM1
MPRPIEALIHAEALTHNLARARAAVPDARVWAVVKAHAYGHGIARVFEALRAADGFALLDLAEAQQLRDLGWRGPILLLEGVFEPRDLELCSRLNLWHTVHCEAQIDWLAMHKTHQPHRVFLKMNSGMNRLGFRPAAFRAAWTRLHALPQVDEISLMSHFSDADGGRGIAAAMQVFDDATRDLPGERSLCNSAATLRHGADAAVRADWVRAGIMLYGSAPDFPSHDIAHWDLQPTMTLRARLIGTQDLQAGDTVGYGSRFTAEAPMRIGVVACGYADGYPRHAPSGTPVLVDGVRTRLVGRVSMDMVTVDLGGLPQAARGSEVTLWGRASSGAVLPIDEVAHAAGTVGYEPMCALAARVPVRLDAAG

SEQ ID NO: 33064 - DNA, 1125 bp, Rhodospirillum rubrum
  CDS (1)..(1125)
atgggtcatgaggaccgggcgacggcccttcttaccgtcgatcttgatgccatcgccgataactggctggccctgcgcggccggctgcgccccggggcgtcgtgcgccggggtggtcaaggccaatgcctatggcctgggggcgcgcaaggtcgttcccgccttgctggccgccggctgccgcgatttcgtcgtcgcccagatcgacgagggcctggatatcctcgatctgctgcccgccgacgcccgcctgttcgtgctctcgggcccgcccgagggggccgaggacgaggtgctcgacagcgcgctgatcccggtgctcaacagtcccgatcaaatcgaccgttgggccaaggcctgcgcgcgggccgggcgcaaggcgccagccgcccttcatgtcgataccggcatgcgccgcctggggctgacgccgctggaactcgacgccctgctcgccgatccccgcccgctcgccgccttcaccccagtgctggtgatgacccatctcgcctgcgccgacgagcccgatcatccgctcaacgccgagcagcgcgccctgttcgccgccgccgccgcccgcttccccggcctgcgcgccagccttgccaatacctcgggcattttcctgggccccgagtggcattttgatctggcgcgcccgggaattggtctttatggcggaaatccgaccgtcggtacagccaaccccatgcggcaagtggttaaattacaaggaaaaatcctgcaagttcgccgcattgacacccccttgagcgttggctatggtgcaacgcatacggccccggcgggaagcacgatcgcaaccgtcggtgtcggatatgccgacggatttccgcgttcggcgggcaaccgggccatggggcttctggccggtcgatccgttccggtcgttggtcgtgtgtccatggatctgctgaccttcgacgtatcggatgttcccgaaaacttggcgagacccggtgccatgatcgaccttcttggacccgatctgagtgtggacgccctggccgatcgcgccgatacggtgtcctacgaaattctcacgcgactaggcgcgcgctacccgcgccgctacggcggggtgagggaggggagcggccaatga

SEQ ID NO: 33065 - protein, 374 aa, Rhodospirillum rubrum
MGHEDRATALLTVDLDAIADNWLALRGRLRPGASCAGVVKANAYGLGARKVVPALLAAGCRDFVVAQIDEGLDILDLLPADARLFVLSGPPEGAEDEVLDSALIPVLNSPDQIDRWAKACARAGRKAPAALHVDTGMRRLGLTPLELDALLADPRPLAAFTPVLVMTHLACADEPDHPLNAEQRALFAAAAARFPGLRASLANTSGIFLGPEWHFDLARPGIGLYGGNPTVGTANPMRQVVKLQGKILQVRRIDTPLSVGYGATHTAPAGSTIATVGVGYADGFPRSAGNRAMGLLAGRSVPVVGRVSMDLLTFDVSDVPENLARPGAMIDLLGPDLSVDALADRADTVSYEILTRLGARYPRRYGGVREGSGQ

SEQ ID NO: 33066 - DNA, 1107 bp, Ralstonia metallidurans CH34
  CDS (1)..(1107)
atgccaagacccattcaagccgtcatccaccagcccgcgctggccaacaatcttgaggtggtgcgtcgccaagcacccgcatcccgcatctgggcggtggtcaaggccaacgcctacggccacggcatccgccgagtctttgccggcctcaaggccgccgacgggtttggcctgctcgatctctcggaagccgtgctgttgcgcgaccttgggtggcagggcccgatcctgctgctcgaaggcatcttccaggcgcaggatgtaccgctgctcgagcaataccgcctgaccaccgccgtgcactgcgaggagcagttgcggatgcttgagctggcccgccccaaggggccgctggcgatccagctcaagctgaataccggcatgaaccgcctgggcttccgtccggcgcagtaccgcgccgcctgggaacgggcccggaccatgtcctgcatcggcagcattgtccacatgacgcacttttccgatgccgacagcaagcgcggcattgcgcatcaggtggaagccttcgaagccgccacggccaacctgccgggggaggtcagcatggccaactcggcagccgtgctctggcatccgcaggcgcatcgcaactgggtgcgtcccggcatcatcctttacggcggatcgcccaccggggtgtcgtccgatatcgcagagaccggcctgcaaccggcgatgtctctccatagcgagctgatcggcatacaggatctgcaaccgggcgatacggtcggctatggttccatgtttactgccgaccgcgcgatgcgggtcggggtggtggcgtgcggctacgccgacggctacccacgccacgcggtgggctggggcgagcgccgcgcgccggtgctggtcgacggcgtgcgcacgcaattggtggggcgggtgtcgatggacatgatctgcgtcgacctgaccccctgcccgaaggcaaaggtaggcacgccggtcacgctctggggccatggtctgccaatcgacgacgtggccgccgccagcggcacggttggctatgaactgatgtgcgcgctggcgccgcgcgtgccgacttccgttgccacgttgaccaccgccgacgccgtataa

SEQ ID NO: 33067 - protein, 368 aa, Ralstonia metallidurans CH34
MPRPIQAVIHQPALANNLEVVRRQAPASRIWAVVKANAYGHGIRRVFAGLKAADGFGLLDLSEAVLLRDLGWQGPILLLEGIFQAQDVPLLEQYRLTTAVHCEEQLRMLELARPKGPLAIQLKLNTGMNRLGFRPAQYRAAWERARTMSCIGSIVHMTHFSDADSKRGIAHQVEAFEAATANLPGEVSMANSAAVLWHPQAHRNWVRPGIILYGGSPTGVSSDIAETGLQPAMSLHSELIGIQDLQPGDTVGYGSMFTADRAMRVGVVACGYADGYPRHAVGWGERRAPVLVDGVRTQLVGRVSMDMICVDLTPCPKAKVGTPVTLWGHGLPIDDVAAASGTVGYELMCALAPRVPTSVATLTTADAV

SEQ ID NO: 33068 - DNA, 1173 bp, Burkholderia fungorum LB400
  CDS (1)..(1173)
atgtctgttccgatcatcgaacccgccgccgatgcgcaaggtgtgcgcttgctgcgtcccagttgggccgaactcgactatggcgccgtcgcggcgaatctggcggtcgcgcgcgaacaggtgggacgcgccacgaaaatctacttcgtctgcaagggcgacggattcggctttggcgccgcgaaggttgcgcggctggcggcgcaagcgggtgtcgatggcttttgcgtcggcagtccggaagagggcgttacgattcgccgtgcgggtatcgaccgcgacatactgctgtttgcttcgaccctgccggaagatgcagcgcaggtcgcggcgttggggctcacggtgacgatccagagtcgggaaagcctgcatgcgttcatcaacgcaggcgtggcggtggatgcgttcctggagatcgatccgggcttcgggcgcttcggctttctgccgtcgcaatggcaagccgcgttcgcggcgctgcgcgatcagtcgaccgtgcggctcaaaggcgtgtacacgcatctgagctcgccggagagcgaagacgtgacgcgccagcaggccggcgtgttcgatgcggcgctggccgacgcgcgcgccgcgggcttcgataacctaacgacgatgctggcaagctcgcgggtcatgctcgcgcatccgcatctggcgtatcaggcagtcgatcccgggcggcttctatacggtgcgctcgacgcggactggatggcccgcgcgccgttgcggcccatgttgcgggccgtgcgtgggcgcatcattcacgttcaggagcacccggccggagccacgctcgggattggctatgcggaaccgatccggctcgaacggggcgtgcgtatcggtgtcgtgccgatcggtttctgggacgggttgaatcatgtgccgccgctgggccgcgtgctggtgcacggacagccggcgcgcattcttgggcgccgctctttccagcataccgtgatcgatatcacggagattgccgcggcccggaccgggagcgtggtcacgttgctcggtcaggacggcgaccagtcgatcacgatcgacgagatggcggaaacgttgcggctgccggtcatggagttgattccccggctggcgagaagtctgccccacgtcgaagtgaaaacggcggatccggcgggcaacaactga

SEQ ID NO: 33069 - protein, 390 aa, Burkholderia fungorum LB400
MSVPIIEPAADAQGVRLLRPSWAELDYGAVAANLAVAREQVGRATKIYFVCKGDGFGFGAAKVARLAAQAGVDGFCVGSPEEGVTIRRAGIDRDILLFASTLPEDAAQVAALGLTVTIQSRESLHAFINAGVAVDAFLEIDPGFGRFGFLPSQWQAAFAALRDQSTVRLKGVYTHLSSPESEDVTRQQAGVFDAALADARAAGFDNLTTMLASSRVMLAHPHLAYQAVDPGRLLYGALDADWMARAPLRPMLRAVRGRIIHVQEHPAGATLGIGYAEPIRLERGVRIGVVPIGFWDGLNHVPPLGRVLVHGQPARILGRRSFQHTVIDITEIAAARTGSVVTLLGQDGDQSITIDEMAETLRLPVMELIPRLARSLPHVEVKTADPAGNN

SEQ ID NO: 33070 - DNA, 1152 bp, Magnetococcus sp. MC-1
  CDS (1)..(1152)
atgcaatggacccatcgccccacatggttggaaatcgacctcgccgccctacgccataacctccgccaagcccgcaccgctaccggaccccaagtcgcccactttcccgtcatcaaagccgacggctacggcatcggcgccatcgccgtcgcccacaccctcgaagaagaggccgacggcttctgcgtggccctggtcgaagaggccgaacaactgcgcaccgccggaattaataaacgcatcatgctcttctcaggactctaccccggtctagaagaacgcgccatccgcgcccgtgttgaacccttcctcagtgacgaaatcaacctaaacgctctgtggcaagccgccaaatgctacggcccaatctccgtgcatatcaaaatagatagcggcatggcccgcctcggttaccaccccgaacacgtgccgagcctattagatcaactcgcccatatgcccgaacttaaattggccggcctggtttctcatatggcctgtgccgatgaccgtcactcccccatcaccaatgcccagttggcgaccttaagccccatacttgaacaccccctggttaaacaaacacaagcccaactctccctagccaactccgcaaccatcctcggccaccccaacgcccactaccaatgggtacgccccggtattatgatctacggagcctcccccttctttccccataccaatgccgccaacgaaggattgcaacccgtggtgcgctgggtcacccatatccaacgcattcacaccctggaaaaaggtaaatcccttggctacggccacacctttaccgccacacgccctacccgtatcgcacaactgcccgtcggctacgccgatggctataaccgcctgtggagtaataaaggttccgtgttgatcgcaggccaacactgccccgtggtggggatcgtctgcatggatcaaatcgccgtggatattagcgatcttcaaggtgaggtcaaacagtgggatgaagcggtactactgggaaaacaacacaatgctgaaatcaccctggaaaactgggcaaccgaacttaaaaccattccatacgaaatcctgacccgcattgggccaagagtgccccgacgctaccgcgatggtagcatcctgtcaggcagctttggctaa

SEQ ID NO: 33071 - protein, 383 aa, Magnetococcus sp. MC-1
MQWTHRPTWLEIDLAALRHNLRQARTATGPQVAHFPVIKADGYGIGAIAVAHTLEEEADGFCVALVEEAEQLRTAGINKRIMLFSGLYPGLEERAIRARVEPFLSDEINLNALWQAAKCYGPISVHIKIDSGMARLGYHPEHVPSLLDQLAHMPELKLAGLVSHMACADDRHSPITNAQLATLSPILEHPLVKQTQAQLSLANSATILGHPNAHYQWVRPGIMIYGASPFFPHTNAANEGLQPVVRWVTHIQRIHTLEKGKSLGYGHTFTATRPTRIAQLPVGYADGYNRLWSNKGSVLIAGQHCPVVGIVCMDQIAVDISDLQGEVKQWDEAVLLGKQHNAEITLENWATELKTIPYEILTRIGPRVPRRYRDGSILSGSFG

SEQ ID NO: 33072 - DNA, 1125 bp, Thermobifida fusca
  CDS (1)..(1125)
atgtcgtcttttgccgaagccaggatcgacctggacgccatcagcggcaacattgcgctcctcgctgaacgagcagcgggcgcccaggtgatgggcgtggtcaaagcagacgggtacgggcacggcatggtccctgccgcgcgggcagcgctcgccggaggggcaacctggctgggcaccgcattcattgccgaggcgctgcagttgcgtgctgccggcatcgacgcgccgatcctcgcctggctggtgccccccggagaacccctcaccgaggcgatcgacgccggcatcgacctcggtatcggatcgatgtgggtgatcaacgaggtcattgacgcggcccggcaggcgcgccgccaggcccgcatccacctcaaagtcgacaccgggctgaaccgcggcggtatcggccccgccgactggtctgccgcagctgcggccctggcgcgcgccgaagccgcagggctgctcaccgtcaccggagtgttctctcacctcgcctgtgccgacgagcccgacaaccccgccaccaccgcccagcttgaagccttccaccaggcgctgtccgtcgtcgacaaggccgggctgcacccccaggtccggcacatcgccaactctgcggcgctcctcacccgacccgatgcccgattcgacctggtgcggcccgggatcgccacctacgggctgtcccccatccccggcctggacgtgccgggcctgcggcccgccatgacactcagcgccaccctggtgggctgcaaacgagtccgccccggcagcggcgtctcctacgggtaccgctacgtgaccgaccgggaaaccaacctcgccctggtacccctcggctacggcgacggggtgccgcgcgccgcaaccaaccgcgcccccgtgttcgtggcaggccgccgccgcaccatcgccggaaccgtgtgcatggaccagttcgtggtggacatcggcgacgacacggtcacccccggcgaccgtgcaatcctgttcggccccggcgaccacggcgaacccaccgcccaagactgggcggacgccttggacacgatctcctacgagatcgtcacccgcatcggccggcgggtgccgcgcgtctacaccggcgctgtgcgctga

SEQ ID NO: 33073 - protein, 374 aa, Thermobifida fusca
MSSFAEARIDLDAISGNIALLAERAAGAQVMGVVKADGYGHGMVPAARAALAGGATWLGTAFIAEALQLRAAGIDAPILAWLVPPGEPLTEAIDAGIDLGIGSMWVINEVIDAARQARRQARIHLKVDTGLNRGGIGPADWSAAAAALARAEAAGLLTVTGVFSHLACADEPDNPATTAQLEAFHQALSVVDKAGLHPQVRHIANSAALLTRPDARFDLVRPGIATYGLSPIPGLDVPGLRPAMTLSATLVGCKRVRPGSGVSYGYRYVTDRETNLALVPLGYGDGVPRAATNRAPVFVAGRRRTIAGTVCMDQFVVDIGDDTVTPGDRAILFGPGDHGEPTAQDWADALDTISYEIVTRIGRRVPRVYTGAVR

SEQ ID NO: 33074 - DNA, 1140 bp, Geobacter metallireducens GS-15
  CDS (1)..(1140)
atggacagtcgccccaccattgccgaaatcgatcttgccgccctgcgtcataacttcgagcaggtgcagcgtgccgttcccgccggatgcgggattcttgccatcgtgaaggccgatgcctacggccacggcttcatggatatctcccgggaactggagtccctgggggtgaccgccttcggcgtggcgtttctggccgagggaatccaactgcgcaagagcggcatcgaccggccggtcctgatcctcggcggggtctatccggggcaggagcgcaagtgcgtcgggttcaacctctccaccgccgtcttctccctggagcaggcgcgggtcctgaacgacaccgccgcccgtctctaccgcaaggcgaagatccacgtgaagatcgataccggcatggggcgtctcggggtcgccgcggccgaggccccggcctttttccgggaactgcgggagatgaaatccctggaactggaggggatcatctctcacttcgcctccgccgacgaactggatgatgatggccgccgcttctcggaccgccaggctgccgtcttcgcccagtcggtggcagaggcccggtccctgggactcgacccccgctacgtccacatcgccaacagtgccgccgctttcggcatggatctccccttctgcaacctggtccggcccggcatcgtcctctacggggcgcttccgtcgggtgacttcgagggaaagatggcgctccggcccatcatgcggctgcagagtaccgtggccatgctcaagtgggtggagcccggcaccagtatcagctacgcccgccgctacacggccccggaccggcgccttatcgccagtgttcccgtggggtacgccgacggctacagccgggccctgaccaaccggggagaggtcctgatccggggcacgcgggcaccggtggttgggaccgtctgcatggactggatcatgatcgatgtgacctccgtccctggcgtggctgtgggggacgaggtgacgctccttggctgcgaccggcagggtcattgcgtgcgggccgaggaactggcctcgtgggccggcaccatcccctacgaaattttctgcggcatcagcaagcgggtgccgcgggtctacctgaacgcgacccggtga

SEQ ID NO: 33075 - protein, 379 aa, Geobacter metallireducens GS-15
MDSRPTIAEIDLAALRHNFEQVQRAVPAGCGILAIVKADAYGHGFMDISRELESLGVTAFGVAFLAEGIQLRKSGIDRPVLILGGVYPGQERKCVGFNLSTAVFSLEQARVLNDTAARLYRKAKIHVKIDTGMGRLGVAAAEAPAFFRELREMKSLELEGIISHFASADELDDDGRRFSDRQAAVFAQSVAEARSLGLDPRYVHIANSAAAFGMDLPFCNLVRPGIVLYGALPSGDFEGKMALRPIMRLQSTVAMLKWVEPGTSISYARRYTAPDRRLIASVPVGYADGYSRALTNRGEVLIRGTRAPVVGTVCMDWIMIDVTSVPGVAVGDEVTLLGCDRQGHCVRAEELASWAGTIPYEIFCGISKRVPRVYLNATR

SEQ ID NO: 33076 - DNA, 1071 bp, Novosphingobium aromaticivorans DSM 12444
  CDS (1)..(1071)
atgactgacatttcccttccgacgacgcccgacctgcccgagtcctcccttcgcctgcggatcgatgccgatgcgcttgcgtctaactggcgcgcactcgacgcgatgtcgggcacggcgaccgccggcgctgcagtaaaggctgatgcctatggactgggcgctgcgcgtgtctcgcgcatccttgtcggcgcgggttgtcgcgacttcttcgtcgcgcattgggcggaagtgccgaacctcctgccgcatgtccccgcagccagcatcgccgtgctgcatggtcccatgaatgcggcggaagccgccttcgctcgggcaactggtgcaaggccagttctgaacagcctgtcgcaggcccgtctctggcaggaaacaggcggcggacggtgccacgtcatggtcgataccggaatgagtcgacttggcctcgccatgtccgagatcgccgatccagcgctggctgacctcgatgtggacctttgcctcagccacctcgcaagtgcggatgaggatgttccgcagaacgagcaacagcgccttcgcttcgaaacggtccgcgccgccattcccgcccgtcgctacagccttgccaacagcgccggcatagcgctcggtgcgggcttccacgcggacgtcactcgcccgggcatcgctctctatggcggcatcgccaggcccgaatttgccggcacgatccgccaggtcgcgcgtcccgaagcagcggtcatccaggtccgccatctccaaccaggcgacaaagtcggctacaatgcgatctttaccgctgatcgcccgatgcgggtcggcgttctcgcgatcggctatgccgacggctatcttcgctgctggaccgggcggggtagcttcctgttcgatggagtcgaagtacccgtcctcggccgggtgtctatggacctcaccatcgtcgaccttggcggagtcccgtcatgcaacgagggggattggctggtcgcatcctacgacttgccgcgcgcagcgcgcgaaagcggcctttcgcagtacgaactgcttacggtgctggggcgtagattttcccgccggaattga

SEQ ID NO: 33077 - protein, 356 aa, Novosphingobium aromaticivorans DSM 12444
MTDISLPTTPDLPESSLRLRIDADALASNWRALDAMSGTATAGAAVKADAYGLGAARVSRILVGAGCRDFFVAHWAEVPNLLPHVPAASIAVLHGPMNAAEAAFARATGARPVLNSLSQARLWQETGGGRCHVMVDTGMSRLGLAMSEIADPALADLDVDLCLSHLASADEDVPQNEQQRLRFETVRAAIPARRYSLANSAGIALGAGFHADVTRPGIALYGGIARPEFAGTIRQVARPEAAVIQVRHLQPGDKVGYNAIFTADRPMRVGVLAIGYADGYLRCWTGRGSFLFDGVEVPVLGRVSMDLTIVDLGGVPSCNEGDWLVASYDLPRAARESGLSQYELLTVLGRRFSRRN

SEQ ID NO: 33078 - DNA, 1176 bp, Clostridium thermocellum ATCC 27405
  CDS (1)..(1176)
atgggaatggactataaatttaacagggcatgggccgaggttaatctggacaacattgcccataatgtaaaggaaatcaggcgaattgttgacaagaaagttgagataatgggagtggttaaggctgacgcatacggacatggagtaatggagattgccagaacacttttggaaaacggtgttacccgtctggcggtgtccatgctggatgaagccatacagcttcgtcaaaacggtattaaggttccgatattgatattaagctataccgaccctgtacgggcggaagagattgttttaaacgacgtcacccagacggttttcagccatgatttggcggaagctctgtcggaggcggctgtaaaacaccacagaaatgtaaagattcatatcaagatagataccggtatgacaagggttggatttatgcccggttacagtgcggttaagaatgtggtgcagataagcaagctgccgggcattattattgaaggattgtttacccattttgcatcggcggacgaggctgacaaatcctacacctatatgcagtttgaaaggtttatgagcatagtcggcgaacttaacagaataggggtgtatattcccgtaaagcacgtatgcaacagtgccgcgttgattgagtttcctgaaatgcacctcaacatggtaaggccgggtatagcattgtacggattgtatccttcggatgaggtggataaaaccaaaatcgacttaagaccggccatgtctttaaaggcaaatgtgatacttgtaaaagatgtggaaaaggacacctttatcagctacggaagaatatttaaaacgagccggaacagcaggatagcaactatacccataggatatgccgacggatatacaaggcttcttaccggcaaaggaaaagtacttctgaacggtcagctggctcctattgtgggaagaatttgcatggatcagtgcatggtagacataacggatattgaaggagacgtaaaagtcggagatgaagccgtgcttatcggaaagcagaaagataacgaaataaaagtcgaggacctggcaaaaagtgttgggacaataaattacgaactggtaagcataataggaaagagaattcccagagtttacctgaaagaagggaagatatacaatgtattaaattatttgatataa

SEQ ID NO: 33079 - protein, 391 aa, Clostridium thermocellum ATCC 27405
MGMDYKFNRAWAEVNLDNIAHNVKEIRRIVDKKVEIMGVVKADAYGHGVMEIARTLLENGVTRLAVSMLDEAIQLRQNGIKVPILILSYTDPVRAEEIVLNDVTQTVFSHDLAEALSEAAVKHHRNVKIHIKIDTGMTRVGFMPGYSAVKNVVQISKLPGIIIEGLFTHFASADEADKSYTYMQFERFMSIVGELNRIGVYIPVKHVCNSAALIEFPEMHLNMVRPGIALYGLYPSDEVDKTKIDLRPAMSLKANVILVKDVEKDTFISYGRIFKTSRNSRIATIPIGYADGYTRLLTGKGKVLLNGQLAPIVGRICMDQCMVDITDIEGDVKVGDEAVLIGKQKDNEIKVEDLAKSVGTINYELVSIIGKRIPRVYLKEGKIYNVLNYLI

SEQ ID NO: 33080 - DNA, 1230 bp, Microbulbifer degradans 2-40
  CDS (1)..(1230)
atgacggtgtgccttttattgtttgcgctaaagcgtcggtggcgttggtttggctttaggctgtatgctaacgcccttgttttatttttaataactccagtagatattgcagcccctatgaccgcgttttccggtaagttaacaattaacctcgatgctatcgccgcgaactggcgacttattcaaagccgccttgccgctggtgcacgcgcgggggcggtagtaaaggccgatgcatacggcttgggggtgcaagaggttgcccctgctctttatcgcgcgggttgccgagatttttttgtggctaaccttgcggaggcattactggttcgctcgctgctggcgggtgatgctcaggttatagttttgtctggctgtgcgccgcgcgaagagagtgagtttgtgcgcaatggcatagtgcctgtaattacctccgcgactatggccgagcgatggctaggggtgaaaggtgcatccaagtgtggcgcagtgctaaaagttaactctggtatggggcgcttggggttagagccaaacgagtttgaatccctgctgatgcaccctaatttcgccaatgctgggttctttatgcttatgagccatctcgcgtgcgcagatcaatttgatcacccattaaatgcagcgcaattacagcggtttgagcgcatgaggcaggcctttttgaaaaaagtgcctgccgccacggccagccttgcgaactcatctggcatatttatttctccttcctttcattacgatgtggcgcggccaggggttgcgctctacggcggcaacccgctgcagaggcggcaaaaccctatgcgaaaagtggtagatttgcggctgccggtattacaggtgcgtcatctcgcatcaggtgaggctgttggttatggcgcgagttttatcacgcagcgccccagcgtgttacttacgcttgctggcggctatgccgatggtctgtttcgttctgcggcggcgggtggcgtggtttacttgggagaaaagcctttgcccattgtgggccgtgtatcgatggattcaattgtggtggatgcaacggatgtacctcaagccgcgatgcctgcagaagggaatatgttggagcttctaggcgataacgtcggcgtggatgaccttgcggcggctgcaggcactatcggttacgaaatacttacctcgttgggtggccgctacaggcgcgaatatatcggaggcgccaatgactga

SEQ ID NO: 33081 - protein, 409 aa, Microbulbifer degradans 2-40
MTVCLLLFALKRRWRWFGFRLYANALVLFLITPVDIAAPMTAFSGKLTINLDAIAANWRLIQSRLAAGARAGAVVKADAYGLGVQEVAPALYRAGCRDFFVANLAEALLVRSLLAGDAQVIVLSGCAPREESEFVRNGIVPVITSATMAERWLGVKGASKCGAVLKVNSGMGRLGLEPNEFESLLMHPNFANAGFFMLMSHLACADQFDHPLNAAQLQRFERMRQAFLKKVPAATASLANSSGIFISPSFHYDVARPGVALYGGNPLQRRQNPMRKVVDLRLPVLQVRHLASGEAVGYGASFITQRPSVLLTLAGGYADGLFRSAAAGGVVYLGEKPLPIVGRVSMDSIVVDATDVPQAAMPAEGNMLELLGDNVGVDDLAAAAGTIGYEILTSLGGRYRREYIGGAND

SEQ ID NO: 33082 - DNA, 1161 bp, Oenococcus oeni PSU-1
  CDS (1)..(1161)
atggtaacagcgattcatagaccaacttgggtcagcgtcgatttagacgcagccgcacataatttacaagagattagagagtggacaaaagcaaaaaaggtatatgcagtcttaaaggcggatggttatggtttgggagccattccgttagcaaaagcttttcaggaaacagcttctgcagatgctctgattgtttctaatttggatgaggcacttgaacttcgtcaggctgatttgactttgccgatttgggtacttggagcttgggattattctgatttaaaactttttattgaccatgatattgtcattactattccaagtcttgcttggctgcagaacttgcctgattttgaggggaccttaaaagtcagtcttgcgatcgatactggaatgacacgaattggttttgataaagctgacgaaatttcagctgccaaaaaaattatcgataaaaatcctcaactggatttattttctgtttatactcattttgctacagcggatgaagctggtgaaaagagcaaagcttattttgaagaacagctccggcgttggcaggaattaaccattaatcaaggattcgacccttcattatttagtatggccaattcggccacttgtatctggcatcacgacgacccaagaatatcttttgcagcaattcgtcctggccaattgatttctggtgttaatgtaagtaacggtgaacttaaaatgccaccgaatttgcatttggaaagaattttttctgtttgttcggagatcgccgatgttcgttttgttaaaaaagatcaatctttgagttatggcgccagcgaaagaatgcctgaagatggttacgttgctacattacctttcggatacaatgatggttggttgagacgaatgcaaaagagttctgtaattattaatggaaagagaatgccgattatcggccgcattacaatggaccagacaatggttaaattggatcgtaaatatccaattggtacgcgggttactttaatcgggaaagatggtggcgaacaaatcactgtcgaggaagttgctaattattcgcatacaatcgttgatgaaattcagacgactctggcacctcggatcaaaaggatttatactggcgacttagccgaagtaatcggtgcaaattatggttag

SEQ ID NO: 33083 - protein, 386 aa, Oenococcus oeni PSU-1
MVTAIHRPTWVSVDLDAAAHNLQEIREWTKAKKVYAVLKADGYGLGAIPLAKAFQETASADALIVSNLDEALELRQADLTLPIWVLGAWDYSDLKLFIDHDIVITIPSLAWLQNLPDFEGTLKVSLAIDTGMTRIGFDKADEISAAKKIIDKNPQLDLFSVYTHFATADEAGEKSKAYFEEQLRRWQELTINQGFDPSLFSMANSATCIWHHDDPRISFAAIRPGQLISGVNVSNGELKMPPNLHLERIFSVCSEIADVRFVKKDQSLSYGASERMPEDGYVATLPFGYNDGWLRRMQKSSVIINGKRMPIIGRITMDQTMVKLDRKYPIGTRVTLIGKDGGEQITVEEVANYSHTIVDEIQTTLAPRIKRIYTGDLAEVIGANYG

SEQ ID NO: 33084 - DNA, 1116 bp, Oenococcus oeni PSU-1
  CDS (1)..(1116)
atggtagaagctattcatcgatcaacgcgtatagaattttctaaatcatcattagcgtataacgttcaatataccaaacaggtctccggtgccaagacgctttggctggctgttaagtccaatgcatatggacacggtctgcttcaggtatctaaaatagccagagaatgtggtgtagatggtttggccgtatctgttcttgacgagggaattgcgattcgccaagccggaattgatgattttattttgatcttgggtccaattgatgtcaagtacgcaccaattgcttccaagtaccattttttaacaactgtctcttcactggattggttaaaatctgccgataagattctcggtaaggaaaaactttctgtaaatttggctgtcgataccggaatgaatcggattggcgttcgttcaaaaaaagatttaaaggatgaaatcgaatttttgcaggaacattccgatcacttctcttatgatggaatttttactcattttgccagttccgacaatcctgacgatcattactttcaaaggcaaaaaaatcgttggtatgagctaattgacggactaataatgccacgctatgttcatgtcatgaattccggagctgctatgtaccattcaaaagaattacctggatgcaattcgattgcccgtgtcggaacagttgtttatggtgttgaaccttccgaaggtgtattggggccgattgataaactaaaaccggtttttgaacttaaatctgccttaacatttgttaaaaaaattcctgccggtgaaggaataagttatggatcgaagtttgtaacaagcagggatacttggatcggtactcttccaattggctatggcgacggctggcttgcggaataccaggattttcagcttttaattgatggccaaaaatgtcgacaggtcggtcaaatagcgatggaccaaatgatggtggctttgccgcatgaatatccgattggaacagaagtaactttaattggaaaaagtggaaagtatgaaaatactctttacgatcttcataaacattccggagttccgccgtggaaaattacagtcgctttttctgatcgattaaaaaggatggtggtcgattaa

SEQ ID NO: 33085 - protein, 371 aa, Oenococcus oeni PSU-1
MVEAIHRSTRIEFSKSSLAYNVQYTKQVSGAKTLWLAVKSNAYGHGLLQVSKIARECGVDGLAVSVLDEGIAIRQAGIDDFILILGPIDVKYAPIASKYHFLTTVSSLDWLKSADKILGKEKLSVNLAVDTGMNRIGVRSKKDLKDEIEFLQEHSDHFSYDGIFTHFASSDNPDDHYFQRQKNRWYELIDGLIMPRYVHVMNSGAAMYHSKELPGCNSIARVGTVVYGVEPSEGVLGPIDKLKPVFELKSALTFVKKIPAGEGISYGSKFVTSRDTWIGTLPIGYGDGWLAEYQDFQLLIDGQKCRQVGQIAMDQMMVALPHEYPIGTEVTLIGKSGKYENTLYDLHKHSGVPPWKITVAFSDRLKRMVVD

SEQ ID NO: 33086 - DNA, 1125 bp, Pediococcus pentosaceus ATCC 25745
  CDS (1)..(1125)
atggttgtagggatacatcgtcccagcaagctagttattaatgctgaggcaattagaaataatgtaaaaaatgagattagtcgattagatggacacagtgaattatttgccgtggttaaggctaatggctatggacatggaattgtagaaacagcccaatttacgaaacaagctggggcaactggtttttgtgttgctatcttagacgaagcgttggctttgcgagatgctgggctaacagaaactatcctagttttaggaattacagatgttaaatatgctaaattagctgctgaaaatgatatctcgttaacggtgggtgatcaagcatggctagatgaagctacgcaaattctaaatcaaaagccgctgaaagttcatttaggtattgatacaggaatgggacggattggttttcaagatggagcttcttttaagaaagcggccgattatcttgaacaaagtcaacagttcaattttgaaggtgtgtttacacattttgcaacagcagatgaaaaggatacgacttatttcaatttacaggtggaacgttttaaccatttcatcagccaattaactcgacgtccacgttatgtgcatgtttctaatactgctaccagcttgtggcatgcagcttgcaatggtaatatgattcgttttggagtcggcatttatgggatgaatccttctggaaaaacactggaaagtccttttgatttacagccagctatgagtctggagtctgaactatctttttctaaactagtgcaaaaaggccgttcaattagttatggagcgacttatacagctgaagaagatgaatggattgggacgatcccgattggttatgcagatggttatgaacgtcgtttacaaggattccatgttttgattgatggtcaattttgcgaaatagtaggacgaatttgtatggatcaaatgatggttcgcttaccaaagtcatatcctgtgggaactaaagtaattttagcgggaaaatcaggcgaaaaatcaattaccatgacagacattgccgaatatgctgggaccattaattatgaaatcacatgtggattcacacaacgtttaccacgaatctatactgaaaatggtgtagtaaattaa

SEQ ID NO: 33087 - protein, 374 aa, Pediococcus pentosaceus ATCC 25745
MVVGIHRPSKLVINAEAIRNNVKNEISRLDGHSELFAVVKANGYGHGIVETAQFTKQAGATGFCVAILDEALALRDAGLTETILVLGITDVKYAKLAAENDISLTVGDQAWLDEATQILNQKPLKVHLGIDTGMGRIGFQDGASFKKAADYLEQSQQFNFEGVFTHFATADEKDTTYFNLQVERFNHFISQLTRRPRYVHVSNTATSLWHAACNGNMIRFGVGIYGMNPSGKTLESPFDLQPAMSLESELSFSKLVQKGRSISYGATYTAEEDEWIGTIPIGYADGYERRLQGFHVLIDGQFCEIVGRICMDQMMVRLPKSYPVGTKVILAGKSGEKSITMTDIAEYAGTINYEITCGFTQRLPRIYTENGVVN

SEQ ID NO: 33088 - DNA, 1188 bp, Trichodesmium erythraeum IMS101
  CDS (1)..(1188)
atgttgagtagagaaaagacttcttttaagactctagcactagaaagtgatgcttatggaggtatttgtcaaagagcatgggtagaaattaatgatcgggcattgagctataatgtccaacaacttaagagtcttttatcagctaaaactcaactaatgggagtagtaaaggcagatgcttatggacatggagcgtctaagatctctaaaactattttagaagctggtgtagataggttggcagtagccacactgccagagggaatagaattaaggttagctggaattaaaccaccaattttaattttaggagcaatagaccgacctgaacaaattcgggcgatcgctcactggcaactagaaccaactatttgtacacctcaacaagctttagttttttcagaaactctttcctaccaaactgaaccaatgctagtacatcttaagttggatacaggaatgtctcgtttgggaacaccttggcaacaggcggtagaatttgtaaaatttgtgcaggggttaccaaatttaaaaattgctagtatttattcccacttagcgacggcggataacttagaccaaacggtgatgaagcagcagcatcaaaggtttgaggaagcaataggtctttgtggtattggtggaaaaagtttttctagtgatatacaacttcatttagctaattcggcggcgacgttaactgaccctgctttacactacgatatggtacgagtaggtttagctatttatggcctgtatccggcacctcatctacaggataaaattaatttaaagcctgttatgcaagtaaaagctagggtgacacaagtcaaaactattgaagctggtactggtgtgagttatggttatcagtttattgctccaaaacagatgcgtttggcagtggtgggtattggttatgctgacggtttacctcgtaacctttctaataggatgaaagtcattgtacgcgatcgactaattcctcaagtaggagctattactatggatcagttgatgttagatgtaagtgctattcctgatctagaaacgggtgaagtggtaactttgttagggcaagttggtaaacatcaaatttctgctgaaaactgggcaaatactctaggaactatttcttgggaaattctttgtggttttaaaaataggttgcctcgggtagcagtttag

SEQ ID NO: 33089 - protein, 395 aa, Trichodesmium erythraeum IMS101
MLSREKTSFKTLALESDAYGGICQRAWVEINDRALSYNVQQLKSLLSAKTQLMGVVKADAYGHGASKISKTILEAGVDRLAVATLPEGIELRLAGIKPPILILGAIDRPEQIRAIAHWQLEPTICTPQQALVFSETLSYQTEPMLVHLKLDTGMSRLGTPWQQAVEFVKFVQGLPNLKIASIYSHLATADNLDQTVMKQQHQRFEEAIGLCGIGGKSFSSDIQLHLANSAATLTDPALHYDMVRVGLAIYGLYPAPHLQDKINLKPVMQVKARVTQVKTIEAGTGVSYGYQFIAPKQMRLAVVGIGYADGLPRNLSNRMKVIVRDRLIPQVGAITMDQLMLDVSAIPDLETGEVVTLLGQVGKHQISAENWANTLGTISWEILCGFKNRLPRVAV

SEQ ID NO: 33090 - DNA, 1230 bp, Moorella thermoacetica ATCC 39073
  CDS (1)..(1230)
atggacctggcaaagctgacggaactggccggaccccgctggatcaccattgaagcgacagccctggcccacaacctcaaagccgttaaagctttactcgctccctcgacccgcctcctggccgttatcaaggccgacgcctacggcgccggcgccgtagaggtggcgcgcatcttcctggacgcaggggcggattacctgggggtaaccaccctggccgaggggctggagttgcgccgggccggcattgcagcccccgttctcctcatgagtcccctcctgccggaagagctaccggcagccatagctgccgggctcaccctaactgtgagcagccgttccggcgccgaggcgattgctgccgcggcggcagcgaccgggcaccgggcccgggtacacctgaaagtagagaccgggttgcagcggacaggcctggaagcggcagcagtagcgcccctggcgcgggagatcctcacctggcccggcgtagaactggagggcgtctacagccatctggccgaggccgcccggccggcggcagcccggcggcagatggcctgttttcagcaggtcctcgccgaactggaggaggagcatatagctatccccttgaggcatatctgcaacagcaccggtctccttacccacccggagatgcatctggacatggtcagaacaggcaccctcctctacggccagttcccctaccaggccccccgccggggactggcattaaaagacccctggcagtttaaagcccgtatcctctttattcacgacgtagccgccggtaccccggtgggttacggcggtgactacgttgtgaaaaaagccacccgcctggccgtcatcccggtgggttatgccgacggttttgccctgacggccgttgcccggccgaaaaacctgaacgacctggcccgctacctggtcaagacattcctcgcctacctgggtcggggcgggggcgaagggaccaccgtgatcataggcggccggacggcacctgtggtaggccgggtggggatgcaactctccatggtcgatgtcggccacctgcctgaggtagaggtgggccaaatagtaactctggatatacgccgcccgacagccagcagccgtctaccccgggtctactgccgggagggacacccctacctggtgcggactaccaccggagaactcctgccggtggacgcaccgcacctttccccgggagttaatagttaa

SEQ ID NO: 33091 - protein, 409 aa, Moorella thermoacetica ATCC 39073
MDLAKLTELAGPRWITIEATALAHNLKAVKALLAPSTRLLAVIKADAYGAGAVEVARIFLDAGADYLGVTTLAEGLELRRAGIAAPVLLMSPLLPEELPAAIAAGLTLTVSSRSGAEAIAAAAAATGHRARVHLKVETGLQRTGLEAAAVAPLAREILTWPGVELEGVYSHLAEAARPAAARRQMACFQQVLAELEEEHIAIPLRHICNSTGLLTHPEMHLDMVRTGTLLYGQFPYQAPRRGLALKDPWQFKARILFIHDVAAGTPVGYGGDYVVKKATRLAVIPVGYADGFALTAVARPKNLNDLARYLVKTFLAYLGRGGGEGTTVIIGGRTAPVVGRVGMQLSMVDVGHLPEVEVGQIVTLDIRRPTASSRLPRVYCREGHPYLVRTTTGELLPVDAPHLSPGVNS

SEQ ID NO: 33092 - DNA, 1122 bp, Moorella thermoacetica ATCC 39073
  CDS (1)..(1122)
ttgtcgcggccggtttgggccgagattgacctggaagcagtggcccgcaatgtccgggccattaaaaagatactggcgccgcaaacagaaattatggccatcgttaaagccaatgcctacggccacggggccgggccggtggccaggacagccctggctaacggcgtcagctggctgggtgtagctaccctgggtgaagccctggacctgcggcgggaaggaattactgccccgcttcttattttgggctataccccgccggaggatgccgggcgggtggtagaggccgatatttcccagacggtcttcagcgttgaccaggcccgggccctgaacgccgccgccgccgctgtaggtaccagggcccgcctgcatttaaagatcgataccggtatgggccggctgggttttctgccccgggaggcggtgactgcggcccgggctatagcggatctgccccatgtcaccctggaaggtattttcacccactttgccgcgtccgatgccgctgataagacctacacccagcggcagctgggcttatttcaacaagtgattgccgaactggagaaacagggcataacctttccctggcgccatgcagccaacagcggggccatcatcgatctccccgggacccactttaacctggtccgcgccgggattatcctttatggccactatccctcgccggaggtccagcggaagaggctggcgttaacgccggtgatgacgctaaaaaccagggtagtcctggtaaaggaggtgccggccgggtcgtatatcagctatggctgcacctaccgcacccccggtccggccaggattgccaccctcccggtgggttatgccgacggctattcccgtctcctttccaaccgggccgaggtcctggtccgcggtcgccgggcaccgatcgtcggccgtatctgtatggaccagtgcatgatagatgttacagctataccggaagtccgggttggtgatgaagtagtcctcttcggtcgccagggaggacagactctgacggtagaagaggtggcggcctggatggggaccattaactacgaaatcctgtgcctgatatccaagcgcgtgccacgtgtatatcttcatagttaa

SEQ ID NO: 33093 - protein, 373 aa, Moorella thermoacetica ATCC 39073
MSRPVWAEIDLEAVARNVRAIKKILAPQTEIMAIVKANAYGHGAGPVARTALANGVSWLGVATLGEALDLRREGITAPLLILGYTPPEDAGRVVEADISQTVFSVDQARALNAAAAAVGTRARLHLKIDTGMGRLGFLPREAVTAARAIADLPHVTLEGIFTHFAASDAADKTYTQRQLGLFQQVIAELEKQGITFPWRHAANSGAIIDLPGTHFNLVRAGIILYGHYPSPEVQRKRLALTPVMTLKTRVVLVKEVPAGSYISYGCTYRTPGPARIATLPVGYADGYSRLLSNRAEVLVRGRRAPIVGRICMDQCMIDVTAIPEVRVGDEVVLFGRQGGQTLTVEEVAAWMGTINYEILCLISKRVPRVYLHS

SEQ ID NO: 33094 - DNA, 1104 bp, Thiobacillus denitrificans ATCC 25259
  CDS (1)..(1104)
atgcgtccgatcaaagcgtcgatctcggcggacgcgatggcccacaaccttcgcgtcgcacggcgtcacgccggcgccgcgcgggtgttcgccgtagtgaaggcgaacgcctacggtcacggtctgtcgcgcgcgttgcgcgccttcggggcggccgacggcttcgcggtgctgacgctcgaggaagcggcgagcctgcggcagatgggtgtcgacaagccgatcctgctgctcgagggcatcttcgacgccggcgagattgcggcttgcgccgaactcgatctctggccggtattgcatcatgcccggcagctcgactggctcgagcaacagcgaccggcgcgcgcgctcgaggtgtttctcaaattcgacagcgggatgcatcgccttggttttccgcttgccgaacacgctgaggtcgtcgcgcgggttcgagccctggcgggcgttgcgcgtgtcacgctgatgacgcactttgcgcaggccgacgacagcgccggtgtcgcctggcagttgcagccgtttcgggaagcgctcgacggccatggcctgccgtggagcagcgcgaattcggcggcgctcatgcgctatccagagacggtcggcgactgggtgcgtccgggcatcatgctgtacggcgcctcgccgtttaccgacgtccccgccagcgggctcggcctcgagcccgcgatgacgctgcgctccgaaatcatcgcggtgcagacgctcgcggccggcgaaggcatcggctacggccagacttttcgtgccgacaagccgatgcgcgccggcgtcgtcgcctgcggctacgccgacggctatccgcgtcatgcgccgaccggcacaccggtcgtcgtcgacggccgacgcacccggacgctcggccgcgtgtcgatggatatgctctgcgtcgacctcagcgaatgtccggccgcgggggtcggaagcgcggtggtgttgtggggcgacggattgccggtcgacgacgtcgccgcggccgccggcacgagcagctacgaattgctgtgcgcgctcgcgccgagagtgccgatcgaggaagtcggcagaaatcaggaagcgggcaggggcttcggcaacgagtga

SEQ ID NO: 33095 - protein, 367 aa, Thiobacillus denitrificans ATCC 25259
MRPIKASISADAMAHNLRVARRHAGAARVFAVVKANAYGHGLSRALRAFGAADGFAVLTLEEAASLRQMGVDKPILLLEGIFDAGEIAACAELDLWPVLHHARQLDWLEQQRPARALEVFLKFDSGMHRLGFPLAEHAEVVARVRALAGVARVTLMTHFAQADDSAGVAWQLQPFREALDGHGLPWSSANSAALMRYPETVGDWVRPGIMLYGASPFTDVPASGLGLEPAMTLRSEIIAVQTLAAGEGIGYGQTFRADKPMRAGVVACGYADGYPRHAPTGTPVVVDGRRTRTLGRVSMDMLCVDLSECPAAGVGSAVVLWGDGLPVDDVAAAAGTSSYELLCALAPRVPIEEVGRNQEAGRGFGNE

SEQ ID NO: 33096 - DNA, 1038 bp, Silicibacter sp. TM1040
  CDS (1)..(1038)
atgagtacggcacgtttaaaaatcaatctggatgcgctggcgatcaactggcgcaatctggatgccaagaccaactgcgagaccgcagcggtggtcaaggccaatggctatggtctggaatccggccgcgtcggcaaggcgctggcacaggcaggcgcgcgcaatttctttgtcgccatcgccgaagaaggcattgcgctcaggcgcgcgcttggacccggcccgggtatttcggtctttgcaggtcatatggagggcgacgcaaaactcctgcgtgacttccagctgacgccgatgctcaactcgctggatcagatgctgcgccatttcgagagcctgccgggccacccctttggcgtccagctcgacagcggcatgaaccggcttggcatggaggccgccgaatggatggccgtgcgcgacatcgccctcgatcaaaaccccgtcctcttgatgtcgcatctggcctgctcggacgagccgggccacggcatgaacgcatatcagctcaagaatttcatcgagatgaccgaggggctcaatatcccccgctcgctcgcggccactggcggccttctgctggggcgcgactaccactttgatctctgccgtcccggcatcgggctttatgggggcgcaccctacgccgatgcgctgcccgtggtcgagcttgaggtgccggtgattcaggtgcgcgacctcgccccgggcgagagcgtcggctacggcaacacctggattgcgcagcgcgacagcaagatcgccaccattgccggcggctatgccgacgggctgcaccgggcgttccagcgacaggggatcatggcttatgcgggcggcaccccctgccccgtggtgggtcggatctcgatggatctcatcaccgtcgatgtcaccgacctggccgaagtgccgccctacctgagcctcatgaatgagacgcagaccgtggatgtgctggcaaacgccgctgataccatcggctatgaggtcctgacctcgctcggcaaccgctatgcgaggacctacagcgcatga

SEQ ID NO: 33097 - protein, 345 aa, Silicibacter sp. TM1040
MSTARLKINLDALAINWRNLDAKTNCETAAVVKANGYGLESGRVGKALAQAGARNFFVAIAEEGIALRRALGPGPGISVFAGHMEGDAKLLRDFQLTPMLNSLDQMLRHFESLPGHPFGVQLDSGMNRLGMEAAEWMAVRDIALDQNPVLLMSHLACSDEPGHGMNAYQLKNFIEMTEGLNIPRSLAATGGLLLGRDYHFDLCRPGIGLYGGAPYADALPVVELEVPVIQVRDLAPGESVGYGNTWIAQRDSKIATIAGGYADGLHRAFQRQGIMAYAGGTPCPVVGRISMDLITVDVTDLAEVPPYLSLMNETQTVDVLANAADTIGYEVLTSLGNRYARTYSA

SEQ ID NO: 33098 - DNA, 1095 bp, Polaromonas sp. JS666
  CDS (1)..(1095)
atgccacgtcccatccttgccaccatccaccgaccggcgctcgcccacaacctcgcgcgcgcccgcagcgccgcgcctgacgcccgggtctgggcggtcgtcaaggccaatgcctacggccatggcattgaacacgtctttgacggcctgcgcagtgccgacggatttgcgctgctggatctggcggaggcgcggcgcctgcgcgcgctcgactggcgcggccccatcctgctgctggaaggctgcttcgaggcgcgcgacctggagttgtgttcgcgcctgagcctgtggcatgtcatccattgcaacgagcagatcgacatgctggccgcgcacaagacccaggttccgcatcgcgtgttcctgaaaatgaactccggcatgaaccgcctgggcttgcggcccgagcgctttcgcgccgcctggacgcgtctgaatgcgctgccgcaggttgacgagatttcgctgatgacgcatttctcggacgccgacggcccgaagggcatcgcggcgcaactccgcgcatttgatgccgtgacgcatgacctgcccggcgagcgctcgttgagcaacagcgcgggtgtgctgcgccatggcgatgaactggcggcccgctccgactgggtgcggcccggcattgtggtctacggcagtgcgcccgacttcccggagcacagcgccgccgactgggggctgcagccgaccatgacgctgtcgtcccgcatcattggcgtgcaggagctggcggccggcgacacggtgggctatggctccagtttcaccgccgatggcccgctgcgcatcggtgtggtcgcctgcggttatgccgacggctacccgcgccactgcagcacgggcacgccggtgctggtaaacggcgtgcgcactcgcatggtcgggcgcgtcagcatggacatgatcacggtcgacctgacgccggtaccggacgccgggatgggggcggaggtgaccttgtggggccggtcttcgggcggtgccgtgctgcccattgacgaagtggcgcaaaccgccggaaccgtggggtatgagctgatgtgcgcggtggcgccgcgcgttccggtgatgactgagtga

SEQ ID NO: 33099 - protein, 364 aa, Polaromonas sp. JS666
MPRPILATIHRPALAHNLARARSAAPDARVWAVVKANAYGHGIEHVFDGLRSADGFALLDLAEARRLRALDWRGPILLLEGCFEARDLELCSRLSLWHVIHCNEQIDMLAAHKTQVPHRVFLKMNSGMNRLGLRPERFRAAWTRLNALPQVDEISLMTHFSDADGPKGIAAQLRAFDAVTHDLPGERSLSNSAGVLRHGDELAARSDWVRPGIVVYGSAPDFPEHSAADWGLQPTMTLSSRIIGVQELAAGDTVGYGSSFTADGPLRIGVVACGYADGYPRHCSTGTPVLVNGVRTRMVGRVSMDMITVDLTPVPDAGMGAEVTLWGRSSGGAVLPIDEVAQTAGTVGYELMCAVAPRVPVMTE

SEQ ID NO: 33100 - DNA, 1083 bp, Thermus thermophilus HB8
  CDS (1)..(1083): transl_table=11
gtgcgcccgggcgggtatcctaaaggggtgcaggcccgggcctgggtggaggtggacctcgccgccctctgggcgaactaccggcttctcgccgggcgggcgggaggggaggtgatccccgtgctcaaggcggacgcctacggccacggggcccttcccctcgcccgcttcctggagggaaagggcgtggggcgcttcgccgtggccaccctggaggaggggaggcgcctccgggaagggggcatcaagggggaggtcctccttctcggaagcctccaccccctggaggcggaggaggccttgaggcttggcctcgtgcccaccctctccaacctggaggcggcggaggccctttcccagagggcccgcgccctgggccttgtgccccgggcccacctcaaggtggatacgggcatgaaccgggtgggctttccctcggaggaggcggtctcggccctgcgggcggtggaggccctgggggtgagggtggagggcgtctacacccacctcgccaccgccggggaggacgcggccttcgtggagacgcagcggcgccgcttccaggaggtgcgccgcgccttgggggaggggtacttctaccacctggagaactccctgggcctcctccgccacggggccacggcgggggtgcgggtggggctcgccctctacggcctcgtccccggctttggcctcaggcccatcctccggatcctcgcccggcccaccctggtgaagcgcctgaaggcgggggaccgggtggggtacgggggggtctatgtggcccggggcggggagtggctcgccaccctgcccgtggggtacgccgacgggcttccctggggggcggtgcggttcgtgaaggggccggacgggcgccttctggaggtggcgggccggatctccatggaccagaccaccgtcctcctccccggccccgtgggcctcgaggccgtgtttgaggtgctctcggccgacttcggccccacgggcctcctcgcctgggccgaggcccggggcaccctcccttatgaggtggccgtccacctttcccggaggcttccccgccgctacctggagtag

SEQ ID NO: 33101 - protein, 360 aa, Thermus thermophilus HB8
MRPGGYPKGVQARAWVEVDLAALWANYRLLAGRAGGEVIPVLKADAYGHGALPLARFLEGKGVGRFAVATLEEGRRLREGGIKGEVLLLGSLHPLEAEEALRLGLVPTLSNLEAAEALSQRARALGLVPRAHLKVDTGMNRVGFPSEEAVSALRAVEALGVRVEGVYTHLATAGEDAAFVETQRRRFQEVRRALGEGYFYHLENSLGLLRHGATAGVRVGLALYGLVPGFGLRPILRILARPTLVKRLKAGDRVGYGGVYVARGGEWLATLPVGYADGLPWGAVRFVKGPDGRLLEVAGRISMDQTTVLLPGPVGLEAVFEVLSADFGPTGLLAWAEARGTLPYEVAVHLSRRLPRRYLE

SEQ ID NO: 33102 - DNA, 1233 bp, Bacillus clausii
  CDS (1)..(1233)
atggatcgaacggcactccctttctttagggatacatgggttgaggttgatttgaatgcaatttcgagcaatgtttcgtcgctagcgcgcttttataaaagccaaggccacaatgtcgccattatggcagttgtgaaagcgaacgcctatggccatggggctatagccgttgctaaggaggcgcttgccgctggagcgacctttcttggtgttgctttattagacgaggcattggaactaagaaaggcaggcattcaggcgccgatccttgtccttggtaaaacacgcccagaaaatgcagagcttgcccggtctgaggggatttcggtaactgtatttgagcaagaatggctagaagaggctacacggtttctggcaaaatcaccgaacgatccactccgtatccatgtcaaaatggacacgggcatgggccgcctaggccaacaaacggttgaaaacacgatggcggttgtctgtgctgcgcaaaaaatcggtgttgttgaagggctgtttacccattttgccactgctgacgagctcgatcatacgtattaccgaaaacagcaagaacggtttgcggcatgtgttgacaaattggaagaagcaaacgtttcgattccgttcatccacactggcaatagtgcagcaagcatgcgctatccaggcgatatgtacaatatggtacgtttcggcatttccatgtatgggctcaccccttcagtagaaataaaacaagcactgccatttaagcttattccagctttatcgctaaaaacaaaaactgttttcacgaagcttattcaaaaaggggacgctgtcagttacggagctacttatcaagcagaagcaccgacatggattgcgacgttgccaattggctatgctgatggctgggcaaggcaaaacagcacgaaaggcgggtatgcactcgtcaatgggcaaaaagcgcgctttgcagggagaatctgtatggaccaatgcatgattgaactttctgagccagtgccaaatggtacaacagttactcttgttggcaaagacggccaagagcaaattgagcttgatgacgtcgcgaagcggcttgatacgattaattatgaagctgcctgtatgctcaatcctcgcttgccccgtatttacgtaaaaaacggcaaatatcaatctgtgcaaatagaatcaagggttatgcataaaatagaagagcaagggaaaaatgaccaacagaatggataa

SEQ ID NO: 33103 - protein, 410 aa, Bacillus clausii
MDRTALPFFRDTWVEVDLNAISSNVSSLARFYKSQGHNVAIMAVVKANAYGHGAIAVAKEALAAGATFLGVALLDEALELRKAGIQAPILVLGKTRPENAELARSEGISVTVFEQEWLEEATRFLAKSPNDPLRIHVKMDTGMGRLGQQTVENTMAVVCAAQKIGVVEGLFTHFATADELDHTYYRKQQERFAACVDKLEEANVSIPFIHTGNSAASMRYPGDMYNMVRFGISMYGLTPSVEIKQALPFKLIPALSLKTKTVFTKLIQKGDAVSYGATYQAEAPTWIATLPIGYADGWARQNSTKGGYALVNGQKARFAGRICMDQCMIELSEPVPNGTTVTLVGKDGQEQIELDDVAKRLDTINYEAACMLNPRLPRIYVKNGKYQSVQIESRVMHKIEEQGKNDQQNG

SEQ ID NO: 33104 - DNA, 1137 bp, Streptomyces lavendulae subsp
  CDS (1)..(1137): transl_table=11
atgaacgagacaccgacgcgcgtgtacgccgagatcgatcttgacgcggtacgggcgaacgtgcgcgcactgcgcgcacgggcgccgcggtccgcgctgatggccgtcgtcaagtcgaacgcctacgggcacggggccgtcccgtgtgcccgcgcggcccaggaggccggggccgcctggctgggcaccgccacccccgaggaggcgctggagctgcgcgccgccgggatccagggccggatcatgtgctggctgtggacccccggcgggccctggcgggaggccatcgagaccgacatcgacgtctccgtcagcgggatgtgggcgctggacgaggtccgcgcggccgcccgcgcggccggccgtaccgcccggatccagctcaaggccgacaccggcctcggccgcaacggctgccagcccgccgactgggccgagctcgtcggcgcggccgtcgccgcgcaggccgagggcaccgtccaggtcaccggcgtttggtcgcacttcgcctgcgccgacgagccgggccacccctccatccggctccagctcgacgccttccgcgacatgctggcctacgcggagaaggagggcgtcgaccccgaggtccggcacatcgccaactcgcccgcgaccctcaccctccccgagacccacttcgacctcgtccgcaccggcctggccgtctacggcgtctcgccgtcccccgagctcggcacccccgcccagctgggcctgcggcccgcgatgaccctcagggcctccctcgcgctggtcaagaccgtccccgccggccacggcgtgagctacggccaccactacgtcaccgagtccgagacgcacctcgcgctcgtgcccgccggctacgccgacggcatcccgcgcaacgcctccggccgcgggcccgtgctcgtcgccgggaagatccggcgggccgccgggcggatcgccatggaccagttcgtcgtggacctcggcgaggacctcgccgaggcgggcgacgaggccgtcatcctcggtgacgccgagcgcggcgagcccaccgccgaggactgggctcaagcggcgcacacgatcgcgtatgagatcgtcacccgtatcggaggtcgggtgccccgggtctacctcggcggctga

SEQ ID NO: 33105 - protein, 378 aa, Streptomyces lavendulae subsp
MNETPTRVYAEIDLDAVRANVRALRARAPRSALMAVVKSNAYGHGAVPCARAAQEAGAAWLGTATPEEALELRAAGIQGRIMCWLWTPGGPWREAIETDIDVSVSGMWALDEVRAAARAAGRTARIQLKADTGLGRNGCQPADWAELVGAAVAAQAEGTVQVTGVWSHFACADEPGHPSIRLQLDAFRDMLAYAEKEGVDPEVRHIANSPATLTLPETHFDLVRTGLAVYGVSPSPELGTPAQLGLRPAMTLRASLALVKTVPAGHGVSYGHHYVTESETHLALVPAGYADGIPRNASGRGPVLVAGKIRRAAGRIAMDQFVVDLGEDLAEAGDEAVILGDAERGEPTAEDWAQAAHTIAYEIVTRIGGRVPRVYLGG

SEQ ID NO: 33106 - DNA, 1152 bp, Clostridium innocuum
  CDS (1)..(1152): transl_table=11
gtggaaaatgtgctgaagagcaatacgccgtcctggctggaaattgatctgaccaggatctcacataacataaaggaagtacagaagctgattccctctacaagcaagattatggcaatcgtcaaagcgaacggctatgggcacggcgatgtggaatgctcccgaatgatggaacagcaggggattgacttttttggagtaagcagtgttgacgaaggcgttcgactgcgtgaaaacggcatccaaagtccgattctggtgctggggtatacgccgcctgttcattttcattatttgaacgaggcttccctgatccaaacgctggtatcaaaggagtatgcagaaaagctgaacgcatatgctaaagagcagaatgttgttgtcaaagcacatgccaaggtgaataccggtatgtccagaatcggtatttcgcacaggatcatgcatatcatatcgaggatatcaaaagcgcttgtacgtctgaagcatctgaatgtctcgggtattttctcccacttcagtgtcagtgactgtctggatgaggaaaattgtgccttcaccaatcaccagattgcgttgtttgaacgtgttctggcggatttgcgtccagaaggattgaccccggtacaacgcatctgcagacagctatggaattttaaattatccgaacctgcattagattatgtacgtccgggtctattatggatgggagttccagcgatgatgcactggcaattcgcacggcaccgcagtttcagccctcatggaatggaaggcaaatgtttccctggtaaaggatattcagcccggtgttacggtcagctacggccgtcatttcaagcggaagtctgtacgagggtggcaacactggctgtcggatatgcggatggttttccgcgcagtgtatccaatcagggagcctgtgtgctgctgcatggcaggcgtgttcccattatcggcaatatctgtatggatcagatgatggtggatatcaccggacttgatggtgtgagtgaaggcgatgtcgctactctgatcgggtgtgacggtgatgaggttctttccgttgatgaactcagcagacttgcacataccataaacaatgaaacactctgctggatttcacagcgggtaccgagaatatacaaatag

SEQ ID NO: 33107 - protein, 383 aa, Clostridium innocuum
MENVLKSNTPSWLEIDLTRISHNIKEVQKLIPSTSKIMAIVKANGYGHGDVECSRMMEQQGIDFFGVSSVDEGVRLRENGIQSPILVLGYTPPVHFHYLNEASLIQTLVSKEYAEKLNAYAKEQNVVVKAHAKVNTGMSRIGISHRIMHIISRISKALVRLKHLNVSGIFSHFSVSDCLDEENCAFTNHQIALFERVLADLRPEGLTPVQRICRQLWNFKLSEPALDYVRPGLLWMGVPAMMHWQFARHRSFSPHGMEGKCFPGKGYSARCYGQLRPSFQAEVCTRVATLAVGYADGFPRSVSNQGACVLLHGRRVPIIGNICMDQMMVDITGLDGVSEGDVATLIGCDGDEVLSVDELSRLAHTINNETLCWISQRVPRIYK

SEQ ID NO: 33108 - DNA, 1074 bp, uncultured bacterium 577
  CDS (1)..(1074): transl_table=11
atgtctcgtcctattcatgctttgattgatctttctgcgcttgagcacaacctttctgttgttcgtcgccattcctcacgttcaagagtaatggcggttataaaagcagatgcatacggacatggattattacgtgcagctgaggcttttaagagtgctgatggctttgcaattttggagttagaggccgcaatacgtttacgagaagccggctatgaacatactatattattaattgaaggtttcttctctaggtcggagttagaactgtttgagcgttatcatcttagtactgtaatacataacagttggcagttagatatgctatctgcttacaagcagcctagaggactagatgtctttctgaaattaaatactggcatgaaccgcttaggctttactccagaacagttccttagggctttagaaatattaaagtctaatcctgttattggtcaaattacattgatgacgcattttgcttgtgctgatgcctataaagataggagtggggttatagagcaactgaaatgttttaattccattacttcagatttagatttcccgtgttcattggccaattctgcggcaatactatcttatcctgaaactcatgctgactgggttcgtcctggaataatgctatatggttcatcaccattctccgatatatctgcaagtgaattagatttacgtccggccatgacattaactagtagaatcatagcagtacaggatctccatacgggagataaagttggatacgggcaaacttattgtgtaaagcgacccatgcgcgtgggcatcgttgctggtggatacgcagatggatacccgcggcatgcgcccactggtacaccaatctcagttgatggaattcgtacccgtattattgggcgagtatctatggatatgttgcatgtagatctgaccaatatcgaaaatggaggtgttggaagcttggttatattttggggaaaaggaatgcccgtagatgaggttgcagagtcagctggaacaattagctatgagttattatgttcactagcccaaagaataaagatagaaacgtaa

SEQ ID NO: 33109 - protein, 357 aa, uncultured bacterium 577
MSRPIHALIDLSALEHNLSVVRRHSSRSRVMAVIKADAYGHGLLRAAEAFKSADGFAILELEAAIRLREAGYEHTILLIEGFFSRSELELFERYHLSTVIHNSWQLDMLSAYKQPRGLDVFLKLNTGMNRLGFTPEQFLRALEILKSNPVIGQITLMTHFACADAYKDRSGVIEQLKCFNSITSDLDFPCSLANSAAILSYPETHADWVRPGIMLYGSSPFSDISASELDLRPAMTLTSRIIAVQDLHTGDKVGYGQTYCVKRPMRVGIVAGGYADGYPRHAPTGTPISVDGIRTRIIGRVSMDMLHVDLTNIENGGVGSLVIFWGKGMPVDEVAESAGTISYELLCSLAQRIKIET

SEQ ID NO: 33110 - DNA, 1359 bp, Bifidobacterium bifidum
  CDS (1)..(1359): transl_table=11
atgactttgaacgcagcatccgaattgcagttttcatccccggctggcgaagccaactaccgggcggcgcgacgccggtaccccgcgcaggcgatcgtcgacctggccacgttgagggacaacatggcccacttggtcgatgtggtgggcggcccgcattccggcacggcggtgatgggcgtggtcaaggcggacgcctacgggcacggtctgctgccggccgcgctggcggcgctcgcgggcggcgcgacctggctgggcaccgcgcaatcgcatgaggcgctgctgctgcgcaaactcggcatcggcccggatcgctgccgcattctgacatgggtgtacaacggcatggatgtgccgttcgacgagctgatcgacaacgacatcgacatctccgtcggctcgctggcgggcatcgacgcgctcgccgacgccgcgcgccggctcggcaaacccgcacgcgtgcatgtcaaggtcgactccggcttcggccgcaacggcttcacgccggccggattcgacgcggcccttgccaagctggtgccgcttgcgcatgagggcgtgctgcacatcgtcggccagtggagccatttggcggttgccgaattgccggatgtgcctgaatttgttgcctccaccgaccggcagattgaattgttcacggaattcacccgttgcatggaagccgcgggcattgcgcccgaaataagccatttggcaaacaccgcggccacgctcaaccgttccgagattcatttcgaaatgacccgtccgggcatcggcctgtacgggtacgagcccgacccggcgatgggcacgccgcgtgaatggcatttgaagcccgccatgacattgcaggcgcagctcggtacggtcaaggatgtcgaggccgggcacggcgtctcatacggtcgcacgtacctgacgcccgacaacaccagcaccgccatcgtgcccctcggctacgccgacggcatccaccgttccgcctccggcttcgacatgcagggcgccaagcatgtcgagaaggccggcggtcccgtgcgtgtgatgaccagcgccggcccgcgcctgctgcacgtgtgcggtcgcgtgtgcatggaccaattcatcgtcgacctgcacgggtcggccgccgagcttggcgtccatgagggcgacaccgtggagttgttcggacccggtcgcggtgagcaatacggcgagccgaccgccgacgactgggcgcgcgccgccgacacgattagctacgaggtgttcacctgtctgcgcaatcgcatcccgaggctctacctgcatgccgccgacgtgctgcctgccgcggacctcgccaagctcgatccggcgagcctgctgtag

SEQ ID NO: 33111 - protein, 452 aa, Bifidobacterium bifidum
MTLNAASELQFSSPAGEANYRAARRRYPAQAIVDLATLRDNMAHLVDVVGGPHSGTAVMGVVKADAYGHGLLPAALAALAGGATWLGTAQSHEALLLRKLGIGPDRCRILTWVYNGMDVPFDELIDNDIDISVGSLAGIDALADAARRLGKPARVHVKVDSGFGRNGFTPAGFDAALAKLVPLAHEGVLHIVGQWSHLAVAELPDVPEFVASTDRQIELFTEFTRCMEAAGIAPEISHLANTAATLNRSEIHFEMTRPGIGLYGYEPDPAMGTPREWHLKPAMTLQAQLGTVKDVEAGHGVSYGRTYLTPDNTSTAIVPLGYADGIHRSASGFDMQGAKHVEKAGGPVRVMTSAGPRLLHVCGRVCMDQFIVDLHGSAAELGVHEGDTVELFGPGRGEQYGEPTADDWARAADTISYEVFTCLRNRIPRLYLHAADVLPAADLAKLDPASLL

SEQ ID NO: 33112 - DNA, 1176 bp, Agrobacterium tumefaciens
  CDS (1)..(1176): transl_table=11
atgacagacgacttcgaagacagctttcccgacaacgaaaccgatgcgttcgagcaagccccgctgcgattgaccgtcgatctcggcgctctcgccgacaattggcgggacatgaagaagcggtccggaagagcccgcacggccgccgtcgtcaaggccgatgcctatggtctcggcatcgaggattgtggtgcgacgctttaccatgccggcgcgcgggacttcttcgtggcgacggtggccgagggcgcgacccttcgctcctatgctccggaagcgcgcatcttcgtattgtcaggcatctggcagggccaggaacggcaggtgttcgacaatgatctggtgccggtgctggcctccgaggagcaactgtccttctggatggcgacggtcgccgagcggggtgaccacccctgcgcgctgcatgtggacaccggcttcaatcgcctcggcctgccgcttgatgacgcgctgtttctggccgacgacgtgacacggccggcgagtttcgacccggttctggtgctgtcgcatctcgcctgcgccgatacaccgtcctcccccatgaacagggcgcagctcgaatcattccgaagggttagcgccgccttcgaaggtatcgaatcaagcctttcggcatccgccggtatctttctcggtcccgactatcatttcgacctcacccgccccggcatcgccctttatggcggcgaggcggtcaacgatgtggccaacccgatgcggcccgtcgccaaggccgaggcccggatcatccagatacgcgaagcaggcgaaggccagacggtgagctatggcagcagcttcctgctcaagcgcgcaagccggcttgccatcgcatccgtcggttatgcggatggctatcagcgttcgctgtccggctcgggcattcccttacgtgaaatgggccatggcggtgcatatggcgtcgtcaacggccacaaggtgcccgtggccgggcgcgtgaccatggacctgactattttcgacgtcacggatgtgccggcaaatgccattcgcgctggcgactatatcgagctttttggccccaacgttccagtcgatgaaaccgcacgggcggccggcacgatcggttatgagatgctgacggggctcggcctgcgttacgaacggcaatatctggtagcggatgactga

SEQ ID NO: 33113 - protein, 391 aa, Agrobacterium tumefaciens
MTDDFEDSFPDNETDAFEQAPLRLTVDLGALADNWRDMKKRSGRARTAAVVKADAYGLGIEDCGATLYHAGARDFFVATVAEGATLRSYAPEARIFVLSGIWQGQERQVFDNDLVPVLASEEQLSFWMATVAERGDHPCALHVDTGFNRLGLPLDDALFLADDVTRPASFDPVLVLSHLACADTPSSPMNRAQLESFRRVSAAFEGIESSLSASAGIFLGPDYHFDLTRPGIALYGGEAVNDVANPMRPVAKAEARIIQIREAGEGQTVSYGSSFLLKRASRLAIASVGYADGYQRSLSGSGIPLREMGHGGAYGVVNGHKVPVAGRVTMDLTIFDVTDVPANAIRAGDYIELFGPNVPVDETARAAGTIGYEMLTGLGLRYERQYLVADD

SEQ ID NO: 33114 - DNA, 1170 bp, Bacillus subtilis
  CDS (1)..(1170)
atgagcacaaaacctttttacagagatacgtgggcggaaattgacttgtccgcgataaaggaaaatgtcagcaatatgaaaaaacatatcggtgaacatgtccacttgatggcagttgtgaaagcaaacgcctacgggcatggtgatgcagaaacagcaaaggctgctcttgacgcaggtgcttcatgcttggccgtggccattttggatgaagcgatttcactgcgcaaaaagggattgaaggcgcctatattggtgcttggcgcggttcccccggagtatgtggcaatcgctgctgagtatgacgtgaccttaacaggttattctgttgaatggcttcaggaggcagcccgccacacgaaaaaaggttctcttcattttcatctgaaggtcgatacggggatgaacagacttggtgtaaaaacagaggaagaagttcagaacgtgatggcaattcttgaccgcaaccctcgtttaaagtgcaaaggggtatttacccattttgcgacagcggatgaaaaagaaagaggctatttcttaatgcagtttgagcgctttaaagagctgattgctccgctgccgttaaagaatctaatggtccactgcgcgaacagcgccgctggactccggctgaaaaaaggcttttttaatgcagtcagattcggcatcggcatgtatggccttcgcccgtctgctgacatgtcggacgagataccgtttcagctgcgtccggcatttaccctgcattcgacactgtcacatgtcaaactgatcagaaaaggcgagagcgtcagctacggagccgagtacacagcggaaaaagacacatggatcgggacggtgcctgtaggctatgcggacggctggctccgaaaattgaaagggaccgacatccttgtgaagggaaaacgcctgaaaattgccggccgaatttgcatggaccaatttatggtggagctggatcaggaatatccgccgggcacaaaagtcacattaataggccggcagggggatgaatatatttccatggatgagattgcaggaaggctcgaaaccattaactatgaggtggcctgtacaataagttcccgtgttccccgtatgtttttggaaaatgggagtataatggaagtaagaaatcctttattgcaggtaaatataagcaattaa

SEQ ID NO: 33115 - protein, 389 aa, Bacillus subtilis
MSTKPFYRDTWAEIDLSAIKENVSNMKKHIGEHVHLMAVVKANAYGHGDAETAKAALDAGASCLAVAILDEAISLRKKGLKAPILVLGAVPPEYVAIAAEYDVTLTGYSVEWLQEAARHTKKGSLHFHLKVDTGMNRLGVKTEEEVQNVMAILDRNPRLKCKGVFTHFATADEKERGYFLMQFERFKELIAPLPLKNLMVHCANSAAGLRLKKGFFNAVRFGIGMYGLRPSADMSDEIPFQLRPAFTLHSTLSHVKLIRKGESVSYGAEYTAEKDTWIGTVPVGYADGWLRKLKGTDILVKGKRLKIAGRICMDQFMVELDQEYPPGTKVTLIGRQGDEYISMDEIAGRLETINYEVACTISSRVPRMFLENGSIMEVRNPLLQVNISN

SEQ ID NO: 33116 - DNA, 1161 bp, Clostridium acetobutylicum
  CDS (1)..(1161): transl_table=11
atgttcagacatataagacctgtatgggctgagatagatttagataatattgcatataatatgcagcaaattagaaggtgttcaaaaagtgatgaaataataggggtagttaaggctgatgcatatggtcatggagctgttgatgtagcaccagtacttttggagaatggtgcaaatcgtcttgcggttgctgtgataagcgaagctgtagaactgagaaagtcaggaattcaatgtccgataatgattttaggttatacacccttaagtttggtggatagtattataaaatacagtatagaacaaactgttttttcatatgattatgcagaaaagctatctgaggcagcaaggcaaaagaatataacgcttagaatccatatagcattagatacagggatggggagaataggatttttgccaacagaggaaagtgtatgggaagtttataaaataagtaaactttcaaacataataatagaaggaatattttcacacttttcaacatctgatgagacaaataaagaatatacgtatgcacaattaaagaagtttgaatggttttataatgaattaagaaagaaaaatattaaaataaatataagacatataggcaacagtgctgccataatggaattgccagaaactcattttgaggctacaagacctggcattatactatatggatactatccatcaaatgaggttgacaagaataagttaaacttaaaacccattatgacacttaaaaccaatgtggttcatataaaaaaaatgatgcctggtgaatatgttagctatggcagaaagtttaaatgtgaaagagagagtattatagctacacttcctgttggatatgcagatggatataccaggatgctttcaggcaaggcaaaagtaataattaatggtaactatgcgcctgttatcgggaggatttgtatggatcaatgtatgatagatattactgatcttccaagcgttcaagttggagacgaagttgtaattatgggtgaaagtgatgataaaaaatttacagcagacgatatggctgaaatcataggaacaataaattacgaagttatttgtatgataagcaagcgtgtaccacgcgtttatataaagaatggggaagttgtaaaaataaggaattacgtgtag

SEQ ID NO: 33117 - protein, 386 aa, Clostridium acetobutylicum
MFRHIRPVWAEIDLDNIAYNMQQIRRCSKSDEIIGVVKADAYGHGAVDVAPVLLENGANRLAVAVISEAVELRKSGIQCPIMILGYTPLSLVDSIIKYSIEQTVFSYDYAEKLSEAARQKNITLRIHIALDTGMGRIGFLPTEESVWEVYKISKLSNIIIEGIFSHFSTSDETNKEYTYAQLKKFEWFYNELRKKNIKINIRHIGNSAAIMELPETHFEATRPGIILYGYYPSNEVDKNKLNLKPIMTLKTNVVHIKKMMPGEYVSYGRKFKCERESIIATLPVGYADGYTRMLSGKAKVIINGNYAPVIGRICMDQCMIDITDLPSVQVGDEVVIMGESDDKKFTADDMAEIIGTINYEVICMISKRVPRVYIKNGEVVKIRNYV

SEQ ID NO: 33118 - DNA, 1080 bp, Escherichia coli O6
  CDS (1)..(1080): transl_table=11
atgcaagcggcaactgttttgattaaccgccgcgctctgcgacacaacctgcaacgtctgcgtgaactggcccccgccagtaaactggtggcggtggtgaaagcgaacgcctacggtcacggtctgattgagaccgcgcgaacgctccccgatgctgacgcctttggcgttgcccgtctcgaagaagccctacggctgcgggcggggggtatcacgcgacctattttgttactggaaggtttttttgaagcagacgatttgccgacgatctccgctgaacatctgcataccgcagtccacaatgaagagcagcttgtcgccctcgaaaacgctgaacttaaagagcctgtcaccgtctggatgaagctcgataccggaatgcaccgtttgggcgtattgccggaacaggccgaggcgttttatcagcgtctgagccagtgtaaaaatgtccgccagccggtgaacattgttagtcacttcgcccgtgccgatgaaccgcaaagcggcgcgactgaaaagcagctcgatatcttcaacaccttttgtgaaggtaaaccggggcaacgctcaattgcggcatcaggcggcattttgttatggccgcagtcgcattttgactgggcgcgtccggggatcattctttacggtgtctcgccgctggaagatggcacgacaggggctgattttggctgtcagccagtcatgtctttaacctccagcctgattgccgtgcgtgagcataaagccggagagcctgtcggttatggtggaacctgggtaagcgaacgtgatactcgtcttggcgtagtcgcgatgggctatggcgatggttatccgcgcgccgcgccgtccggtacgccagtgctggtgaacggtcgcgaagtgccgattgtcgggcgagtcgcgatggatatgatctgcgtagacttaggtccacaggcgcaggacaaagccggggacccggtcattttatggggcgaaggtttgcccgtagaacgtatcgctgaaatgacgaaagtaagcgcttacgaacttattacgcgcctgacttcaagagtcgcgatgaaatacgtggattaa

SEQ ID NO: 33119 - protein, 359 aa, Escherichia coli O6
MQAATVLINRRALRHNLQRLRELAPASKLVAVVKANAYGHGLIETARTLPDADAFGVARLEEALRLRAGGITRPILLLEGFFEADDLPTISAEHLHTAVHNEEQLVALENAELKEPVTVWMKLDTGMHRLGVLPEQAEAFYQRLSQCKNVRQPVNIVSHFARADEPQSGATEKQLDIFNTFCEGKPGQRSIAASGGILLWPQSHFDWARPGIILYGVSPLEDGTTGADFGCQPVMSLTSSLIAVREHKAGEPVGYGGTWVSERDTRLGVVAMGYGDGYPRAAPSGTPVLVNGREVPIVGRVAMDMICVDLGPQAQDKAGDPVILWGEGLPVERIAEMTKVSAYELITRLTSRVAMKYVD

SEQ ID NO: 33120 - DNA, 1131 bp, Oceanobacillus iheyensis
  CDS (1)..(1131)
atgaaagtaacgagttatcgcgatgcatgggtggaagtttccttagatgcactaacttataatgtacgtcaatttaagaatcatttacaggaaaagtcaaggttgatggcagttgtaaaagcagatggttatggtcacggggccgttccgatagcgcggagatccttagaagcaggggcggaatatcttggagtagcttttatagatgaggcacttcagattcgggaagctggaatattagctccaatcttattacttggttttacaccaagctacgctgtaagagaagctgttagacatgacctcacactcaccgtatattcgacggaaacactggaagcgataaaggatgcagctcgatctttagataaaaaggcaaaaatacatataaaagtggatagtggtatgagtcggatcgggttaagatcctctgaggaggtcatctctctaatgacatcactacaaacggaagaaattgaagtagaagggattttcactcattttgcggatgctgataatgatgagagtgatgcgtatacatataaacaatttgaaacatttcaagggattatggaagcgttagaaaatgaaggttattcgataccaatcaagcattgctgtaatagtgcagcaacgatagcatttcctgacatgcatatggatatggttcgtgttggcattagtttatacgggttataccctggacaacatttaaaggaaatattgtccttacagcaagtaatgagctttaaagcaaagcctgtgctcataaaagatgttccccctcatcaaccaattagctatggattaacgtatgaaacaaaggaaacgtccaagatcgcaacacttcctataggctatgcggatggtttttcccgtttgttatcaaatgtaggtcatgtgactgttcatggaacagcgtgtcccattgtagggagaatttgtatggatcagtctatgatagatgtgtctgaagttcaaacggatgtaactaaagacgatatcgtaaccatttttggtgatgaaaatgcggggtatataccgctcgacgttgttgcagagcaaatgcaaacgatccattatgaaacagtgtgtcttattggaaaaagagtaccaagacattacgtgtag

SEQ ID NO: 33121 - protein, 376 aa, Oceanobacillus iheyensis
MKVTSYRDAWVEVSLDALTYNVRQFKNHLQEKSRLMAVVKADGYGHGAVPIARRSLEAGAEYLGVAFIDEALQIREAGILAPILLLGFTPSYAVREAVRHDLTLTVYSTETLEAIKDAARSLDKKAKIHIKVDSGMSRIGLRSSEEVISLMTSLQTEEIEVEGIFTHFADADNDESDAYTYKQFETFQGIMEALENEGYSIPIKHCCNSAATIAFPDMHMDMVRVGISLYGLYPGQHLKEILSLQQVMSFKAKPVLIKDVPPHQPISYGLTYETKETSKIATLPIGYADGFSRLLSNVGHVTVHGTACPIVGRICMDQSMIDVSEVQTDVTKDDIVTIFGDENAGYIPLDVVAEQMQTIHYETVCLIGKRVPRHYV

SEQ ID NO: 33122 - DNA, 1077 bp, Pseudomonas aeruginosa
  CDS (1)..(1077): transl_table=11
atgcgtcccctcgttgccaccgtcgacctttccgccattcgccacaactatgccctggccaagcgctgcgcgccgcagcgccaggcgttcgcggtggtcaaggcgaacgcctatggccacggtgcgcgcgaagtggttaccgcgttgcacgacgatgccgatggcttcgccgtggcctgcctggaggaggccgcggaagtccgcgccttgcacgccagcgcgcgcatcctgttgctggaaggctgcttcgaggcgagcgaatacgccctcgccgggcaattgcgcctggacctggtgatccagggcgcggaacagggcgaggcgttcctcgccgccggcctggatattccactcaacgtctggctcaagctcgactccggcatgcaccgcctgggcttcgatcctgccgcgctgcgcgcctggcatgcgcgcctgcgcagccatcccggtgtgcgcgagctgaacctgatcagccatttcgcctgcgccgacgaacgcaaccatccgctcaccgaacagcagctggagagtttcctcggcctgctcgacctggacttcgaccagcgcagcctggccaattcggcggcggtgctgactatcccggccgcccacatggactggctgcggccgggaatcatgctctacgggtcgaccccgctggccgacctcagtgctgccgaactgggcctgaagccggccatgagcctgggcgcgcagttgatttcactgcgcgaggtggccgtgggtgagagcgtcggctacggcgccacctggatcgccgagcggccggcgcggatcggcacggtcagttgcggctacgccgacggctatccgcgtaccgcgccagccgggactccggtactggtcgggggacgccgcgcgatcctggccgggcgggtctcgatggacatgctggcggtcgacctctccgacctgccggaggctcgcgttggcgacccggtggagttgtggggcgccgggttgtcggtggacgaggtcgcccgtgcctgcggcacccttggctacgagcttctgagcaaggtcacggctcgggttccgcgacgctacagccactga

SEQ ID NO: 33123 - protein, 358 aa, Pseudomonas aeruginosa
MRPLVATVDLSAIRHNYALAKRCAPQRQAFAVVKANAYGHGAREVVTALHDDADGFAVACLEEAAEVRALHASARILLLEGCFEASEYALAGQLRLDLVIQGAEQGEAFLAAGLDIPLNVWLKLDSGMHRLGFDPAALRAWHARLRSHPGVRELNLISHFACADERNHPLTEQQLESFLGLLDLDFDQRSLANSAAVLTIPAAHMDWLRPGIMLYGSTPLADLSAAELGLKPAMSLGAQLISLREVAVGESVGYGATWIAERPARIGTVSCGYADGYPRTAPAGTPVLVGGRRAILAGRVSMDMLAVDLSDLPEARVGDPVELWGAGLSVDEVARACGTLGYELLSKVTARVPRRYSH

SEQ ID NO: 33124 - DNA, 1194 bp, Rhizobium loti
  CDS (1)..(1194)
atgatgttgtccatagtgcggtcagtcgacgtcgtattggaaatcgatctagcggctattcgggcgaatttccagaagatctcgacacttgttggggataaggtgaaggtagctgcagtcgtcaaaagtgatgcgtacggacttggtcttgtagacattgccaggacgctcatagatgccggctgcgacctactgtttgttgccaatttggatgaggccctgcttctaagatcttcctttagtcgagttgcaattgcggtctttcgtgatgagtttgataggtttggcacatggtaccggtcgcatggcctgatacctgtggtgaacaactgcaaggaattgcatgcagttggcacagccggagagccgcaatcatactttctcaatgtggaaactggattctctcgctttgggctcagcgttggcgatatccagcgcgagtatctgctacgcaccttcgaaaggtatcgcccttcgatcgtgctcagccacctcgcatgcggcgaatgcatttcggacccaatgaatcaattgcagagggaccgttttcggacagtctatgatcttcttaaacccacgcgcggcagtctctctgcctccgccggtgtatggctcggaaagtcctaccactttgacatggtgcgtgtaggatcggcgctgtacgggatccataacgctggcgtgcaaacaaatcccctgaagcccgtggtcaaactcagagcaagaatacttgacgtgcggagcgttccggcgggggaagccgttggatatggtgcaacgtttcgtacggaccgagccagccgagtagcaatcgtcgggatcgggtacaagcacgggcttccatggtcctgcgcgaacaagatattcgttcggttggcggaatattcagcgccttcaataggaagaatctccatggaatatatgataattgatataacggacgttccggcgagacgttgcagcccgggcacctttgcggaattgctaagtgaagacttcaccgtcaatgacctcggagcggccgctggggttagtccacaggaggcactgacgcggcttggtgccgggtgcacacggaagtatctgaatttattccctccatctgcagcgttcacagcaaaccgcccgacggaggcgatgagtaacccatcgagagcaaagagccgaccgatggacaagcaagcgctcatctag

SEQ ID NO: 33125 - protein, 397 aa, Rhizobium loti
MMLSIVRSVDVVLEIDLAAIRANFQKISTLVGDKVKVAAVVKSDAYGLGLVDIARTLIDAGCDLLFVANLDEALLLRSSFSRVAIAVFRDEFDRFGTWYRSHGLIPVVNNCKELHAVGTAGEPQSYFLNVETGFSRFGLSVGDIQREYLLRTFERYRPSIVLSHLACGECISDPMNQLQRDRFRTVYDLLKPTRGSLSASAGVWLGKSYHFDMVRVGSALYGIHNAGVQTNPLKPVVKLRARILDVRSVPAGEAVGYGATFRTDRASRVAIVGIGYKHGLPWSCANKIFVRLAEYSAPSIGRISMEYMIIDITDVPARRCSPGTFAELLSEDFTVNDLGAAAGVSPQEALTRLGAGCTRKYLNLFPPSAAFTANRPTEAMSNPSRAKSRPMDKQALI

SEQ ID NO: 33126 - DNA, 1080 bp, Salmonella typhimurium
  CDS (1)..(1080)
atgcaagcggcaacagtcgtcattaaccgccgcgctctgcgacacaacctgcaacgtctgcgtgaactggcgcctgccagtaagctggttgcggtggtgaaagcgaacgcttatggacacggtcttctggagaccgcgcgaacgctccctgatgctgacgcttttggcgtggcgcgtcttgaagaggctctacgtctgcgagcgggtgggatcacgcagcctatcctgctgctggagggttttttcgacgccgccgatctgccgaccatttccgcgcaatgtctgcataccgccgtacataatcaggagcagcttgccgccctggaggcggtggagctggcggagccggtaacggtctggatgaaactggataccggtatgcatcgtctcggcgtgcgtcccgaagaggcggaggcgttctaccagcgtctgacgcactgtaaaaatgtacgccagccggtgaatatcgtcagccattttgcccgtgcggatgagccggaatgcggcgctaccgaacatcagctcgacatttttaatgccttctgtcagggtaaacccggtcagcgctctattgccgcgtctggcggtattctgctgtggccgcagtctcactttgactgggcgcgtccgggaatcattttgtatggcgtatcgccgctggaacacaaaccctgggggccggattttggttttcagccggtgatgtccttaacttccagtttgatcgcggtgcgtgaccacaaagcgggcgaaccggtgggctacggcgggacatgggtgagtgagcgcgacacgcgcctgggcgtggtggcgatgggttatggcgatggctacccacgagcggcgccttccggtacgccagtactggtcaatggtcgtgaagtcccgattgtcgggcgggtggcgatggatatgatttgcgtggatttggggccaaacgcgcaggataacgcgggcgatccggtggttttatggggtgaaggtctgccggttgaacgtatcgctgaaatgacaaaagtaagtgcttacgaacttatcacgcgcctgacctcaagggtggcaatgaagtatattgattaa

SEQ ID NO: 33127 - protein, 359 aa, Salmonella typhimurium
MQAATVVINRRALRHNLQRLRELAPASKLVAVVKANAYGHGLLETARTLPDADAFGVARLEEALRLRAGGITQPILLLEGFFDAADLPTISAQCLHTAVHNQEQLAALEAVELAEPVTVWMKLDTGMHRLGVRPEEAEAFYQRLTHCKNVRQPVNIVSHFARADEPECGATEHQLDIFNAFCQGKPGQRSIAASGGILLWPQSHFDWARPGIILYGVSPLEHKPWGPDFGFQPVMSLTSSLIAVRDHKAGEPVGYGGTWVSERDTRLGVVAMGYGDGYPRAAPSGTPVLVNGREVPIVGRVAMDMICVDLGPNAQDNAGDPVVLWGEGLPVERIAEMTKVSAYELITRLTSRVAMKYID

SEQ ID NO: 33128 - DNA, 1128 bp, Schizosaccharomyces pombe
  CDS (1)..(1128)
atgagaggtgcaaagtccgtcattgatttgcatgccattgcacacaattataatgttgccaagcaaatgatgcttcaaaaaaatccaagcggtcatgttttagcaattgtaaaagcaaacgcttatggacacggagctgtacaagttgcacgtttccttctcaaacattgctcttcaattgatggctttggtgtttcttcaattgaagaggctttagaattaaggcacggtggaatctataacaaaattgttctcctggaaggattctttactgaggaggatgaattaaaacttattgatgattacaatttttctattatcattcattctgaagaccaggtgaatagttttattaaataccctttcaacagaccagtagagatttggttgaaacttgactctggaatgaaccgtctaggttttacacctagtcagtttatgaagttctataatttactaagcaataacaaaaacgttagtaatatcggaaaaatcactcattttgcatttgcagatatgctagaaaatccggaacacactttgaagcaatgggatatatttgaaaagtctgttgcgcatttaccaggtccacttagtgctggcggatctgcgattattttgggctggctaaacactgtgtgcacagactggttgcgtgctggtatcatgttatatggtatttctccatttctttctaaaaataaagactcaaaaactccagagtctgttaatataaagcctgccatgaaactggtatctaccataataagtgtgaaacatgttgacaagggccagcccattggttatggagggagatatgttgctactagagatatgaaactaggtgttgtagcaatgggttacggagacggatttccccgtcaagttaaagatggatgtccagttttagtgaatggcgtgaaggctccaattgttggtagggtttccatggacatgcttactgttgatctttcagacattcctgatgtcaagccaggggatgaagtaatattttggggaactccagaattgacagtggcagacattgctaaatattgtagtgatactagcccttatgagcttgtaacaaaactcactaggagagttcctttacagtacacatactaa

SEQ ID NO: 33129 - protein, 375 aa, Schizosaccharomyces pombe [sequence omitted]

SEQ ID NO: 33130 - DNA, 1149 bp, Staphylococcus aureus
  CDS (1)..(1149): transl_table=11
atgtcggataaatattatagatctgcgtatatgaatgtagatttaaacgctgttgcatcaaatttcaaagtattcagtacattgcatccaaataaaacagtgatggctgtcgttaaagccaatgcctatggactaggtagtgttaaagtagcacgtcatttaatggaaaatggcgccacattttttgctgtagcaacgttagatgaagcgatagaacttagaatgcatgggattactgctaaaattttagtcttaggtgtgttaccagctaaagatattgataaagcgatacaacaccgagttgccttaacggttccgtctaaacagtggttgaaagaagcaattaaaaacatttctggtgagcaagagaaaaagttatggttgcacattaaattagatacaggaatgggacgtttaggtattaaagatactaaaacgtatcaagaagtgattgaaatcattcaacaatatgagcaacttgtatttgaaggcgtgtttacacactttgcctgtgctgacgaaccaggagatatgacaactgaacaatatcaacgttttaaagatatggtcaatgaagcaattaaacctgaatatatacattgtcagaactcagcaggctctctattaatggattgccaattctgtaatgcaataagaccaggaatttccctttatggatattatccatcagagtatgtacagcaaaaagttaaagtacaccttaaaccaagtgtgcaattaattgctaatgtagttcaaacaaagacgctacaagcgggtgagtctgtaagttatggtgcaacttatacagctactgacccaactacaatagcattgttacctattggatatgcagatggctatttacgcataatgcaaggtagctttgtaaatgtaaatggtcatcaatgcgaagttattggtcgcgtatgtatggatcagacaattgttaaagtgccagatcaagttaaagctggagattcggtgattttaatagataatcatagagaaagtccacagtcggtagaggtggtagctgaaaagcaacatactattaattatgaagtgctttgtaacttgtcgagacgtttgccgcgaatctatcatgatggtgatcaacgttttgtaacaaatgaattgttaaaataa

SEQ ID NO: 33131 - protein, 382 aa, Staphylococcus aureus
MSDKYYRSAYMNVDLNAVASNFKVFSTLHPNKTVMAVVKANAYGLGSVKVARHLMENGATFFAVATLDEAIELRMHGITAKILVLGVLPAKDIDKAIQHRVALTVPSKQWLKEAIKNISGEQEKKLWLHIKLDTGMGRLGIKDTKTYQEVIEIIQQYEQLVFEGVFTHFACADEPGDMTTEQYQRFKDMVNEAIKPEYIHCQNSAGSLLMDCQFCNAIRPGISLYGYYPSEYVQQKVKVHLKPSVQLIANVVQTKTLQAGESVSYGATYTATDPTTIALLPIGYADGYLRIMQGSFVNVNGHQCEVIGRVCMDQTIVKVPDQVKAGDSVILIDNHRESPQSVEVVAEKQHTINYEVLCNLSRRLPRIYHDGDQRFVTNELLK

SEQ ID NO: 33132 - DNA, 1167 bp, Thermoanaerobacter tengcongensis
  CDS (1)..(1167): transl_table=11
gtgaaatttgacggggtaagacccacccgcgtagaagtatatctagatgcaataacacataacttcagagaaataaagaagatagttggaaaaaatgtgaaaataatggcggtgataaaaggggatgcatatggtcatggagcttcatatgtagccaaatttttagaaaaagaaggggtagactatttcggagtagcaactacagaagaagctttagagttgagggaaaagggaataaaaactcctattctaatttttggttatactcctcctacacagttaagacaaatagttaaacatgaccttactcaaacggtgtacgatataaaatatgcgaaagagttagagaaagaaagtctaaaacaaaacaaaagagcaaaagtccatataaaaattgatacaggtttgggacgaatcggatatattgattttgatttagcgcagaaagagattctagaaatggcaaacatgagaggattaatattggaagggatatacagtcattttgctgccgcatccgaagatgatagggattattgcaaagagcagttcgacaaattcatgaatctaattagtagtttggagaaaaaaaggttaaaaattcctttaaaacatatagccaatgcggcagctattttaaatctcaattattctcatttagatatggtaaggccgggtataattttgttcggtgcatatccttcaaagagagtagaacgaaaggtagaattgagagaaacactgaggtttactacgcgggtggtccatttaaaagatgtaccagcgggattttttataggctacggcaaaagttttgtgacaaaaagaaaaagtgtaatagctactatccccgtggggtatgcggatggacttgataggagattatctaataactataaattgctattaaagggaaagtatgttccaatagtaggcagagtatgtatggaccagtgcatgatagatgttactgatgtagaaggtgtggaaataggagatgaggtggttattatagggacacaaaacaatgagacagtttctgtagaatctatggctgataaaattgaaactattcctcaagaagttttttctagaattagcagaagggtgcctagagtgtatttttatgatggaataaagattggagaagtaaattacttaaagtga

SEQ ID NO: 33133 - protein, 388 aa, Thermoanaerobacter tengcongensis
MKFDGVRPTRVEVYLDAITHNFREIKKIVGKNVKIMAVIKGDAYGHGASYVAKFLEKEGVDYFGVATTEEALELREKGIKTPILIFGYTPPTQLRQIVKHDLTQTVYDIKYAKELEKESLKQNKRAKVHIKIDTGLGRIGYIDFDLAQKEILEMANMRGLILEGIYSHFAAASEDDRDYCKEQFDKFMNLISSLEKKRLKIPLKHIANAAAILNLNYSHLDMVRPGIILFGAYPSKRVERKVELRETLRFTTRVVHLKDVPAGFFIGYGKSFVTKRKSVIATIPVGYADGLDRRLSNNYKLLLKGKYVPIVGRVCMDQCMIDVTDVEGVEIGDEVVIIGTQNNETVSVESMADKIETIPQEVFSRISRRVPRVYFYDGIKIGEVNYLK

SEQ ID NO: 33134 - DNA, 1086 bp, Vibrio cholerae
  CDS (1)..(1086)
atgaaggcggccaccgcctacatcaatttagaggcgttgcagcacaacttgcagcgcgttaagcagcaagcgccagagagtaaaatcatggcggtggtgaaagccaatggttatggacacgggctgcgccatatcgcacgtcacgcccttggggcggatgcctttggcgtggcgcgcattgaagaggctttacagctgcgcgccagtggcgtagtgaaacccattttgttgcttgagggattttattctcccggtgatttgccagtattggttaccaacaacatccaaaccgtcgtacattgtgaagagcagttacaagcgctggagcaagctcagctagagactccggtcatggtatggctgaaagtcgacagcgggatgcatcggctaggggttcgccctgaacaatatcaagatttcgtggctcgtttgcaccagtgtgagaatgtggctaaaccactgcgttacatgagccatttcggctgtgccgatgagttagataaatcgacgacggtagagcaaacagaactgtttttatccctgacgcaaggctgtcagggtgagcgttcgctggccgcttctgccggattattagcttggccgcaaagccagcttgaatgggtaaggccgggaattattatgtacggcgtttctccctttgtggaaaagagcgcggttcagttaggttaccagccagtgatgaccttaaagtcgcacttgatcgctgtccgcgaagtgaaagcgggggagagtgtcggttatggcggtacttggaccagccagcgagataccaaaattggtgtgattgcgattggttatggtgatggctatccacgcactgcgccgaatgggacgccagtggttgtcaatgggcgtcgggtgccgattgctgggcgcgtatctatggatatgttgacggtagatttagggccggatgcttgcgatcgcgtcggtgatgaagccatgctgtggggtaatgagctgcccgtagaagaagtggccgcacatattggtacgatagggtatgagttagtgacgaaactcacctcgcgagtggaaatgtcttattatggagcaggcgtttag

SEQ ID NO: 33135 - protein, 361 aa, Vibrio cholerae
MKAATAYINLEALQHNLQRVKQQAPESKIMAVVKANGYGHGLRHIARHALGADAFGVARIEEALQLRASGVVKPILLLEGFYSPGDLPVLVTNNIQTVVHCEEQLQALEQAQLETPVMVWLKVDSGMHRLGVRPEQYQDFVARLHQCENVAKPLRYMSHFGCADELDKSTTVEQTELFLSLTQGCQGERSLAASAGLLAWPQSQLEWVRPGIIMYGVSPFVEKSAVQLGYQPVMTLKSHLIAVREVKAGESVGYGGTWTSQRDTKIGVIAIGYGDGYPRTAPNGTPVVVNGRRVPIAGRVSMDMLTVDLGPDACDRVGDEAMLWGNELPVEEVAAHIGTIGYELVTKLTSRVEMSYYGAGV

SEQ ID NO: 33136 - DNA, 1080 bp, Yersinia pestis
  CDS (1)..(1080): transl_table=11
atgaaagcggcaacagcagtcatcgaccgccatgctctgcgacataacttacaacaaattcggcgtctggcaccgcaaagccggttggtggctgttgtgaaagcaaatgcttatggccacgggttattagccgcagcacacacattacaggatgctgattgttatggcgtggcccgtattagcgaggcgctgatgttgcgagcgggtggaatagttaaacctattttgctgctggaagggttctttgatgcagaagacctgccggtattggtggctaaccacattgaaaccgccgttcacagcctggaacagctcgtggcattggaagcggctacgctttctgcgccgattaatgtctggatgaaattggatacagggatgcaccgcctgggggttcgcccagatcaggccgaagcgttttatcagcgtttgagcgcatgccgtaacgtcatccagccggtcaatatcatgagtcactttagccgtgccgatgaacctgaagtggcggccacgcaacagcaactggcgtgttttgatgcgtttgctgcaggtaaacctgggaaacaatctatcgctgcttcgggcggtattctgcggtggccacaagcgcaccgtgattgggtgcgcccagggattgtgctgtatggggtttcgccgtttgatgcgccctatggccgtgatttcggtttattgcccgccatgaccctgaaatccagtctgatcgcggtgcgtgaacataaagccggtgaatcggtcgggtatggcggcacctgggtcagtgagcgcgatacgcgtttaggtgtgatcgcgataggctatggtgatggctacccacgtagcgccccgtcagggacaccggtatggcttaatggccgtgaagtgagcatcgttggccgggtatcgatggacatgatctccattgatcttggcccggaaagtacagataaggtgggcgatgaagccctgatgtggggagccgaattaccggttgaacgcgtggctgcctgcaccggtatcagcgcgtatgaattgatcactaatctgacctcccgcgtagcgatggaatatctaggggaataa

SEQ ID NO: 33137 - protein, 359 aa, Yersinia pestis
MKAATAVIDRHALRHNLQQIRRLAPQSRLVAVVKANAYGHGLLAAAHTLQDADCYGVARISEALMLRAGGIVKPILLLEGFFDAEDLPVLVANHIETAVHSLEQLVALEAATLSAPINVWMKLDTGMHRLGVRPDQAEAFYQRLSACRNVIQPVNIMSHFSRADEPEVAATQQQLACFDAFAAGKPGKQSIAASGGILRWPQAHRDWVRPGIVLYGVSPFDAPYGRDFGLLPAMTLKSSLIAVREHKAGESVGYGGTWVSERDTRLGVIAIGYGDGYPRSAPSGTPVWLNGREVSIVGRVSMDMISIDLGPESTDKVGDEALMWGAELPVERVAACTGISAYELITNLTSRVAMEYLGE

SEQ ID NO: 33138 - DNA, 1167 bp, Agrobacterium tumefaciens
  CDS (1)..(1167): transl_table=11
atggacatgcagatcagccgccagcaggccgccggtggtgcaagcggccatctaaccatcgatctgggcgcattgcgggataattacctgactcttgccggtatggcccccgcatcgcaaacggccgccgtcgtgaaggccgatgcctatggtctcggcgcggatgtcgtctcacagaccctgttcgaggcgggttgccgcaatttcttcgtcgcccatatcgatgaggcgctggcactcaggctccggctttcggcaaaggcgcggattttcgtcctcaatggtctgcagcccggcaacgaaacctcctgcgccgccatggccatcaccccggttctgaactcgctggaacagatcgcgcaatggtcagctcatgccagagagctcggcaagacgctcaccgccgccgtccagatcgataccggcatgtgccgccttgggctctcccccgaagagcttgaaatcctctccgccaagcagcagttgctcgatggaattgagatcgccttcgtcatgagccatctcgcctgtgccgacgagccggatcatgtttccaatgccgcgcagctcgccgtgatgcgcaaggccgccaccgcctttcccgagacgccggtctgtttttccaattcgggcggtatttttctcggcaacgactatcataacgctctactgcgccccggcatcgcgctttatggcggtgcgccttccgctgccggccccaacccgatgaagccggtcgttcgtctcgatgtcgccgtcattcagacccgcaccgttcccgccggctcgctggttggttacggcggctcttttacggcgagcgttccgacgcggcttgcgacaatcgctgccggctatgccgatggcctgccgcgttcgctcagcaatcgcggcgcggcgtggtacaatggcgtgcgtctgccgattgccgggcgcgtttcgatggacagcatcattctcgacatatccgccctgcccgagggaacattgacgcagggcagcctcgtgcagatgatcgggcctgatcagacactggaagacatcgccgaggatgcgggcacgattgcctatgaaatcctgaccggcctcggccgccgttaccgccgcagctacattcaaccgggcatgagcccggcaaccgcttcaacatcagtcaatcacaagtga

SEQ ID NO: 33139 - protein, 388 aa, Agrobacterium tumefaciens
MDMQISRQQAAGGASGHLTIDLGALRDNYLTLAGMAPASQTAAVVKADAYGLGADVVSQTLFEAGCRNFFVAHIDEALALRLRLSAKARIFVLNGLQPGNETSCAAMAITPVLNSLEQIAQWSAHARELGKTLTAAVQIDTGMCRLGLSPEELEILSAKQQLLDGIEIAFVMSHLACADEPDHVSNAAQLAVMRKAATAFPETPVCFSNSGGIFLGNDYHNALLRPGIALYGGAPSAAGPNPMKPVVRLDVAVIQTRTVPAGSLVGYGGSFTASVPTRLATIAAGYADGLPRSLSNRGAAWYNGVRLPIAGRVSMDSIILDISALPEGTLTQGSLVQMIGPDQTLEDIAEDAGTIAYEILTGLGRRYRRSYIQPGMSPATASTSVNHK

SEQ ID NO: 33140 - DNA, 1185 bp, Bacillus subtilis
  CDS (1)..(1185): transl_table=11
atgataaagctttgccgagaagtttggatcgaagtcaatcttgatgccgttaaaaagaatttgcgagcgatccgccgtcatattccacataagagcaaaattatggctgttgtaaaagcgaacggttatggccacgggtctatagaagtggcacgccatgcactggaacacggggcgagtgagctcgctgttgccagtgtggaggaaggaatcgttttacgtaaagctgggattacagcacctatccttgtgcttggttttacatcccttagttgtgtaaagaagtcagcagcttggaatataacattatcagcatttcaggttgattggatgaaagaagcaaacgagatattggaaaaagaagcgagtgctaaccggctggccattcatattaacgtggataccggcatgggacgattaggtgtacgcacaaaggaagaacttttagaggtagtgaaagccttaaaggcaagtaaattcctcagatggacagggattttcacacatttttcgacagctgatgaaccggacacaacactcacaaagctgcagcatgaaaaattcatcagttttctcagctttttaaaaaaacaggggattgagctgcccaccgtgcatatgtgcaacacggctgcagctatcgcatttccggaatttagcgctgatatgatccgtttaggtatcggcttatatggtttatatccttcagcctatattaaacaactaaatctcgttaagcttgaacctgcgttaagtttaaaggcacgcatcgcttatgtgaaaaccatgcggacagaaccccgaaccgttagctatggtgctacatacatcgcagaacctaatgaagtaattgctacactcccgattggctatgctgacggctattctcgtgccctttccaatcgcgggtttgttcttcatcgcggaaaacgagtgccagtggcgggaagagtaacaatggatatgatcatggtcagtttaggagaaaacggtgaaggtaaacaaggagatgaagtcgtgatttacggtaagcaaaaaggagccgagatttccgttgatgaagtggctgaaatgctcaatacgattaactatgaagtcgtgtctacattaagccgccgcatccctcgtttttatataagagatggcgagatttttaaagtatcaactccagtattatacgtgtag

SEQ ID NO: 33141 - protein, 394 aa, Bacillus subtilis [sequence omitted]

SEQ ID NO: 33142 - DNA, 1188 bp, Clostridium acetobutylicum
  CDS (1)..(1188): transl_table=11
atggagaaaaaaacagtatataatatcacaaattctattgctataagtgaagaggaagctgtaaattgtaatatacctgaggttaacaaggctgaaattaatttaagtcagcttaagcgtaattttgatattattcaaggatttttaaaacctaatacaaaattcatggcggtcttaaagggagatgcctatggacatggaatacgtccaattgcaaaagaattgataaatttaaaatgtgatgtctttggggttgttagattgattgaggcttttaccctgagaaaggctggtattaaaactcccattatgctgcttgcaccaatttctccatcgcaagcagcttgggttattagatataatataattccaatggtagatagtgaagagattgtagaagcattagatcaaagtgcttcacaaaatgatactatagttaaattgcatgtaaagataaatacaggtttaaataggtatggagtaaatccagaaaatgcagtaaagtttattagagaaattcatgaaaagtatctgcatgttcaagtggatggagtatatactcactttcaggaccccgattacaaccctgattttactcataagcagattgagtgctttaataatattatatttcaacttcaaaaacaaaaattaagacctagaataattcatgcagctaattccactggcataataagatatccagaagctcattatgatatggttcggtgtggaacccttttatttggcttggagcacgaacaggggcagagaaatatgccaaaaggtataaaaacactaatggagttaaaagggcggattatgaaggttagaacaataagagcaggtgaggctggaggttatggaagtacttttgtagcaaaaaaggattcaaaagttgctatcattgcttttggatatggtgatggtatcagtagaggttggaaggaggtattagtagcaggtaagagggttccggtagtgaattattttatggatggtttaatggtagatatttcaaacatagatgaaacagtaaaggagctagatgaagctgttattgtaggaaatcaaggcgatgaaagcataacttggttagaggcttgtaaaagtcttggaagctatgtagatgagcaaatacaatgcattactgaaagagttcctaaaaaatatttttatgagaaatag

SEQ ID NO: 33143 - protein, 395 aa, Clostridium acetobutylicum
MEKKTVYNITNSIAISEEEAVNCNIPEVNKAEINLSQLKRNFDIIQGFLKPNTKFMAVLKGDAYGHGIRPIAKELINLKCDVFGVVRLIEAFTLRKAGIKTPIMLLAPISPSQAAWVIRYNIIPMVDSEEIVEALDQSASQNDTIVKLHVKINTGLNRYGVNPENAVKFIREIHEKYLHVQVDGVYTHFQDPDYNPDFTHKQIECFNNIIFQLQKQKLRPRIIHAANSTGIIRYPEAHYDMVRCGTLLFGLEHEQGQRNMPKGIKTLMELKGRIMKVRTIRAGEAGGYGSTFVAKKDSKVAIIAFGYGDGISRGWKEVLVAGKRVPVVNYFMDGLMVDISNIDETVKELDEAVIVGNQGDESITWLEACKSLGSYVDEQIQCITERVPKKYFYEK

SEQ ID NO: 33144 - DNA, 1071 bp, Escherichia coli
  CDS (1)..(1071): transl_table=11
atgacccgtccgatacaggccagcctcgatctgcaggcattaaaacagaatctgtccattgtccgccaggccgcgacgcacgcgcgcgtctggtcggtggtaaaagcgaacgcttacgggcatggtattgagcgtatctggagcgcgatcggggccaccgatggctttgcattgcttaacctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtgggatgaatcggttgggcttccagcccgatcgcgtgcttaccgtctggcagcagttgcgggcaatggcgaatgttggcgaaatgaccctgatgtcgcattttgccgaagcggaacatcctgatggaatttccggcgcgatggcgcgtattgagcaggcggcggaggggctggagtgtcggcgttcgttgtccaattcggcggcgactctgtggcacccggaagcgcattttgactgggttcggcctggcattattttgtatggcgcttcgccgtccggtcagtggcgtgatatcgccaataccggattacgtccggtgatgacgctaagcagtgagattattggtgtccagacgctaaaagcgggcgagcgtgtgggctacggcggtcgctatactgcgcgcgatgaacagcgaatcggcattgtcgccgcagggtacgccgacggttatccgcgccacgcgcctaccggtacccctgttttagtggacggcgtgcgcaccatgacggtggggaccgtctcgatggatatgctagcggtcgatttaacgccttgcccgcaggcgggtattggtacgccggttgagctgtggggcaaggagatcaaaattgatgatgtcgccgccgctgccggaacggtgggctatgagttgatgtgcgcgctggcgctacgcgtcccggttgtgacggtgtaa

SEQ ID NO: 33145 - protein, 356 aa, Escherichia coli [sequence omitted]

SEQ ID NO: 33146 - DNA, 1071 bp, Klebsiella aerogenes
  CDS (1)..(1071): transl_table=11
atgacccgtccggtagtggccagcatcgacctgctggccttgcggcagaatttacagatagtgcgtcgcgcggcccccgggtcgcgcctgtgggcggtggacaaggacaacgcctacggacacggtgtggcgcgcgtatggagtgcgttaagcgcggcggatggtttcgccttgctcaacctggaagaggcgatcctgctgcgcgagcagggctggaaaggcccgatcctgctgctggagggcttcttccatgccgatgagctggcggtgctggatcaatatcgtttacccaccagcgtccacagcaactggcagattaaggccctgcaacaggcgaagctgcgcgcgccgctggatatctatctcaaggtgaacagcggcatgaaccggctgggctttatgcctgagcgggtccacaccgtctggcagcagctgcgggcgataagcaacgtcggcgagatgacgctgatgtcgcacttcgcggaggcggagaacccgcagggaattgtcgagccgatgcgccgtatcgaacaggcggcggaggggctggattgcccgcgctcgctggccaactcggcggcgaccctctggcatccggaagcgcattttgactgggttcgtccaggcatcgtgctgtatggcgcgtcgccttccgggcagtggcaggacatcgccaacaccgggctgaagccggtcatgacgctgcgcagcgagatcatcggcgtgcagaacctgcgtcccggcgaggcgattggctatggcggcctgtaccgcaccacccaggagcagcggatcggcatcgtcgcctgcggctatgccgacggctatccgcgggtggcgccgagcggcacgccggtgctggtggatggcgtacgcaccactaccgtgggacgcgtatcgatggatatgctggcggtcgatttaacgccttgtccgcaggccgggatcggcgcgccggtcgagctgtggggcaaagagattaaaatcgacgacgtggcggccagcagcggcaccgtcggctatgagttgatgtgcgccctggcgccgcgggtgccagttgtgaccctgtaa

SEQ ID NO: 33147 - protein, 356 aa, Klebsiella aerogenes
MTRPVVASIDLLALRQNLQIVRRAAPGSRLWAVDKDNAYGHGVARVWSALSAADGFALLNLEEAILLREQGWKGPILLLEGFFHADELAVLDQYRLPTSVHSNWQIKALQQAKLRAPLDIYLKVNSGMNRLGFMPERVHTVWQQLRAISNVGEMTLMSHFAEAENPQGIVEPMRRIEQAAEGLDCPRSLANSAATLWHPEAHFDWVRPGIVLYGASPSGQWQDIANTGLKPVMTLRSEIIGVQNLRPGEAIGYGGLYRTTQEQRIGIVACGYADGYPRVAPSGTPVLVDGVRTTTVGRVSMDMLAVDLTPCPQAGIGAPVELWGKEIKIDDVAASSGTVGYELMCALAPRVPVVTL

SEQ ID NO: 33148 - DNA, 1179 bp, Oceanobacillus iheyensis
  CDS (1)..(1179)
atgattcaaggaagttatcgtgacacatggacagaagtatcattagatgccatccatcacaatgtaacggcgtttaaaaaccatattgatcatcatacaaagttaatggcggttgtaaaagcggatggatacggacacggtgctgtagaggttgcacaggaggctttaacagcaggcgccgattatctagctgttgctatcttagacgaagctattcaattacgagatgctggaattgatgcaccgttgcttgtacttggatacacacatcccgatggattaaaaacagccattgaacagcaaattacactcacagttttcacaaaagaagatgcagaacaagtgaaaatagctgctgagcttctgcaaaagacagctcgcatacacctaaaaatcgaatctggtatgaatcggatcggcatcgctacgaaagaagaagcagttgaaatagctaaagcacttcattcttcttttgttatgttagaaggtgcatttacacactttgccgatgcggataatacagatcccacttatacagagatgcaatttcaccgttttaatcagattatttctcatttaagaacgcattgccatatccctattgtacattgctgtaatactgctgcgacaatagcttacccggatatgcatttggatatggttcgtgttggtatcggcatctatggattatacccagaaacacatttgaaagaattgattgatttaaaacaagcaatgagtctaaaaacaaaacctgtttatataaaaacagttgatcaggacaccgcaattagttatggtcttacattcacgacagagcgaaagagcaccattgcaacaatgccaattggttatgcagatggcttttctcgactactgtctaatcgaggagatgtgattgtacatgccggccgcgctcctattgttggacgaatttgtatggatcaatcgatgatcgatgttacggacgtggagaatgttggactagatgatgtaattaccatttttggtgagcctaccgaaggatatatcgcgatggaagaagtagctaatctgatggggacgatacattatgaaacagcatgcctaattggaaagcgtgttccacggatatatatgaggcaaagtgaagcagttaattataaaggactagtagagaaagaacctgttacgtcttag

SEQ ID NO: 33149 - protein, 392 aa, Oceanobacillus iheyensis
MIQGSYRDTWTEVSLDAIHHNVTAFKNHIDHHTKLMAVVKADGYGHGAVEVAQEALTAGADYLAVAILDEAIQLRDAGIDAPLLVLGYTHPDGLKTAIEQQITLTVFTKEDAEQVKIAAELLQKTARIHLKIESGMNRIGIATKEEAVEIAKALHSSFVMLEGAFTHFADADNTDPTYTEMQFHRFNQIISHLRTHCHIPIVHCCNTAATIAYPDMHLDMVRVGIGIYGLYPETHLKELIDLKQAMSLKTKPVYIKTVDQDTAISYGLTFTTERKSTIATMPIGYADGFSRLLSNRGDVIVHAGRAPIVGRICMDQSMIDVTDVENVGLDDVITIFGEPTEGYIAMEEVANLMGTIHYETACLIGKRVPRIYMRQSEAVNYKGLVEKEPVTS

SEQ ID NO: 33150 - DNA, 1074 bp, Pseudomonas aeruginosa
  CDS (1)..(1074): transl_table=11
atgcgccccgcccgtgccctgatcgacctgcaagcccttcgtcacaactatcggctggcccgcgaggccaccggcgcccgtgcgctcgcggtgatcaaggcggacgcatacggccacggcgcggtgcgctgtgccgaagcgctggcggccgaggccgatggcttcgccgtggcctgcatcgaggagggcctggagctgcgcgaggccggtatccgccagccgatcctgctgctggagggcttcttcgaggcgtccgagctggagctgatcgtcgcccacgacttctggtgcgtggtgcattgcgcctggcaattggaggcgatcgaacgcgccagcctggcccgcccgctgaacgtctggctgaagatggattcgggcatgcaccgcgtcggcttcttccccgaggacttcagcgccgcccacgagcgcctgcgggccagcggcaaggtggcgaagatcgtgatgatgagtcacttctcccgcgccgacgaactggattgcccgcgcaccgaggaacagctcgccgccttcgcggccgcgagccagggcctggaaggcgagatcagcctgcgcaattcgccagccgtgctcggctggccgaaggtgcccagcgattgggtacgtccgggcatcctgctctacggagccacgccgttcgagcgcgcacatccgctggccgaccgcttgcgcccggtgatgaccctagaatcgaaggtgatcagcgtccgcgacctgccggccggcgaaccggtcggctacggcgcgcgctacagcaccgagcgtagccagcgcatcggcgtggtcgccatgggctacgccgatggctatccgcgccacgccgccgacggcacccttgtgttcatcgacggcaagccggggcgcctggttggccgggtatcgatggacatgctcaccgtcgaccttaccgaccatccccaggccgggctgggcagccgggtcgaactatggggcccgaacgtgccggtcggcgccctggcggcgcagttcggcagcattccctaccagctgctgtgcaacctgaaaagggtgccgcgcgtctattccggggcttga

SEQ ID NO: 33151 - protein, 357 aa, Pseudomonas aeruginosa
MRPARALIDLQALRHNYRLAREATGARALAVIKADAYGHGAVRCAEALAAEADGFAVACIEEGLELREAGIRQPILLLEGFFEASELELIVAHDFWCVVHCAWQLEAIERASLARPLNVWLKMDSGMHRVGFFPEDFSAAHERLRASGKVAKIVMMSHFSRADELDCPRTEEQLAAFAAASQGLEGEISLRNSPAVLGWPKVPSDWVRPGILLYGATPFERAHPLADRLRPVMTLESKVISVRDLPAGEPVGYGARYSTERSQRIGVVAMGYADGYPRHAADGTLVFIDGKPGRLVGRVSMDMLTVDLTDHPQAGLGSRVELWGPNVPVGALAAQFGSIPYQLLCNLKRVPRVYSGA

SEQ ID NO: 33152 - DNA, 1146 bp, Rhizobium loti
  CDS (1)..(1146)
atgaacgacgccgtcaatccgactgctgcgaaaaccgtcaccggttggccggtcagcgaggccgcggccggcgcgatcctgaccatcgatctcggcgcgatccgtgaaaactaccggcggctgaaggcgctgctgggcggcgtgcactgcgccggcgttgtcaaggccaatggctacggccttggcgcggccaaggtggcggcggcactgacccgggaaggctgtgacatcttcttcgtcgcgctgctggccgaaggcatcgcgctgcgcaaggcggtcgggaccggaccggacatctacgtgctgaacgggctgccgcctggctccgagccggaagcggtggcggctggcctttgcgcggtcatcaatagtggcgcgcagttgaaagcctggcgcgcggcggtgcacgatgccggtcgccggctgccggcggccatccaggtcgacagcggcatgtcgcggctcggcatggcgccggccgaagtcgaggcgctggccggggatagcagcgcgttcgacggcatcgacatcaaatatgtcatgagccatctggcctgcgccgacgagccgcgccatccggccaacgaacagcagaggctggccttcgaacggctgcgcgccatgctgccccgggcgcccgcctcgctcgccaattcctccggcatctttctcgggccgtcctaccatcacgatctcgctcggcccggagccgcgctctacggcatcaacccgacgccgggcgagcccaacccgatgttgcccgtggtgtggctgcaggccaaggtggcgcagacgcgccgcatcgaaaagggcgccggcatcggctatggtcacagctatcacgcggacggtccgctgagcctggcgacgatttcgttcggctatgcggatggctggctgcgccgctccgcttcggcggcctggttcgaaggcgtgcgcctgcctttcctcgggcgtgtgtcgatggattcgattattctcgacatctccgctttgccgcccggcaggctgcgcgagggcgatctggtcgagctgctcggtccctcgcagagcgtcgacgacgccgccggccatgccggcaccatcggctatgaaatcctggccagtctcggcccgcgctttcaccgccactatgtcggcggctga

SEQ ID NO: 33153 - protein, 381 aa, Rhizobium loti
MNDAVNPTAAKTVTGWPVSEAAAGAILTIDLGAIRENYRRLKALLGGVHCAGVVKANGYGLGAAKVAAALTREGCDIFFVALLAEGIALRKAVGTGPDIYVLNGLPPGSEPEAVAAGLCAVINSGAQLKAWRAAVHDAGRRLPAAIQVDSGMSRLGMAPAEVEALAGDSSAFDGIDIKYVMSHLACADEPRHPANEQQRLAFERLRAMLPRAPASLANSSGIFLGPSYHHDLARPGAALYGINPTPGEPNPMLPVVWLQAKVAQTRRIEKGAGIGYGHSYHADGPLSLATISFGYADGWLRRSASAAWFEGVRLPFLGRVSMDSIILDISALPPGRLREGDLVELLGPSQSVDDAAGHAGTIGYEILASLGPRFHRHYVGG

SEQ ID NO: 33154 - DNA, 1119 bp, Rhizobium leguminosarum
  CDS (1)..(1119)
atggtttcccgcacacgcaccgctacgatcgcgcagggagccacgggctatctgatgatcgatcttgccgccctcggccgtaactatcgcaagctcgtatcgatgctggcaccggtccgcgccggcgccgtcgtcaaggccgatgcctatggtctcggcgccgagcgggtcgcgagaacgctttacagtgaaggttgcaggcatttcttcgtcgcccaatttgtcgaggccgtgaggctcagaccggcccttgcgcacgacgcccagattttcgtgctgaacggcttgcagccgggcaacgagatcgcctgcgccgagatgggcattgtcccggttctcaattcgctggcgcagtggcggcagtggtcggcggctgcgcgcattctgaagcgctgcctgccagccgtcctccaattcgacaccgggatgtcgcggctcggttttccccgggaagagcgaagagagctggcggcggctcttcgcgatggcagcaatgtcgaaatcctgttcatcatgagccatctggcttcggccgatgacatgggcagcgagcagaacggcgaacagtttgccgagatgtcccgcatcgccgacgaatttcccggcttcgacatttccttcgccaattccggcggcgttttcctgggcgaggcctattacggcgtactcgcccgccccggcatcgcgctttatggcggcgctccgaacgccggcgagaagaacccgatggagccggtcgtcagcctcaatgtcgccgttgtgcagacgcgcaccgtaccggcgggtgcgaaggtcggctatggcggcgcgcatgtcacgcaacgggaaacgcgtctcgccaccattgccgccggctatgctgatggcctgccgcgatgcctcagcgaccgcggcgccgtctatttcaagggcgtccgcctgccgatcgtcggccgcgtgtcgatggacagcacgaccgtcgacatcacagcactgcccgaaggggcgctgaccttcggcagtctcgtcgaagtgctcggccgccatcagacgcttgaggacatcgcgcgcgatgccggcaccatttcttacgaaatcctaactggcctgggcgatcgttacgacaggcaatatcgctaa

SEQ ID NO: 33155 - protein, 372 aa, Rhizobium leguminosarum
MVSRTRTATIAQGATGYLMIDLAALGRNYRKLVSMLAPVRAGAVVKADAYGLGAERVARTLYSEGCRHFFVAQFVEAVRLRPALAHDAQIFVLNGLQPGNEIACAEMGIVPVLNSLAQWRQWSAAARILKRCLPAVLQFDTGMSRLGFPREERRELAAALRDGSNVEILFIMSHLASADDMGSEQNGEQFAEMSRIADEFPGFDISFANSGGVFLGEAYYGVLARPGIALYGGAPNAGEKNPMEPVVSLNVAVVQTRTVPAGAKVGYGGAHVTQRETRLATIAAGYADGLPRCLSDRGAVYFKGVRLPIVGRVSMDSTTVDITALPEGALTFGSLVEVLGRHQTLEDIARDAGTISYEILTGLGDRYDRQYR

SEQ ID NO: 33156 - DNA, 1071 bp, Salmonella typhimurium
  CDS (1)..(1071): transl_table=11
atgacccgccctatacaggccagccttgatttacaggtaatgaaacaaaatttggctattgtgcgccgggcggccccagaggcgcgcgtctggtcggtagtgaaagccaacgcctacggccacggtattgaacgcgtctggagcgcgctgggcgccacagatggtttcgctatgctcaaccttgaagaggcgattaccctgcgtgagcgcgggtggaaagggccgatattgatgctggaggggtttttccatgcgcaagacctggaggcgtatgacacttatcggctgaccacctgcatccacagtaactggcagttgaaagcgctgcaaaatgcgcggcttaacgcgccgctggatatctatgtcaaagtcaacagcggcatgaaccgactcggttttcagcctgagcgggcgcagaccgtctggcagcaattgcgggcaatgcgcaatgtcggtgaaatgaccctgatgtcacattttgctcaggccgatcatccggaaggtatcggggaggcgatgaggcgtattgcgctggcgacggaaggtcttcagtgtgcatactcgttatcaaattcggcagcgacgctgtggcatccccaggcgcattatgactgggtcaggccgggcattattttgtacggcgcgtcgccgtcaggacagtggcgggatattgccgataccggactaaaacctgtgatgacgctgagtagcgaaattattggcgtgcagacgctgagcgcgggtgaaagggtaggctatggcggagggtattctgtgactcaggaacaacgcattggcatcgtcgcggcgggttatgccgatggctatccacgccatgcgccgaccgggacgcctgtgctggtggacggtatccgtaccagaacagtaggcaccgtttcaatggatatgctggcggtggatttgacgccgtgtccgcaggcgggaatcggcacgccggttgaattatggggcaaagaaattaaggtcgatgatgtcgcttctgcggcaggcacgctgggctatgagctactgtgcgccgtagcgccgcgtgtgccgtttgtgacaacgtaa

SEQ ID NO: 33157 - protein, 356 aa, Salmonella typhimurium
MTRPIQASLDLQVMKQNLAIVRRAAPEARVWSVVKANAYGHGIERVWSALGATDGFAMLNLEEAITLRERGWKGPILMLEGFFHAQDLEAYDTYRLTTCIHSNWQLKALQNARLNAPLDIYVKVNSGMNRLGFQPERAQTVWQQLRAMRNVGEMTLMSHFAQADHPEGIGEAMRRIALATEGLQCAYSLSNSAATLWHPQAHYDWVRPGIILYGASPSGQWRDIADTGLKPVMTLSSEIIGVQTLSAGERVGYGGGYSVTQEQRIGIVAAGYADGYPRHAPTGTPVLVDGIRTRTVGTVSMDMLAVDLTPCPQAGIGTPVELWGKEIKVDDVASAAGTLGYELLCAVAPRVPFVTT

SEQ ID NO: 33158 - DNA, 1113 bp, Schizosaccharomyces pombe
  CDS (1)..(1113)
atgaggggggctagagctgttatcgatttgcgcgctattggttacaattacaatctcattagagaattactagacgaaaaaaatccagacgctcacatcttatgcattttaaaggcaaatgcttatggacatggagccgttgaagttgctcaattccttgctaaatattgttcagctgagggttttggcgtcgcatccattgaagaagctctggagttacggcttagcggaatacaaaatagaattcttttgttggaaggcttttttacagatgaagacgaactaagcctgattgataaatataatttttctataactattcactgtgaagaacagttaaaaagttttatgaattatccatttaaaaaaccggttgaagttcacttaaaacttgattctggaatgaatcgacttggatttactcctgcagaatatgctgataaatatcggttactaaaaaatcacaaaaatgttagtggtattgtcaaagccactcactttgcattcgcggatatccctgaaaagtccgaatacacattaaaacaatggagaatttttgaaaaagctgccggctgcttacctgatccacttagtgctggaggtggagtaattgtagtgggttggttaaatacaattcatatggattggttacgcactggctctatgctatacggacttgatccatatgatctcgacgctaaggctcctgaattacctaaaccgttgattccggctatgaagttaatgtctactattgtttgtgtaaagcacgttgaaaaagatcaacctattggttatggtggtgcatatgtgacaactcgtgattcgcttataggcgttgttgctataggctatggtgatggatttcctcaagttagaaatggatgtcccgtaataataaatggaaagagagtaccaacagtaggaaaagtttgtatggatatgctggctattgacgttacagacgtcccggatgttaaaaggggtgatgatgttgttttgtgggggaatccagaactgacaatagaagaagtatcaactttttctaacgaaaacccgtttgaaatcattacaggacttaccagacgtgtaccattacagtatacgttctaa

SEQ ID NO: 33159 - protein, 370 aa, Schizosaccharomyces pombe
MRGARAVIDLRAIGYNYNLIRELLDEKNPDAHILCILKANAYGHGAVEVAQFLAKYCSAEGFGVASIEEALELRLSGIQNRILLLEGFFTDEDELSLIDKYNFSITIHCEEQLKSFMNYPFKKPVEVHLKLDSGMNRLGFTPAEYADKYRLLKNHKNVSGIVKATHFAFADIPEKSEYTLKQWRIFEKAAGCLPDPLSAGGGVIVVGWLNTIHMDWLRTGSMLYGLDPYDLDAKAPELPKPLIPAMKLMSTIVCVKHVEKDQPIGYGGAYVTTRDSLIGVVAIGYGDGFPQVRNGCPVIINGKRVPTVGKVCMDMLAIDVTDVPDVKRGDDVVLWGNPELTIEEVSTFSNENPFEIITGLTRRVPLQYTF

SEQ ID NO: 33160 - DNA, 1086 bp, Staphylococcus aureus
  CDS (1)..(1086)
atgacagcaacatggtctgtaaataagaaaatatttttacaaaatgcaatcacagtcaaaaacaatcagccattaatggcagttgttaaaaataatgcatatcactatgacctagaatttgctgtaactcagtttatccatgcaggtatagatacatttagcacaacatcactacgagaagcaattcaaattagacaacttgctccagatgcaacaatctttttaatgaatgcagtttacgagtttgatttagtccgtgaacatcaaatacacatgactttgccgtcgttgacatattactataaccataaaaatgatttagctggtattcatgttcacttagaatttgaaaatttattacatcggtctggatttaaagatttaaacgaaattaaagaagtattgaaagatcaccatcataatcaaaatgcaaaaatgattattagtggtttatggacccattttggatatgctgatgaattcgatgtgtcagattataatgttgaacgttcacaatggatggaaattgttgaagcacttttatctgaaggttatcagttcgacctaatccatgctcaaaatagtgcgagtttttatcgggaaggacaaatattactaccccaccatacacatgcgcgtgtaggtattgcgttatacggttcaagaccatatagttcactgaatcaacatgatatagttcagtcattaactttaaaagcacatgttattcaagtgcgcgaagtacaagctggtgattattgcggttatagctttgcctttgaagtgactaaaaacaatacaaaattagctgtagttgatatcggttatggcgatggaattttaagaactcgtgctaaacatgaagcacttatcaatggtaaacgctacccgatacgtgcattaatgatgagccatatgtttgttgaagtagatggcaatgtacatgcacaagatgaagttattctttataataatgatatccgcatcgatgaatatacctttaaaggtgttggtgcaaattctgaacaattaagtgctatgaatcatgattctttaaaaaaggagtacatttcaaatgactgttaa

SEQ ID NO: 33161 - protein, 361 aa, Staphylococcus aureus
MTATWSVNKKIFLQNAITVKNNQPLMAVVKNNAYHYDLEFAVTQFIHAGIDTFSTTSLREAIQIRQLAPDATIFLMNAVYEFDLVREHQIHMTLPSLTYYYNHKNDLAGIHVHLEFENLLHRSGFKDLNEIKEVLKDHHHNQNAKMIISGLWTHFGYADEFDVSDYNVERSQWMEIVEALLSEGYQFDLIHAQNSASFYREGQILLPHHTHARVGIALYGSRPYSSLNQHDIVQSLTLKAHVIQVREVQAGDYCGYSFAFEVTKNNTKLAVVDIGYGDGILRTRAKHEALINGKRYPIRALMMSHMFVEVDGNVHAQDEVILYNNDIRIDEYTFKGVGANSEQLSAMNHDSLKKEYISNDC

SEQ ID NO: 33162 - DNA, 1167 bp, Thermoanaerobacter tengcongensis
  CDS (1)..(1167): transl_table=11
atgtttgatgagataaggcccacaagggtagaggtaaatttggacagtatagtccataattttagggaaataaagagggtggttggagatagggttaaagtgatgggggttgtaaaggccaatgcgtatggccatggggcgtatcacgttgcgaaagcattagtagaaaatggtgttgattatcttgctgttgctacagtagaagaggcattggaattgagaagctacgggattactgcccctgtcctaattttgggttacacccctttaagccaggcaggagaggctgtggagaaagatgtgacttttaccgcctttgatttaaagtatgtaaaggagttaggggaaatagccagtaggaaaggaaaaaaagcaaaaattcatgtaaaaattgatacagggatgggacggatagggtatactgattttgatttagcagaaagagaaattgaagagatgtcaaagcttgaagggattgaattggaaggcatatttagtcattttgctacttccgacgaaaaagataaggactatgcgagggaacagtttgaaagatttgcggatatgctaaagcgtttagaaaaaagaggagtaaatatcactttgaagcatattgctaacagcggagctataactgatttaaattatgcatatcttgacatggtaaggcccggaataactctttacggcagttacccttctaatgatgttaataaaattttagacttaagacctgccatgaactttaagaccaaaatagtctacataaaagaagtgccggaaaatacttctataagctatggaagaacttttataactaaaaggcctagcaaaatagctactctaccgataggatatgcggatggactcaacagacttctttcaaataaccatgaagtgctggttagaggtaaatatgtgccgatagtaggtagagtatgcatggaccagaccatgatagatgtgacagaagtagagggagtagaggtaggagacgaggtggtcatatttggagagcaggaaggaaagaggataacggcagatgatatagctaaaaaacttcgcactattcctcacgaagtatattgtggaatatctagaagggtacctagaatatatatttacagaggagaagttttcgatgtaaaaaattatttaaaaatttaa

SEQ ID NO: 33163 - protein, 388 aa, Thermoanaerobacter tengcongensis [sequence omitted]

SEQ ID NO: 33164 - DNA, 1179 bp, Vibrio cholerae
  CDS (1)..(1179)
atgccttctttctctctctctgctgcgccattacacatcgacaccgctttaccggatgccgctcaaattcagcaaagtaattcttggctggagattagcttaggccaattccaaagcaacattgaacaattcaaatcacacatgaacgccaacaccaaaatttgcgccatcatgaaagccgacgcttacggtaacggtattcgtggtttaatgccgaccattatcgcgcaaggcattccttgtgtgggggtggcaagtaatgcagaggcgcgtgcggtgcgtgaaagtggctttaaaggtgaactgatccgtgtgcgctctgccagcctaagtgaaatgtcctcggcactcgatctcaatatcgaagagctgattggtacccaccaacaagccctcgatctggcggagcttgccaaacaaagtggtaaaacgctcaaagttcacatcgcgctgaatgacggcggcatgggccgtaacggcattgatatgaccacggaagccggcaagaaagaagccgtctctattgcgactcaaccttcgttgagtgtcgttggcattatgacccacttcccgaattacaatgcggacgaagtgcgcgcaaaactggctcaattcaaagagagctcaacttggctaatgcaacaagccaatttgaaacgtgaagagatcacactgcatgttgcgaactcttacaccgcgctcaatgtgccagaagcacaactggacatggttcgtccaggtggcgtgttgtttggtgatttgccaaccaaccctgaatacccatcgattgtttctttcaaaacacgtgtgtcttcgctgcaccatttgccaaaggactcaactgtgggttatgacagtacttttactaccagccgtgacagtgtgctggcgaacctgcctgtgggttattctgatggttacccgcgcaaaatgggcaataaagccgaagtgctgatcaatggacaacgcgccaaagtcgtgggagtgacatcgatgaacaccactgtggttgatgtgaccgagattaagggcgtgctccccggtcaagaagtggttctgtttggtcagcaacagaagcaaagcatcgcggtcagtgagatggaaaacaacgctgagctgattttccctgagttgtatacgctgtggggaaccagtaacccacgtttctacgtgaaataa

SEQ ID NO: 33165 - protein, 392 aa, Vibrio cholerae
MPSFSLSAAPLHIDTALPDAAQIQQSNSWLEISLGQFQSNIEQFKSHMNANTKICAIMKADAYGNGIRGLMPTIIAQGIPCVGVASNAEARAVRESGFKGELIRVRSASLSEMSSALDLNIEELIGTHQQALDLAELAKQSGKTLKVHIALNDGGMGRNGIDMTTEAGKKEAVSIATQPSLSVVGIMTHFPNYNADEVRAKLAQFKESSTWLMQQANLKREEITLHVANSYTALNVPEAQLDMVRPGGVLFGDLPTNPEYPSIVSFKTRVSSLHHLPKDSTVGYDSTFTTSRDSVLANLPVGYSDGYPRKMGNKAEVLINGQRAKVVGVTSMNTTVVDVTEIKGVLPGQEVVLFGQQQKQSIAVSEMENNAELIFPELYTLWGTSNPRFYVK

SEQ ID NO: 33166 - DNA, 1227 bp, Vibrio vulnificus
  CDS (1)..(1227): transl_table=11
atgaactttaaaaagacccttctatccattgccatcgctagcgccagtctcactccggctttctcttacagcgcacctctcttactcgacaacacggttcaccaaaccagccaaatcgctggggccaatgcttggctcgaaatcagcctcggccaattcaaaagcaacattgaacaatttaaatcgcacattgccccacaaaccaaaatttgtgcggtgatgaaagccgacgcttatggcaacggaattcgtggtttgatgccaaccattcttgaacaacaaattccctgcgtggctatcgccagtaatgcggaggctaaactcgtccgagaaagtgggtttgaaggcgagttaattcgcgtgcgctccgctagcacaagtgaaattgaacaggcactctctcttgatatcgaagagttaattggcagtgagcaacaagctcgtgagttagcaagcttggcagaaaagtacagcaaaaccattaaagttcaccttgctcttaatgacggtggcatgggccgtaatggtattgatatgagtaccgaacgtggaccaaaagaagcagtcgccattgcaacgcacccttcggttgccgtggtcggtatcatgacccatttcccgaattacaatgcagaggatgtacgaacaaagctaaaaagctttaaccaacatgcacagtggttaatggaaagtgcagggctaaaacgtgaagagatcaccctacatgtggccaattcctacaccgcgttgaatgtccctgaagcgcagttggatatggttcgcccaggtggtgtgctctatggtgatctcccgaccaaccctgagtacccttctattgtggcgttcaaaacccgcgttgcttcacttcattcgcttccggcaggcagcaccgtgggttacgacagcacgtttaccacagcaaatgacgcagtgatggcaaacctcacggtcggctattccgatggctacccacgaaaaatgggcaacaaagcgcaagtgctgatcaacggccaacgcgccaatgtggtgggcgttgcttcaatgaatactacgatggtggatgtgtccaatatcaaaggcgtgttacccggcgatgaggtgacgctctttggtgctcaaaaaaaccagcacatctctgtcggtgaaatggaagaaaacgccgaggtaattttcccagagctttacaccatttggggcaccagcaacccgcgcttctatgtgaagtga

SEQ ID NO: 33167 - protein, 408 aa, Vibrio vulnificus
MNFKKTLLSIAIASASLTPAFSYSAPLLLDNTVHQTSQIAGANAWLEISLGQFKSNIEQFKSHIAPQTKICAVMKADAYGNGIRGLMPTILEQQIPCVAIASNAEAKLVRESGFEGELIRVRSASTSEIEQALSLDIEELIGSEQQARELASLAEKYSKTIKVHLALNDGGMGRNGIDMSTERGPKEAVAIATHPSVAVVGIMTHFPNYNAEDVRTKLKSFNQHAQWLMESAGLKREEITLHVANSYTALNVPEAQLDMVRPGGVLYGDLPTNPEYPSIVAFKTRVASLHSLPAGSTVGYDSTFTTANDAVMANLTVGYSDGYPRKMGNKAQVLINGQRANVVGVASMNTTMVDVSNIKGVLPGDEVTLFGAQKNQHISVGEMEENAEVIFPELYTIWGTSNPRFYVK

SEQ ID NO: 33168 - DNA, 1161 bp, Anabaena sp
  CDS (1)..(1161)
atggcttctcatcaacaatgtgatacctatgcttggttttcacaacgcgcttgggtagaaattgacctagaggcgttgtcgcacaatgtccagcaacttaagcagtttttatcaccgcgtactcagttaatggcagtagttaaagcagatgcttatggtcatggtgctgtgacggtggcacagacagcattacaagcgggggctagttgtttgggtgtcgccactgttccagagggtattcaattgcgagaggccggtattcaagcgcccattttgattttaggggctacccatacaccagaacaaattcaggcgatcgctcaatggcaactccaagcaactattggtagtcccaaacaagctttaatattttccaataccttggaaaccatccagcatgattctcctatacctgtacatattaagttagatacgggtatgtctagactgggtactaactggcaacaagcaggggagtttgtacagttagtagagcgtttaccccatttggatattgctagtgtttactcccacctagcgaccgcagatagcccagatccagggattatggaagaacagcatagaagatttgaggaggcgatcgctcaaatcaaaactttgggtattaaaattcctagcctgcatttagcaaactcggctgcaaccctggcagatccgagattacactatgatatggtacgggtaggtttagccgtgtatggactctatccagcccctcatttacagaataaaatcagcctaaaaccagtcatccaagtccaagcgcgaattacccacgtcaaaacaattgctgccggtactggcgtaagctacggacaccaatttatagcccctcatgaaatgcgccttgccgttgtgagtattggttacgctgatggcgtaccgcgtaatctatccaacaaaatgcaggttttaattcgtggtcaacgagtgccacaaatcggtgctatcacgatggatcagttgatgatagatgctagtgctttaccagacctacaagaaggggaaattgtcaccttacttgggaaacaaggaaaggaaaaaatcacagccgatgattgggcagaagcgttaaacactatttcctgggaagttctttgtggatttaaacatcgcctacctcgtgtaggcgtgatgtga

SEQ ID NO: 33169 - protein, 386 aa, Anabaena sp
MASHQQCDTYAWFSQRAWVEIDLEALSHNVQQLKQFLSPRTQLMAVVKADAYGHGAVTVAQTALQAGASCLGVATVPEGIQLREAGIQAPILILGATHTPEQIQAIAQWQLQATIGSPKQALIFSNTLETIQHDSPIPVHIKLDTGMSRLGTNWQQAGEFVQLVERLPHLDIASVYSHLATADSPDPGIMEEQHRRFEEAIAQIKTLGIKIPSLHLANSAATLADPRLHYDMVRVGLAVYGLYPAPHLQNKISLKPVIQVQARITHVKTIAAGTGVSYGHQFIAPHEMRLAVVSIGYADGVPRNLSNKMQVLIRGQRVPQIGAITMDQLMIDASALPDLQEGEIVTLLGKQGKEKITADDWAEALNTISWEVLCGFKHRLPRVGVM

SEQ ID NO: 33170 - DNA, 1017 bp, Aquifex aeolicus
  CDS (1)..(1017): transl_table=11
atgcccagagctattctggagataaacagtgaaaggataagacacaacgtcaagaagttatcggagttttccgggaaaaaggttatagcggttataaaggcggacgcctacggtataggttctatacaaatggcaaaaatactagagcctattgaagaagtggacgctttcgcggtagcctgcgttgaagagggggttgaactcaggaaaatgggaataaaaaaggaaatactcatactgggaggagtactgaaggatgaagtccctttagtagaggagtacttccttacccccgttgtttcggatattgagcacctgagagctataggaaacagggatataaagtttcacgtaaagtacgacacgggaatgggaagacttgggtttttgaacgaagttatacacgacccgagggtggaagggataatgagtcacctctcgagcccggcggacgaagaattttccaaactccagataaagaagtttgaggagatagttaagaagtacacaaaagttgagaaaatccacatggagagttcagcaggtgttgtgtacagagtgccttttaccactcacataagggtagggcttgcaatgtacggcgaaaaacccctgaagaattaccccgttgatataaaacccgcactcactcttaaagctaagttaatatccgtaaaggaacttcctgaaaattatccggtatcttacagcaggacgtacgtaactaagaaaaaaacgaaaacaggtgtagttgccttcgggtacgcggacggactcatgaaaacactgtccaacaggagttatttgctttataagggagaaaagctaccaattttcgggaacattaccatggacatgacaatagtggacctgaaaaatacggacgcaaaggtaggggattgggtttacgtggtaaacgaagaaagaacctttacggaacttgcaagagaagcgggaacgataccctatgagctcatgtgcaacttatcaaaaaggattaaaagagtcgtagtgtag

SEQ ID NO: 33171 - protein, 338 aa, Aquifex aeolicus
MPRAILEINSERIRHNVKKLSEFSGKKVIAVIKADAYGIGSIQMAKILEPIEEVDAFAVACVEEGVELRKMGIKKEILILGGVLKDEVPLVEEYFLTPVVSDIEHLRAIGNRDIKFHVKYDTGMGRLGFLNEVIHDPRVEGIMSHLSSPADEEFSKLQIKKFEEIVKKYTKVEKIHMESSAGVVYRVPFTTHIRVGLAMYGEKPLKNYPVDIKPALTLKAKLISVKELPENYPVSYSRTYVTKKKTKTGVVAFGYADGLMKTLSNRSYLLYKGEKLPIFGNITMDMTIVDLKNTDAKVGDWVYVVNEERTFTELAREAGTIPYELMCNLSKRIKRVVV

SEQ ID NO: 33172 - DNA, 1026 bp, Aquifex pyrophilus
  CDS (1)..(1026): transl_table=11
atgagaagggcggttcttgagatactggaggagagaataatacacaatgtaaaggagatacacaggttcagcgggaagaggataatagctgtcgttaaggcaaacgcatacgggataggggtgagggaggtatcaaggatacttgaagggcttgaggaggttgatgcctttgcggttgcctgcacccaggaaggtgttgaactgagggaatgcggaattaagaagaagattctcatacttggaggcatacttgaggaggatgtaaagctccttgaggagtatgatttaacgcccgttatttcggaccccgaacaccttaaggttctaaaagacagaaatataaagtttcacgtaaagtacgatacggggatgggaaggctcggatttacaaacgaaattataaaggacccaagagttgagggagtcatgtcccacttctcaagccctgcggacagaaatttttccaaactacagataaagcgttttgaggaaattcttaagaattacgaaaaggttaaatacatacaccttgagagttccgcaggtctcatttacagggttccttttacaacccatgtgagagtaggacttgcgatttatggagaaaaacctctgaaggattacccccttgaggttaaaccggcactgagactgagggcaaggctcatatccgtaaaggagcttcccgaaaattaccctgtatcctacggaagaacctatataacgaaaaggaaaacgaagctcggcgttgtcgcctttggatatgcggatggacttatgaaaacactatcaaacaggagcttcctgatttttgaaggaagaaaagttcccataataggaaacataaccatggacatgaccatggtggacctgagcggaacggaagcaagaacgggagactgggtttacatcgtaaacgaggagagaagctttacaccccttgcgagggatgcgggaacaattccctacgagataatgtgcaatctctcaaggagggttgagagactcgtaattaagaaaaggtaa

SEQ ID NO: 33173 - protein, 341 aa, Aquifex pyrophilus
MRRAVLEILEERIIHNVKEIHRFSGKRIIAVVKANAYGIGVREVSRILEGLEEVDAFAVACTQEGVELRECGIKKKILILGGILEEDVKLLEEYDLTPVISDPEHLKVLKDRNIKFHVKYDTGMGRLGFTNEIIKDPRVEGVMSHFSSPADRNFSKLQIKRFEEILKNYEKVKYIHLESSAGLIYRVPFTTHVRVGLAIYGEKPLKDYPLEVKPALRLRARLISVKELPENYPVSYGRTYITKRKTKLGVVAFGYADGLMKTLSNRSFLIFEGRKVPIIGNITMDMTMVDLSGTEARTGDWVYIVNEERSFTPLARDAGTIPYEIMCNLSRRVERLVIKKR

SEQ ID NO: 33174 - DNA, 1167 bp, Bacillus halodurans
  CDS (1)..(1167)
atggaacatttttatcgagacacttgggtagaagttgacttagatgcgattgaacaaaatgtgacgaacgctcttcgtctttataaagacagggaaatgaatttgatggctgtcgtaaaagcaaacggttatggtcatggtgctgtagaagtcagtcaagctgctttacgcgcaggggcgtcttatttgtctgttgcttttttagatgaagccctcgctttgcgaaaagcaggaatcgatgcccccattctggtcatgggtctagtgggcgctgagcatgttcagctagccatcaaacatcgtattacgttaaccgtttatcaattggactggctggaacaagcgatctctcgcttgcacactagagacaagctagccattcatttaaagctagatactggaatgggacgaattggattacggcgaaaagaggatattcgctcatgtatggattttatcgcatcccacgaatgctttgaattagaaggagtttttacccattttgccacagctgatgagaaggatttaacgtattttaagaagcaatgtcaacgatttaatcagtggcttgagtacattcgtgaatggcagttgcccattcggtacgttcattgcggcaatagtgcagcaggccttaggtttcctgagaaaaattttaatatgttccgctttggcatcgccatgtacgggctcaccccatcccctgaaataacagatgagcttccattcccattaaagcaggctttttcattaaaatcacgactctccaacgtgaaaaaactaccgaaaggagaaggcattagctatggagctacgtatgtgacagagggtgctgaatggattggtactctgccgatcgggtacgcagatggttggattcgccatcattccaatgctggagggcatgttttgatcgatggaaagcgggctccttttgttggtcggatttgtatggatcaatgtatgattcgtttaccgaaaaaacattcaattggtgatacagtaacgttaatcggggaaagtgatgggaagcaaattacgatggacgaagtagcaaaacggctgaacaccattaactatgaaattccttgcgtgatttcgtggcgggtaccgcgtatatattttcgagatggacaaataatatctgttaaaaataaccttttgtga

SEQ ID NO: 33175 - protein, 388 aa, Bacillus halodurans
MEHFYRDTWVEVDLDAIEQNVTNALRLYKDREMNLMAVVKANGYGHGAVEVSQAALRAGASYLSVAFLDEALALRKAGIDAPILVMGLVGAEHVQLAIKHRITLTVYQLDWLEQAISRLHTRDKLAIHLKLDTGMGRIGLRRKEDIRSCMDFIASHECFELEGVFTHFATADEKDLTYFKKQCQRFNQWLEYIREWQLPIRYVHCGNSAAGLRFPEKNFNMFRFGIAMYGLTPSPEITDELPFPLKQAFSLKSRLSNVKKLPKGEGISYGATYVTEGAEWIGTLPIGYADGWIRHHSNAGGHVLIDGKRAPFVGRICMDQCMIRLPKKHSIGDTVTLIGESDGKQITMDEVAKRLNTINYEIPCVISWRVPRIYFRDGQIISVKNNLL

SEQ ID NO: 33176 - DNA, 1152 bp, Bacillus psychrosaccharolyticus
  CDS (1)..(1152): transl_table=11
gtgactttgcaaaatttttatagagatacttgggcagaaatcaatttagatgctattttcgagaatgcagcaaatatgaaaaaacacctgcctcctgagattactctctttgcagttgtaaaggcaaatgcatatggtcatggcgatgttgaggtagctgagactgctattcaggctggtgcgggttatttagcagtagcctttttagatgaagcactcgcattacgaaaaaaaggaataacggcaccgattttggtcttaggagcatcacgccctgaagatgctcaaattgctgctagagaatcaataaccttaactgtttttcaagcaggctggcttgaagcagctcagtcttttcttgagggaactgttcttactatacatttaaagtgtgatagtgggatggggagaattggtatacgaaaacaagaagagatgaatgaaatcgaacgttttcttcagaaaacgaagtgttttgtactagagggaatctttactcacttcgctactgcggatcaactagatacagagtattttagtaaacagcttgctcgatttgaggaaatgctgacgtggctcaaggaaaaaccaaaatatgtccacgcggcaaatagtgccgcattattgagattcccgaatgcagtcttcaattcagttcgcatgggcatttctttatatggcttgtcaccctccatggaaatgaaagaagttttaccttttgcgctgcgtccagctttttcgttaaagactaaacttgtgcatgtcaagaatatctcgaaaggccaaagcgtcagttatggagcaacctatacagcagaagaagatacctggattggaacattgcctattggatatgcggatggctggattcgaatgctccaaggtcaggaagtgctgcttgaaggtggaaggtctccgttagttgggcggatatgtatggaccaatgtatggttaaattatcgcgagagtttccagtaggtactgaggtaacgttaatagggaagaacggcactgagtgcatcactgtcgatgatattgctgagaaactaaatacaataaactatgaagtaacttgtatgatttcatcccgagttccccggatgtacctgaaggacggacggataactggagttgttaatcaactaatataa

SEQ ID NO: 33177 - protein, 383 aa, Bacillus psychrosaccharolyticus [sequence omitted]

SEQ ID NO: 33178 - DNA, 1119 bp, Borrelia burgdorferi
  CDS (1)..(1119): transl_table=11
atgtataataataaaacaatgggtagtaacaaaacaataataataaatttaaataatttagaacataacttaaatttaattaaaaataaaattggcgaaaaagaaatagtggccaccttaaaaggtgacgcatatggtcacggacttataaacatctttaaatttttaaaatcaaaaaacataaattattttggactttctaatattgaagatgctaaaacacttaaaaaaattgataaaaatataaaaatattaatgtacattaaggtggataaaaaagaaattaaaaatttgattaaatttgagttagtaccatttgtttctgattttgaatatctatttttaatagaaaaagaatgcgcattgcaaaaaaataaaataaaagtccacttaaaaattgatatcggaatgaatagatatggaataaaaatagatgatgcccttgaaatagctacatatattcaaaattcaaaatttctagaactagaagggatctgctcacatctcccatcaatagaaaactttaaaaccacacaaaagcaaatagagcaattcttattttttttagaaacactaaaacaaaaaaatattcatcccaaatttgtccatatttctaattcagggcacattattaactacaaactaaatccacaatttaatatggtaagaccaggtcttattctttacggttactgtcaatcgctaaaaaacaaaaaacctgctttaaattttaagcctgtattaagtttattttcaaaagtaatatttatcaaaaatgtcaaaaagggtgaaaaaatttcatattcgggtatatttcaagccaaagaagatatgaaaataggaattattccaatcggatattttgatggaatacctcaaaatataagtaatgatttttattttttaataaacaataaaaaatgtaaaataagaggaaaagtttgcatgaatctgacaatagtagaaattcccaaagacctaaaagttaaaacaggttcaaaagtagaaattgtatcagaaaaattaagtatagatgaaatgagtaaattttctaaaagaagtcattatgaattactatgtaatataggaaaatacgaaaagagaaaatacttagattaa

SEQ ID NO: 33179 - protein, 372 aa, Borrelia burgdorferi
MYNNKTMGSNKTIIINLNNLEHNLNLIKNKIGEKEIVATLKGDAYGHGLINIFKFLKSKNINYFGLSNIEDAKTLKKIDKNIKILMYIKVDKKEIKNLIKFELVPFVSDFEYLFLIEKECALQKNKIKVHLKIDIGMNRYGIKIDDALEIATYIQNSKFLELEGICSHLPSIENFKTTQKQIEQFLFFLETLKQKNIHPKFVHISNSGHIINYKLNPQFNMVRPGLILYGYCQSLKNKKPALNFKPVLSLFSKVIFIKNVKKGEKISYSGIFQAKEDMKIGIIPIGYFDGIPQNISNDFYFLINNKKCKIRGKVCMNLTIVEIPKDLKVKTGSKVEIVSEKLSIDEMSKFSKRSHYELLCNIGKYEKRKYLD

SEQ ID NO: 33180 - DNA, 1191 bp, Brucella suis
  CDS (1)..(1191)
atgtctttacctttttctcaggatgagcgcgatctcgcggctggcggcatattgaccattgatctcgcagccctgcgccacaattattcagccatcgcaacccgcattgccccaacccgtacggccgctgtggtaaaggcagacgcctatggcctgggcgcaagccgggtcgcaccggctttctacgaggccggttgccgcgatttcttcgttgcacatcttggcgaagcagtggcgctgaagccctttttgaaacctgacgcaacactttatgtcctgaacggccttcagcccggaacggaagcagcctgtgcccgcgaaggcatcctgcctgttctcaattcgctggaacaggttgaaaactgggcagcactcgccacccggctgggcaaaaaactgcccgccctgctccagttcgataccggcatgtctcgtcttggcctgtcagccaaggaatttgaccgccttcttgagaacgtcacgctcctgagcaggatcgacatcaaattcgccatcagccatctggcaaacggcgacgagccgggaaatgcggcaaatgcccgtcagcttgccaagatgacggccttgctcgctcgcctgccgaaactgccggctgccttggccaattccggcggcaccttcctcggcaagacctattatttcgatctcgcccgccccggcatcgcgctatatggcatcgatccggagaggcagcatgacttttcggataaggtggcgcacgagaataagaaacccaagcattcgatccttcccgtcctcaccctttcggcgcgtgtcattcaggtgcgcgacgtcgacaagggagcgacagttggctatggcggcacctatgtcgccaacggcccgatgcggattgcgacgattgcggtcggctatgctgacggcttgttccgttccttgagtaacaagggcgcagcctttttcggcgatacgcgcctgcccatcatcgggcgcgtatcgatggattcgatcacgctcgacgtcacctcattgccggagggaacgctgaaactcggcagccttgtggaattgatcggcccgcatcagcgcctcgaagacgtggcgcgggactgcgacactatcccctatgaaattctgactgcgcttggcaaccgttatgcgcgcgtttacgtttacgtgaatggcggtggcaccagcacaacagcataa

SEQ ID NO: 33181 - protein, 396 aa, Brucella suis
MSLPFSQDERDLAAGGILTIDLAALRHNYSAIATRIAPTRTAAVVKADAYGLGASRVAPAFYEAGCRDFFVAHLGEAVALKPFLKPDATLYVLNGLQPGTEAACAREGILPVLNSLEQVENWAALATRLGKKLPALLQFDTGMSRLGLSAKEFDRLLENVTLLSRIDIKFAISHLANGDEPGNAANARQLAKMTALLARLPKLPAALANSGGTFLGKTYYFDLARPGIALYGIDPERQHDFSDKVAHENKKPKHSILPVLTLSARVIQVRDVDKGATVGYGGTYVANGPMRIATIAVGYADGLFRSLSNKGAAFFGDTRLPIIGRVSMDSITLDVTSLPEGTLKLGSLVELIGPHQRLEDVARDCDTIPYEILTALGNRYARVYVYVNGGGTSTTA

SEQ ID NO: 33182 - DNA, 1095 bp, Caulobacter crescentus
  CDS (1)..(1095): transl_table=11
gtgaccgacgcccaagacacccgcatcaccatcgatctcgacgccctggcgcataactacgcggccttgcgcgcgcgcgccggtgacgccgaggtggctccggcggtcaaggccgacgcctatggcctcggcgccgcgcccgtggccgatcgcctgtgggcggaaggcgcgcgcagcttctatgtcgcgcgattggctgagggcgtggccctgcgccggtcgctcggtgaccgcgaggccacgatctatgtgctggacggcgcgacgccgggttcgggcgaggcgctggaaggcgcgcagttggtccccgtgctcaacagcctgccgcaggtcgaggcctggaacgtgcaggcgcgatcgggacggctgcgggcggccctgcacatcgacaccggcatgaaccggcttggcctgcgccccgaggagctgaaggtgctggtcgggtccttcgaccggctcaagcgcttggatgtggagctggtcgtcagtcacctggcctgcgccgacacccccgagcatcccctgaacgccacgcagctggcgcgtttccaggaggccgccgccctgttgccgggcgttcggcgaagcctggccaattccggcggcctgtttctcggtgaggcctatcggttcgaccagacccgccccggcgtcagcctctacggcggtggccccgaaggccgtccccaccccgagatccgggcggtcgccaccgttgaggcgccgatcctgcaggtccgtgtcgtgccgcgcggcgaaagcatcggctacggcgccggatggaccgccagcgacaacacccgcgtcgccattgtcgcggcgggctacgccgacggcgtgccgcgcgccgcctttccgcgcggcgaggtgtggttcgacggcgcgcggcggccgatgctgggccgcgtgtcgatggacctgatcgcggtggatgtcaccgactgcgacgcggcccgtccgggtgctatggtcgagctgttcggggccaaccttcccgtggacgacgccgcagacgccgccgggacctcggcctatgagcgcctgacccgactgacgctgcgcggggttcgccgatacgtcggaggggcacgctag

SEQ ID NO: 33183 - protein, 364 aa, Caulobacter crescentus
MTDAQDTRITIDLDALAHNYAALRARAGDAEVAPAVKADAYGLGAAPVADRLWAEGARSFYVARLAEGVALRRSLGDREATIYVLDGATPGSGEALEGAQLVPVLNSLPQVEAWNVQARSGRLRAALHIDTGMNRLGLRPEELKVLVGSFDRLKRLDVELVVSHLACADTPEHPLNATQLARFQEAAALLPGVRRSLANSGGLFLGEAYRFDQTRPGVSLYGGGPEGRPHPEIRAVATVEAPILQVRVVPRGESIGYGAGWTASDNTRVAIVAAGYADGVPRAAFPRGEVWFDGARRPMLGRVSMDLIAVDVTDCDAARPGAMVELFGANLPVDDAADAAGTSAYERLTRLTLRGVRRYVGGAR

SEQ ID NO: 33184 - DNA, 1161 bp, Clostridium perfringens
  CDS (1)..(1161)
atggatatatgtgttagacctgtatgggctgaaatagatttagatataatagcaaataatatgaaagaaataagaaacctagttggtgaaaaggaaataatagccgttgttaaggctaatgcttatggtcatggagctttagacatagcttccactcttttagaaaatggtgcttctagattggcagtagctataatcacagaagctgatgaacttagggatgctggaataactgcacctattatgattttaggatatactcctataaatttcgctgaaaatttaatcaataatgaaattgaacaaacagtttatgatgtggagtatgctaaggaattatctgactttgccttaaagcttggcaaaaaagctaaaatacacattgcaatagatacaggaatgggcagaataggtttccttccaaatgaagagggattaaataaagttttagaaatatgctctttacctggagttgaggtaataggcttgtttactcacttctcaacatcagatgaaaaagataaaacttatacttatgaacaattttcaaaattaactgcttttaataaagctttagaagacaatggaatacacattcctttaaaacatgcttctaatagtggggctattatggatttaccagaaacttatttagacggagttagatgtggaattatttcttatggatactatccatctgaagaagtaaaaaaagaaaacttaaaacttaaaccagcacttacattaaaaactaatgtagcctttgttaaagagttagatgaagatatgtatgtaagctacggaagaacttataaaactgaaaagaaaagtaaaattgccactcttccaataggatatgctgatggatattcaagacttcttagtggaaaagctaaagttataataaagggtcaatttgctaatgttataggaagagtttgtatggatcaatgtatgattgatgtaactcatatagaagatgttaaaattggtgatgaagtaattcttttaggggaagaaaatggattaaaatttgatgctaatgatatggctgaaattatgggaacaataaactacgaaatactttgtatgattagccacagagttcctagaatatataaaaagaataatgaaatagttaaggtaagaaactatatttaa

SEQ ID NO: 33185 - protein, 386 aa, Clostridium perfringens
MDICVRPVWAEIDLDIIANNMKEIRNLVGEKEIIAVVKANAYGHGALDIASTLLENGASRLAVAIITEADELRDAGITAPIMILGYTPINFAENLINNEIEQTVYDVEYAKELSDFALKLGKKAKIHIAIDTGMGRIGFLPNEEGLNKVLEICSLPGVEVIGLFTHFSTSDEKDKTYTYEQFSKLTAFNKALEDNGIHIPLKHASNSGAIMDLPETYLDGVRCGIISYGYYPSEEVKKENLKLKPALTLKTNVAFVKELDEDMYVSYGRTYKTEKKSKIATLPIGYADGYSRLLSGKAKVIIKGQFANVIGRVCMDQCMIDVTHIEDVKIGDEVILLGEENGLKFDANDMAEIMGTINYEILCMISHRVPRIYKKNNEIVKVRNYI

SEQ ID NO: 33186 - DNA, 1086 bp, Corynebacterium glutamicum
  CDS (1)..(1086): transl_table=11
atgaacttgctgaccaccaaaattgacctggatgccatcgcccataacacgagggtgcttaaacaaatggcgggtccggcgaagctgatggcggtggtgaaggcgaatgcatataaccatggcgtagagaaggtcgctccggttattgctgctcatggtgcggatgcgtttggtgtggcaactcttgcggaggctatgcagttgcgtgatatcggcatcagccaagaggttttgtgttggatttggacaccggagcaggatttccgcgccgccattgatcgcaatattgatttggctgttatttctcccgcgcatgccaaagccttgatcgaaactgatgcggagcatattcgggtgtccatcaagattgattctgggttgcatcgttcgggtgtggatgagcaggagtgggagggcgtgttcagcgcgttggctgctgccccgcacattgaggtcacgggcatgttcacgcacttggcgtgcgcggatgagccagagaatccggaaactgatcgccaaattattgcttttcgacgcgcccttgcgctcgcccgcaagcacgggcttgagtgcccggtcaaccacgtatgcaactcacctgcattcttgactcgatctgatttacacatggagatggtccgaccgggtttggccttttatgggttggaacccgtggcgggactggagcatggtttgaagccggcgatgacgtgggaggcgaaggtgagcgtcgtaaagcaaattgaagctggacaaggcacttcctatggcctgacctggcgcgctgaggatcgcggctttgtggctgtggtgcctgcgggctatgccgatggcatgccgcggcatgcccaggggaaattctccgtcacgattgatggcctggactatccgcaggttgggcgcgtatgcatggatcagttcgttatttctttgggcgacaatccacacggcgtggaagctggggcgaaggccgtgatattcggtgagaatgggcatgacgcaactgattttgcggagcgtttagacaccattaactatgaggtagtgtgccgaccaaccggccgaactgtccgcgcatatgtttaa

SEQ ID NO: 33187 - protein, 361 aa, Corynebacterium glutamicum
MNLLTTKIDLDAIAHNTRVLKQMAGPAKLMAVVKANAYNHGVEKVAPVIAAHGADAFGVATLAEAMQLRDIGISQEVLCWIWTPEQDFRAAIDRNIDLAVISPAHAKALIETDAEHIRVSIKIDSGLHRSGVDEQEWEGVFSALAAAPHIEVTGMFTHLACADEPENPETDRQIIAFRRALALARKHGLECPVNHVCNSPAFLTRSDLHMEMVRPGLAFYGLEPVAGLEHGLKPAMTWEAKVSVVKQIEAGQGTSYGLTWRAEDRGFVAVVPAGYADGMPRHAQGKFSVTIDGLDYPQVGRVCMDQFVISLGDNPHGVEAGAKAVIFGENGHDATDFAERLDTINYEVVCRPTGRTVRAYV

SEQ ID NO: 33188 - DNA, 1065 bp, Fusobacterium nucleatum
  CDS (1)..(1065): transl_table=11
atgagaacttggatagaaattgataaagaaaatttaaagtacaatgtattaaaattaaaggaaattgctaataataaagaaattttaggagttgtaaaagctaacgcttatggtttagggtcaatagaaattgctaaaattttaaaagaagtcgaagttaaactttttggtgttgcaaatcttgaagaagctatagagctacaagaagcaggaattaaagataagattttaattcttggggctagctttgaagatgaattagttgaagcaacaaaaagaggagttcatgttgcaattagttctatgggacaactacaatttttagtatctaaaaacttaaatcctaatattcatttaaaatttgatactgggatgacaagattaggctttgaggttgatgatgctgaaaaagttatagaatattgtaaaaataataatcttaatcttgtaggtattttttctcatttatctgattcagatggaaatacaatagaaactaaaaattttacattagaacaaatagaaaaatttaaaaaaattgtcaattctttaaatttagaatatatccatatttcaaatagtgctggaattactaattttcataatgatatccttggtaatcttgttagattaggtataggtatgtattctttcacaggaaacaaaaaaactccgtacttaaaaaatattttcacaataaaatcaaaaattctatttataaaaaaagttaagaaagattcttttgtatcctatggaagacactatactttaccagctgattcaacttatgcggttcttccaataggttatgctgatggacttaaaaaatatctttctaagggtggctatgttttaattaataaccacagatgtgaaattattggaaatatctgtatggatatgactatgattagagttcctaaagaaattgaaaattcaattaaaataggagatgaagttacagttatcaatgctgatattttagataacttaaatatccctgaactttgtgtgtgggaatttatgactggaattggaagaagagttaaaagaattatagtttaa

SEQ ID NO: 33189 - protein, 354 aa, Fusobacterium nucleatum
MRTWIEIDKENLKYNVLKLKEIANNKEILGVVKANAYGLGSIEIAKILKEVEVKLFGVANLEEAIELQEAGIKDKILILGASFEDELVEATKRGVHVAISSMGQLQFLVSKNLNPNIHLKFDTGMTRLGFEVDDAEKVIEYCKNNNLNLVGIFSHLSDSDGNTIETKNFTLEQIEKFKKIVNSLNLEYIHISNSAGITNFHNDILGNLVRLGIGMYSFTGNKKTPYLKNIFTIKSKILFIKKVKKDSFVSYGRHYTLPADSTYAVLPIGYADGLKKYLSKGGYVLINNHRCEIIGNICMDMTMIRVPKEIENSIKIGDEVTVINADILDNLNIPELCVWEFMTGIGRRVKRIIV

SEQ ID NO: 33190 - DNA, 1083 bp, Haemophilus influenzae
  CDS (1)..(1083): transl_table=11
atgaacgtaaaaccggcgacagcgaaaattagttcgcacgccttaaaacagaatttagaaataattaaacaaaaagcaccaaatagcaaaattattgctgtggttaaagcaaacgcctatggtcacggcgttgtattcgttgcttcaaccttagaacaaaatgttgattgctttggcgtggcgcgtttagaagaggctttagcattacgctccaacggcattactaaaccgattttattgcttgaaggttttttcaatgaacaagatttgcctattctagccgttaataatattgaaaccgtggtacacaatcacgaacagcttgatgctttaaaacgtgcgaatttaccaagtccaattaaggtttggttaaaaatagatacgggaatgcatcgcttgggcgttgctcttgatgaagtggattatttttatcaagaactgaaaaaactccctcaaattcaaccgcacttaggctttgtcagccatttcagccgagccgatgaactagaatcagattacacccaacttcaaatcaatcgttttttatccgtcacaaaagataaacaaggtgaacgtactattgcagcgtcaggcggcattcttttctggccaaaatcccacttagaatgtatccgcccaggcattattatgtacggcatttctccaactgatactatcggtaaagagtttggcttaacgccagtgatgaatttaacctcgtcattaattgccgttcgccatcataaacaaggcgatcctgtaggttacggcggtatttggacaagtccacgagataccaaaattggagtggtcgcaatgggttatggcgatggttatccgcgcgatgtgccagaaggtacacctgtttatttaaatggccgtcttgtaccaattgttggacgtgtgtcaatggatatgcttactgttgatttaggcgcagatagccaagatttggtaggcgatgaagtaattttatggggcaaggaattacctattgaaaccgtagctaaattcacaggcattttaagctacgagctaattacaaaattaacacctcgtgttataactgaatacgttgattaa

SEQ ID NO: 33191 - protein, 360 aa, Haemophilus influenzae
MNVKPATAKISSHALKQNLEIIKQKAPNSKIIAVVKANAYGHGVVFVASTLEQNVDCFGVARLEEALALRSNGITKPILLLEGFFNEQDLPILAVNNIETVVHNHEQLDALKRANLPSPIKVWLKIDTGMHRLGVALDEVDYFYQELKKLPQIQPHLGFVSHFSRADELESDYTQLQINRFLSVTKDKQGERTIAASGGILFWPKSHLECIRPGIIMYGISPTDTIGKEFGLTPVMNLTSSLIAVRHHKQGDPVGYGGIWTSPRDTKIGVVAMGYGDGYPRDVPEGTPVYLNGRLVPIVGRVSMDMLTVDLGADSQDLVGDEVILWGKELPIETVAKFTGILSYELITKLTPRVITEYVD

SEQ ID NO: 33192 - DNA, 1134 bp, Helicobacter pylori J99
  CDS (1)..(1134): transl_table=11
atgttaaaaagggcgagttttgtagaagtgaatacccattctttaaggcataattttaatgcagtcaaaaatattgtccctaaagacgcttgtgtcatggcggttgtcaaggcaaacgcttatggggcaggggcgattaaagcgagcgaaatttttttacaagaaggggctaattatttaggggtagcgaccttagatgaagccttagaattgcgctctcatttttctcaaacccccattttgatcttaggttatagccctaatactaacgcttccatgctgattgataacgatttgagcgctatggtttttagccttgaacaagcggaagttttttctcaaatggctttaaagtctcaaaaacgcttaaaagtgcatctcaaaattgataccggcatgcaccgcttgggtttagagcctacttttaaaagcatagaaaccattaaaaaaatccgcgctttaaaaggcttggaagtggaagggatattcacgcatttaagcaacgctgattctaacattaaaacccatgctaaaaaccagatgaaagtctttaacgcttttttagagcagcttttggatcaaaaaatagaatttcaataccgccatgcctataattctgccggcatcctttctttgtgtaacgggaatgaaaatcgtttgttaaacctttatcgcccaggcatcatgctctatggtttttacccttctaatgaaatgaaagagtcgtctcaaacgatattaaaaaatgttatcagtttaaaagcgcgaatcgttcaaatcaaacgagtcaaaaaaggcgaatttattggctacggcgagcatttttacaccaatgaagagactttagtgggcgttttagctctagggtatgcggatgggttggtgcgcgctttgggcaatcgcattcaagtagcgatcaataaccaattagccccccttattggcaaggtgtgcatggatcaatgctttgtcaaactcaatgatattgaagccaaagagggcgatgaggtcattttgtttggggataaaagcactaaagctaatgacgcaagcgaaatcgccacgcttttaaacaccattccttatgaaaccatcagcactttgtccaaacgcttggagcgcgtttatgtgtga

SEQ ID NO: 33193 - protein, 377 aa, Helicobacter pylori J99
MLKRASFVEVNTHSLRHNFNAVKNIVPKDACVMAVVKANAYGAGAIKASEIFLQEGANYLGVATLDEALELRSHFSQTPILILGYSPNTNASMLIDNDLSAMVFSLEQAEVFSQMALKSQKRLKVHLKIDTGMHRLGLEPTFKSIETIKKIRALKGLEVEGIFTHLSNADSNIKTHAKNQMKVFNAFLEQLLDQKIEFQYRHAYNSAGILSLCNGNENRLLNLYRPGIMLYGFYPSNEMKESSQTILKNVISLKARIVQIKRVKKGEFIGYGEHFYTNEETLVGVLALGYADGLVRALGNRIQVAINNQLAPLIGKVCMDQCFVKLNDIEAKEGDEVILFGDKSTKANDASEIATLLNTIPYETISTLSKRLERVYV

SEQ ID NO: 33194 - DNA, 1134 bp, Helicobacter pylori
  CDS (1)..(1134): n means a or g or c or t/u, s means g or c
atgttaaaaagggcgagttttgtagaagtggataccgcttctttaaggcataattttagcgcagtcaaaagcattgtccctaaagacgcttgtgtcatggcggttgtcaaggcgaacgcttatggggcaggagcgattaaagcgagcgaaattttcttacaagaaggggctaattatttaggggtagcgaccttagatgaagctttagagttgcgttctcatttttctaaaacccccattttgatcttaggctatagccctaatgctaacgcttccatgctggttgataacgatttgagcgctatgatttttagccttgaacaagcggaagttttttctcaaatggctttaaaatctcaaaaacgcttaaaagtgcacatcaaaattgataccggcatgcaccgcttgggtttagagcctaattttaaaagcatagaaaccattaaaaaaatccgcgctttaaaaggtttggaaatagaggggatatttacgcatttaagcaacgctgatgctaagattaaaacccatgctaaaaaccaaatgaaagcctttaacgcttttttagagcagcttttggatcaaaaaatagagttccaataccgccatgcttataattctgccggtatcctttctttgtgtaacgggaatgaaaatcgtttgttaaacctttatcgcccaggcatcatgctctatggtttttacccctctaatggaatgaaagaatcatgcccaaccatcttaaaaaatgttatcagtttgaaagcgcaaatcgttcaaatcagaagcgttaaaaaaggcgaatttattggctatggcgagcatttttataccaatgaagagactttagtgggtgttttagctctagggtatgcagacgggttaatgcgcgctttaggcaatcgcattcaagtagcgatcaataaccaattagcccccctgattggcaaggtgtgcatggatcaatgttttgtcaaactcaataatattcaagccaaagagggcgatgaggtcattttgtttggggataaaagcgctaaggctaatgacgcgagcgaaatcgytgcgcttttaaacaccattgcttatgaaaccataagcaccctatccaaacgcttggagcgcgtytatatttaa

SEQ ID NO: 33195 - protein, 377 aa, Helicobacter pylori
  Xaa in position 354 is unknown
MLKRASFVEVDTASLRHNFSAVKSIVPKDACVMAVVKANAYGAGAIKASEIFLQEGANYLGVATLDEALELRSHFSKTPILILGYSPNANASMLVDNDLSAMIFSLEQAEVFSQMALKSQKRLKVHIKIDTGMHRLGLEPNFKSIETIKKIRALKGLEIEGIFTHLSNADAKIKTHAKNQMKAFNAFLEQLLDQKIEFQYRHAYNSAGILSLCNGNENRLLNLYRPGIMLYGFYPSNGMKESCPTILKNVISLKAQIVQIRSVKKGEFIGYGEHFYTNEETLVGVLALGYADGLMRALGNRIQVAINNQLAPLIGKVCMDQCFVKLNNIQAKEGDEVILFGDKSAKANDASEIXALLNTIAYETISTLSKRLERVYI

SEQ ID NO: 33196 - DNA, 1104 bp, Lactococcus lactis
  CDS (1)..(1104): transl_table=11
atgaaaacttctccacatcgcaatacgtcagccattgttgacttaaaggcgattagaaataatattgaaaaatttaaaaaacatattcaccctaatgcggaaatttggccagcagtgaaagcagatgcttatggtcatggctcggttgaggtttctaaagcggtgagcgatttggtaggcggtttttgtgtatcaaaccttgatgaggcaattgaattacggaatcatttggtaactaaaccgattttagttttatcaggaattgttccagaagatgttgatattgcagctgctcttaatatcagtcttactgccccaagtttagaatggttaaaattggttgttcaagaagaagcagaactttcagatttaaaaattcatattggtgtagattctggtatgggtcggattgggattcgggatgttgaagaagcaaatcagatgattgaacttgctgataaatatgcgattaattttgaagggattttcactcactttgcgaccgccgatatggctgatgatacaaaatttaaagatcaacaggcaagatttaacaaaattatggccggattatcacgtaaaccaaaatttgttcactcaactaatacggccgccgctttatggcataaggaacaggttcaagctattgaacgcttaggtatttcaatgtacggcttgaatccaagtggtaaaactttggaacttccttttgaaatcgaacctgctctctctttagtttctgaattgactcatattaaaaaaatagccgcaggcgaaacagttggttacggtgcaacttatgaaacaagtgaagaaacatggattggaaccgttccaattggttatgctgatggttggactcgtcaaatgcaaggcttcaaagtactggtaaatggagaattttgtgagattgttggtcgagtttgtatggatcaaatgatgataaaacttgataaatcttatcctctaggaacaaaagttaccctgattggtcgtgataagactaatgaaatcacgacgacagatgttgctgattggcgtggaacgataaattatgaagtgctttgtttactttctgatagaatcaaacgaatttataaataa

SEQ ID NO: 33197 - protein, 367 aa, Lactococcus lactis
MKTSPHRNTSAIVDLKAIRNNIEKFKKHIHPNAEIWPAVKADAYGHGSVEVSKAVSDLVGGFCVSNLDEAIELRNHLVTKPILVLSGIVPEDVDIAAALNISLTAPSLEWLKLVVQEEAELSDLKIHIGVDSGMGRIGIRDVEEANQMIELADKYAINFEGIFTHFATADMADDTKFKDQQARFNKIMAGLSRKPKFVHSTNTAAALWHKEQVQAIERLGISMYGLNPSGKTLELPFEIEPALSLVSELTHIKKIAAGETVGYGATYETSEETWIGTVPIGYADGWTRQMQGFKVLVNGEFCEIVGRVCMDQMMIKLDKSYPLGTKVTLIGRDKTNEITTTDVADWRGTINYEVLCLLSDRIKRIYK

SEQ ID NO: 33198 - DNA, 1104 bp, Lactococcus lactis
  CDS (1)..(1104): transl_table=11
atgaaaacttcaccacatcgtaatacttcagctattgttgatttaaaagcgattagaaataatattgaaaaatttaaaaagcatattaaccctaatgcagagatttggccagcagtgaaagcagatgcttatggtcatggctcgattgaggtttctaaagcggtgagcgatttggtaggtggtttttgtgtatcaaacctagatgaggcaattgaattacgaaatcatctggtgactaaaccgattttagttttatccggaattgttccagaagatgttgatattgcagctgcccttaatattagtcttactgccccgagtttagaatggttgaaattggttgttcaagaagaagcagaactttcagatttaaaaattcatattggtgtagattctggtatgggtcggattggtattcgtgatgttgaagaagctaatcagatgattgaacttgctgataaatatgcgattaattttgaaggaattttcactcattttgcgactgcggatatggctgatgaaacaaaatttaaaaatcaacaggcaagatttaacaaaattatggccggattatcacgtcaaccaaaatttatacactcaactaatacggccgctgctttatggcataaggaacaagttcaagctattgaacgtttagggatttcaatgtatggcttgaatccaagtggtaaaactttggaacttccttttgaaattgaacccgctctctctttagtttctgaattgactcatataaaaaaaatagctgcaggtgaaacggttggttatggtgcaacttatgagacgagtgaagaaacttggattggaactgttccaattggttacgctgacgggtggacccgtcaaatgcaaggtttcaaagtgcttgttgatggaaagttttgtgagattgttggtcgagtttgtatggatcaaatgatgataaaacttgataagtcttaccctttgggaacgaaggtcactttgattggtcgagataaggctaatgaaatcacgacaacagacgttgctgattggcgtggaacgattaattatgaagtgctttgcttactttctgatagaatcaaaagaatctataaataa

SEQ ID NO: 33199 - protein, 367 aa, Lactococcus lactis
MKTSPHRNTSAIVDLKAIRNNIEKFKKHINPNAEIWPAVKADAYGHGSIEVSKAVSDLVGGFCVSNLDEAIELRNHLVTKPILVLSGIVPEDVDIAAALNISLTAPSLEWLKLVVQEEAELSDLKIHIGVDSGMGRIGIRDVEEANQMIELADKYAINFEGIFTHFATADMADETKFKNQQARFNKIMAGLSRQPKFIHSTNTAAALWHKEQVQAIERLGISMYGLNPSGKTLELPFEIEPALSLVSELTHIKKIAAGETVGYGATYETSEETWIGTVPIGYADGWTRQMQGFKVLVDGKFCEIVGRVCMDQMMIKLDKSYPLGTKVTLIGRDKANEITTTDVADWRGTINYEVLCLLSDRIKRIYK

SEQ ID NO: 33200 - DNA, 1128 bp, Lactobacillus plantarum
  CDS (1)..(1128): transl_table=11
atggttgtaattggggagcaccgccacacacaagtcacagtcgacttgcaggcaattaagacaaatattagtaatgaaatggcgcaaaaggatgagttgaccgagttatgggcagtcgttaaagcgaatggttatggacatggaattatccaagttgctcaggccgccaaagaagccggggcgaccggcttttgtgttgcaatcctggatgaggccttagcgttgcgggccgctggctttgcggaacccatcctagtacttggaattacggaaccggaatacgccccactggtagctgaaaaggatatttcactagctgttggaacgcaagattggctgactacggccgcagcaattttagcggctaatcaagtgacgacaccacttcacgttcatcttgcattagatacgggtatgggacgaatcgggtttcagacgcccgaagaattggcaacggcggttacgactttgcgtcaaccgcagtcaccatttgactttgaagggatttttacgcattttgcaacggctgaccaggcagatgatacgtattttactcatcaattaaataattggaaacacttgattgcagtggtggatgagctaccacgctatgtccacgtgtccaattcggccaccagtctctggcatcaagcttgcaatggcaacatggtgcgctttggggttgcactctatggtctaaatccttctggtcgcgaactcagcgcaccataccccttgcaacccgcgttgtcgctaacggcacgcttgacgtttgttaaacgcttggctcggggcaaatcggtcagctatggtgccacgtatacggccgcacaggatgaatggattggcacggtgccgattgggtatgcggacggctatgaacgccgattacaaggcttccatgtacttgttgatggtgagttttgcgaaatcgtcggacgggtctgcatggaccagctgatggttcgtctgccacatgaagtaccggttggagctaaggtaactttggttggcacggacggtgctcgtaccatttcgttgcaagatattgctgactattgtgggacaattcattatgagattgcttgtgggttagcaccacgagtgccgagagtttatatagattaa

SEQ ID NO: 33201 - protein, 375 aa, Lactobacillus plantarum
MVVIGEHRHTQVTVDLQAIKTNISNEMAQKDELTELWAVVKANGYGHGIIQVAQAAKEAGATGFCVAILDEALALRAAGFAEPILVLGITEPEYAPLVAEKDISLAVGTQDWLTTAAAILAANQVTTPLHVHLALDTGMGRIGFQTPEELATAVTTLRQPQSPFDFEGIFTHFATADQADDTYFTHQLNNWKHLIAVVDELPRYVHVSNSATSLWHQACNGNMVRFGVALYGLNPSGRELSAPYPLQPALSLTARLTFVKRLARGKSVSYGATYTAAQDEWIGTVPIGYADGYERRLQGFHVLVDGEFCEIVGRVCMDQLMVRLPHEVPVGAKVTLVGTDGARTISLQDIADYCGTIHYEIACGLAPRVPRVYID

SEQ ID NO: 33202 - DNA, 1128 bp, Lactobacillus reuteri
  CDS (1)..(1128): transl_table=11
atggttgaaggatggcatcgcgcaagtcggctagtagtcgatgcggcggcaattcggcaaaatgtaaaaaaggaaattgaacgtttagatccgcaaagcgagttatttgcagtagttaaagcaaatggatacggacatggactgattccggtggcccggtatactgaacaagcgggcgccaccggtttttgcgtggcaattttagacgaggcattgaccctgcgagaggcgggttttgctgaaccaatcttagtcttaggaatcactaacgtaaagtgggcggctttagctgctgaaaagaacgtttctttaaccgtgggagacgtggagtggttgactaaggcggctccccagttaacggcagaacatccgttaaaggttcatttggcgttagacactggaatgggacggattggttttcaagagtcagatggccttaatcaggcggcggagttgctcaccaatgatccgcgttttgtttttgaaggtgtatttacacactttgcaaccgcggatgaaaaggatcccacttatttcaatcttcaagtggaccgttttcataaattagtggacactttgccagaaaagcctcgctacgttcacgtttctaatacagcaactagtctatggcacgcagcttgcaacggtaacctaatccggtttggggtcggaatttatgggatgaatccgtccggaaccgttttggaaccaccgtatgatttgcagccagccatgacgttagagtcccagctttcattttctaagctgttgaaaaaggggcgttcggtaagctatggagcaacttacactgttgaacaagacgaatggattgggacagttccaattggctatgccgatgggtatccccgctgtttacaagggttccacgtgttagttgacgggcatttttgtgaaatcgtgggccgagtttgcatggaccagttaatgattcgccttccgcatgaatatccggcgggaacctcggtaatcttagcggggaaatcgcaagggaaaagtattagcatgacggacattgctgattatgctggaacaattaattatgaaatcacatgtggctttacggagcggattccgcgggtctataagaataatgatatagtaaaataa

SEQ ID NO: 33203 - protein, 375 aa, Lactobacillus reuteri
MVEGWHRASRLVVDAAAIRQNVKKEIERLDPQSELFAVVKANGYGHGLIPVARYTEQAGATGFCVAILDEALTLREAGFAEPILVLGITNVKWAALAAEKNVSLTVGDVEWLTKAAPQLTAEHPLKVHLALDTGMGRIGFQESDGLNQAAELLTNDPRFVFEGVFTHFATADEKDPTYFNLQVDRFHKLVDTLPEKPRYVHVSNTATSLWHAACNGNLIRFGVGIYGMNPSGTVLEPPYDLQPAMTLESQLSFSKLLKKGRSVSYGATYTVEQDEWIGTVPIGYADGYPRCLQGFHVLVDGHFCEIVGRVCMDQLMIRLPHEYPAGTSVILAGKSQGKSISMTDIADYAGTINYEITCGFTERIPRVYKNNDIVK

SEQ ID NO: 33204 - DNA, 1107 bp, Listeria innocua
  CDS (1)..(1107): transl_table=11
gtggtaacaggctggcaccgtccgacatggattgaaattgaccgcgcagcaattcgcgaaaatataaaaaatgaacaaaataaactaccagataaggtggcactttgggccgtagtaaaagcaaatgcatacggtcacggaattattgaaacagcaaaaatagcgaaagaagccggagcaaaaggtttttgtgtcgctattttagatgaagctcttgcattaagagaagctgggtttcgaaatgaatttattctcgtcttaggggcaactagaaaagaagacgccaaccttgctgctaaaaataatatctcagttactgtttttagagaagattggttggacgatttaactttagaggcgccactccggattcatttaaaagtagatagtggcatgggacgccttggtattcgtagtagagaagaagcacagcgaatcgaaacaacaatagcgatagatcatcaaatgattttagaaggtatttatacgcattttgcgacagccgatcaattagaaacaagttattttgaacaacaattagcaaaattccaagcaattttaagtagtttaacaacacgcccaacattcgttcatacagcaaattcagcagcttcattgctacaaccgcaaattgatttcgatgctattcgctttgggatttcgatgtatggtttaacaccttccacggaaattaaaaatagtttgccctttgaacttaaacctgcacttgcactttatacggaaatggttcatgtgaaagaactagcgccaggtgacagtgttagctacggcgcaacttatacagcaaccgaaaaagaatgggttgcgacattaccaattggttatgcagatggccttattcgccattatagtggctttcatgttttagtagaaggcgagcgggcaccaattatcggaaggatttgtatggatcaaaccatcataaaacttcctcgtgaatttcaaactggtacaaaagtaacgataatcggttcagatcatggaaataaggtaacagcagatgatgcagcagaatatttaggcacaattaattatgaagttacttgtttgttaacggagcgcataccaaggaaatacatcaattag

SEQ ID NO: 33205 - protein, 368 aa, Listeria innocua
MVTGWHRPTWIEIDRAAIRENIKNEQNKLPDKVALWAVVKANAYGHGIIETAKIAKEAGAKGFCVAILDEALALREAGFRNEFILVLGATRKEDANLAAKNNISVTVFREDWLDDLTLEAPLRIHLKVDSGMGRLGIRSREEAQRIETTIAIDHQMILEGIYTHFATADQLETSYFEQQLAKFQAILSSLTTRPTFVHTANSAASLLQPQIDFDAIRFGISMYGLTPSTEIKNSLPFELKPALALYTEMVHVKELAPGDSVSYGATYTATEKEWVATLPIGYADGLIRHYSGFHVLVEGERAPIIGRICMDQTIIKLPREFQTGTKVTIIGSDHGNKVTADDAAEYLGTINYEVTCLLTERIPRKYIN

SEQ ID NO: 33206 - DNA, 1107 bp, Listeria monocytogenes
  CDS (1)..(1107): transl_table=11
atggtgacaggctggcatcgtcctacatggattgaaatagaccgcgcagcaattcgcgaaaatataaaaaatgaacaaaataaactcccggaaagtgtcgacttatgggcagtagtcaaagctaatgcatatggtcacggaattatcgaagttgctaggacggcgaaagaagctggagcaaaaggtttctgcgtagccattttagatgaggctctggctcttagagaagctggatttcaagatgactttattcttgtgcttggtgcaaccagaaaagaagatgctaatctggcagccaaaaaccacatttcacttactgtttttagagaagattggctagagaatctaacgctagaagcaacacttcgaattcatttaaaagtagatagcggtatggggcgtctcggtattcgtacgactgaagaagcacggcgaattgaagcaaccagtactaatgatcaccaattacaactggaaggtatctacacgcattttgcaacagccgaccagcttgaaactagttatttcgaacaacaactagctaagttccaaacaattttaacgagtttaaaaaatcgtccaacgtatgttcatacagccaattcggctgcttccttattacagccacaaatcgggtttgatgcgattcgctttggtatatcgatgtatggattgaccccttccacagaaatcaaaactagcttaccatttgaacttaagccagcacttgcgctctataccgaaatggttcatgtgaaagaactcgcaccaggggatagtgtcagctacggagcaacctacacagcaacagaacgagaatgggttgcaacgttaccaattggctatgcagacggattgattcgtcattacagcggttttcatgttttagtaggcggggaacttgccccaattatagggcgcgtttgtatggatcaaaccatcataaaactaccacgtgaatttcaaactggttcaaaagtaacgataattggcaaagatcatggtaacacgataacagcagatgatgccgctcaatatttagatacaattaattatgaggtaacttgtttgttaaatgagcgcatacctagaaaatacatccattag

SEQ ID NO: 33207 - protein, 368 aa, Listeria monocytogenes
MVTGWHRPTWIEIDRAAIRENIKNEQNKLPESVDLWAVVKANAYGHGIIEVARTAKEAGAKGFCVAILDEALALREAGFQDDFILVLGATRKEDANLAAKNHISLTVFREDWLENLTLEATLRIHLKVDSGMGRLGIRTTEEARRIEATSTNDHQLQLEGIYTHFATADQLETSYFEQQLAKFQTILTSLKNRPTYVHTANSAASLLQPQIGFDAIRFGISMYGLTPSTEIKTSLPFELKPALALYTEMVHVKELAPGDSVSYGATYTATEREWVATLPIGYADGLIRHYSGFHVLVGGELAPIIGRVCMDQTIIKLPREFQTGSKVTIIGKDHGNTITADDAAQYLDTINYEVTCLLNERIPRKYIH

SEQ ID NO: 33208 - DNA, 1193 bp, Mycobacterium avium
  CDS (10)..(1176)
atggccgccatggccgttacgccgatatccctgaccccgggcgtcctcgccgaggcgctggtcgacctgggcgccatcgagcacaacgtgcggctgctgtgcgagcaggcccgcggcgcgcaggtgatggccgtggtcaaggccgacggctacggccacggggccgtgcagacggcgcgtgccgcgctggccgccggggccgccgagctgggcgtggccaccgtcgacgaggcgctggcgctgcgcgccgcggggatcagcgcgccggtgctggcctggctgcatccgcccggcatcgacttccggcccgcgctgctggccggcgtgcagatcggcctgtcctcgcagcgccagctcgacgagctgctgaccgcggtgcgcgacaccggccggaccgccacggtcaccgtcaaggtcgacaccgggctgaaccgcaacggcgtgccgccggcgcagtacccgtcgatgctgaccgcgctgcgccgcgccgtcgccgagcaggccatcgtgccgcgcggcctgatgtctcacatggtgtacgccgaccaacccgccaacccggtgaatgacgttcaggcgcaacggttcaccgacatgctggcccaggcgcgcgagcagggggtgcgcttcgaggtggcccacctgtcgaattcgtcggccaccatgtcgcgtcccgacctggccttcgacatggtgcgccccggtatcgcggtgtacggcctcagccctgtccccgagctgggcgacatgggcctggtgcccgcgatgacggtgaaatgtactgtggcactggtgaagtcgatacgtgcgggggaaagcgtgtcatacggacacacctggacggcgcagcgcgacaccaacctggcgctgctgccggtgggctacgccgacggcatcttccggtcgctgggcgggcggctgcaggtgtcgatcaacggccggcggcggccgggcgtcggccggatctgcatggaccagttcgtcgtcgacctgggcccgggccgccccgacgtggccgagggcgacgaggcgatcctgttcgggccgggcagcaacggtgaacccaccgcccaggattgggccgatctgctcggcactatccactacgaagtggtgaccagcccccgcgggcggatcaccaggacctaccgcgaggcgcacaccgttgagtcctgaccgaacccgcaagcgcc

SEQ ID NO: 33209 - protein, 388 aa, Mycobacterium avium
MAVTPISLTPGVLAEALVDLGAIEHNVRLLCEQARGAQVMAVVKADGYGHGAVQTARAALAAGAAELGVATVDEALALRAAGISAPVLAWLHPPGIDFRPALLAGVQIGLSSQRQLDELLTAVRDTGRTATVTVKVDTGLNRNGVPPAQYPSMLTALRRAVAEQAIVPRGLMSHMVYADQPANPVNDVQAQRFTDMLAQAREQGVRFEVAHLSNSSATMSRPDLAFDMVRPGIAVYGLSPVPELGDMGLVPAMTVKCTVALVKSIRAGESVSYGHTWTAQRDTNLALLPVGYADGIFRSLGGRLQVSINGRRRPGVGRICMDQFVVDLGPGRPDVAEGDEAILFGPGSNGEPTAQDWADLLGTIHYEVVTSPRGRITRTYREAHTVES

SEQ ID NO: 33210 - DNA, 1167 bp, Mycobacterium leprae
  CDS (1)..(1167): transl_table=11
ttggctgttacaccgatatccttgaggccaggtgtcttggccgaagctgttgtggatctgggagctattgactacaacgtgcgcgtgttgcgtgagcacgctggcatggcgcaactgatggttgtcctcaaagccgacgcctacggtcacggtgccacccaggttgccctcgccgcattggcagccggtgcggccgagctgggtgtggccaccgtcgacgaagcgctcgcattgcgcgcggacggtatcagtgcaccggtgctggcctggctgcatccacccggaatcgacttcgggcccgcgctgctggccgacgtgcagatagcggtgtcctcggtgcgtcagcttgacgagctgctggatgcggtgcgtcggaccggtcgtacggcgacggtgaccgtcaaagccgacaccgggctgaaccgcaacggggtcgtcaccgatcaatacccggcgatgctgaccgcgttgcagcgggctgtcgtagaagacgccgtaaggctgcgcgggttgatgtcgcacttggtttacgctgaccagcccgataatcccagcaatgacgttcagggcaagcggtttgctgctctgctcgctcaggcgcacgaacagggattgcggttcgaggtggcgcatctgtcgaattcatcagctacgatgtctcgtcctgacctggcttacgacctggtcaggcccggcatcgcggtgtacggtcttagtcctgtgccttcccgcggtgatatgggactaatacccgcaatgacggtgaaatgcgctgttgcgatggtgaagtctattcgtgctggtgaaggtgtttcgtacggacacgactggattgcgcagcatgacaccaatttggcgctgttgccggttggatatgcggacggtgtgttccggtcgctgggcggccggctggatgtgctgatcaatggcaagcgccggcctggcgtcggacggatctgtatggaccagtttgtcgtcgacttgggtccggggccaatcgatgtagccgaaggcgacgaagccatcttgttcggtcccggcgccagaggcgaacccactgcgcaagattgggctgatctgcttggaactatccactatgaagtggtcaccagtctacgcgggcggatcaccagaacgtaccgcgaggcccaaaccgttgacagatga

SEQ ID NO: 33211 - protein, 388 aa, Mycobacterium leprae
MAVTPISLRPGVLAEAVVDLGAIDYNVRVLREHAGMAQLMVVLKADAYGHGATQVALAALAAGAAELGVATVDEALALRADGISAPVLAWLHPPGIDFGPALLADVQIAVSSVRQLDELLDAVRRTGRTATVTVKADTGLNRNGVVTDQYPAMLTALQRAVVEDAVRLRGLMSHLVYADQPDNPSNDVQGKRFAALLAQAHEQGLRFEVAHLSNSSATMSRPDLAYDLVRPGIAVYGLSPVPSRGDMGLIPAMTVKCAVAMVKSIRAGEGVSYGHDWIAQHDTNLALLPVGYADGVFRSLGGRLDVLINGKRRPGVGRICMDQFVVDLGPGPIDVAEGDEAILFGPGARGEPTAQDWADLLGTIHYEVVTSLRGRITRTYREAQTVDR

SEQ ID NO: 33212 - DNA, 1170 bp, Mycobacterium smegmatis
  CDS (1)..(1170): transl_table=11
atgcagaccaccgagcccatgacaccgcctgcgccactggcgtcggcacagacggtgatcgatctgggcgccatcgaccacaacgtgcgcgtgctgcgcgaactcgccggttccgcggacgtgatggcggtggtcaaggccgacgcctacggacacggggcgctcccggtggcccgcaccgcgctggccgccggggccgccgccctcggtgtcgcgaccatccccgaggcgcttgcgctgcgtgagggtggcatcacggcgccggtcctggcgtggctgcatccgcccggcaccgacttcgccccggcgatcgccgccgacgtcgaggtcgccgtgtcgtcgcgccgccaactcgaacaggtgacggcggccgcggccgaggtgggccgcaccgcgacggtgaccgtcaaggtcgacaccgggctcagccgcaacggcgtcggcgcggccgactatcccgaggtgctcgatgtcctgcgccgcgcgcaggccgacggggcgatccgggtgcgcggtctgatgagccacctggtgcacggcgacgacccggagaacccgttcaacggtctgcagggccaacggctggcggacatgcgtgtttacgcgcgcgagcacggcgtcgactacgaggtggcgcacctgtgcaactcgcctgcggccatgaccaggcccgacctggcgttcgagatggtgcgtcccggcatctcgctgtacgggctcagtcccatccctgagcgcggcgacatgggcctgcggcccgcgatgaccttgaaatgcccggtggcgcttgtccgttcggtgcacgccggggacggggtgtcgtacgggcaccggtgggtggccgaccgtgacaccaccctggggctgctgccgatcggctacgccgacggcgtgtaccgcgcactgagcgggcgtatcgacgtgctgatcaagggcaggcgcaggcgcgccgtcggccggatctgcatggaccagttcgtggtcgacctcggcccggacgcggacgacgtggccgtaggtgacgacgccatcctgttcggcccgggcgccaacggcgaaccgaccgcgcaggactgggccgaactgctcgacaccattcactacgaggtcgtcacgagcccgcgcggacgcgtcacgcgcacgtatcttccggcaggacaacaagattga

SEQ ID NO: 33213 - protein, 389 aa, Mycobacterium smegmatis
MQTTEPMTPPAPLASAQTVIDLGAIDHNVRVLRELAGSADVMAVVKADAYGHGALPVARTALAAGAAALGVATIPEALALREGGITAPVLAWLHPPGTDFAPAIAADVEVAVSSRRQLEQVTAAAAEVGRTATVTVKVDTGLSRNGVGAADYPEVLDVLRRAQADGAIRVRGLMSHLVHGDDPENPFNGLQGQRLADMRVYAREHGVDYEVAHLCNSPAAMTRPDLAFEMVRPGISLYGLSPIPERGDMGLRPAMTLKCPVALVRSVHAGDGVSYGHRWVADRDTTLGLLPIGYADGVYRALSGRIDVLIKGRRRRAVGRICMDQFVVDLGPDADDVAVGDDAILFGPGANGEPTAQDWAELLDTIHYEVVTSPRGRVTRTYLPAGQQD

SEQ ID NO: 33214 - DNA, 1059 bp, Neisseria meningitidis
  CDS (1)..(1059): transl_table=11
atgcgccctttgaacgtgcagatcaggttgggcaaccttaggcacaattatcggattttgaaggaaatgcacggaggcaaactgttggcggtagtgaaggccgacgcatacggacacggtgcggtcagatgtgctttcgcgctggcagacttggcagacggctttgccgtggcgacaatcgacgagggaatcaggctacgggagagtggcattacccatccgattgtccttttggaaggcgtatttgaagcatcagagtacgaagcggtcgaacaatactcgctctggccggcagtcggaaaccaatggcaacttgaggctttgctttcccgccattggaaaaaacctgtcaaggtctggttgaaaatggattcgggaatgcaccgtaccggatttttccctcatgattacgcttcggtatatgcggcattgaagcagtcggaatatgtggacagtattgtcaaattctcgcatttctcctgtgcggacgaacccgaaagcggtatgacggaaatacagatggaagcattcgatttgggtacggaagggctggaaggcgaagaaagccttgccaactccgccgctattttgaatgttcccgaagcacgcagggactgggggcgagccggcttggcgttgtacggcatttccccgttcggaggcagcgatgacaggctgaaacccgtgatgaggctttccacccgtattttcggcgaacgcgttttacagccgcactcccctatcggttatggcgcaacattttataccagtaaatctacgcgcgtcggcctgattgcctgcggttatgcggacggttatccgcgccgcgccccaagcaattcccccgtcgccgtcgacggtaaattgacccgggtcatcggcagggtctctatggatatgatgaccatcgagctggacgcttcgcaagaaggtttgggacacgaggtcgaactgtggggcgatacggttaatatcaataccgttgccgaagcggccggaaccatcccttacgaattgatgtgcaatatcaaacgtgcaaaattcacttatatcgagtaa

SEQ ID NO: 33215 - protein, 352 aa, Neisseria meningitidis
MRPLNVQIRLGNLRHNYRILKEMHGGKLLAVVKADAYGHGAVRCAFALADLADGFAVATIDEGIRLRESGITHPIVLLEGVFEASEYEAVEQYSLWPAVGNQWQLEALLSRHWKKPVKVWLKMDSGMHRTGFFPHDYASVYAALKQSEYVDSIVKFSHFSCADEPESGMTEIQMEAFDLGTEGLEGEESLANSAAILNVPEARRDWGRAGLALYGISPFGGSDDRLKPVMRLSTRIFGERVLQPHSPIGYGATFYTSKSTRVGLIACGYADGYPRRAPSNSPVAVDGKLTRVIGRVSMDMMTIELDASQEGLGHEVELWGDTVNINTVAEAAGTIPYELMCNIKRAKFTYIE

SEQ ID NO: 33216 - DNA, 1059 bp, Neisseria meningitidis
  CDS (1)..(1059): transl_table=11
atgcgccctttgaacgtgcagatcaggttgggcaaccttaggcacaattatcggattttgaaggaaatgcacggaggcaaactgttggcggtagtgaaggccgacgcatacggacacggtgcggtcagatgtgctttcgcgctggcagacttggcagacggctttgccgtggcgacaatcgatgaaggaatcaggctgcgggagagcggcattacccatccgattgtccttttggaaggcgtatttgaagcatcggaatacgaagcggtcgaacaatactcgctttggccggcagtcggaaaccaatggcagcttgaggctttgctgatccgccattggaaaaaaaccgtcaaagtctggttgaaaatggattcggggatgcaccgtaccggttttttccctcatgattacgcttcggcatatgcggcattgaagcagtcggaatatgtggacagtattgtcaaattctcgcatttctcctgtgcggacgaacccgaaagcggtatgacggaaatacagatggaagcattcgatttgggtacggaagggctggaaggcgaagaaagccttgccaactccgccgctattttgaatgttcccgaagcacgcagggactgggggcgcgccggtctggcgttatacggcatttccccgttcggaggaggcgatgacaggctgaagcccgtgatgaggctttcaacccgtattttcggcgaacgcgttttacagccgcactcccctatcggttatggcgcaacattttataccagcaaatctacgcgcgtcggcctgattgcctgcggttatgcggacggttatccgcgccgcgccccaagcaattcccccgtcgctgtcgacggcaaattgacccgggtcatcggcagggtctctatggatatgatgaccatcgagctggatgcttcgcaagaaggtttgggacacgaggtcgaactgtggggcgatacggtcaacatcaataccgttgccgaagcggccggaaccatcccttacgaattgatgtgcaatatcaaacgtgcaaaattcacttatatcgagtaa

SEQ ID NO: 33217 - protein, 352 aa, Neisseria meningitidis
MRPLNVQIRLGNLRHNYRILKEMHGGKLLAVVKADAYGHGAVRCAFALADLADGFAVATIDEGIRLRESGITHPIVLLEGVFEASEYEAVEQYSLWPAVGNQWQLEALLIRHWKKTVKVWLKMDSGMHRTGFFPHDYASAYAALKQSEYVDSIVKFSHFSCADEPESGMTEIQMEAFDLGTEGLEGEESLANSAAILNVPEARRDWGRAGLALYGISPFGGGDDRLKPVMRLSTRIFGERVLQPHSPIGYGATFYTSKSTRVGLIACGYADGYPRRAPSNSPVAVDGKLTRVIGRVSMDMMTIELDASQEGLGHEVELWGDTVNINTVAEAAGTIPYELMCNIKRAKFTYIE

SEQ ID NO: 33218 - DNA, 1083 bp, Pasteurella multocida
  CDS (1)..(1083): transl_table=11
atgaatatgaaacctgccacagcaaaaatcagttctgtggcattaaaacacaacattcaaacgattaaacaaaaagccccgcaaagtaaaattattgctgttgtgaaagccaacgcctatggtcatggtgttgtgtttgtgtccgctgccgtagaagagttggtcgattgttttggcgtcgcccgtttagaagaagccttaagtttacgctcaaatgggattacgaaacctattttgctcttagaaggttttttttgcgataaagatttaccggtgattgcgataaataatattcaaactgtggtgcataacgtcgaacaattggaagcgttaaaagcagctaaagttcctaatccgattaaagtctggctaaaaattgataccggtatgcaccgtttaggggtagcactagaagacgttgagtatttttaccaagcgctccgcgattcagagaatgttgatccacagattggttttgtcagccattttagtcgcgcggatgaattggaatgtgactataccaagttacaattgacacgttttttaaatgctacgcaaaataaagcgggcgaaaaaagtattgctgcctcaggtgggatcttattttgggaaagttcccatttagactggattcgtccgggcattattatgtatgggatttcaccgattaatgtaccagcacaagaatatgatttaacccctgtgatgaccttaacctcctctcttattgcaattaaacagcataaaaaaggggagccagtaggatatggcgggatttgggtcagcgataaagacacgaaaattggtgtggttgccattggttatggcgatggttatccgcgtgacataccaacaggcacaccggtttacctcaatggtcgtcgtgtgcccattgtgggacgtgtctcgatggatatgttgacagtcgatctcggtgcagaagcacaagacaaagttggcgatgaagtcattctttggggcaaagaattgcccattgaagaaatcgcggatattagtggggtgattagttatgaattgattacaaaattaacgccacgtgttttaacggaatatattgattaa

SEQ ID NO: 33219 - protein, 360 aa, Pasteurella multocida
MNMKPATAKISSVALKHNIQTIKQKAPQSKIIAVVKANAYGHGVVFVSAAVEELVDCFGVARLEEALSLRSNGITKPILLLEGFFCDKDLPVIAINNIQTVVHNVEQLEALKAAKVPNPIKVWLKIDTGMHRLGVALEDVEYFYQALRDSENVDPQIGFVSHFSRADELECDYTKLQLTRFLNATQNKAGEKSIAASGGILFWESSHLDWIRPGIIMYGISPINVPAQEYDLTPVMTLTSSLIAIKQHKKGEPVGYGGIWVSDKDTKIGVVAIGYGDGYPRDIPTGTPVYLNGRRVPIVGRVSMDMLTVDLGAEAQDKVGDEVILWGKELPIEEIADISGVISYELITKLTPRVLTEYID

SEQ ID NO: 33220 - DNA, 1128 bp, Ralstonia solanacearum
  CDS (1)..(1128): transl_table=11
atgccaagacccattcaggccgtcatccacggccccgcactcgtcaacaatctccaggtggttcgccgccacgccgcggactcgcgcgtctgggcggtcatcaaggccaacgcatatggccacggcatcgagcgtgcctatgaggggctgcgccaggccgacggcttcggcctgctcgatctggacgaggccgtccggctgcgccagctgggctggcaggggccgatcctgctgctcgagggcttcttcaagccggaagacctggcgctggtcgagcaataccgactgaccaccaccgtccattgcgaggagcagttgcgcatgctggagctggcgcgcctgaaggggccggtgagtatccagctgaagatcaacacgggcatgagccgcctgggcttcgcgccggccgcgtaccgtgcggcctgggagcatgcccgcgccatttccggcatcggcaccatcgtccacatgacgcatttttccgatgccgacggcccgcgcggcatcgatcaccagttggccgccttcgagcaagccacgcaggggctgccgggcgaggcgagcctgtccaactccgccgccacgctgtggcatccgagggcgcaccgggactgggtgcgccccggcgtgatcctgtacggtgcttcgccgaccggcgtggccgccgacatcgaaggcaccggcctgatgccggccatgacgctcaagagcgagctgatcgccgtccaggacctgcagccgggcgcgaccgtcggctacggctcgcgcttcgaggccgagcagccgatgcgcatcggcatcgtcgcgtgcggctatgccgatggctatccgcgccatgctcccggctgggacggcaactacacgccggtgctggtggacggcgtgcgcacgcgcatggtgggccgcgtgtcgatggacatgatcaccgtggacctggccgaagtgccgggcgcccgcgttggcgcacccgtcacgctgtgggggcagggcctgccgatcgacgaggtggcgcatgccgccggcacggtcggctacgagctgatgtgcgcgctggcgccgcgcgtgccggtgacggtcgagccggccggcgcggcggatgccggcgagacgctcggcaaggcggcctga

SEQ ID NO: 33221 - protein, 375 aa, Ralstonia solanacearum
MPRPIQAVIHGPALVNNLQVVRRHAADSRVWAVIKANAYGHGIERAYEGLRQADGFGLLDLDEAVRLRQLGWQGPILLLEGFFKPEDLALVEQYRLTTTVHCEEQLRMLELARLKGPVSIQLKINTGMSRLGFAPAAYRAAWEHARAISGIGTIVHMTHFSDADGPRGIDHQLAAFEQATQGLPGEASLSNSAATLWHPRAHRDWVRPGVILYGASPTGVAADIEGTGLMPAMTLKSELIAVQDLQPGATVGYGSRFEAEQPMRIGIVACGYADGYPRHAPGWDGNYTPVLVDGVRTRMVGRVSMDMITVDLAEVPGARVGAPVTLWGQGLPIDEVAHAAGTVGYELMCALAPRVPVTVEPAGAADAGETLGKAA

SEQ ID NO: 33222 - DNA, 1140 bp, Rhizobium meliloti
  CDS (1)..(1140): transl_table=11
atgcaaagccccgagtttctttccgcctccagcaggctcaccgtcgacctcaccgcgctcgccgacaattggcgggcgatgaacgagcggtccggaaaagcccgcgccgccgccgttctgaaggccgatgcctacggtctcggcgtcgtgcatgccgctccggctctctatgccgccggcgcgcgcgatttcttcgtggccagtgtcgaagaaggggccgatcttcgcccgcttgttccggatgggcgaatctacattctcgcgggaatgtggcccggcaacgaggagctcttcttcgagaacgatctcgtgccgatcatcaactcggaagagcagctggcggtcttcatggcagcgctttccgaacggggcgaccacccctgcgttctccacgtcgacacgggcatgaaccggctcggcctgtcgcctgaggaggcgcttgccctcgcccacgaccctgcgcggcctgcgagtttctcgccggtcctcgtcatgagccatctggcctgcgccgacgatcccggacacccgatgaaccgctatcagcttcagcgtttccgcgaggtgaccgccgccttcgagggcgtgccggcgagccttgcaaattccggcggcgtgttcctcggtgcggactaccacttcgacctcacccggcccggcatcgcggtctatggcggcgaggcggtaaatggcgcggtcaatccgatgaaagcggtcgtcaccgccgaagcgcgcatcgtgcaggtcaggacggttccatccggcggaacggcaagctacggcgcctcggtccgcttcggccgcgacagccgcattgcgacggtcgcgatcggctatgccgacggctaccaccgttcggtttcgggcggcggcgtcaccctcagacaggcgatgccctcgggcgccttcggtttcctgcatggtatgaaggtgccgcatgtcggtcgggtgacgatggatctgagcctgttcgatgtcacggacctgccggaagcggccgtacgtgccggcgattatatcgaggtcttcgggcgcaatgtcgtcatcgacgacgtcgcgcgcgccggcggtaccatcggctacgagctgctgacgagcctcggccggcgctatcatcggacctatgtcggaggcgcttga

SEQ ID NO: 33223 - protein, 379 aa, Rhizobium meliloti
MQSPEFLSASSRLTVDLTALADNWRAMNERSGKARAAAVLKADAYGLGVVHAAPALYAAGARDFFVASVEEGADLRPLVPDGRIYILAGMWPGNEELFFENDLVPIINSEEQLAVFMAALSERGDHPCVLHVDTGMNRLGLSPEEALALAHDPARPASFSPVLVMSHLACADDPGHPMNRYQLQRFREVTAAFEGVPASLANSGGVFLGADYHFDLTRPGIAVYGGEAVNGAVNPMKAVVTAEARIVQVRTVPSGGTASYGASVRFGRDSRIATVAIGYADGYHRSVSGGGVTLRQAMPSGAFGFLHGMKVPHVGRVTMDLSLFDVTDLPEAAVRAGDYIEVFGRNVVIDDVARAGGTIGYELLTSLGRRYHRTYVGGA

SEQ ID NO: 33224 - DNA, 1068 bp, Rickettsia conorii
  CDS (1)..(1068): transl_table=11
atgagcttgtgtactgtagaaataaatctatctacaataaaaaataattaccttttattacaagatatttgcaaaacctcattagtcggtgctgccgttaaagctaacggttacggtcttggagcagtacaaatttctaaagctttaatagaagaaaattgtaggcatttttttgtggcctcaagtgaagaaggagtgaatttacgcaatgctttaggattagatgttaatattttagttcttaacggcgtttttgaacatgatgctttagagctgatagaatataatttaacacctgtcctaaataacttaaaacaaatagaaatttggcaaaaatttagtaatttgaaaaaccgattattgccttgttatttacatttcaatacggggattaatcgtcttggcttaagctctgatgagatagagcagctcattaatgatcgtgatttgttaaaagggctagatttacaatatattataagccatctagctatatccgaggaaatagataatccttataatctagaacaattaaacagatttaaagcttatttacaatatttcccaaacgtcaaagcaagccttgctaattccggcggcatatttttaggacaggattaccattttgatttagcaagaccaggggcagccttatatggtcttaatcccttaacaaagaatcccgtaaccttaaaagctcctataattcacttacagaatttgacactagatagccatatcggttataatatgacttttacaactaagcgtgatagtgtcattgcaacgttaccgcttggttatgccgatgggtttagtcgtaattttagcaatcaaggcgaagtatttattaacagtcgcagcgttcctatagtagggcgagtatcgatggatttaataaatatcgatgttaccgatctaccaccatccgagatttttctagggcaggaagcggaaattatcggaaattattgcacgcccgataaaatagcgagtattataggtactatcgggtatgaggtattaactaaccttggtagtagatataaaagaaagtatatcgggtag

SEQ ID NO: 33225 - protein, 355 aa, Rickettsia conorii
MSLCTVEINLSTIKNNYLLLQDICKTSLVGAAVKANGYGLGAVQISKALIEENCRHFFVASSEEGVNLRNALGLDVNILVLNGVFEHDALELIEYNLTPVLNNLKQIEIWQKFSNLKNRLLPCYLHFNTGINRLGLSSDEIEQLINDRDLLKGLDLQYIISHLAISEEIDNPYNLEQLNRFKAYLQYFPNVKASLANSGGIFLGQDYHFDLARPGAALYGLNPLTKNPVTLKAPIIHLQNLTLDSHIGYNMTFTTKRDSVIATLPLGYADGFSRNFSNQGEVFINSRSVPIVGRVSMDLINIDVTDLPPSEIFLGQEAEIIGNYCTPDKIASIIGTIGYEVLTNLGSRYKRKYIG

SEQ ID NO: 33226 - DNA, 1215 bp, Rickettsia prowazekii
  CDS (1)..(1215): transl_table=11
atgagcttgtgtaccctagaaataaatctatctgcaataaagaataattatcgtttattacaagatatttgtaaaactgcattagttggtgctgtagttaaagctaacggttatgggcttggtgcgatgcaaattgctaaagctttaataaaagaaaattgtcagtatttttttgtagctacaagcgaggagggaattaatttacgtaaagtactaaataatgatataactattttagttctcaatggagtttttacacatgatgctttagagcttatacaatataatttaactcctgttctaaataatttaagccaaatagaaatctggcaaaaatttagtaatttaaaaggaaaaatattgccttgttatctacattttaatactgggcttaatcgttttggcttaaactctgatgagatagaacagttgattaatgatcgtgatttattaaaaggtttagatctgcaatatattatcagtcatttagcagcttctgaagaaactggtaatccatataatttaatacaattaaacagatttaaagtttatttggaatattttccaaacgttaaggcaagttttgctaattccggtggcatatttttagggcaggattatcattttgatttagcaaggccaggtgcggctttatacggacttaattctttaatagaggtttcgtctaatctgtcttatacagaggaatttgaaagcaacacagcagctcttactaccacagcgtgtataaataaatgtccagatgttagtgtcagattgactcccaaattacctttaaaaggaagttatactgtacgtctacagaatcctgtaactttaaaggctcctataattgacttacagaatttgacactagatagtcatatcggttataatatgacttttacaactaagcgtgatagtgtaattgcaacgttaccacttggttatgccgatggatttagtcgtaattttagcagtcaaggtgaagtatttattaatagttgtagcgttcctatagtagggcgtgtatcgatggatttgataaatattgatgttacagatctaccaccgtccgaggtttttcttgggcaggaagcagagattataggtaattattgtacgccagataaaatagcgagtattatagggactatcggatatgaggtattgactagccttggtagtagatataagagaaagtatatatcgtag

SEQ ID NO: 33227 - protein, 404 aa, Rickettsia prowazekii
MSLCTLEINLSAIKNNYRLLQDICKTALVGAVVKANGYGLGAMQIAKALIKENCQYFFVATSEEGINLRKVLNNDITILVLNGVFTHDALELIQYNLTPVLNNLSQIEIWQKFSNLKGKILPCYLHFNTGLNRFGLNSDEIEQLINDRDLLKGLDLQYIISHLAASEETGNPYNLIQLNRFKVYLEYFPNVKASFANSGGIFLGQDYHFDLARPGAALYGLNSLIEVSSNLSYTEEFESNTAALTTTACINKCPDVSVRLTPKLPLKGSYTVRLQNPVTLKAPIIDLQNLTLDSHIGYNMTFTTKRDSVIATLPLGYADGFSRNFSSQGEVFINSCSVPIVGRVSMDLINIDVTDLPPSEVFLGQEAEIIGNYCTPDKIASIIGTIGYEVLTSLGSRYKRKYIS

SEQ ID NO: 33228 - DNA, 1149 bp, Staphylococcus epidermidis
  CDS (1)..(1149): transl_table=11
atgtcagagaagttttatagagcaacatatttaaatgtgaatttagatgcaattttagcaaattatcaaaatttcaatcaattacacgctaataagactgtcatttcagttattaaagcaaatggatatggattaggaagtgtgaaaatagcacaacatttaatgcgtcatggtgcaacattttttgcggtggctacacttgatgaagcaatagagttaagaatgcatggagttgatgctaaattattagttttaggcgttgttccaacagaagacattgagaaggctatacagcatcgtgttgcattaacagtaccttctaaagcatggttgaaggaaactatcaagcaaattcctgatgataaccaaaaaaatttatggctacatgtaaaattagatactggtatgggccgaattggaatgaaagatatagatgaatataaagaagtggttgatttaattaataaaagagatcatttagtttttgaaggggttttcacacattttgcgagtgctgatgaacctggaagttctatgaatgaacaatatactttgttcaaagagatggttaatcaagttgagaaaccaatttatattcattgtcaaaattctgctggatcactactcatggatggtcaattttgtaatgcaataagattaggaatctctctttatggatactatccttcagaatatgttaaagataatgtgaaagttcatttaagaccgagtgcgcagttagtatcagaaaccgttcaagtcaaaacgcttaaagttggggaaactgttagttatggacgtacatttattgctgatgaagaaatgacaattgcaattttacctattgggtatgccgacggatatttaagatcgatgcaaggtgcattcgtcaatgttaacgggagtcaatgtgaagtcattggacgcatttgtatggaccaaatgatagttaaggttccttctcatgtaaaaacgggtgaaaaagtaatacttatggataatcacgttgattcaccacaatcagctgaagccgtagcaaataaacaaggtacaattaactacgaagtattatgtaatttatcaagacgtcttccaagaatatattattatgataataatgaagaggttactaacgaattgttaaaatag

SEQ ID NO: 33229 - protein, 382 aa, Staphylococcus epidermidis
MSEKFYRATYLNVNLDAILANYQNFNQLHANKTVISVIKANGYGLGSVKIAQHLMRHGATFFAVATLDEAIELRMHGVDAKLLVLGVVPTEDIEKAIQHRVALTVPSKAWLKETIKQIPDDNQKNLWLHVKLDTGMGRIGMKDIDEYKEVVDLINKRDHLVFEGVFTHFASADEPGSSMNEQYTLFKEMVNQVEKPIYIHCQNSAGSLLMDGQFCNAIRLGISLYGYYPSEYVKDNVKVHLRPSAQLVSETVQVKTLKVGETVSYGRTFIADEEMTIAILPIGYADGYLRSMQGAFVNVNGSQCEVIGRICMDQMIVKVPSHVKTGEKVILMDNHVDSPQSAEAVANKQGTINYEVLCNLSRRLPRIYYYDNNEEVTNELLK

SEQ ID NO: 33230 - DNA, 1176 bp, Streptomyces coelicolor
  CDS (1)..(1176): transl_table=11
atgagcgagacaactgctcggcgggacgcggacgcggtactgcgcgcccgggccgagatcgacctggccgccctgcgggccaacgtacgcgcactgcgcgaacgggcccccggggcggctctcatggccgtcgtcaaggcggacgcctacggccacggcgcgatcccctgcgcccgtgcggccgtcgcggccggtgcgacctggctcggcaccgccaccccgcaggaggccctcgccctgcgcgcggcggagccaggcctgccggacgacgtacggatcatgtgctggctgtggacgcccggcgggccctggcgggaggcggtcgaggcccgtctcgacgtgtccgtcagcgcgatgtgggccatggaggaggtcaccggggcggcccgggcggccggggtgcccgcgcgcgtgcagctcaaggccgacaccggcctcgggcggggcggctgccagcccggcgcggactgggagcggctggtcggggccgcgctgcgggccgaggaggaggggctgctgagagtcaccgggctctggtcccacttcgcctgcgccgacgagcccggccacccctccatcgccgcccagctcacccgtttccgggagatgacggcctacgccgagcagcggggcctgcgtcccgaggtgcggcacatcgccaactcgccggccaccctcaccctccccgacgcccacttcgacctcgtccggcccggcatcgcgatgtacggtgtctcaccgagccccgagatcggcaccccggccgacttcgggctgcgccccgtgatgacgctggccgcctcgctggccctggtcaagcaggtccccggcggccacggcgtcagctacgggcaccactacaccacccccggcgagaccaccctcggcctcgtcccgctcggctacgcggacggcatcccccggcacgcctcctccagcggccccgtgctggtcgacggcaagtggcgcacggtcgcggggcggatcgcgatggaccagttcgtcgtcgacctgggcggggaccggcccgagccgggcgccgaggcggtgctgttcggaccgggcgaccgcggcgagcccaccgccgaggactgggcccaggcggcgggcaccatcgcgtacgagatcgtcacccggatcggaagccgggtcccgcgcgtctacgtcaacgaatga

SEQ ID NO: 33231 - protein, 391 aa, Streptomyces coelicolor
MSETTARRDADAVLRARAEIDLAALRANVRALRERAPGAALMAVVKADAYGHGAIPCARAAVAAGATWLGTATPQEALALRAAEPGLPDDVRIMCWLWTPGGPWREAVEARLDVSVSAMWAMEEVTGAARAAGVPARVQLKADTGLGRGGCQPGADWERLVGAALRAEEEGLLRVTGLWSHFACADEPGHPSIAAQLTRFREMTAYAEQRGLRPEVRHIANSPATLTLPDAHFDLVRPGIAMYGVSPSPEIGTPADFGLRPVMTLAASLALVKQVPGGHGVSYGHHYTTPGETTLGLVPLGYADGIPRHASSSGPVLVDGKWRTVAGRIAMDQFVVDLGGDRPEPGAEAVLFGPGDRGEPTAEDWAQAAGTIAYEIVTRIGSRVPRVYVNE

SEQ ID NO: 33232 - DNA, 1119 bp, Synechocystis sp
  CDS (1)..(1119)
atgattcgtcagcgggcttgggtggaaattgaccaagcggcgttggtgcataacgtccggcagttccgccagtatgtggggccaaaaactaatttgatggcggtggtcaaagccgatgcctatggccatggagcagtccgggtagcccaaactgctttacaggccggggctgattggttggcgatcgccactttgggggagggcatcgaactgagggaagcgggcatcaccgccccgattttgcttttgggaggtattaatagcccagaggaaattgaagccattgcccattggcgactacagcccaccctctgctccccggaacaggcccaattgttcaacgatattttgcttaagttgggtaaggttttacccgtacatctcaagctggatacgggcatgactaggttgggtactccctggccccaggcggcgaactttgttggtttggtgcaatctttgccccagctacggctagctagtttatattcccatctggccacagcggacgaccccaacaccgccaccatgctccagcaacaggaaagatttgccaaggcgatcgccagtttgcgtcaagcccgattacccatacccaaattacatttagctaattctgcggccaccctccacggccaggcttggcactacgacatggtccgggtaggtttaggtttgtatggcctttatcctgctccccacctaggcgattgcctggacctaaaacccgtattaacagtgcgggccaaaatcacccagatcagaaccattccccccggcaccggcgttagttacggtcaccaattcgttagtgaagaaaccatgcccatggcagtagtgggcattggctatgcggacggtgtcccccgtaatctttccaatcaattggaagtgcttttgcggggccaaccagtgcgacaaatcggggccatcaccatggatcaaatgatggtggatttacggggcattgatgatccccaagtgggggaagtggttaccctgattggccaagacggcgatcgccaaatcaccgcagaccattgggcctctactttgggcaccatatcctgggaaattctctgtggcttcaaacaccgtctaccccgtattcttatctaa

SEQ ID NO: 33233 - protein, 372 aa, Synechocystis sp
MIRQRAWVEIDQAALVHNVRQFRQYVGPKTNLMAVVKADAYGHGAVRVAQTALQAGADWLAIATLGEGIELREAGITAPILLLGGINSPEEIEAIAHWRLQPTLCSPEQAQLFNDILLKLGKVLPVHLKLDTGMTRLGTPWPQAANFVGLVQSLPQLRLASLYSHLATADDPNTATMLQQQERFAKAIASLRQARLPIPKLHLANSAATLHGQAWHYDMVRVGLGLYGLYPAPHLGDCLDLKPVLTVRAKITQIRTIPPGTGVSYGHQFVSEETMPMAVVGIGYADGVPRNLSNQLEVLLRGQPVRQIGAITMDQMMVDLRGIDDPQVGEVVTLIGQDGDRQITADHWASTLGTISWEILCGFKHRLPRILI

SEQ ID NO: 33234 - DNA, 1134 bp, Treponema pallidum
  CDS (1)..(1134)
atggcatgcaatcaggcattgatccatttagcaaacttgcgtcataacctcggtgaaattatgagccgtacacgcgcgcgtgtgtgtctacctgttaaggcggacgcgtatggacacggtgcgtgtgacgtcgcacaggcggcgctttcgtgcggggtgcactcgttcgccgttgcatgtgtgcaagaagcgtcgcaactgcgtgcggcaggtgttcgcgcgccgattttgtgtttaagtactccaactgctgaagagatttctagtcttattgagcatcgtgtgcacaccgtgatttctgagcgcgcgcatattgcccttatcgcacgcgcgctccgtcagtctgctgatacgggtgccacgtgtggggtacacgtaaagattgataccggaatggggagaatcggctgtgcgccggatgaggcctgtgcgctcgtgcagatggtgtgcgcaacaccgggtctccatcttgagggggtatgtacgcatttttctgtcgcggattctgtgcgtgctgaggacctgcagtacactgagatgcaacgtgcacattttatgcattgcgtacagtacatacggaaaagtggcatatcgattccattggtgcatgcggcaaactctgcagcgctgttgtgccatccgcgggcacacttcgacatggtgcgtccgggattgttggcatacggctatgcccctgagtctgtgcatcctgctgtgcgcagtgtgttccttcccgtcatggagcttgttacccaagtccgtgcaatcaaaaaaatacctgcaggcgcgtacgtttcttaccagcgcttgtggcgtgcgcatacagaaacacatgtaggtattctgcctatcggatatgcagacggagttatgcgcgcgctgtcgccgggtttgcaggtgtgcattggggggaagtggtatccggtggtgggggcaatttgcatggaccagtgtgtagtggacctaggtaccccgctgcgtgtgacagttggagatagggtgacacttttcggtcctcaggacgcaggtggcccaggacagggggcagatgtgctcgcctcgcatgcaggcaccattccctatgagcttttgtgcgcgattggtaagcgtgtcgaacgggtgtacatccggtga

SEQ ID NO: 33235 - protein, 377 aa, Treponema pallidum
MACNQALIHLANLRHNLGEIMSRTRARVCLPVKADAYGHGACDVAQAALSCGVHSFAVACVQEASQLRAAGVRAPILCLSTPTAEEISSLIEHRVHTVISERAHIALIARALRQSADTGATCGVHVKIDTGMGRIGCAPDEACALVQMVCATPGLHLEGVCTHFSVADSVRAEDLQYTEMQRAHFMHCVQYIRKSGISIPLVHAANSAALLCHPRAHFDMVRPGLLAYGYAPESVHPAVRSVFLPVMELVTQVRAIKKIPAGAYVSYQRLWRAHTETHVGILPIGYADGVMRALSPGLQVCIGGKWYPVVGAICMDQCVVDLGTPLRVTVGDRVTLFGPQDAGGPGQGADVLASHAGTIPYELLCAIGKRVERVYIR

SEQ ID NO: 33236 - DNA, 1074 bp, Wigglesworthia glossinidia brevipalpis
  CDS (1)..(1074)
atgccaagaaaaactacaatcagaattagttctaatgcattagcttcaaatttaagaacaataaaaaattacgcaaataaatcaaaagtatggtccgttataaaatctaatgcttatggtcacaccataaaagcagcattaaaaggattaaaagaaacttctgggtttgcagtattagaattaaatgaagctgtattattaagagaaaatggatggaatggaccaattttattacttgaaggattttttgaagaatctgatttactagaaatatgtcaatataaaataactactgttatacacaacgattggcaattaaattacatcaagcaatatgacattaaatctcctatagatgtttatttaaagcttaatagcggaatgaatagattaggttttaatgaaaaagattttattagaacgtggtatgatttgtctaatttaaaaaaaatatctagcttgactttaatgagtcatttttctttaggattttctacaaaaacagtaaataaacaaatgaacataattagaaaaatattcaaaatattaaatcctactttatgcctagcaaattcaacagctattatatttcatacttatactcataaagattggattaggccaggaattatattatatgggattttacctaaagaaaacaaaaaaatatctaaaaaattcaatttaaaaccagttatgactttagaaagtagaataatttctatacaaaatattaaatctaaagaatatatagggtatgggaaaaattattattctaataaatcaaatttaattggaatagtatcatgtggatatgcagatggatatccattcagcgtaccttttagtggtactcctgtttttgtaaatggaacacgtacccaaattattggatctgtttgcatggatatgttaacgattgatttaaatgattgtccaaatgcaaaaattggatccaaagtagaattatggggtaataatataagtattaatgaaatttcaaagctagctaatacaacaagttatgaattaatgtgtagaatttcttccagagttttagtgaaaatagaataa

SEQ ID NO: 33237 - protein, 357 aa, Wigglesworthia glossinidia brevipalpis
MPRKTTIRISSNALASNLRTIKNYANKSKVWSVIKSNAYGHTIKAALKGLKETSGFAVLELNEAVLLRENGWNGPILLLEGFFEESDLLEICQYKITTVIHNDWQLNYIKQYDIKSPIDVYLKLNSGMNRLGFNEKDFIRTWYDLSNLKKISSLTLMSHFSLGFSTKTVNKQMNIIRKIFKILNPTLCLANSTAIIFHTYTHKDWIRPGIILYGILPKENKKISKKFNLKPVMTLESRIISIQNIKSKEYIGYGKNYYSNKSNLIGIVSCGYADGYPFSVPFSGTPVFVNGTRTQIIGSVCMDMLTIDLNDCPNAKIGSKVELWGNNISINEISKLANTTSYELMCRISSRVLVKIE

SEQ ID NO: 33238 - DNA, 1101 bp, Xanthomonas axonopodis
  CDS (1)..(1101): transl_table=11
gtgcgtcctgcgcaagcgtcgatcgatctggaggcattgcgccacaactaccgcctggccaagcgcctgggcggcagcaaggcgctggcggtggtcaaggccgacgcgtacggacacggtgcagtgcgctgcgcgcaggcgctggagccggaagccgatggctttgcagtggcctgcatcgaagaggcgctggaactgcgccaggccggcatccgtgcgccgatcctgttgctggaaggattcttcgaacacgacgagctgcgcctgatcgccgagcacgacctgtggacggtggctgccacgccgcagcaggtgcgcgcgctggccgagttccagagcccgcggccgttgcgggtatggttgaagctggacagcggcatgcatcggctgggtctgtcgccggaagatttccgcgccgcctggttgcgcctgcgggggctgccgcagatcgcctcgctggtgctgatgacccatctggcgcgtgccgacgaattggactgcagccgcaccgacgagcaggcggtggcctttgcgctcaccgcaggcggcatgcgcgcggaaaccagcctgcgcaattcgcccggcctgctcggctggccggcgctgcgcaacgactggtcgcgcccggggctgatgttgtacggcgccaacccgttcccgcaggacaccgaaaacaccgcgcagctgcgcccggtgatgacgctgcgctcgcgcatcatttcggttcgcgagctgccggccggcgaaccggtgggctacggcgcacgctttgttgccgagcggccgacgcgtgtcggcgtcgtggcgatgggctatgccgacggctacccgcagttcgcacccaacggcaccccggtgctggtggacggccaggtctgtccgttggccggtcgcgtctcgatggacatgctcaccgtggacctcaccgaccacccgcaggccgacatcggcacgccggtgcagctgtggggtgatgcaccgcaggtcggcgcactggccgcgcaatgcaacgtcagcgcgtaccaactgctgtgcgggctcaagcgggtgccgcgggtgtatatgggcgaggcagcagcgaaggagggagtcacgcgttga

SEQ ID NO: 33239 - protein, 366 aa, Xanthomonas axonopodis
MRPAQASIDLEALRHNYRLAKRLGGSKALAVVKADAYGHGAVRCAQALEPEADGFAVACIEEALELRQAGIRAPILLLEGFFEHDELRLIAEHDLWTVAATPQQVRALAEFQSPRPLRVWLKLDSGMHRLGLSPEDFRAAWLRLRGLPQIASLVLMTHLARADELDCSRTDEQAVAFALTAGGMRAETSLRNSPGLLGWPALRNDWSRPGLMLYGANPFPQDTENTAQLRPVMTLRSRIISVRELPAGEPVGYGARFVAERPTRVGVVAMGYADGYPQFAPNGTPVLVDGQVCPLAGRVSMDMLTVDLTDHPQADIGTPVQLWGDAPQVGALAAQCNVSAYQLLCGLKRVPRVYMGEAAAKEGVTR

SEQ ID NO: 33240 - DNA, 1083 bp, Xanthomonas campestris
  CDS (1)..(1083): transl_table=11
gtgcgtcctgcgcaagcgttgatcgacctggacgcgttgcgtcacaactaccgcctggcccggcaactgggtggcggcaaggcactggcagtggtcaaggccgacgcctacggccacggcgcggtgcgctgtgcgcaggcgctggaaccggaggccgacggctttgcggtggcctgcatcgaagaagcgctggagctgcgccaggccggcgtgcgcgcgccgatcctgctgctggaaggttttttcgagcatgacgagctggcgctgattgccgaacacgatctatggacggtggtcgccacgccctggcaggtgcgcgcgctggccgagttccgcagcccgcgccctttgcgggtgtggttgaagctggacagcggcatgcatcggctcggcctgtcgccggaagattttcgcgccgcatggctgcatttgcgcggcttgccgcagatcgactcgctggtgctgatgacgcatctggcacaggccgacgagctggagtgcagccgcaccgacgaacaggccgtggcgttcgcgctgacctgcggcggcatgcgcgcggaaaccagcctgcgcaattcgcccggcctgctcggctggccagcgctgcgcaacgattggtcacgcccggggctgatgctgtacggcgccaacccgttcccgcagccgagcgagctcaccgcgcaactgcgcccggtgatgacggtgcgctcgcgcatcatcagcgtgcgcgacctgccggccggcgagccggttggctatggcgcgcgcttcgttgccgaacggcccacgcgcgtgggcgtggtggcgatgggctatgccgacggctacccgcagttcgcgcccaacggcacgccggtgctggtggatggcaaggtgtgcccgctgatcggccgtgtgtcgatggacatgctcactgtggatctcaccgagcatccgcacgccgatgtgggaacgcccgtgcagctgtggggcgacgcgccgcaggtgagcacgttggccgcgcagtgcaatgtcagtgcataccagctgctgtgtggactcaagcgcgttccgcgtcactacagcacccctgcacacgcgtaa

SEQ ID NO: 33241 - protein, 360 aa, Xanthomonas campestris
MRPAQALIDLDALRHNYRLARQLGGGKALAVVKADAYGHGAVRCAQALEPEADGFAVACIEEALELRQAGVRAPILLLEGFFEHDELALIAEHDLWTVVATPWQVRALAEFRSPRPLRVWLKLDSGMHRLGLSPEDFRAAWLHLRGLPQIDSLVLMTHLAQADELECSRTDEQAVAFALTCGGMRAETSLRNSPGLLGWPALRNDWSRPGLMLYGANPFPQPSELTAQLRPVMTVRSRIISVRDLPAGEPVGYGARFVAERPTRVGVVAMGYADGYPQFAPNGTPVLVDGKVCPLIGRVSMDMLTVDLTEHPHADVGTPVQLWGDAPQVSTLAAQCNVSAYQLLCGLKRVPRHYSTPAHA

SEQ ID NO: 33242 - DNA, 23 bp, Artificial sequence
  (1)..(23): primer
atgcaagcggcaactgttgtgat

SEQ ID NO: 33243 - DNA, 24 bp, Artificial sequence
  (1)..(24): primer
ttaatccacgtatttcatcgcgac

SEQ ID NO: 33244 - protein, 490 aa, Artificial sequence
  Variant (2)..(4): xaa in position 2 to 4 is any amino acid
  Variant (7)..(8): xaa in position 7 to 8 is any amino acid
  Variant (10)..(18): xaa in position 10 to 18 is any amino acid
  Variant (19)..(30): xaa in position 19 to 30 is any or no amino acid
  Variant (32)..(32): xaa in position 32 is any amino acid
  Variant (38)..(38): xaa in position 38 is any amino acid
  Variant (42)..(42): xaa in position 42 is any amino acid
  Variant (44)..(58): xaa in position 44 to 58 is any amino acid
  Variant (59)..(62): xaa in position 59 to 62 is any or no amino acid
  Variant (65)..(65): xaa in position 65 is any amino acid
  Variant (67)..(67): xaa in position 67 is any amino acid
  Variant (71)..(71): xaa in position 71 is any amino acid
  Variant (74)..(80): xaa in position 74 to 80 is any amino acid
  Variant (83)..(83): xaa in position 83 is any amino acid
  Variant (85)..(92): xaa in position 85 to 92 is any amino acid
  Variant (93)..(103): xaa in position 93 to 103 is any or no amino acid
  Variant (105)..(107): xaa in position 105 to 107 is any amino acid
  Variant (109)..(124): xaa in position 109 to 124 is any amino acid
  Variant (125)..(146): xaa in position 125 to 146 is any or no amino acid
  Variant (148)..(148): xaa in position 148 is any amino acid
  Variant (153)..(153): xaa in position 153 is any or no amino acid
  Variant (155)..(155): xaa in position 155 is any amino acid
  Variant (157)..(157): xaa in position 157 is any amino acid
  Variant (159)..(171): xaa in position 159 to 171 is any amino acid
  Variant (172)..(185): xaa in position 172 to 185 is any or no amino acid
  Variant (187)..(187): xaa in position 187 is any or no amino acid
  Variant (190)..(190): xaa in position 190 is any amino acid
  Variant (192)..(192): xaa in position 192 is any amino acid
  Variant (195)..(200): xaa in position 195 to 200 is any amino acid
  Variant (201)..(207): xaa in position 201 to 207 is any or no amino acid
  Variant (209)..(211): xaa in position 209 to 211 is any amino acid
  Variant (213)..(225): xaa in position 213 to 225 is any amino acid
  Variant (226)..(236): xaa in position 226 to 236 is any or no amino acid
  Variant (239)..(239): xaa in position 239 is any amino acid
  Variant (241)..(241): xaa in position 241 is any amino acid
  Variant (243)..(250): xaa in position 243 to 250 is any amino acid
  Variant (251)..(266): xaa in position 251 to 266 is any or no amino acid
  Variant (268)..(268): xaa in position 268 is any amino acid
  Variant (271)..(271): xaa in position 271 is any amino acid
  Variant (275)..(276): xaa in position 275 to 276 is any amino acid
  Variant (278)..(280): xaa in position 278 to 280 is any amino acid
  Variant (281)..(327): xaa in position 281 to 327 is any or no amino acid
  Variant (329)..(329): xaa in position 329 is any or no amino acid
  Variant (331)..(331): xaa in position 331 is any amino acid
  Variant (333)..(333): xaa in position 333 is any amino acid
  Variant (335)..(337): xaa in position 335 to 337 is any amino acid
  Variant (339)..(340): xaa in position 339 to 340 is any amino acid
  Variant (342)..(343): xaa in position 342 to 343 is any amino acid
  Variant (345)..(347): xaa in position 345 to 347 is any amino acid
  Variant (348)..(351): xaa in position 348 to 351 is any or no amino acid
  Variant (353)..(353): xaa in position 353 is any or no amino acid
  Variant (356)..(357): xaa in position 356 to 357 is any or no amino acid
  Variant (359)..(366): xaa in position 359 to 366 is any or no amino acid
  Variant (369)..(369): xaa in position 369 is any amino acid
  Variant (371)..(372): xaa in position 371 to 372 is any amino acid
  Variant (378)..(379): xaa in position 378 to 379 is any amino acid
  Variant (381)..(384): xaa in position 381 to 384 is any amino acid
  Variant (385)..(413): xaa in position 385 to 413 is any or no amino acid
  Variant (415)..(415): xaa in position 415 is any or no amino acid
  Variant (417)..(417): xaa in position 417 is any amino acid
  Variant (419)..(423): xaa in position 419 to 423 is any amino acid
  Variant (426)..(426): xaa in position 426 is any amino acid
  Variant (428)..(428): xaa in position 428 is any amino acid
  Variant (431)..(433): xaa in position 431 to 433 is any amino acid
  Variant (435)..(435): xaa in position 435 is any amino acid
  Variant (437)..(439): xaa in position 437 to 439 is any amino acid
  Variant (440)..(449): xaa in position 440 to 449 is any or no amino acid
  Variant (451)..(451): xaa in position 451 is any amino acid
  Variant (452)..(452): xaa in position 452 is any or no amino acid
  Variant (454)..(454): xaa in position 454 is any amino acid
  Variant (456)..(456): xaa in position 456 is any amino acid
  Variant (458)..(463): xaa in position 458 to 463 is any amino acid
  Variant (464)..(472): xaa in position 464 to 472 is any or no amino acid
  Variant (474)..(476): xaa in position 474 to 476 is any amino acid
  Variant (477)..(477): xaa in position 477 is any or no amino acid
  Variant (480)..(480): xaa in position 480 is any amino acid
  Variant (484)..(486): xaa in position 484 to 486 is any amino acid
  Variant (488)..(489): xaa in position 488 to 489 is any amino acid
IXXXALXXNXXXXXXXXXXXXXXXXXXXXXLXAVVKAXAYGXGXXXXXXXXXXXXXXXXXXXVAXLXEALXLRXXXXXXXILXLXXXXXXXXXXXXXXXXXXXLXXXVXXXXXXXXXXXXXXXXXXXXXXXXXXXXXXXXXXXXXXLXVDTGXMXRXGXXXXXXXXXXXXXXXXXXXXXXXXXXXIXTHXAXADXXXXXXXXXXXXXQXXXFXXXXXXXXXXXXXXXXXXXXXXXXNSXAXLXXXXXXXXXXXXXXXXXXXXXXXXRXGIXLYGXXPXXXXXXXXXXXXXXXXXXXXXXXXXXXXXXXXXXXXXXXXXXXXXXXXXXLXPXMXLXXXVXXVXXLXXXXXXXVXYGXXFXXXXXXXXIAXVXXGYADGXXRXXXXXXXXXXXXXXXXXXXXXXXXXXXXXXXXXVXVXGXXXXXVGXVXMDXXXVXLXXXXXXXXXXXXXGXXVXLXGXXXXXXXXXXXXXXXAXXXXTIXYELXXXLXXR

SEQ ID NO: 33245 - protein, 10 aa, Artificial sequence
  Variant (2)..(2): xaa in position 2 is any or no amino acid
  Variant (5)..(5): xaa in position 5 is Asp or Asn
  Variant (6)..(6): xaa in position 6 is Ala, Cys or Gly
  Variant (9)..(9): xaa in position 9 is any amino acid
VXKAXXYGXG

SEQ ID NO: 33246 - protein, 6 aa, Artificial sequence
  Variant (3)..(3): xaa in position 3 is any amino acid
  Variant (5)..(5): xaa in position 5 is any amino acid
GMXRXG

SEQ ID NO: 33247 - protein, 11 aa, Artificial sequence
  Variant (2)..(2): xaa in position 2 is any amino acid
  Variant (4)..(4): xaa in position 4 is Ala, Ile, Leu or Val
  Variant (5)..(6): xaa in position 5 to 6 is any amino acid
  Variant (9)..(10): xaa in position 9 to 10 is any amino acid
RXGXXXYGXXP

SEQ ID NO: 33248 - protein, 26 aa, Artificial sequence
  Variant (2)..(2): xaa in position 2 is Asp, Gly or Asn
  Variant (3)..(13): xaa in position 3 to 13 is any amino acid
  Variant (14)..(14): xaa in position 14 is Ala or Gly
  Variant (15)..(15): xaa in position 15 is any amino acid
  Variant (16)..(16): xaa in position 16 is Ala, Ile, Leu or Val
  Variant (17)..(17): xaa in position 17 is Ala, Gly, Pro, Ser or Thr
  Variant (18)..(18): xaa in position 18 is any amino acid
  Variant (21)..(21): xaa in position 21 is Ala, Glu, Gly, Asn or Ser
  Variant (24)..(25): xaa in position 24 to 25 is any amino acid
YXXXXXXXXXXXXXXXXXGYXDGXXR

SEQ ID NO: 33249 - DNA, 2280 bp, Escherichia coli K12; identical to SEQ ID NO: 11018
  CDS (470)..(1951)

SEQ ID NO: 33250 - protein, 493 aa, Escherichia coli K12; identical to SEQ ID NO: 11019

SEQ ID NO: 33251 - DNA, 1770 bp, Arabidopsis thaliana; identical to SEQ ID NO: 11020
  CDS (84)..(1559)

SEQ ID NO: 33252 - protein, 491 aa, Arabidopsis thaliana; identical to SEQ ID NO: 11021

SEQ ID NO: 33253 - DNA, 1512 bp, Arabidopsis thaliana; identical to SEQ ID NO: 11022
  CDS (1)..(1479)

SEQ ID NO: 33254 - protein, 492 aa, Arabidopsis thaliana; identical to SEQ ID NO: 11023

SEQ ID NO: 33255 - DNA, 1500 bp, Arabidopsis thaliana; identical to SEQ ID NO: 11024
  CDS (1)..(1500)

SEQ ID NO: 33256 - protein, 499 aa, Arabidopsis thaliana; identical to SEQ ID NO: 11025

SEQ ID NO: 33257 - DNA, 1865 bp, Solanum tuberosum; identical to SEQ ID NO: 11026
  CDS (66)..(1547)

SEQ ID NO: 33258 - protein, 493 aa, Solanum tuberosum; identical to SEQ ID NO: 11027

SEQ ID NO: 33259 - DNA, 1616 bp, Arabidopsis thaliana; identical to SEQ ID NO: 11028
  CDS (44)..(1576)

SEQ ID NO: 33260 - protein, 510 aa, Arabidopsis thaliana; identical to SEQ ID NO: 11029

SEQ ID NO: 33261 - DNA, 1416 bp, Nostoc sp. PCC 7120; identical to SEQ ID NO: 11030
  CDS (1)..(1416)

SEQ ID NO: 33262 - protein, 471 aa, Nostoc sp. PCC 7120; identical to SEQ ID NO: 11031

SEQ ID NO: 33263 - DNA, 1437 bp, Salmonella enterica subsp. enterica serovar Typhi; identical to SEQ ID NO: 11032
  CDS (1)..(1437)

SEQ ID NO: 33264 - protein, 478 aa, Salmonella enterica subsp. enterica serovar Typhi; identical to SEQ ID NO: 11033

SEQ ID NO: 33265 - DNA, 1452 bp, Brucella melitensis; identical to SEQ ID NO: 11034
  CDS (1)..(1452)

SEQ ID NO: 33266 - protein, 483 aa, Brucella melitensis; identical to SEQ ID NO: 11035

SEQ ID NO: 33267 - DNA, 1416 bp, Bacillus halodurans; identical to SEQ ID NO: 11036
  CDS (1)..(1416)

SEQ ID NO: 33268 - protein, 471 aa, Bacillus halodurans; identical to SEQ ID NO: 11037

SEQ ID NO: 33269 - DNA, 1428 bp, Haemophilus influenzae; identical to SEQ ID NO: 11038
  CDS (1)..(1428)

SEQ ID NO: 33270 - protein, 475 aa, Haemophilus influenzae; identical to SEQ ID NO: 11039

SEQ ID NO: 33271 - DNA, 1398 bp, Neisseria meningitidis; identical to SEQ ID NO: 11040
  CDS (1)..(1398)

SEQ ID NO: 33272 - protein, 465 aa, Neisseria meningitidis; identical to SEQ ID NO: 11041

SEQ ID NO: 33273 - DNA, 1425 bp, Pseudomonas aeruginosa; identical to SEQ ID NO: 11042
  CDS (1)..(1425)

SEQ ID NO: 33274 - protein, 474 aa, Pseudomonas aeruginosa; identical to SEQ ID NO: 11043

SEQ ID NO: 33275 - DNA, 1398 bp, Clostridium acetobutylicum; identical to SEQ ID NO: 11044
  CDS (1)..(1398)

SEQ ID NO: 33276 - protein, 465 aa, Clostridium acetobutylicum; identical to SEQ ID NO: 11045

SEQ ID NO: 33277 - DNA, 1446 bp, Agrobacterium tumefaciens; identical to SEQ ID NO: 11046
  CDS (1)..(1446)

SEQ ID NO: 33278 - protein, 481 aa, Agrobacterium tumefaciens; identical to SEQ ID NO: 11047

SEQ ID NO: 33279 - DNA, 1377 bp, Thermotoga maritima; identical to SEQ ID NO: 11048
  CDS (1)..(1377)

SEQ ID NO: 33280 - protein, 458 aa, Thermotoga maritima; identical to SEQ ID NO: 11049

SEQ ID NO: 33281 - DNA, 1407 bp, Campylobacter jejuni; identical to SEQ ID NO: 11050
  CDS (1)..(1407)

SEQ ID NO: 33282 - protein, 468 aa, Campylobacter jejuni; identical to SEQ ID NO: 11051

SEQ ID NO: 33283 - DNA, 1452 bp, Vibrio cholerae; identical to SEQ ID NO: 11052
  CDS (1)..(1452)

SEQ ID NO: 33284 - protein, 483 aa, Vibrio cholerae; identical to SEQ ID NO: 11053

SEQ ID NO: 33285 - DNA, 1413 bp, Clostridium acetobutylicum; identical to SEQ ID NO: 11054
  CDS (1)..(1413)

SEQ ID NO: 33286 - protein, 470 aa, Clostridium acetobutylicum; identical to SEQ ID NO: 11055

SEQ ID NO: 33287 - DNA, 1407 bp, Helicobacter pylori; identical to SEQ ID NO: 11056
  CDS (1)..(1407)

SEQ ID NO: 33288 - protein, 468 aa, Helicobacter pylori; identical to SEQ ID NO: 11057

SEQ ID NO: 33289 - DNA, 2867 bp, Serratia marcescens; identical to SEQ ID NO: 11058
  CDS (787)..(2223)

SEQ ID NO: 33290 - protein, 478 aa, Serratia marcescens; identical to SEQ ID NO: 11059

SEQ ID NO: 33291 - DNA, 1428 bp, Bacillus subtilis; identical to SEQ ID NO: 11060
  CDS (1)..(1428)

SEQ ID NO: 33292 - protein, 475 aa, Bacillus subtilis; identical to SEQ ID NO: 11061

SEQ ID NO: 33293 - DNA, 2066 bp, Pseudomonas fluorescens; identical to SEQ ID NO: 11062
  CDS (323)..(1759)

SEQ ID NO: 33294 - protein, 478 aa, Pseudomonas fluorescens; identical to SEQ ID NO: 11063

SEQ ID NO: 33295 - DNA, 1437 bp, Bacillus cereus; identical to SEQ ID NO: 11064
  CDS (1)..(1437)

SEQ ID NO: 33296 - protein, 478 aa, Bacillus cereus; identical to SEQ ID NO: 11065

SEQ ID NO: 33297 - DNA, 1419 bp, Acinetobacter sp; identical to SEQ ID NO: 11066
  CDS (1)..(1419)

SEQ ID NO: 33298 - protein, 472 aa, Acinetobacter sp; identical to SEQ ID NO: 11067

SEQ ID NO: 33299 - DNA, 1431 bp, Bacillus anthracis str; identical to SEQ ID NO: 11068
  CDS (1)..(1431)

SEQ ID NO: 33300 - protein, 476 aa, Bacillus anthracis str; identical to SEQ ID NO: 11069

SEQ ID NO: 33301 - DNA, 1461 bp, Photobacterium profundum; identical to SEQ ID NO: 11070
  CDS (1)..(1461)

SEQ ID NO: 33302 - protein, 486 aa, Photobacterium profundum; identical to SEQ ID NO: 11071

SEQ ID NO: 33303 - DNA, 1431 bp, Bdellovibrio bacteriovorus; identical to SEQ ID NO: 11072
  CDS (1)..(1431)

SEQ ID NO: 33304 - protein, 476 aa, Bdellovibrio bacteriovorus; identical to SEQ ID NO: 11073

SEQ ID NO: 33305 - DNA, 1575 bp, Corynebacterium diphtheriae; identical to SEQ ID NO: 11074
  CDS (1)..(1575)

SEQ ID NO: 33306 - protein, 524 aa, Corynebacterium diphtheriae; identical to SEQ ID NO: 11075

SEQ ID NO: 33307 - DNA, 1407 bp, Desulfovibrio vulgaris; identical to SEQ ID NO: 11076
  CDS (1)..(1407)

SEQ ID NO: 33308 - protein, 468 aa, Desulfovibrio vulgaris; identical to SEQ ID NO: 11077

SEQ ID NO: 33309 - DNA, 1413 bp, Desulfovibrio vulgaris; identical to SEQ ID NO: 11078
  CDS (1)..(1413)

SEQ ID NO: 33310 - protein, 470 aa, Desulfovibrio vulgaris; identical to SEQ ID NO: 11079

SEQ ID NO: 33311 - DNA, 1434 bp, Bacillus cereus; identical to SEQ ID NO: 11080
  CDS (1)..(1434)

SEQ ID NO: 33312 - protein, 477 aa, Bacillus cereus; identical to SEQ ID NO: 11081

SEQ ID NO: 33313 - DNA, 1392 bp, Treponema denticola; identical to SEQ ID NO: 11082
  CDS (1)..(1392)

SEQ ID NO: 33314 - protein, 463 aa, Treponema denticola; identical to SEQ ID NO: 11083

SEQ ID NO: 33315 - DNA, 1392 bp, Geobacter sulfurreducens; identical to SEQ ID NO: 11084
  CDS (1)..(1392)

SEQ ID NO: 33316 - protein, 463 aa, Geobacter sulfurreducens; identical to SEQ ID NO: 11085

SEQ ID NO: 33317 - DNA, 1437 bp, Yersinia pestis; identical to SEQ ID NO: 11086
  CDS (1)..(1437)

SEQ ID NO: 33318 - protein, 478 aa, Yersinia pestis; identical to SEQ ID NO: 11087

SEQ ID NO: 33319 - DNA, 1401 bp, Bradyrhizobium japonicum USDA 110; identical to SEQ ID NO: 11088
  CDS (1)..(1401)

SEQ ID NO: 33320 - protein, 466 aa, Bradyrhizobium japonicum USDA 110; identical to SEQ ID NO: 11089

SEQ ID NO: 33321 - DNA, 1416 bp, Wolinella succinogenes; identical to SEQ ID NO: 11090
  CDS (1)..(1416)

SEQ ID NO: 33322 - protein, 471 aa, Wolinella succinogenes; identical to SEQ ID NO: 11091

SEQ ID NO: 33323 - DNA, 1452 bp, Vibrio vulnificus; identical to SEQ ID NO: 11092
  CDS (1)..(1452)

SEQ ID NO: 33324 - protein, 483 aa, Vibrio vulnificus; identical to SEQ ID NO: 11093

SEQ ID NO: 33325 - DNA, 1428 bp, Porphyromonas gingivalis W83; identical to SEQ ID NO: 11094
  CDS (1)..(1428)

SEQ ID NO: 33326 - protein, 475 aa, Porphyromonas gingivalis W83; identical to SEQ ID NO: 11095

SEQ ID NO: 33327 - DNA, 1425 bp, Photorhabdus luminescens subsp; identical to SEQ ID NO: 11096
  CDS (1)..(1425)

SEQ ID NO: 33328 - protein, 474 aa, Photorhabdus luminescens subsp; identical to SEQ ID NO: 11097

SEQ ID NO: 33329 - DNA, 1410 bp, Gloeobacter violaceus PCC 7421; identical to SEQ ID NO: 11098
  CDS (1)..(1410)

SEQ ID NO: 33330 - protein, 469 aa, Gloeobacter violaceus PCC 7421; identical to SEQ ID NO: 11099

SEQ ID NO: 33331 - DNA, 1404 bp, Chromobacterium violaceum ATCC 12472; identical to SEQ ID NO: 11100
  CDS (1)..(1404)

SEQ ID NO: 33332 - protein, 467 aa, Chromobacterium violaceum ATCC 12472; identical to SEQ ID NO: 11101

SEQ ID NO: 33333 - DNA, 1440 bp, Helicobacter hepaticus ATCC 51449; identical to SEQ ID NO: 11102
  CDS (1)..(1440)

SEQ ID NO: 33334 - protein, 479 aa, Helicobacter hepaticus ATCC 51449; identical to SEQ ID NO: 11103

SEQ ID NO: 33335 - DNA, 1428 bp, Haemophilus ducreyi 35000HP; identical to SEQ ID NO: 11104
  CDS (1)..(1428)

SEQ ID NO: 33336 - protein, 475 aa, Haemophilus ducreyi 35000HP; identical to SEQ ID NO: 11105

SEQ ID NO: 33337 - DNA, 1413 bp, Streptomyces avermitilis; identical to SEQ ID NO: 11106
  CDS (1)..(1413)

SEQ ID NO: 33338 - protein, 470 aa, Streptomyces avermitilis; identical to SEQ ID NO: 11107

SEQ ID NO: 33339 - DNA, 1395 bp, Eikenella corrodens; identical to SEQ ID NO: 11108
  CDS (1)..(1395)

SEQ ID NO: 33340 - protein, 464 aa, Eikenella corrodens; identical to SEQ ID NO: 11109

SEQ ID NO: 33341 - DNA, 1452 bp, Vibrio parahaemolyticus; identical to SEQ ID NO: 11110
  CDS (1)..(1452)

SEQ ID NO: 33342 - protein, 483 aa, Vibrio parahaemolyticus; identical to SEQ ID NO: 11111

SEQ ID NO: 33343 - DNA, 1425 bp, Pseudomonas syringae pv; identical to SEQ ID NO: 11112
  CDS (1)..(1425)

SEQ ID NO: 33344 - protein, 474 aa, Pseudomonas syringae pv; identical to SEQ ID NO: 11113

SEQ ID NO: 33345 - DNA, 1437 bp, Pseudomonas putida; identical to SEQ ID NO: 11114
  CDS (1)..(1437)

SEQ ID NO: 33346 - protein, 478 aa, Pseudomonas putida; identical to SEQ ID NO: 11115

SEQ ID NO: 33347 - DNA, 1401 bp, Lactobacillus plantarum WCFS1; identical to SEQ ID NO: 11116
  CDS (1)..(1401)

SEQ ID NO: 33348 - protein, 466 aa, Lactobacillus plantarum WCFS1; identical to SEQ ID NO: 11117

SEQ ID NO: 33349 - DNA, 1413 bp, Clostridium tetani E88; identical to SEQ ID NO: 11118
  CDS (1)..(1413)

SEQ ID NO: 33350 - protein, 470 aa, Clostridium tetani E88; identical to SEQ ID NO: 11119

SEQ ID NO: 33351 - DNA, 1461 bp, Bacteroides thetaiotaomicron VPI; identical to SEQ ID NO: 11120
  CDS (1)..(1461)

SEQ ID NO: 33352 - protein, 486 aa, Bacteroides thetaiotaomicron VPI; identical to SEQ ID NO: 11121

SEQ ID NO: 33353 - DNA, 1440 bp, Wigglesworthia glossinidia brevipalpis; identical to SEQ ID NO: 11122
  CDS (1)..(1440)

SEQ ID NO: 33354 - protein, 479 aa, Wigglesworthia glossinidia brevipalpis; identical to SEQ ID NO: 11123

SEQ ID NO: 33355 - DNA, 1617 bp, Corynebacterium efficiens YS; identical to SEQ ID NO: 11124
  CDS (1)..(1617)

SEQ ID NO: 33356 - protein, 538 aa, Corynebacterium efficiens YS; identical to SEQ ID NO: 11125

SEQ ID NO: 33357 - DNA, 1473 bp, Bifidobacterium longum; identical to SEQ ID NO: 11126
  CDS (1)..(1473)

SEQ ID NO: 33358 - protein, 490 aa, Bifidobacterium longum; identical to SEQ ID NO: 11127

SEQ ID NO: 33359 - DNA, 1410 bp, Cytophaga sp; identical to SEQ ID NO: 11128
  CDS (1)..(1410)

SEQ ID NO: 33360 - protein, 469 aa, Cytophaga sp; identical to SEQ ID NO: 11129

SEQ ID NO: 33361 - DNA, 1386 bp, Thermoanaerobacter tengcongensis; identical to SEQ ID NO: 11130
  CDS (1)..(1386)

SEQ ID NO: 33362 - protein, 461 aa, Thermoanaerobacter tengcongensis; identical to SEQ ID NO: 11131

SEQ ID NO: 33363 - DNA, 1419 bp, Pasteurella multocida; identical to SEQ ID NO: 11132
  CDS (1)..(1419)

SEQ ID NO: 33364 - protein, 472 aa, Pasteurella multocida; identical to SEQ ID NO: 11133

SEQ ID NO: 33365 - DNA, 1374 bp, Thermoplasma acidophilum; identical to SEQ ID NO: 11134
  CDS (1)..(1374)

SEQ ID NO: 33366 - protein, 457 aa, Thermoplasma acidophilum; identical to SEQ ID NO: 11135

SEQ ID NO: 33367 - DNA, 2106 bp, Bacillus sp; identical to SEQ ID NO: 11136
  CDS (349)..(1755)

SEQ ID NO: 33368 - protein, 468 aa, Bacillus sp; identical to SEQ ID NO: 11137

SEQ ID NO: 33369 - DNA, 1428 bp, Rhizobium etli; identical to SEQ ID NO: 11138
  CDS (1)..(1428)

SEQ ID NO: 33370 - protein, 475 aa, Rhizobium etli; identical to SEQ ID NO: 11139

SEQ ID NO: 33371 - DNA, 1581 bp, Corynebacterium glutamicum; identical to SEQ ID NO: 11140
  CDS (1)..(1581)

SEQ ID NO: 33372 - protein, 526 aa, Corynebacterium glutamicum; identical to SEQ ID NO: 11141

SEQ ID NO: 33373 - DNA, 26 bp, Artificial sequence
  (1)..(26): primer
atgtgtttaaagcaaatcattggcag

SEQ ID NO: 33374 - DNA, 25 bp, Artificial sequence
  (1)..(25): primer
ttactgttcgctttcatcagtatag

SEQ ID NO: 33375 - protein, 465 aa, Artificial sequence
  Variant (2)..(2): xaa in position 2 is any amino acid
  Variant (4)..(4): xaa in position 4 is any amino acid
  Variant (6)..(7): xaa in position 6 to 7 is any amino acid
  Variant (9)..(12): xaa in position 9 to 12 is any amino acid
  Variant (14)..(16): xaa in position 14 to 16 is any amino acid
  Variant (18)..(18): xaa in position 18 is any amino acid
  Variant (20)..(21): xaa in position 20 to 21 is any amino acid
  Variant (23)..(23): xaa in position 23 is any amino acid
  Variant (26)..(27): xaa in position 26 to 27 is any amino acid
  Variant (30)..(30): xaa in position 30 is any amino acid
  Variant (32)..(49): xaa in position 32 to 49 is any amino acid
  Variant (51)..(51): xaa in position 51 is any amino acid
  Variant (53)..(53): xaa in position 53 is any amino acid
  Variant (55)..(56): xaa in position 55 to 56 is any amino acid
  Variant (58)..(70): xaa in position 58 to 70 is any amino acid
  Variant (72)..(73): xaa in position 72 to 73 is any amino acid
  Variant (75)..(88): xaa in position 75 to 88 is any amino acid
  Variant (90)..(91): xaa in position 90 to 91 is any amino acid
  Variant (93)..(94): xaa in position 93 to 94 is any amino acid
  Variant (102)..(102): xaa in position 102 is any amino acid
  Variant (106)..(106): xaa in position 106 is any amino acid
  Variant (110)..(110): xaa in position 110 is any amino acid
  Variant (113)..(113): xaa in position 113 is any amino acid
  Variant (115)..(115): xaa in position 115 is any amino acid
  Variant (117)..(118): xaa in position 117 to 118 is any amino acid
  Variant (120)..(122): xaa in position 120 to 122 is any amino acid
  Variant (124)..(124): xaa in position 124 is any amino acid
  Variant (126)..(129): xaa in position 126 to 129 is any amino acid
  Variant (132)..(133): xaa in position 132 to 133 is any amino acid
  Variant (136)..(137): xaa in position 136 to 137 is any amino acid
  Variant (143)..(144): xaa in position 143 to 144 is any amino acid
  Variant (147)..(159): xaa in position 147 to 159 is any amino acid
  Variant (161)..(166): xaa in position 161 to 166 is any amino acid
  Variant (168)..(173): xaa in position 168 to 173 is any amino acid
  Variant (175)..(176): xaa in position 175 to 176 is any amino acid
  Variant (179)..(182): xaa in position 179 to 182 is any amino acid
  Variant (184)..(184): xaa in position 184 is any amino acid
  Variant (188)..(188): xaa in position 188 is any amino acid
  Variant (195)..(197): xaa in position 195 to 197 is any amino acid
  Variant (202)..(226): xaa in position 202 to 226 is any amino acid
  Variant (228)..(228): xaa in position 228 is any amino acid
  Variant (230)..(230): xaa in position 230 is any amino acid
  Variant (233)..(233): xaa in position 233 is any amino acid
  Variant (237)..(237): xaa in position 237 is any amino acid
  Variant (239)..(242): xaa in position 239 to 242 is any amino acid
  Variant (244)..(250): xaa in position 244 to 250 is any amino acid
  Variant (252)..(261): xaa in position 252 to 261 is any amino acid
  Variant (263)..(264): xaa in position 263 to 264 is any amino acid
  Variant (266)..(267): xaa in position 266 to 267 is any amino acid
  Variant (270)..(281): xaa in position 270 to 281 is any amino acid
  Variant (284)..(285): xaa in position 284 to 285 is any amino acid
  Variant (287)..(290): xaa in position 287 to 290 is any amino acid
  Variant (292)..(293): xaa in position 292 to 293 is any amino acid
  Variant (300)..(300): xaa in position 300 is any amino acid
  Variant (305)..(305): xaa in position 305 is any amino acid
  Variant (307)..(308): xaa in position 307 to 308 is any amino acid
  Variant (310)..(311): xaa in position 310 to 311 is any amino acid
  Variant (314)..(315): xaa in position 314 to 315 is any amino acid
  Variant (317)..(317): xaa in position 317 is any amino acid
  Variant (324)..(324): xaa in position 324 is any amino acid
  Variant (330)..(331): xaa in position 330 to 331 is any amino acid
  Variant (333)..(334): xaa in position 333 to 334 is any amino acid
  Variant (337)..(340): xaa in position 337 to 340 is any amino acid
  Variant (342)..(342): xaa in position 342 is any amino acid
  Variant (346)..(350): xaa in position 346 to 350 is any amino acid
  Variant (352)..(354): xaa in position 352 to 354 is any amino acid
  Variant (358)..(358): xaa in position 358 is any amino acid
  Variant (361)..(363): xaa in position 361 to 363 is any amino acid
  Variant (365)..(372): xaa in position 365 to 372 is any amino acid
  Variant (374)..(387): xaa in position 374 to 387 is any amino acid
  Variant (389)..(390): xaa in position 389 to 390 is any amino acid
  Variant (393)..(394): xaa in position 393 to 394 is any amino acid
  Variant (396)..(405): xaa in position 396 to 405 is any amino acid
  Variant (407)..(410): xaa in position 407 to 410 is any amino acid
  Variant (412)..(412): xaa in position 412 is any amino acid
  Variant (416)..(417): xaa in position 416 to 417 is any amino acid
  Variant (419)..(432): xaa in position 419 to 432 is any amino acid
  Variant (434)..(447): xaa in position 434 to 447 is any amino acid
  Variant (449)..(464): xaa in position 449 to 464 is any amino acid
RXEXDXXGXXXXPXXXYXGXXTXRAXXNFXIXXXXXXXXXXXXXXXXXXKXAXAXXNXXXXXXXXXXXXXIXXAXXXXXXXXXXXXXXFXXDXXQGGAGTSXNMNXNEVXANXAXEXXGXXXGXYXXXXPNXXVNXXQSTNDXXPTXXXXXXXXXXXXXLXXXXXXLXXXXXXKXXEFXXXXKXGRTXLQDAVPXXXGQEFXXXXXXXXXXXXXXXXXXXXXXXXXNXGXTAXGTGXNXXXXYXXXXXXXLXXXXXXXXXXAXXLXXATXXXXXXXXXXXXLKXXAXXXXKXXNDLRLLXSGPRXGXXEXXLPXXQXGSSIMPXKVNPVXXEXXNQXXXXVXGNDXXXXXAXXXGQLXLNXXXPXXXXXXXXSXXXXXXXXXXXXXXCXXGIXXNXXXXXXXXXXSXXXXTXLNPXXGXXXXXXXXXXXXXXGXXXXXXXXXXXXXXLXXXXXXXXXXXXXXXXP

SEQ ID NO: 33376 - protein, 50 aa, Artificial sequence; identical to SEQ ID NO: 13505
  Variant (2)..(2): xaa in position 2 is any amino acid
  Variant (4)..(4): xaa in position 4 is any amino acid
  Variant (6)..(6): xaa in position 6 is any amino acid
  Variant (7)..(7): xaa in position 7 is Leu, Ile, Phe, Met or Val
  Variant (9)..(11): xaa in position 9 to 11 is any amino acid
  Variant (12)..(12): xaa in position 12 is Val, Ile or Leu
  Variant (13)..(13): xaa in position 13 is Pro, Ser, Glu or Ala
  Variant (14)..(16): xaa in position 14 to 16 is any amino acid
  Variant (17)..(17): xaa in position 17 is Tyr, Leu or Phe
  Variant (18)..(18): xaa in position 18 is Tyr, Trp, Phe or His
  Variant (20)..(20): xaa in position 20 is Ile, Val or Ala
  Variant (21)..(21): xaa in position 21 is Gln, His or Asn
  Variant (22)..(22): xaa in position 22 is Thr or Ser
  Variant (23)..(23): xaa in position 23 is any amino acid
  Variant (25)..(25): xaa in position 25 is Ala, Ser or Gly
  Variant (26)..(27): xaa in position 26 to 27 is any amino acid
  Variant (29)..(29): xaa in position 29 is Phe, Tyr or Val
  Variant (30)..(30): xaa in position 30 is any amino acid
  Variant (31)..(31): xaa in position 31 is Ile, Leu or Val
  Variant (32)..(32): xaa in position 32 is Ser, Thr or Gly
  Variant (33)..(40): xaa in position 33 to 40 is any amino acid
  Variant (41)..(42): xaa in position 41 to 42 is any or no amino acid
  Variant (43)..(43): xaa in position 43 is Ile, Val or Met
  Variant (44)..(44): xaa in position 44 is any amino acid
  Variant (45)..(45): xaa in position 45 is Ala, Gly or Ser
  Variant (46)..(48): xaa in position 46 to 48 is any amino acid
  Variant (49)..(49): xaa in position 49 is Val, Thr, Ile or Leu

SEQ ID NO: 33377 - protein, 57 aa, Artificial sequence; identical to SEQ ID NO: 13506
  Variant (1)..(1): xaa in position 1 is Gln or Ser
  Variant (2)..(2): xaa in position 2 is Gly, Thr or Ala
  Variant (4)..(4): xaa in position 4 is Ala or Ser
  Variant (7)..(7): xaa in position 7 is Ser, Gln or Thr
  Variant (8)..(8): xaa in position 8 is any amino acid
  Variant (9)..(9): xaa in position 9 is Asn or His
  Variant (12)..(12): xaa in position 12 is any amino acid
  Variant (16)..(16): xaa in position 16 is Ile, Leu or Val
  Variant (17)..(17): xaa in position 17 is Ala, Ser, Thr or Gly
  Variant (19)..(19): xaa in position 19 is Arg, Ile, Leu or Val
  Variant (20)..(20): xaa in position 20 is Ala, Gly or Leu
  Variant (21)..(21): xaa in position 21 is any amino acid
  Variant (22)..(22): xaa in position 22 is Glu, Ile, Gln, Thr or Arg
  Variant (23)..(23): xaa in position 23 is any amino acid
  Variant (24)..(24): xaa in position 24 is Leu, Met, Arg, Ala or Ile
  Variant (25)..(25): xaa in position 25 is Gly, Asn or Pro
  Variant (26)..(27): xaa in position 26 to 27 is any or no amino acid
  Variant (28)..(28): xaa in position 28 is Lys, Arg, Ala or Pro
  Variant (29)..(29): xaa in position 29 is Gly or Val
  Variant (30)..(30): xaa in position 30 is any amino acid
  Variant (31)..(31): xaa in position 31 is Tyr, Phe or no amino acid
  Variant (32)..(33): xaa in position 32 to 33 is any or no amino acid
  Variant (34)..(34): xaa in position 34 is Leu, Val, Ile or Cys
  Variant (35)..(35): xaa in position 35 is His, Asn, Ser or Asp
  Variant (37)..(37): xaa in position 37 is Asn, Met, Ile or Leu
  Variant (38)..(38): xaa in position 38 is any amino acid
  Variant (39)..(39): xaa in position 39 is His or Asp
  Variant (40)..(40): xaa in position 40 is Val or Leu
  Variant (42)..(42): xaa in position 42 is any amino acid
  Variant (43)..(43): xaa in position 43 is Ser, Ala, Cys, Gly or His
  Variant (46)..(46): xaa in position 46 is Thr, Ser or Gln
  Variant (48)..(48): xaa in position 48 is Asp or Cys
  Variant (49)..(49): xaa in position 49 is Ala, Val, Thr or Ser
  Variant (50)..(50): xaa in position 50 is Tyr, Phe or Ile
  Variant (51)..(51): xaa in position 51 is Pro or Ser
  Variant (52)..(52): xaa in position 52 is Thr, Ser or Ala
  Variant (53)..(53): xaa in position 53 is Ala, Gly, Val, Ser or Met
  Variant (54)..(54): xaa in position 54 is any amino acid
  Variant (55)..(55): xaa in position 55 is Arg, His, Lys or Asn
  Variant (56)..(56): xaa in position 56 is Ile, Leu, Val or Met
  Variant (57)..(57): xaa in position 57 is Ala, Gly, Ser or Thr

SEQ ID NO: 33378 - protein, 56 aa, Artificial sequence; identical to SEQ ID NO: 13507
  Variant (1)..(1): xaa in position 1 is Leu, Ile or Val
  Variant (2)..(2): xaa in position 2 is Lys or Arg
  Variant (3)..(3): xaa in position 3 is any amino acid
  Variant (4)..(4): xaa in position 4 is Gly or Ala
  Variant (7)..(7): xaa in position 7 is Gln or His
  Variant (8)..(8): xaa in position 8 is Leu, Thr or Met
  Variant (9)..(9): xaa in position 9 is Gln, Glu or Met
  Variant (11)..(11): xaa in position 11 is Ala or Gly
  Variant (12)..(12): xaa in position 12 is Val, Thr, Leu, Ala or Pro
  Variant (14)..(14): xaa in position 14 is Met, Ile, Leu or Val
  Variant (15)..(15): xaa in position 15 is Thr, Arg, Ser, Met or Leu
  Variant (16)..(16): xaa in position 16 is Leu, Val, Met, Phe or Tyr
  Variant (18)..(18): xaa in position 18 is any amino acid
  Variant (19)..(19): xaa in position 19 is Glu or Thr
  Variant (21)..(21): xaa in position 21 is any amino acid
  Variant (22)..(22): xaa in position 22 is Ala, Gly, Thr or Ser
  Variant (23)..(23): xaa in position 23 is Phe, Tyr or Trp
  Variant (24)..(26): xaa in position 24 to 26 is any amino acid
  Variant (27)..(27): xaa in position 27 is Leu, Val, Ile, Met or Phe
  Variant (28)..(29): xaa in position 28 to 29 is any amino acid
  Variant (30)..(30): xaa in position 30 is Asp, Glu, Gly, His or Asn
  Variant (31)..(33): xaa in position 31 to 33 is any amino acid
  Variant (34)..(34): xaa in position 34 is Leu, Ile, Val or Phe
  Variant (35)..(38): xaa in position 35 to 38 is any amino acid
  Variant (39)..(39): xaa in position 39 is Pro or no amino acid
  Variant (40)..(41): xaa in position 40 to 41 is any amino acid
  Variant (42)..(42): xaa in position 42 is Leu, Ile, Met, Val or Phe
  Variant (43)..(44): xaa in position 43 to 44 is any amino acid
  Variant (45)..(45): xaa in position 45 is Val, Ile, Leu or Met
  Variant (46)..(46): xaa in position 46 is Asn, Ala, Gly or Ser
  Variant (47)..(47): xaa in position 47 is Leu, Met, Ile or Gln
  Variant (49)..(49): xaa in position 49 is Ala or Gly
  Variant (50)..(50): xaa in position 50 is Thr or Ser
  Variant (51)..(51): xaa in position 51 is Ala or Val
  Variant (52)..(52): xaa in position 52 is Ile, Val or Ala
  Variant (55)..(55): xaa in position 55 is Gly, Arg, Ala, Ser or Lys
  Variant (56)..(56): xaa in position 56 is Leu, Ile, Val or Met

SEQ ID NO: 33379 - protein, 105 aa, Artificial sequence; identical to SEQ ID NO: 13508
  Variant (1)..(1): xaa in position 1 is Lys or Arg
  Variant (2)..(2): xaa in position 2 is any amino acid
  Variant (3)..(3): xaa in position 3 is Cys, Ala, Ser or Gly
  Variant (4)..(4): xaa in position 4 is Asn, Ser, His, Asp or Gly
  Variant (6)..(6): xaa in position 6 is Leu or Ile
  Variant (8)..(8): xaa in position 8 is Leu, Phe or Ile
  Variant (9)..(9): xaa in position 9 is Leu or Met
  Variant (10)..(10): xaa in position 10 is any amino acid
  Variant (14)..(15): xaa in position 14 to 15 is any amino acid
  Variant (16)..(16): xaa in position 16 is Gly or Val
  Variant (17)..(17): xaa in position 17 is Leu, Ile or Phe
  Variant (18)..(18): xaa in position 18 is any amino acid
  Variant (19)..(19): xaa in position 19 is Glu or Asp
  Variant (20)..(20): xaa in position 20 is Ile, Leu, Phe or Val
  Variant (21)..(21): xaa in position 21 is any amino acid
  Variant (22)..(22): xaa in position 22 is Leu, Val or Ile
  Variant (23)..(23): xaa in position 23 is Pro or Glu
  Variant (24)..(25): xaa in position 24 to 25 is any amino acid
  Variant (26)..(26): xaa in position 26 is Gln, Glu or Ala
  Variant (27)..(27): xaa in position 27 is Pro, Ala, Asn or Gln
  Variant (34)..(34): xaa in position 34 is Gly or Ala
  Variant (36)..(36): xaa in position 36 is Val, Ile or Tyr
  Variant (39)..(39): xaa in position 39 is Val, Thr or Ser
  Variant (40)..(40): xaa in position 40 is Ile, Met, Val, Gln or Leu
  Variant (41)..(41): xaa in position 41 is Pro, Cys, Ala or Ser
  Variant (43)..(43): xaa in position 43 is any amino acid
  Variant (44)..(44): xaa in position 44 is Val, Ile, Leu, Met or Thr
  Variant (45)..(45): xaa in position 45 is any amino acid
  Variant (46)..(46): xaa in position 46 is Gln, Met, Thr or Leu
  Variant (47)..(47): xaa in position 47 is Val, Ile, Thr, Ala or Cys
  Variant (48)..(48): xaa in position 48 is Cys, Ala or Ser
  Variant (49)..(49): xaa in position 49 is Phe, Tyr, Ala, His or Met
  Variant (50)..(50): xaa in position 50 is any amino acid
  Variant (51)..(51): xaa in position 51 is Val, Ile or Ala
  Variant (52)..(52): xaa in position 52 is any amino acid
  Variant (53)..(53): xaa in position 53 is Gly, Ala or Ser
  Variant (54)..(54): xaa in position 54 is any amino acid
  Variant (55)..(55): xaa in position 55 is Asp, His, Gln or Asn
  Variant (56)..(56): xaa in position 56 is any amino acid
  Variant (57)..(57): xaa in position 57 is Thr, Ala, Cys, Ser or Ile
  Variant (58)..(58): xaa in position 58 is Val, Ile or Leu
  Variant (59)..(60): xaa in position 59 to 60 is any amino acid
  Variant (61)..(61): xaa in position 61 is Ala, Gly or Ser
  Variant (62)..(62): xaa in position 62 is Ala, Ser, Gly, Val or Cys
  Variant (63)..(63): xaa in position 63 is Glu, Ser, Gln, Ala or Asp
  Variant (64)..(64): xaa in position 64 is any amino acid
  Variant (65)..(65): xaa in position 65 is Gly or Ala
  Variant (66)..(66): xaa in position 66 is Gln, His or Asn
  Variant (67)..(67): xaa in position 67 is Leu, Phe or Met
  Variant (68)..(68): xaa in position 68 is Gln or Glu
  Variant (71)..(71): xaa in position 71 is Val, Ala or Gln
  Variant (72)..(72): xaa in position 72 is Met or Phe
  Variant (73)..(73): xaa in position 73 is any amino acid
  Variant (75)..(75): xaa in position 75 is any amino acid
  Variant (76)..(76): xaa in position 76 is Ile, Leu, Met, Thr or Val
  Variant (77)..(79): xaa in position 77 to 79 is any amino acid
  Variant (80)..(80): xaa in position 80 is Leu, Met, Ile or Cys
  Variant (81)..(82): xaa in position 81 to 82 is any amino acid
  Variant (83)..(83): xaa in position 83 is Ser, Gly or Thr
  Variant (84)..(86): xaa in position 84 to 86 is any amino acid
  Variant (87)..(87): xaa in position 87 is Leu, Met or Ile
  Variant (88)..(89): xaa in position 88 to 89 is any amino acid
  Variant (90)..(90): xaa in position 90 is Ala, Gly, Thr or Val
  Variant (91)..(93): xaa in position 91 to 93 is any amino acid
  Variant (94)..(94): xaa in position 94 is Leu or Phe
  Variant (95)..(96): xaa in position 95 to 96 is any amino acid
  Variant (97)..(97): xaa in position 97 is any or no amino acid
  Variant (98)..(98): xaa in position 98 is Cys, Ala, Tyr or Leu
  Variant (99)..(99): xaa in position 99 is Ile, Val or Leu
  Variant (100)..(101): xaa in position 100 to 101 is any amino acid
  Variant (102)..(102): xaa in position 102 is Ile, Leu, Met or Val
  Variant (103)..(103): xaa in position 103 is any amino acid
  Variant (104)..(104): xaa in position 104 is Ala, Val, Ile, Pro or Gly
  Variant (105)..(105): xaa in position 105 is Asn, Asp or Gln

SEQ ID NO: 33380 - DNA, 1791 bp, Saccharomyces cerevisiae; identical to SEQ ID NO: 7248
  CDS (2)..(1504)

SEQ ID NO: 33381 - protein, 500 aa, Saccharomyces cerevisiae; identical to SEQ ID NO: 7249

SEQ ID NO: 33382 - DNA, 1461 bp, Vibrio cholerae; identical to SEQ ID NO: 7250
  CDS (1)..(1461)

SEQ ID NO: 33383 - protein, 486 aa, Vibrio cholerae; identical to SEQ ID NO: 7251

SEQ ID NO: 33384 - DNA, 1455 bp, Chlamydophila pneumoniae, Chlamydia pneumoniae; identical to SEQ ID NO: 7252
  CDS (1)..(1455)

SEQ ID NO: 33385 - protein, 484 aa, Chlamydophila pneumoniae, Chlamydia pneumoniae; identical to SEQ ID NO: 7253

SEQ ID NO: 33386 - DNA, 1419 bp, Clostridium acetobutylicum; identical to SEQ ID NO: 7254
  CDS (1)..(1419)

SEQ ID NO: 33387 - protein, 472 aa, Clostridium acetobutylicum; identical to SEQ ID NO: 7255

SEQ ID NO: 33388 - DNA, 1413 bp, Yersinia pestis; identical to SEQ ID NO: 7256
  CDS (1)..(1413)

SEQ ID NO: 33389 - protein, 470 aa, Yersinia pestis; identical to SEQ ID NO: 7257

SEQ ID NO: 33390 - DNA, 1413 bp, Salmonella enterica subsp. enterica serovar Typhi; identical to SEQ ID NO: 7258
  CDS (1)..(1413)

SEQ ID NO: 33391 - protein, 470 aa, Salmonella enterica subsp. enterica serovar Typhi; identical to SEQ ID NO: 7259

SEQ ID NO: 33392 - DNA, 1758 bp, Listeria innocua; identical to SEQ ID NO: 7260
  CDS (1)..(1758)

SEQ ID NO: 33393 - protein, 585 aa, Listeria innocua; identical to SEQ ID NO: 7261

SEQ ID NO: 33394 - DNA, 1431 bp, Nostoc sp. PCC 7120; identical to SEQ ID NO: 7262
  CDS (1)..(1431)

SEQ ID NO: 33395 - protein, 476 aa, Nostoc sp. PCC 7120; identical to SEQ ID NO: 7263

SEQ ID NO: 33396 - DNA, 1440 bp, Agrobacterium tumefaciens; identical to SEQ ID NO: 7264
  CDS (1)..(1440)

SEQ ID NO: 33397 - protein, 479 aa, Agrobacterium tumefaciens; identical to SEQ ID NO: 7265

SEQ ID NO: 33398 - DNA, 1770 bp, Nostoc sp. PCC 7120; identical to SEQ ID NO: 7266
  CDS (1)..(1770)

SEQ ID NO: 33399 - protein, 589 aa, Nostoc sp. PCC 7120; identical to SEQ ID NO: 7267

SEQ ID NO: 33400 - DNA, 1401 bp, Thermotoga maritima; identical to SEQ ID NO: 7268
  CDS (1)..(1401)

SEQ ID NO: 33401 - protein, 466 aa, Thermotoga maritima; identical to SEQ ID NO: 7269

SEQ ID NO: 33402 - DNA, 1377 bp, Aeropyrum pernix; identical to SEQ ID NO: 7270
  CDS (1)..(1377)

SEQ ID NO: 33403 - protein, 458 aa, Aeropyrum pernix; identical to SEQ ID NO: 7271

SEQ ID NO: 33404 - DNA, 1449 bp, Deinococcus radiodurans; identical to SEQ ID NO: 7272
  CDS (1)..(1449)

SEQ ID NO: 33405 - protein, 482 aa, Deinococcus radiodurans; identical to SEQ ID NO: 7273

SEQ ID NO: 33406 - DNA, 1446 bp, Vibrio cholerae; identical to SEQ ID NO: 7274
  CDS (1)..(1446)

SEQ ID NO: 33407 - protein, 481 aa, Vibrio cholerae; identical to SEQ ID NO: 7275

SEQ ID NO: 33408 - DNA, 1740 bp, Halobacterium sp. NRC-1; identical to SEQ ID NO: 7276
  CDS (1)..(1740)

SEQ ID NO: 33409 - protein, 579 aa, Halobacterium sp. NRC-1; identical to SEQ ID NO: 7277

SEQ ID NO: 33410 - DNA, 1437 bp, Haemophilus influenzae; identical to SEQ ID NO: 7278
  CDS (1)..(1437)

SEQ ID NO: 33411 - protein, 478 aa, Haemophilus influenzae; identical to SEQ ID NO: 7279

SEQ ID NO: 33412 - DNA, 1434 bp, Borrelia burgdorferi (Lyme disease spirochete); identical to SEQ ID NO: 7280
  CDS (1)..(1434)

SEQ ID NO: 33413 - protein, 477 aa, Borrelia burgdorferi (Lyme disease spirochete); identical to SEQ ID NO: 7281

SEQ ID NO: 33414 - DNA, 1413 bp, Vibrio cholerae; identical to SEQ ID NO: 7282
  CDS (1)..(1413)

SEQ ID NO: 33415 - protein, 470 aa, Vibrio cholerae; identical to SEQ ID NO: 7283

SEQ ID NO: 33416 - DNA, 1755 bp, Bacillus halodurans; identical to SEQ ID NO: 7284
  CDS (1)..(1755)

SEQ ID NO: 33417 - protein, 584 aa, Bacillus halodurans; identical to SEQ ID NO: 7285

SEQ ID NO: 33418 - DNA, 1443 bp, Buchnera sp; identical to SEQ ID NO: 7286
  CDS (1)..(1443)

SEQ ID NO: 33419 - protein, 480 aa, Buchnera sp; identical to SEQ ID NO: 7287

SEQ ID NO: 33420 - DNA, 1344 bp, Methanococcus jannaschii; identical to SEQ ID NO: 7288
  CDS (1)..(1344)

SEQ ID NO: 33421 - protein, 447 aa, Methanococcus jannaschii; identical to SEQ ID NO: 7289

SEQ ID NO: 33422 - DNA, 1413 bp, Escherichia coli; identical to SEQ ID NO: 7290
  CDS (1)..(1413)

SEQ ID NO: 33423 - protein, 470 aa, Escherichia coli; identical to SEQ ID NO: 7291

SEQ ID NO: 33424 - DNA, 1434 bp, Pseudomonas aeruginosa; identical to SEQ ID NO: 7292
  CDS (1)..(1434)

SEQ ID NO: 33425 - protein, 477 aa, Pseudomonas aeruginosa; identical to SEQ ID NO: 7293

SEQ ID NO: 33426 - DNA, 1509 bp, Lactococcus lactis subsp. lactis; identical to SEQ ID NO: 7294
  CDS (1)..(1509)

SEQ ID NO: 33427 - protein, 502 aa, Lactococcus lactis subsp. lactis; identical to SEQ ID NO: 7295

SEQ ID NO: 33428 - DNA, 1431 bp, Caulobacter crescentus; identical to SEQ ID NO: 7296
  CDS (1)..(1431)

SEQ ID NO: 33429 - protein, 476 aa, Caulobacter crescentus; identical to SEQ ID NO: 7297

SEQ ID NO: 33430 - DNA, 1452 bp, Pseudomonas aeruginosa; identical to SEQ ID NO: 7298
  CDS (1)..(1452)

SEQ ID NO: 33431 - protein, 483 aa, Pseudomonas aeruginosa; identical to SEQ ID NO: 7299

SEQ ID NO: 33432 - DNA, 1437 bp, Pyrococcus horikoshii; identical to SEQ ID NO: 7300
  CDS (1)..(1437)

SEQ ID NO: 33433 - protein, 478 aa, Pyrococcus horikoshii; identical to SEQ ID NO: 7301

SEQ ID NO: 33434 - DNA, 1443 bp, Campylobacter jejuni; identical to SEQ ID NO: 7302
  CDS (1)..(1443)

SEQ ID NO: 33435 - protein, 480 aa, Campylobacter jejuni; identical to SEQ ID NO: 7303

SEQ ID NO: 33436 - DNA, 1446 bp, Chlamydia muridarum, Chlamydia trachomatis MoPn; identical to SEQ ID NO: 7304
  CDS (1)..(1446)

SEQ ID NO: 33437 - protein, 481 aa, Chlamydia muridarum, Chlamydia trachomatis MoPn; identical to SEQ ID NO: 7305

SEQ ID NO: 33438 - DNA, 1704 bp, Arabidopsis thaliana (mouse-ear cress); identical to SEQ ID NO: 7306
  CDS (1)..(1704)

SEQ ID NO: 33439 - protein, 567 aa, Arabidopsis thaliana (mouse-ear cress); identical to SEQ ID NO: 7307

SEQ ID NO: 33440 - DNA, 1758 bp, Staphylococcus aureus; identical to SEQ ID NO: 7308
  CDS (1)..(1758)

SEQ ID NO: 33441 - protein, 585 aa, Staphylococcus aureus; identical to SEQ ID NO: 7309

SEQ ID NO: 33442 - DNA, 1758 bp, Bacillus subtilis; identical to SEQ ID NO: 7310
  CDS (1)..(1758)

SEQ ID NO: 33443 - protein, 585 aa, Bacillus subtilis; identical to SEQ ID NO: 7311

SEQ ID NO: 33444 - DNA, 1419 bp, Mycobacterium tuberculosis; identical to SEQ ID NO: 7312
  CDS (1)..(1419)

SEQ ID NO: 33445 - protein, 472 aa, Mycobacterium tuberculosis; identical to SEQ ID NO: 7313

SEQ ID NO: 33446 - DNA, 1458 bp, Chlamydia trachomatis; identical to SEQ ID NO: 7314
  CDS (1)..(1458)

SEQ ID NO: 33447 - protein, 485 aa, Chlamydia trachomatis; identical to SEQ ID NO: 7315

SEQ ID NO: 33448 - DNA, 1437 bp, Pyrococcus abyssi; identical to SEQ ID NO: 7316
  CDS (1)..(1437)

SEQ ID NO: 33449 - protein, 478 aa, Pyrococcus abyssi; identical to SEQ ID NO: 7317

SEQ ID NO: 33450 - DNA, 1473 bp, Neisseria meningitidis; identical to SEQ ID NO: 7318
  CDS (1)..(1473)

SEQ ID NO: 33451 - protein, 490 aa, Neisseria meningitidis; identical to SEQ ID NO: 7319

SEQ ID NO: 33452 - DNA, 1506 bp, Streptococcus pneumoniae; identical to SEQ ID NO: 7320
  CDS (1)..(1506)

SEQ ID NO: 33453 - protein, 501 aa, Streptococcus pneumoniae; identical to SEQ ID NO: 7321

SEQ ID NO: 33454 - DNA, 1422 bp, Clostridium acetobutylicum; identical to SEQ ID NO: 7322
  CDS (1)..(1422)

SEQ ID NO: 33455 - protein, 473 aa, Clostridium acetobutylicum; identical to SEQ ID NO: 7323

SEQ ID NO: 33456 - DNA, 1359 bp, Sulfolobus solfataricus; identical to SEQ ID NO: 7324
  CDS (1)..(1359)

SEQ ID NO: 33457 - protein, 452 aa, Sulfolobus solfataricus; identical to SEQ ID NO: 7325

SEQ ID NO: 33458 - DNA, 1428 bp, Mycoplasma pulmonis; identical to SEQ ID NO: 7326
  CDS (1)..(1428): transl_table=4

SEQ ID NO: 33459 - protein, 475 aa, Mycoplasma pulmonis; identical to SEQ ID NO: 7327

SEQ ID NO: 33460 - DNA, 1533 bp, Solanum tuberosum (potato); identical to SEQ ID NO: 7328
  CDS (1)..(1533)

SEQ ID NO: 33461 - protein, 510 aa, Solanum tuberosum (potato); identical to SEQ ID NO: 7329

SEQ ID NO: 33462 - DNA, 2083 bp, Bacillus psychrophilus; identical to SEQ ID NO: 7330
  CDS (271)..(2031)

SEQ ID NO: 33463 - protein, 586 aa, Bacillus psychrophilus; identical to SEQ ID NO: 7331

SEQ ID NO: 33464 - DNA, 2054 bp, Bacillus licheniformis; identical to SEQ ID NO: 7332
  CDS (132)..(1889)

SEQ ID NO: 33465 - protein, 585 aa, Bacillus licheniformis; identical to SEQ ID NO: 7333

SEQ ID NO: 33466 - DNA, 1617 bp, Trichoderma reesei; identical to SEQ ID NO: 7334
  CDS (1)..(1617)

SEQ ID NO: 33467 - protein, 538 aa, Trichoderma reesei; identical to SEQ ID NO: 7335

SEQ ID NO: 33468 - DNA, 1725 bp, Rattus norvegicus (Norway rat); identical to SEQ ID NO: 7336
  CDS (1)..(1725)

SEQ ID NO: 33469 - protein, 574 aa, Rattus norvegicus (Norway rat); identical to SEQ ID NO: 7337

SEQ ID NO: 33470 - DNA, 1596 bp, Trypanosoma brucei; identical to SEQ ID NO: 7338
  CDS (59)..(1558)

SEQ ID NO: 33471 - protein, 499 aa, Trypanosoma brucei; identical to SEQ ID NO: 7339

SEQ ID NO: 33472 - DNA, 1581 bp, Aspergillus niger; identical to SEQ ID NO: 7340
  CDS (1)..(1581)

SEQ ID NO: 33473 - protein, 526 aa, Aspergillus niger; identical to SEQ ID NO: 7341

SEQ ID NO: 33474 - DNA, 1636 bp, Bacillus stearothermophilus; identical to SEQ ID NO: 7342
  CDS (114)..(1598)

SEQ ID NO: 33475 - protein, 494 aa, Bacillus stearothermophilus; identical to SEQ ID NO: 7343

SEQ ID NO: 33476 - DNA, 1581 bp, Emericella nidulans, Aspergillus nidulans; identical to SEQ ID NO: 7344
  CDS (1)..(1581)

SEQ ID NO: 33477 - protein, 526 aa, Emericella nidulans, Aspergillus nidulans; identical to SEQ ID NO: 7345

SEQ ID NO: 33478 - DNA, 1847 bp, Nicotiana tabacum (common tobacco); identical to SEQ ID NO: 7346
  CDS (45)..(1571)

SEQ ID NO: 33479 - protein, 508 aa, Nicotiana tabacum (common tobacco); identical to SEQ ID NO: 7347

SEQ ID NO: 33480 - DNA, 2243 bp, Nicotiana tabacum (common tobacco); identical to SEQ ID NO: 7348
  CDS (318)..(2006)

SEQ ID NO: 33481 - protein, 562 aa, Nicotiana tabacum (common tobacco); identical to SEQ ID NO: 7349

SEQ ID NO: 33482 - DNA, 2044 bp, Xenopus sp. (clawed frog); identical to SEQ ID NO: 7350
  CDS (29)..(1612)

SEQ ID NO: 33483 - protein, 527 aa, Xenopus sp. (clawed frog); identical to SEQ ID NO: 7351

SEQ ID NO: 33484 - DNA, 2146 bp, Mus musculus (house mouse); identical to SEQ ID NO: 7352
  CDS (30)..(1625)

SEQ ID NO: 33485 - protein, 531 aa, Mus musculus (house mouse); identical to SEQ ID NO: 7353

SEQ ID NO: 33486 - DNA, 1596 bp, Homo sapiens (man); identical to SEQ ID NO: 7354
  CDS (1)..(1596)

SEQ ID NO: 33487 - protein, 531 aa, Homo sapiens (man) [sequence omitted]

SEQ ID NO: 33488 - DNA, 2113 bp, Saccharomyces cerevisiae; identical to SEQ ID NO: 7356
  CDS (437)..(1957)

SEQ ID NO: 33489 - protein, 506 aa, Saccharomyces cerevisiae; identical to SEQ ID NO: 7357

SEQ ID NO: 33490 - DNA, 1527 bp, Mycoplasma pneumoniae; identical to SEQ ID NO: 7358
  CDS (1)..(1527): transl_table=4

SEQ ID NO: 33491 - protein, 508 aa, Mycoplasma pneumoniae; identical to SEQ ID NO: 7359

SEQ ID NO: 33492 - DNA, 1452 bp, Synechocystis sp; identical to SEQ ID NO: 7360
  CDS (1)..(1452)

SEQ ID NO: 33493 - protein, 483 aa, Synechocystis sp; identical to SEQ ID NO: 7361

SEQ ID NO: 33494 - DNA, 1776 bp, Synechocystis sp; identical to SEQ ID NO: 7362
  CDS (1)..(1776)

SEQ ID NO: 33495 - protein, 591 aa, Synechocystis sp; identical to SEQ ID NO: 7363

SEQ ID NO: 33496 - DNA, 1494 bp, Arabidopsis thaliana (mouse-ear cress); identical to SEQ ID NO: 7364
  CDS (1)..(1494)

SEQ ID NO: 33497 - protein, 497 aa, Arabidopsis thaliana (mouse-ear cress); identical to SEQ ID NO: 7365

SEQ ID NO: 33498 - DNA, 2115 bp, Ricinus communis (castor bean); identical to SEQ ID NO: 7366
  CDS (118)..(1869)

SEQ ID NO: 33499 - protein, 583 aa, Ricinus communis (castor bean); identical to SEQ ID NO: 7367

SEQ ID NO: 33500 - DNA, 2022 bp, Ricinus communis (castor bean); identical to SEQ ID NO: 7368
  CDS (46)..(1527)

SEQ ID NO: 33501 - protein, 493 aa, Ricinus communis (castor bean); identical to SEQ ID NO: 7369

SEQ ID NO: 33502 - DNA, 1548 bp, Caenorhabditis elegans; identical to SEQ ID NO: 7370
  CDS (1)..(1548)

SEQ ID NO: 33503 - protein, 515 aa, Caenorhabditis elegans; identical to SEQ ID NO: 7371

SEQ ID NO: 33504 - DNA, 1437 bp, Streptomyces coelicolor; identical to SEQ ID NO: 7372
  CDS (1)..(1437)

SEQ ID NO: 33505 - protein, 478 aa, Streptomyces coelicolor; identical to SEQ ID NO: 7373

SEQ ID NO: 33506 - DNA, 1530 bp, Schizosaccharomyces pombe; identical to SEQ ID NO: 7374
  CDS (1)..(1530)

SEQ ID NO: 33507 - protein, 509 aa, Schizosaccharomyces pombe; identical to SEQ ID NO: 7375

SEQ ID NO: 33508 - DNA, 1584 bp, Arabidopsis thaliana (mouse-ear cress); identical to SEQ ID NO: 7376
  CDS (40)..(1584)

SEQ ID NO: 33509 - protein, 514 aa, Arabidopsis thaliana (mouse-ear cress); identical to SEQ ID NO: 7377

SEQ ID NO: 33510 - DNA, 1533 bp, Arabidopsis thaliana (mouse-ear cress); identical to SEQ ID NO: 7378
  CDS (1)..(1533)

SEQ ID NO: 33511 - protein, 510 aa, Arabidopsis thaliana (mouse-ear cress); identical to SEQ ID NO: 7379

SEQ ID NO: 33512 - DNA, 1479 bp, Arabidopsis thaliana (mouse-ear cress); identical to SEQ ID NO: 7380
  CDS (1)..(1479)

SEQ ID NO: 33513 - protein, 492 aa, Arabidopsis thaliana (mouse-ear cress); identical to SEQ ID NO: 7381

SEQ ID NO: 33514 - DNA, 1572 bp, synthetic construct; identical to SEQ ID NO: 7382
  CDS (1)..(1572)

SEQ ID NO: 33515 - protein, 523 aa, synthetic construct; identical to SEQ ID NO: 7383

SEQ ID NO: 33516 - DNA, 2795 bp, Corynebacterium glutamicum; identical to SEQ ID NO: 7384
  CDS (740)..(2173)

SEQ ID NO: 33517 - protein, 477 aa, Corynebacterium glutamicum; identical to SEQ ID NO: 7385

SEQ ID NO: 33518 - DNA, 2264 bp, Bacillus subtilis; identical to SEQ ID NO: 7386
  CDS (258)..(2012)

SEQ ID NO: 33519 - protein, 584 aa, Bacillus subtilis; identical to SEQ ID NO: 7387

SEQ ID NO: 33520 - DNA, 2569 bp, Zymomonas mobilis; identical to SEQ ID NO: 7388
  CDS (137)..(1564)

SEQ ID NO: 33521 - protein, 475 aa, Zymomonas mobilis; identical to SEQ ID NO: 7389

SEQ ID NO: 33522 - DNA, 1701 bp, Homo sapiens; identical to SEQ ID NO: 7390
  CDS (1)..(1701)

SEQ ID NO: 33523 - protein, 566 aa, Homo sapiens; identical to SEQ ID NO: 7391

SEQ ID NO: 33524 - DNA, 1515 bp, Debaryomyces hansenii; identical to SEQ ID NO: 7392
  CDS (1)..(1515)

SEQ ID NO: 33525 - protein, 504 aa, Debaryomyces hansenii; identical to SEQ ID NO: 7393

SEQ ID NO: 33526 - DNA, 1443 bp, Erwinia carotovora subsp; identical to SEQ ID NO: 7394
  CDS (1)..(1443)

SEQ ID NO: 33527 - protein, 480 aa, Erwinia carotovora subsp; identical to SEQ ID NO: 7395

SEQ ID NO: 33528 - DNA, 1179 bp, Mycoplasma arthritidis; identical to SEQ ID NO: 7396
  CDS (1)..(1179): transl-table=4

SEQ ID NO: 33529 - protein, 392 aa, Mycoplasma arthritidis; identical to SEQ ID NO: 7397

SEQ ID NO: 33530 - DNA, 1437 bp, Mesoplasma florum L1; identical to SEQ ID NO: 7398
  CDS (1)..(1437): transl_table=4

SEQ ID NO: 33531 - protein, 478 aa, Mesoplasma florum L1; identical to SEQ ID NO: 7399

SEQ ID NO: 33532 - DNA, 1506 bp, Candida glabrata; identical to SEQ ID NO: 7400
  CDS (1)..(1506)

SEQ ID NO: 33533 - protein, 501 aa, Candida glabrata; identical to SEQ ID NO: 7401

SEQ ID NO: 33534 - DNA, 1527 bp, Candida glabrata; identical to SEQ ID NO: 7402
  CDS (1)..(1527)

SEQ ID NO: 33535 - protein, 508 aa, Candida glabrata; identical to SEQ ID NO: 7403

SEQ ID NO: 33536 - DNA, 1071 bp, Bacillus thuringiensis serovar konkukian str; identical to SEQ ID NO: 7404
  CDS (1)..(1071)

SEQ ID NO: 33537 - protein, 356 aa, Bacillus thuringiensis serovar konkukian str; identical to SEQ ID NO: 7405

SEQ ID NO: 33538 - DNA, 1960 bp, Zea mays; identical to SEQ ID NO: 7406
  CDS (144)..(1673)

SEQ ID NO: 33539 - protein, 509 aa, Zea mays; identical to SEQ ID NO: 7407

SEQ ID NO: 33540 - DNA, 1452 bp, Mycoplasma mobile; identical to SEQ ID NO: 7408
  CDS (1)..(1452)

SEQ ID NO: 33541 - protein, 483 aa, Mycoplasma mobile; identical to SEQ ID NO: 7409

SEQ ID NO: 33542 - DNA, 1668 bp, Picrophilus torridus; identical to SEQ ID NO: 7410
  CDS (1)..(1668)

SEQ ID NO: 33543 - protein, 555 aa, Picrophilus torridus; identical to SEQ ID NO: 7411

SEQ ID NO: 33544 - DNA, 1536 bp, Plasmodium falciparum; identical to SEQ ID NO: 7412
  CDS (1)..(1536)

SEQ ID NO: 33545 - protein, 511 aa, Plasmodium falciparum; identical to SEQ ID NO: 7413

SEQ ID NO: 33546 - DNA, 1458 bp, Photobacterium profundum; identical to SEQ ID NO: 7414
  CDS (1)..(1458)

SEQ ID NO: 33547 - protein, 485 aa, Photobacterium profundum; identical to SEQ ID NO: 7415

SEQ ID NO: 33548 - DNA, 1413 bp, Photobacterium profundum; identical to SEQ ID NO: 7416
  CDS (1)..(1413)

SEQ ID NO: 33549 - protein, 470 aa, Photobacterium profundum; identical to SEQ ID NO: 7417

SEQ ID NO: 33550 - DNA, 1344 bp, Methanococcus maripaludis; identical to SEQ ID NO: 7418
  CDS (1)..(1344)

SEQ ID NO: 33551 - protein, 447 aa, Methanococcus maripaludis; identical to SEQ ID NO: 7419

SEQ ID NO: 33552 - DNA, 1797 bp, Parachlamydia sp; identical to SEQ ID NO: 7420
  CDS (1)..(1797)

SEQ ID NO: 33553 - protein, 598 aa, Parachlamydia sp; identical to SEQ ID NO: 7421

SEQ ID NO: 33554 - DNA, 1488 bp, Bdellovibrio bacteriovorus; identical to SEQ ID NO: 7422
  CDS (1)..(1488)

SEQ ID NO: 33555 - protein, 495 aa, Bdellovibrio bacteriovorus; identical to SEQ ID NO: 7423

SEQ ID NO: 33556 - DNA, 1437 bp, Mycoplasma mycoides; identical to SEQ ID NO: 7424
  CDS (1)..(1437): transl_table=4

SEQ ID NO: 33557 - protein, 478 aa, Mycoplasma mycoides; identical to SEQ ID NO: 7425

SEQ ID NO: 33558 - DNA, 1434 bp, Rhodopseudomonas palustris; identical to SEQ ID NO: 7426
  CDS (1)..(1434)

SEQ ID NO: 33559 - protein, 477 aa, Rhodopseudomonas palustris; identical to SEQ ID NO: 7427

SEQ ID NO: 33560 - DNA, 1422 bp, Corynebacterium diphtheriae; identical to SEQ ID NO: 7428
  CDS (1)..(1422)

SEQ ID NO: 33561 - protein, 473 aa, Corynebacterium diphtheriae; identical to SEQ ID NO: 7429

SEQ ID NO: 33562 - DNA, 3179 bp, Lactobacillus casei; identical to SEQ ID NO: 7430
  CDS (1307)..(3070)

SEQ ID NO: 33563 - protein, 587 aa, Lactobacillus casei; identical to SEQ ID NO: 7431

SEQ ID NO: 33564 - DNA, 1341 bp, Onion yellows phytoplasma; identical to SEQ ID NO: 7432
  CDS (1)..(1341)

SEQ ID NO: 33565 - protein, 446 aa, Onion yellows phytoplasma; identical to SEQ ID NO: 7433

SEQ ID NO: 33566 - DNA, 2023 bp, Oryza sativa; identical to SEQ ID NO: 7434
  CDS (324)..(1688)

SEQ ID NO: 33567 - protein, 454 aa, Oryza sativa; identical to SEQ ID NO: 7435

SEQ ID NO: 33568 - DNA, 1410 bp, Desulfovibrio vulgaris; identical to SEQ ID NO: 7436
  CDS (1)..(1410)

SEQ ID NO: 33569 - protein, 469 aa, Desulfovibrio vulgaris; identical to SEQ ID NO: 7437

SEQ ID NO: 33570 - DNA, 1425 bp, Thermus thermophilus; identical to SEQ ID NO: 7438
  CDS (1)..(1425)

SEQ ID NO: 33571 - protein, 474 aa, Thermus thermophilus; identical to SEQ ID NO: 7439

SEQ ID NO: 33572 - DNA, 1317 bp, Leptospira interrogans; identical to SEQ ID NO: 7440
  CDS (1)..(1317)

SEQ ID NO: 33573 - protein, 438 aa, Leptospira interrogans; identical to SEQ ID NO: 7441

SEQ ID NO: 33574 - DNA, 1758 bp, Bacillus cereus; identical to SEQ ID NO: 7442
  CDS (1)..(1758)

SEQ ID NO: 33575 - protein, 585 aa, Bacillus cereus; identical to SEQ ID NO: 7443

SEQ ID NO: 33576 - DNA, 1059 bp, Bacillus cereus; identical to SEQ ID NO: 7444
  CDS (1)..(1059): n means a or g or c or t/u, s means g or c

SEQ ID NO: 33577 - protein, 352 aa, Bacillus cereus; identical to SEQ ID NO: 7445
  Xaa in position 224 is unknown

SEQ ID NO: 33578 - DNA, 1416 bp, Treponema denticola; identical to SEQ ID NO: 7446
  CDS (1)..(1416)

SEQ ID NO: 33579 - protein, 471 aa, Treponema denticola; identical to SEQ ID NO: 7447

SEQ ID NO: 33580 - DNA, 1419 bp, Mycobacterium paratuberculosis; identical to SEQ ID NO: 7448
  CDS (1)..(1419)

SEQ ID NO: 33581 - protein, 472 aa, Mycobacterium paratuberculosis; identical to SEQ ID NO: 7449

SEQ ID NO: 33582 - DNA, 1443 bp, Geobacter sulfurreducens; identical to SEQ ID NO: 7450
  CDS (1)..(1443)

SEQ ID NO: 33583 - protein, 480 aa, Geobacter sulfurreducens; identical to SEQ ID NO: 7451

SEQ ID NO: 33584 - DNA, 1770 bp, Lactobacillus johnsonii; identical to SEQ ID NO: 7452
  CDS (1)..(1770)

SEQ ID NO: 33585 - protein, 589 aa, Lactobacillus johnsonii; identical to SEQ ID NO: 7453

SEQ ID NO: 33586 - DNA, 1506 bp, Ashbya gossypii; identical to SEQ ID NO: 7454
  CDS (1)..(1506)

SEQ ID NO: 33587 - protein, 501 aa, Ashbya gossypii; identical to SEQ ID NO: 7455

SEQ ID NO: 33588 - DNA, 1461 bp, Leptospira interrogans; identical to SEQ ID NO: 7456
  CDS (1)..(1461)

SEQ ID NO: 33589 - protein, 486 aa, Leptospira interrogans; identical to SEQ ID NO: 7457

SEQ ID NO: 33590 - DNA, 1519 bp, Bombyx mori; identical to SEQ ID NO: 7458
  CDS (130)..(1341)

SEQ ID NO: 33591 - protein, 403 aa, Bombyx mori; identical to SEQ ID NO: 7459

SEQ ID NO: 33592 - DNA, 1437 bp, Pyrococcus kodakaraensis; identical to SEQ ID NO: 7460
  CDS (1)..(1437)

SEQ ID NO: 33593 - protein, 478 aa, Pyrococcus kodakaraensis; identical to SEQ ID NO: 7461

SEQ ID NO: 33594 - DNA, 1503 bp, Streptococcus pyogenes; identical to SEQ ID NO: 7462
  CDS (1)..(1503)

SEQ ID NO: 33595 - protein, 500 aa, Streptococcus pyogenes; identical to SEQ ID NO: 7463

SEQ ID NO: 33596 - DNA, 1476 bp, Vibrio vulnificus; identical to SEQ ID NO: 7464
  CDS (1)..(1476)

SEQ ID NO: 33597 - protein, 491 aa, Vibrio vulnificus; identical to SEQ ID NO: 7465

SEQ ID NO: 33598 - DNA, 1449 bp, Vibrio vulnificus; identical to SEQ ID NO: 7466
  CDS (1)..(1449)

SEQ ID NO: 33599 - protein, 482 aa, Vibrio vulnificus; identical to SEQ ID NO: 7467

SEQ ID NO: 33600 - DNA, 1410 bp, Photorhabdus luminescens; identical to SEQ ID NO: 7468
  CDS (1)..(1410)

SEQ ID NO: 33601 - protein, 469 aa, Photorhabdus luminescens; identical to SEQ ID NO: 7469

SEQ ID NO: 33602 - DNA, 1443 bp, Photorhabdus luminescens; identical to SEQ ID NO: 7470
  CDS (1)..(1443)

SEQ ID NO: 33603 - protein, 480 aa, Photorhabdus luminescens; identical to SEQ ID NO: 7471

SEQ ID NO: 33604 - DNA, 1527 bp, Mycoplasma gallisepticum; identical to SEQ ID NO: 7472
  CDS (1)..(1527)

SEQ ID NO: 33605 - protein, 508 aa, Mycoplasma gallisepticum; identical to SEQ ID NO: 7473

SEQ ID NO: 33606 - DNA, 1818 bp, Gloeobacter violaceus; identical to SEQ ID NO: 7474
  CDS (1)..(1818)

SEQ ID NO: 33607 - protein, 605 aa, Gloeobacter violaceus; identical to SEQ ID NO: 7475

SEQ ID NO: 33608 - DNA, 1422 bp, Gloeobacter violaceus; identical to SEQ ID NO: 7476
  CDS (1)..(1422)

SEQ ID NO: 33609 - protein, 473 aa, Gloeobacter violaceus; identical to SEQ ID NO: 7477

SEQ ID NO: 33610 - DNA, 1407 bp, Chromobacterium violaceum; identical to SEQ ID NO: 7478
  CDS (1)..(1407)

SEQ ID NO: 33611 - protein, 468 aa, Chromobacterium violaceum; identical to SEQ ID NO: 7479

SEQ ID NO: 33612 - DNA, 1662 bp, Giardia lamblia ATCC 50803; identical to SEQ ID NO: 7480
  CDS (1)..(1662)

SEQ ID NO: 33613 - protein, 553 aa, Giardia lamblia ATCC 50803; identical to SEQ ID NO: 7481

SEQ ID NO: 33614 - DNA, 1536 bp, Plasmodium yoelii yoelii; identical to SEQ ID NO: 7482
  CDS (1)..(1536)

SEQ ID NO: 33615 - protein, 511 aa, Plasmodium yoelii yoelii; identical to SEQ ID NO: 7483

SEQ ID NO: 33616 - DNA, 1584 bp, Neurospora crassa; identical to SEQ ID NO: 7484
  CDS (1)..(1584)

SEQ ID NO: 33617 - protein, 527 aa, Neurospora crassa; identical to SEQ ID NO: 7485

SEQ ID NO: 33618 - DNA, 1455 bp, Synechococcus sp; identical to SEQ ID NO: 7486
  CDS (1)..(1455)

SEQ ID NO: 33619 - protein, 484 aa, Synechococcus sp; identical to SEQ ID NO: 7487

SEQ ID NO: 33620 - DNA, 1431 bp, Rhodopirellula baltica; identical to SEQ ID NO: 7488
  CDS (1)..(1431)

SEQ ID NO: 33621 - protein, 476 aa, Rhodopirellula baltica; identical to SEQ ID NO: 7489

SEQ ID NO: 33622 - DNA, 1791 bp, Prochlorococcus marinus subsp; identical to SEQ ID NO: 7490
  CDS (1)..(1791)

SEQ ID NO: 33623 - protein, 596 aa, Prochlorococcus marinus subsp; identical to SEQ ID NO: 7491

SEQ ID NO: 33624 - DNA, 1818 bp, Prochlorococcus marinus; identical to SEQ ID NO: 7492
  CDS (1)..(1818)

SEQ ID NO: 33625 - protein, 605 aa, Prochlorococcus marinus; identical to SEQ ID NO: 7493

SEQ ID NO: 33626 - DNA, 1785 bp, Prochlorococcus marinus; identical to SEQ ID NO: 7494
  CDS (1)..(1785)

SEQ ID NO: 33627 - protein, 594 aa, Prochlorococcus marinus; identical to SEQ ID NO: 7495

SEQ ID NO: 33628 - DNA, 1440 bp, Haemophilus ducreyi; identical to SEQ ID NO: 7496
  CDS (1)..(1440)

SEQ ID NO: 33629 - protein, 479 aa, Haemophilus ducreyi; identical to SEQ ID NO: 7497

SEQ ID NO: 33630 - DNA, 1467 bp, Candidatus Blochmannia floridanus; identical to SEQ ID NO: 7498
  CDS (1)..(1467)

SEQ ID NO: 33631 - protein, 488 aa, Candidatus Blochmannia floridanus; identical to SEQ ID NO: 7499

SEQ ID NO: 33632 - DNA, 1443 bp, Bordetella parapertussis; identical to SEQ ID NO: 7500
  CDS (1)..(1443)

SEQ ID NO: 33633 - protein, 480 aa, Bordetella parapertussis; identical to SEQ ID NO: 7501

SEQ ID NO: 33634 - DNA, 2002 bp, Oryza sativa; identical to SEQ ID NO: 7502
  CDS (113)..(1648)

SEQ ID NO: 33635 - protein, 511 aa, Oryza sativa; identical to SEQ ID NO: 7503

SEQ ID NO: 33636 - DNA, 1071 bp, Bacillus cereus; identical to SEQ ID NO: 7504
  CDS (1)..(1071)

SEQ ID NO: 33637 - protein, 356 aa, Bacillus cereus; identical to SEQ ID NO: 7505

SEQ ID NO: 33638 - DNA, 1059 bp, Bacillus anthracis; identical to SEQ ID NO: 7506
  CDS (1)..(1059)

SEQ ID NO: 33639 - protein, 352 aa, Bacillus anthracis; identical to SEQ ID NO: 7507

SEQ ID NO: 33640 - DNA, 1446 bp, Chlamydophila caviae; identical to SEQ ID NO: 7508
  CDS (1)..(1446)

SEQ ID NO: 33641 - protein, 481 aa, Chlamydophila caviae; identical to SEQ ID NO: 7509

SEQ ID NO: 33642 - DNA, 1437 bp, Streptomyces avermitilis; identical to SEQ ID NO: 7510
  CDS (1)..(1437)

SEQ ID NO: 33643 - protein, 478 aa, Streptomyces avermitilis; identical to SEQ ID NO: 7511

SEQ ID NO: 33644 - DNA, 1431 bp, Streptomyces avermitilis; identical to SEQ ID NO: 7512
  CDS (1)..(1431)

SEQ ID NO: 33645 - protein, 476 aa, Streptomyces avermitilis; identical to SEQ ID NO: 7513

SEQ ID NO: 33646 - DNA, 1491 bp, Nitrosomonas europaea; identical to SEQ ID NO: 7514
  CDS (1)..(1491)

SEQ ID NO: 33647 - protein, 496 aa, Nitrosomonas europaea; identical to SEQ ID NO: 7515

SEQ ID NO: 33648 - DNA, 1758 bp, Enterococcus faecalis; identical to SEQ ID NO: 7516
  CDS (1)..(1758)

SEQ ID NO: 33649 - protein, 585 aa, Enterococcus faecalis; identical to SEQ ID NO: 7517

SEQ ID NO: 33650 - DNA, 1434 bp, Coxiella burnetii; identical to SEQ ID NO: 7518
  CDS (1)..(1434)

SEQ ID NO: 33651 - protein, 477 aa, Coxiella burnetii; identical to SEQ ID NO: 7519

SEQ ID NO: 33652 - DNA, 1422 bp, Tropheryma whipplei; identical to SEQ ID NO: 7520
  CDS (1)..(1422)

SEQ ID NO: 33653 - protein, 473 aa, Tropheryma whipplei; identical to SEQ ID NO: 7521

SEQ ID NO: 33654 - DNA, 1416 bp, Tropheryma whipplei; identical to SEQ ID NO: 7522
  CDS (1)..(1416)

SEQ ID NO: 33655 - protein, 471 aa, Tropheryma whipplei; identical to SEQ ID NO: 7523

SEQ ID NO: 33656 - DNA, 1584 bp, Shigella flexneri; identical to SEQ ID NO: 7524
  CDS (1)..(1584)

SEQ ID NO: 33657 - protein, 527 aa, Shigella flexneri; identical to SEQ ID NO: 7525

SEQ ID NO: 33658 - DNA, 1425 bp, Microbispora rosea subsp; identical to SEQ ID NO: 7526
  CDS (1)..(1425)

SEQ ID NO: 33659 - protein, 474 aa, Microbispora rosea subsp; identical to SEQ ID NO: 7527

SEQ ID NO: 33660 - DNA, 1806 bp, Oryza sativa; identical to SEQ ID NO: 7528
  CDS (75)..(1721)

SEQ ID NO: 33661 - protein, 548 aa, Oryza sativa; identical to SEQ ID NO: 7529

SEQ ID NO: 33662 - DNA, 1506 bp, Kluyveromyces lactis; identical to SEQ ID NO: 7530
  CDS (1)..(1506)

SEQ ID NO: 33663 - protein, 501 aa, Kluyveromyces lactis; identical to SEQ ID NO: 7531

SEQ ID NO: 33664 - DNA, 1506 bp, Saccharomyces kluyveri; identical to SEQ ID NO: 7532
  CDS (1)..(1506)

SEQ ID NO: 33665 - protein, 501 aa, Saccharomyces kluyveri; identical to SEQ ID NO: 7533

SEQ ID NO: 33666 - DNA, 1506 bp, Saccharomyces castellii; identical to SEQ ID NO: 7534
  CDS (1)..(1506)

SEQ ID NO: 33667 - protein, 501 aa, Saccharomyces castellii; identical to SEQ ID NO: 7535

SEQ ID NO: 33668 - DNA, 1521 bp, Saccharomyces bayanus; identical to SEQ ID NO: 7536
  CDS (1)..(1521)

SEQ ID NO: 33669 - protein, 506 aa, Saccharomyces bayanus; identical to SEQ ID NO: 7537

SEQ ID NO: 33670 - DNA, 1467 bp, Xylella fastidiosa; identical to SEQ ID NO: 7538
  CDS (1)..(1467)

SEQ ID NO: 33671 - protein, 488 aa, Xylella fastidiosa; identical to SEQ ID NO: 7539

SEQ ID NO: 33672 - DNA, 1479 bp, Vibrio parahaemolyticus; identical to SEQ ID NO: 7540
  CDS (1)..(1479)

SEQ ID NO: 33673 - protein, 492 aa, Vibrio parahaemolyticus; identical to SEQ ID NO: 7541

SEQ ID NO: 33674 - DNA, 1443 bp, Vibrio parahaemolyticus; identical to SEQ ID NO: 7542
  CDS (1)..(1443)

SEQ ID NO: 33675 - protein, 480 aa, Vibrio parahaemolyticus; identical to SEQ ID NO: 7543

SEQ ID NO: 33676 - DNA, 1413 bp, Vibrio parahaemolyticus; identical to SEQ ID NO: 7544
  CDS (1)..(1413)

SEQ ID NO: 33677 - protein, 470 aa, Vibrio parahaemolyticus; identical to SEQ ID NO: 7545

SEQ ID NO: 33678 - DNA, 1452 bp, Pseudomonas syringae; identical to SEQ ID NO: 7546
  CDS (1)..(1452)

SEQ ID NO: 33679 - protein, 483 aa, Pseudomonas syringae; identical to SEQ ID NO: 7547

SEQ ID NO: 33680 - DNA, 1416 bp, Pseudomonas putida; identical to SEQ ID NO: 7548
  CDS (1)..(1416)

SEQ ID NO: 33681 - protein, 471 aa, Pseudomonas putida; identical to SEQ ID NO: 7549

SEQ ID NO: 33682 - DNA, 1455 bp, Pseudomonas putida; identical to SEQ ID NO: 7550
  CDS (1)..(1455)

SEQ ID NO: 33683 - protein, 484 aa, Pseudomonas putida; identical to SEQ ID NO: 7551

SEQ ID NO: 33684 - DNA, 1761 bp, Lactobacillus plantarum; identical to SEQ ID NO: 7552
  CDS (1)..(1761)

SEQ ID NO: 33685 - protein, 586 aa, Lactobacillus plantarum; identical to SEQ ID NO: 7553

SEQ ID NO: 33686 - DNA, 1755 bp, Clostridium tetani; identical to SEQ ID NO: 7554
  CDS (1)..(1755)

SEQ ID NO: 33687 - protein, 584 aa, Clostridium tetani; identical to SEQ ID NO: 7555

SEQ ID NO: 33688 - DNA, 1437 bp, Bradyrhizobium japonicum; identical to SEQ ID NO: 7556
  CDS (1)..(1437)

SEQ ID NO: 33689 - protein, 478 aa, Bradyrhizobium japonicum; identical to SEQ ID NO: 7557

SEQ ID NO: 33690 - DNA, 1458 bp, Bacteroides thetaiotaomicron; identical to SEQ ID NO: 7558
  CDS (1)..(1458)

SEQ ID NO: 33691 - protein, 485 aa, Bacteroides thetaiotaomicron; identical to SEQ ID NO: 7559

SEQ ID NO: 33692 - DNA, 2797 bp, Staphylococcus epidermidis; identical to SEQ ID NO: 7560
  CDS (854)..(2611)

SEQ ID NO: 33693 - protein, 585 aa, Staphylococcus epidermidis; identical to SEQ ID NO: 7561

SEQ ID NO: 33694 - DNA, 1440 bp, Wigglesworthia glossinidia brevipalpis; identical to SEQ ID NO: 7562
  CDS (1)..(1440)

SEQ ID NO: 33695 - protein, 479 aa, Wigglesworthia glossinidia brevipalpis; identical to SEQ ID NO: 7563

SEQ ID NO: 33696 - DNA, 1413 bp, Vibrio vulnificus; identical to SEQ ID NO: 7564
  CDS (1)..(1413)

SEQ ID NO: 33697 - protein, 470 aa, Vibrio vulnificus; identical to SEQ ID NO: 7565

SEQ ID NO: 33698 - DNA, 1785 bp, Synechococcus elongatus; identical to SEQ ID NO: 7566
  CDS (1)..(1785)

SEQ ID NO: 33699 - protein, 594 aa, Synechococcus elongatus; identical to SEQ ID NO: 7567

SEQ ID NO: 33700 - DNA, 1503 bp, Streptococcus mutans; identical to SEQ ID NO: 7568
  CDS (1)..(1503)

SEQ ID NO: 33701 - protein, 500 aa, Streptococcus mutans; identical to SEQ ID NO: 7569

SEQ ID NO: 33702 - DNA, 1503 bp, Streptococcus agalactiae; identical to SEQ ID NO: 7570
  CDS (1)..(1503)

SEQ ID NO: 33703 - protein, 500 aa, Streptococcus agalactiae; identical to SEQ ID NO: 7571

SEQ ID NO: 33704 - DNA, 1440 bp, Shewanella oneidensis; identical to SEQ ID NO: 7572
  CDS (1)..(1440)

SEQ ID NO: 33705 - protein, 479 aa, Shewanella oneidensis; identical to SEQ ID NO: 7573

SEQ ID NO: 33706 - DNA, 1761 bp, Oceanobacillus iheyensis; identical to SEQ ID NO: 7574
  CDS (1)..(1761)

SEQ ID NO: 33707 - protein, 586 aa, Oceanobacillus iheyensis; identical to SEQ ID NO: 7575

SEQ ID NO: 33708 - DNA, 1497 bp, Mycoplasma penetrans; identical to SEQ ID NO: 7576
  CDS (1)..(1497): transl_table=4

SEQ ID NO: 33709 - protein, 498 aa, Mycoplasma penetrans; identical to SEQ ID NO: 7577

SEQ ID NO: 33710 - DNA, 1584 bp, Escherichia coli O6; identical to SEQ ID NO: 7578
  CDS (1)..(1584)

SEQ ID NO: 33711 - protein, 527 aa, Escherichia coli O6; identical to SEQ ID NO: 7579

SEQ ID NO: 33712 - DNA, 1437 bp, Brucella suis; identical to SEQ ID NO: 7580
  CDS (1)..(1437)

SEQ ID NO: 33713 - protein, 478 aa, Brucella suis; identical to SEQ ID NO: 7581

SEQ ID NO: 33714 - DNA, 1530 bp, Bifidobacterium longum; identical to SEQ ID NO: 7582
  CDS (1)..(1530)

SEQ ID NO: 33715 - protein, 509 aa, Bifidobacterium longum; identical to SEQ ID NO: 7583

SEQ ID NO: 33716 - DNA, 1890 bp, Lactobacillus delbrueckii; identical to SEQ ID NO: 7584
  CDS (1)..(1770)

SEQ ID NO: 33717 - protein, 589 aa, Lactobacillus delbrueckii; identical to SEQ ID NO: 7585

SEQ ID NO: 33718 - DNA, 2043 bp, Stigmatella aurantiaca; identical to SEQ ID NO: 7586
  CDS (463)..(1896)

SEQ ID NO: 33719 - protein, 477 aa, Stigmatella aurantiaca; identical to SEQ ID NO: 7587

SEQ ID NO: 33720 - DNA, 1584 bp, Arabidopsis thaliana; identical to SEQ ID NO: 7588
  CDS (1)..(1584)

SEQ ID NO: 33721 - protein, 527 aa, Arabidopsis thaliana; identical to SEQ ID NO: 7589

SEQ ID NO: 33722 - DNA, 1437 bp, Bartonella henselae; identical to SEQ ID NO: 7590
  CDS (1)..(1437)

SEQ ID NO: 33723 - protein, 478 aa, Bartonella henselae; identical to SEQ ID NO: 7591

SEQ ID NO: 33724 - DNA, 1533 bp, Glycine max; identical to SEQ ID NO: 7592
  CDS (1)..(1533)

SEQ ID NO: 33725 - protein, 510 aa, Glycine max; identical to SEQ ID NO: 7593

SEQ ID NO: 33726 - DNA, 1536 bp, Glycine max; identical to SEQ ID NO: 7594
  CDS (1)..(1536)

SEQ ID NO: 33727 - protein, 511 aa, Glycine max; identical to SEQ ID NO: 7595

SEQ ID NO: 33728 - DNA, 1527 bp, Xanthomonas campestris; identical to SEQ ID NO: 7596
  CDS (1)..(1527)

SEQ ID NO: 33729 - protein, 508 aa, Xanthomonas campestris; identical to SEQ ID NO: 7597

SEQ ID NO: 33730 - DNA, 1506 bp, Xanthomonas axonopodis; identical to SEQ ID NO: 7598
  CDS (1)..(1506)

SEQ ID NO: 33731 - protein, 501 aa, Xanthomonas axonopodis; identical to SEQ ID NO: 7599

SEQ ID NO: 33732 - DNA, 1434 bp, Methanosarcina mazei; identical to SEQ ID NO: 7600
  CDS (1)..(1434)

SEQ ID NO: 33733 - protein, 477 aa, Methanosarcina mazei; identical to SEQ ID NO: 7601

SEQ ID NO: 33734 - DNA, 1752 bp, Thermoanaerobacter tengcongensis; identical to SEQ ID NO: 7602
  CDS (1)..(1752)

SEQ ID NO: 33735 - protein, 583 aa, Thermoanaerobacter tengcongensis; identical to SEQ ID NO: 7603

SEQ ID NO: 33736 - DNA, 1428 bp, Fusobacterium nucleatum; identical to SEQ ID NO: 7604
  CDS (1)..(1428)

SEQ ID NO: 33737 - protein, 475 aa, Fusobacterium nucleatum; identical to SEQ ID NO: 7605

SEQ ID NO: 33738 - DNA, 1713 bp, Oryza sativa; identical to SEQ ID NO: 7606
  CDS (1)..(1713)

SEQ ID NO: 33739 - protein, 570 aa, Oryza sativa; identical to SEQ ID NO: 7607

SEQ ID NO: 33740 - DNA, 1872 bp, Oryza sativa; identical to SEQ ID NO: 7608
  CDS (1)..(1872)

SEQ ID NO: 33741 - protein, 623 aa, Oryza sativa; identical to SEQ ID NO: 7609

SEQ ID NO: 33742 - DNA, 1560 bp, Encephalitozoon cuniculi; identical to SEQ ID NO: 7610
  CDS (1)..(1560)

SEQ ID NO: 33743 - protein, 519 aa, Encephalitozoon cuniculi; identical to SEQ ID NO: 7611

SEQ ID NO: 33744 - DNA, 1470 bp, Methanosarcina acetivorans; identical to SEQ ID NO: 7612
  CDS (1)..(1470)

SEQ ID NO: 33745 - protein, 489 aa, Methanosarcina acetivorans; identical to SEQ ID NO: 7613

SEQ ID NO: 33746 - DNA, 1434 bp, Pyrococcus furiosus; identical to SEQ ID NO: 7614
  CDS (1)..(1434)

SEQ ID NO: 33747 - protein, 477 aa, Pyrococcus furiosus; identical to SEQ ID NO: 7615

SEQ ID NO: 33748 - DNA, 1404 bp, Clostridium perfringens; identical to SEQ ID NO: 7616
  CDS (1)..(1404)

SEQ ID NO: 33749 - protein, 467 aa, Clostridium perfringens; identical to SEQ ID NO: 7617

SEQ ID NO: 33750 - DNA, 1419 bp, Ralstonia solanacearum; identical to SEQ ID NO: 7618
  CDS (1)..(1419)

SEQ ID NO: 33751 - protein, 472 aa, Ralstonia solanacearum; identical to SEQ ID NO: 7619

SEQ ID NO: 33752 - DNA, 1440 bp, Ralstonia solanacearum; identical to SEQ ID NO: 7620
  CDS (1)..(1440)

SEQ ID NO: 33753 - protein, 479 aa, Ralstonia solanacearum; identical to SEQ ID NO: 7621

SEQ ID NO: 33754 - DNA, 1443 bp, Salmonella typhimurium; identical to SEQ ID NO: 7622
  CDS (1)..(1443)

SEQ ID NO: 33755 - protein, 480 aa, Salmonella typhimurium; identical to SEQ ID NO: 7623

SEQ ID NO: 33756 - DNA, 1386 bp, Pyrobaculum aerophilum; identical to SEQ ID NO: 7624
  CDS (1)..(1386)

SEQ ID NO: 33757 - protein, 461 aa, Pyrobaculum aerophilum; identical to SEQ ID NO: 7625

SEQ ID NO: 33758 - DNA, 1440 bp, Rhizobium meliloti; identical to SEQ ID NO: 7626
  CDS (1)..(1440)

SEQ ID NO: 33759 - protein, 479 aa, Rhizobium meliloti; identical to SEQ ID NO: 7627

SEQ ID NO: 33760 - DNA, 1745 bp, Mastigamoeba balamuthi; identical to SEQ ID NO: 7628
  CDS (36)..(1541)

SEQ ID NO: 33761 - protein, 501 aa, Mastigamoeba balamuthi; identical to SEQ ID NO: 7629

SEQ ID NO: 33762 - DNA, 2207 bp, Toxoplasma gondii; identical to SEQ ID NO: 7630
  CDS (225)..(1820)

SEQ ID NO: 33763 - protein, 531 aa, Toxoplasma gondii; identical to SEQ ID NO: 7631

SEQ ID NO: 33764 - DNA, 1317 bp, Sulfolobus tokodaii; identical to SEQ ID NO: 7632
  CDS (1)..(1317)

SEQ ID NO: 33765 - protein, 438 aa, Sulfolobus tokodaii; identical to SEQ ID NO: 7633

SEQ ID NO: 33766 - DNA, 1626 bp, Thermoplasma volcanium; identical to SEQ ID NO: 7634
  CDS (1)..(1626)

SEQ ID NO: 33767 - protein, 541 aa, Thermoplasma volcanium; identical to SEQ ID NO: 7635

SEQ ID NO: 33768 - DNA, 1437 bp, Rhizobium loti; identical to SEQ ID NO: 7636
  CDS (1)..(1437)

SEQ ID NO: 33769 - protein, 478 aa, Rhizobium loti; identical to SEQ ID NO: 7637

SEQ ID NO: 33770 - DNA, 1440 bp, Pasteurella multocida; identical to SEQ ID NO: 7638
  CDS (1)..(1440)

SEQ ID NO: 33771 - protein, 479 aa, Pasteurella multocida; identical to SEQ ID NO: 7639

SEQ ID NO: 33772 - DNA, 1880 bp, Arabidopsis thaliana; identical to SEQ ID NO: 7640
  CDS (126)..(1658)

SEQ ID NO: 33773 - protein, 510 aa, Arabidopsis thaliana; identical to SEQ ID NO: 7641

SEQ ID NO: 33774 - DNA, 1517 bp, Arabidopsis thaliana; identical to SEQ ID NO: 7642
  CDS (1)..(1497)

SEQ ID NO: 33775 - protein, 498 aa, Arabidopsis thaliana; identical to SEQ ID NO: 7643

SEQ ID NO: 33776 - DNA, 1564 bp, Arabidopsis thaliana; identical to SEQ ID NO: 7644
  CDS (1)..(1533)

SEQ ID NO: 33777 - protein, 510 aa, Arabidopsis thaliana; identical to SEQ ID NO: 7645

SEQ ID NO: 33778 - DNA, 1581 bp, Aspergillus oryzae; identical to SEQ ID NO: 7646
  CDS (1)..(1581)

SEQ ID NO: 33779 - protein, 526 aa, Aspergillus oryzae; identical to SEQ ID NO: 7647

SEQ ID NO: 33780 - DNA, 1431 bp, Streptomyces coelicolor; identical to SEQ ID NO: 7648
  CDS (1)..(1431)

SEQ ID NO: 33781 - protein, 476 aa, Streptomyces coelicolor; identical to SEQ ID NO: 7649

SEQ ID NO: 33782 - DNA, 1503 bp, Streptococcus thermophilus; identical to SEQ ID NO: 7650
  CDS (1)..(1503)

SEQ ID NO: 33783 - protein, 500 aa, Streptococcus thermophilus; identical to SEQ ID NO: 7651

SEQ ID NO: 33784 - DNA, 2150 bp, Pseudomonas hydrogenothermophila; identical to SEQ ID NO: 7652
  CDS (16)..(1437)

SEQ ID NO: 33785 - protein, 473 aa, Pseudomonas hydrogenothermophila; identical to SEQ ID NO: 7653

SEQ ID NO: 33786 - DNA, 1413 bp, Selenomonas ruminantium; identical to SEQ ID NO: 7654
  CDS (1)..(1413)

SEQ ID NO: 33787 - protein, 470 aa, Selenomonas ruminantium; identical to SEQ ID NO: 7655

SEQ ID NO: 33788 - DNA, 1822 bp, Arabidopsis thaliana; identical to SEQ ID NO: 7656
  CDS (1)..(1791)

SEQ ID NO: 33789 - protein, 596 aa, Arabidopsis thaliana; identical to SEQ ID NO: 7657

SEQ ID NO: 33790 - DNA, 1494 bp, Arabidopsis thaliana; identical to SEQ ID NO: 7658
  CDS (1)..(1494)

SEQ ID NO: 33791 - protein, 497 aa, Arabidopsis thaliana; identical to SEQ ID NO: 7659

SEQ ID NO: 33792 - DNA, 1920 bp, Lilium longiflorum; identical to SEQ ID NO: 7660
  CDS (145)..(1677)

SEQ ID NO: 33793 - protein, 510 aa, Lilium longiflorum; identical to SEQ ID NO: 7661

SEQ ID NO: 33794 - DNA, 1413 bp, Vibrio marinus; identical to SEQ ID NO: 7662
  CDS (1)..(1413)

SEQ ID NO: 33795 - protein, 470 aa, Vibrio marinus; identical to SEQ ID NO: 7663

SEQ ID NO: 33796 - DNA, 1979 bp, Oryza sativa; identical to SEQ ID NO: 7664
  CDS (224)..(1747)

SEQ ID NO: 33797 - protein, 507 aa, Oryza sativa; identical to SEQ ID NO: 7665

SEQ ID NO: 33798 - DNA, 1533 bp, Arabidopsis thaliana; identical to SEQ ID NO: 7666
  CDS (1)..(1533)

SEQ ID NO: 33799 - protein, 510 aa, Arabidopsis thaliana; identical to SEQ ID NO: 7667

SEQ ID NO: 33800 - DNA, 2235 bp, Drosophila melanogaster; identical to SEQ ID NO: 7668
  CDS (1)..(2235)

SEQ ID NO: 33801 - protein, 744 aa, Drosophila melanogaster; identical to SEQ ID NO: 7669

SEQ ID NO: 33802 - DNA, 3033 bp, Drosophila melanogaster; identical to SEQ ID NO: 7670
  CDS (1)..(3033)

SEQ ID NO: 33803 - protein, 1010 aa, Drosophila melanogaster; identical to SEQ ID NO: 7671

SEQ ID NO: 33804 - DNA, 1814 bp, Drosophila melanogaster; identical to SEQ ID NO: 7672
  CDS (83)..(1747)

SEQ ID NO: 33805 - protein, 554 aa, Drosophila melanogaster; identical to SEQ ID NO: 7673

SEQ ID NO: 33806 - DNA, 1425 bp, Agrobacterium vitis; identical to SEQ ID NO: 7674
  CDS (1)..(1425)

SEQ ID NO: 33807 - protein, 474 aa, Agrobacterium vitis; identical to SEQ ID NO: 7675

SEQ ID NO: 33808 - DNA, 1449 bp, Agrobacterium vitis; identical to SEQ ID NO: 7676
  CDS (1)..(1449)

SEQ ID NO: 33809 - protein, 482 aa, Agrobacterium vitis; identical to SEQ ID NO: 7677

SEQ ID NO: 33810 - DNA, 2234 bp, Nicotiana tabacum; identical to SEQ ID NO: 7678
  CDS (59)..(1840)

SEQ ID NO: 33811 - protein, 593 aa, Nicotiana tabacum; identical to SEQ ID NO: 7679

SEQ ID NO: 33812 - DNA, 1599 bp, Agaricus bisporus; identical to SEQ ID NO: 7680
  CDS (1)..(1599)

SEQ ID NO: 33813 - protein, 532 aa, Agaricus bisporus; identical to SEQ ID NO: 7681

SEQ ID NO: 33814 - DNA, 1446 bp, Buchnera aphidicola; identical to SEQ ID NO: 7682
  CDS (1)..(1446)

SEQ ID NO: 33815 - protein, 481 aa, Buchnera aphidicola; identical to SEQ ID NO: 7683

SEQ ID NO: 33816 - DNA, 1440 bp, Buchnera aphidicola; identical to SEQ ID NO: 7684
  CDS (1)..(1440)

SEQ ID NO: 33817 - protein, 479 aa, Buchnera aphidicola; identical to SEQ ID NO: 7685

SEQ ID NO: 33818 - DNA, 2354 bp, Gallus gallus; identical to SEQ ID NO: 7686
  CDS (81)..(1673)

SEQ ID NO: 33819 - protein, 530 aa, Gallus gallus; identical to SEQ ID NO: 7687

SEQ ID NO: 33820 - DNA, 1425 bp, Clostridium perfringens; identical to SEQ ID NO: 7688
  CDS (1)..(1425)

SEQ ID NO: 33821 - protein, 474 aa, Clostridium perfringens; identical to SEQ ID NO: 7689

SEQ ID NO: 33822 - DNA, 1425 bp, Corynebacterium efficiens; identical to SEQ ID NO: 7690
  CDS (1)..(1425)

SEQ ID NO: 33823 - protein, 474 aa, Corynebacterium efficiens; identical to SEQ ID NO: 7691

SEQ ID NO: 33824 - DNA, 2084 bp, Drosophila melanogaster; identical to SEQ ID NO: 7692
  CDS (229)..(1830)

SEQ ID NO: 33825 - protein, 533 aa, Drosophila melanogaster; identical to SEQ ID NO: 7693

SEQ ID NO: 33826 - DNA, 1901 bp, Eimeria tenella; identical to SEQ ID NO: 7694
  CDS (57)..(1652)

SEQ ID NO: 33827 - protein, 531 aa, Eimeria tenella; identical to SEQ ID NO: 7695

SEQ ID NO: 33828 - DNA, 3479 bp, Lactobacillus delbrueckii; identical to SEQ ID NO: 7696
  CDS (1277)..(3046)

SEQ ID NO: 33829 - protein, 589 aa, Lactobacillus delbrueckii; identical to SEQ ID NO: 7697

SEQ ID NO: 33830 - DNA, 1941 bp, Leishmania mexicana; identical to SEQ ID NO: 7698
  CDS (112)..(1611)

SEQ ID NO: 33831 - protein, 499 aa, Leishmania mexicana; identical to SEQ ID NO: 7699

SEQ ID NO: 33832 - DNA, 1452 bp, Methylobacterium extorquens; identical to SEQ ID NO: 7700
  CDS (1)..(1452)

SEQ ID NO: 33833 - protein, 483 aa, Methylobacterium extorquens; identical to SEQ ID NO: 7701

SEQ ID NO: 33834 - DNA, 1439 bp, Mycobacterium intracellulare; identical to SEQ ID NO: 7702
  CDS (1)..(1419)

SEQ ID NO: 33835 - protein, 472 aa, Mycobacterium intracellulare; identical to SEQ ID NO: 7703

SEQ ID NO: 33836 - DNA, 1635 bp, Thermoplasma acidophilum; identical to SEQ ID NO: 7704
  CDS (1)..(1635)

SEQ ID NO: 33837 - protein, 544 aa, Thermoplasma acidophilum; identical to SEQ ID NO: 7705

SEQ ID NO: 33838 - DNA, 1497 bp, Trypanoplasma borreli; identical to SEQ ID NO: 7706
  CDS (1)..(1497)

SEQ ID NO: 33839 - protein, 498 aa, Trypanoplasma borreli; identical to SEQ ID NO: 7707

SEQ ID NO: 33840 - DNA, 1629 bp, Yarrowia lipolytica; identical to SEQ ID NO: 7708
  CDS (1)..(1629)

SEQ ID NO: 33841 - protein, 542 aa, Yarrowia lipolytica; identical to SEQ ID NO: 7709

SEQ ID NO: 33842 - DNA, 1596 bp, Oryctolagus cuniculus; identical to SEQ ID NO: 7710
  CDS (1)..(1596)

SEQ ID NO: 33843 - protein, 531 aa, Oryctolagus cuniculus; identical to SEQ ID NO: 7711

SEQ ID NO: 33844 - DNA, 1799 bp, Xenopus laevis; identical to SEQ ID NO: 7712
  CDS (11)..(1606)

SEQ ID NO: 33845 - protein, 531 aa, Xenopus laevis; identical to SEQ ID NO: 7713

SEQ ID NO: 33846 - DNA, 2404 bp, Brachydanio rerio; identical to SEQ ID NO: 7714
  CDS (37)..(1635)

SEQ ID NO: 33847 - protein, 532 aa, Brachydanio rerio; identical to SEQ ID NO: 7715

SEQ ID NO: 33848 - DNA, 26 bp, Artificial sequence
  (1)..(26): primer
atgtctagattagaaagattgacctc

SEQ ID NO: 33849 - DNA, 25 bp, Artificial sequence
  (1)..(25): primer
ttaaacggtagagacttgcaaagtg

SEQ ID NO: 33850 - protein, 346 aa, Artificial sequence; identical to SEQ ID NO: 9106
  Variant (2)..(6): xaa in position 2 to 6 is any amino acid
  Variant (8)..(8): xaa in position 8 is any amino acid
  Variant (14)..(17): xaa in position 14 to 17 is any amino acid
  Variant (19)..(46): xaa in position 19 to 46 is any amino acid
  Variant (48)..(49): xaa in position 48 to 49 is any amino acid
  Variant (52)..(52): xaa in position 52 is any amino acid
  Variant (55)..(72): xaa in position 55 to 72 is any amino acid
  Variant (74)..(110): xaa in position 74 to 110 is any amino acid
  Variant (112)..(117): xaa in position 112 to 117 is any amino acid
  Variant (120)..(124): xaa in position 120 to 124 is any amino acid
  Variant (126)..(149): xaa in position 126 to 149 is any amino acid
  Variant (151)..(155): xaa in position 151 to 155 is any amino acid
  Variant (157)..(158): xaa in position 157 to 158 is any amino acid
  Variant (160)..(172): xaa in position 160 to 172 is any amino acid
  Variant (175)..(176): xaa in position 175 to 176 is any amino acid
  Variant (178)..(188): xaa in position 178 to 188 is any amino acid
  Variant (190)..(193): xaa in position 190 to 193 is any amino acid
  Variant (196)..(200): xaa in position 196 to 200 is any amino acid
  Variant (202)..(226): xaa in position 202 to 226 is any amino acid
  Variant (228)..(228): xaa in position 228 is any amino acid
  Variant (230)..(242): xaa in position 230 to 242 is any amino acid
  Variant (244)..(247): xaa in position 244 to 247 is any amino acid
  Variant (249)..(250): xaa in position 249 to 250 is any amino acid
  Variant (259)..(259): xaa in position 259 is any amino acid
  Variant (261)..(269): xaa in position 261 to 269 is any amino acid
  Variant (272)..(273): xaa in position 272 to 273 is any amino acid
  Variant (275)..(283): xaa in position 275 to 283 is any amino acid
  Variant (286)..(286): xaa in position 286 is any amino acid
  Variant (292)..(292): xaa in position 292 is any amino acid
  Variant (295)..(297): xaa in position 295 to 297 is any amino acid
  Variant (299)..(299): xaa in position 299 is any amino acid
  Variant (305)..(306): xaa in position 305 to 306 is any amino acid
  Variant (309)..(309): xaa in position 309 is any amino acid
  Variant (312)..(313): xaa in position 312 to 313 is any amino acid
  Variant (316)..(316): xaa in position 316 is any amino acid
  Variant (318)..(319): xaa in position 318 to 319 is any amino acid
  Variant (323)..(323): xaa in position 323 is any amino acid
  Variant (325)..(325): xaa in position 325 is any amino acid
  Variant (327)..(327): xaa in position 327 is any amino acid
  Variant (329)..(330): xaa in position 329 to 330 is any amino acid
  Variant (332)..(334): xaa in position 332 to 334 is any amino acid
  Variant (336)..(337): xaa in position 336 to 337 is any amino acid
  Variant (339)..(345): xaa in position 339 to 345 is any amino acid

SEQ ID NO: 33851 - protein, 48 aa, Artificial sequence; identical to SEQ ID NO: 9104
  Variant (2)..(2): xaa in position 2 is Ile, Val or Leu
  Variant (4)..(6): xaa in position 4 to 6 is any amino acid
  Variant (7)..(7): xaa in position 7 is Gly, Ala, Ser, Thr or Val
  Variant (8)..(8): xaa in position 8 is Val, Ile, Leu or Met
  Variant (9)..(10): xaa in position 9 to 10 is any amino acid
  Variant (11)..(13): xaa in position 11 to 13 is any or no amino acid
  Variant (14)..(14): xaa in position 14 is Phe, Ile, Leu or Met
  Variant (15)..(16): xaa in position 15 to 16 is any amino acid
  Variant (17)..(17): xaa in position 17 is Ile, Val or Leu
  Variant (18)..(18): xaa in position 18 is Leu, Ile, Val, Ala or Cys
  Variant (19)..(20): xaa in position 19 to 20 is any amino acid
  Variant (21)..(21): xaa in position 21 is Ser, Ala, Thr, Phe or Cys
  Variant (22)..(22): xaa in position 22 is Asp or Gln
  Variant (23)..(23): xaa in position 23 is any amino acid
  Variant (24)..(24): xaa in position 24 is Ile, Val, Leu, Phe or Ala
  Variant (25)..(25): xaa in position 25 is Met or Ile
  Variant (26)..(26): xaa in position 26 is Val, Ile or Leu
  Variant (27)..(27): xaa in position 27 is Ala or Ser
  Variant (31)..(31): xaa in position 31 is Leu or Met
  Variant (32)..(32): xaa in position 32 is Gly or Ala
  Variant (33)..(33): xaa in position 33 is Val, Ile, Met, Ala or Leu
  Variant (34)..(34): xaa in position 34 is Glu or Gln
  Variant (35)..(35): xaa in position 35 is Ile, Leu, Val, Met, Cys or Tyr
  Variant (36)..(39): xaa in position 36 to 39 is any amino acid
  Variant (40)..(40): xaa in position 40 is Val, Leu, Ile or Met
  Variant (41)..(43): xaa in position 41 to 43 is any amino acid
  Variant (44)..(44): xaa in position 44 is Gln or Glu
  Variant (45)..(45): xaa in position 45 is Lys, Arg, Glu or Gln
  Variant (46)..(46): xaa in position 46 is any amino acid
  Variant (47)..(47): xaa in position 47 is Ile, Leu, Met or Ala
  Variant (48)..(48): xaa in position 48 is Ile, Val, Thr, Leu or Ala

SEQ ID NO: 33852 - protein, 63 aa, Artificial sequence; identical to SEQ ID NO: 9105
  Variant (1)..(1): xaa in position 1 is Val, Ile, Ala, Cys, Ser or Thr
  Variant (2)..(2): xaa in position 2 is Ile, Val or Ala
  Variant (3)..(3): xaa in position 3 is any or no amino acid
  Variant (5)..(5): xaa in position 5 is Thr or Ser
  Variant (6)..(6): xaa in position 6 is Gln, Asn, His or Glu
  Variant (7)..(7): xaa in position 7 is Met, Leu, Val or Ile
  Variant (8)..(8): xaa in position 8 is Leu, Met or Val
  Variant (9)..(9): xaa in position 9 is any amino acid
  Variant (10)..(10): xaa in position 10 is Ser or Thr
  Variant (11)..(11): xaa in position 11 is Met or Leu
  Variant (12)..(16): xaa in position 12 to 16 is any amino acid
  Variant (17)..(17): xaa in position 17 is Pro or Ala
  Variant (20)..(20): xaa in position 20 is Ala or Ser
  Variant (22)..(22): xaa in position 22 is Val, Ala, Ile, Thr or Gly
  Variant (23)..(23): xaa in position 23 is any amino acid
  Variant (25)..(25): xaa in position 25 is Val or Ile
  Variant (26)..(26): xaa in position 26 is Ala, Gly, Phe, Ser, Tyr or Thr
  Variant (27)..(27): xaa in position 27 is any amino acid
  Variant (28)..(28): xaa in position 28 is Ala or Ser
  Variant (29)..(29): xaa in position 29 is Val, Ile or Thr
  Variant (30)..(32): xaa in position 30 to 32 is any amino acid
  Variant (33)..(33): xaa in position 33 is Thr, Ala, Ser or Val
  Variant (34)..(34): xaa in position 34 is Asp, Ser or Asn
  Variant (35)..(35): xaa in position 35 is Ala, Cys, Ser or Gly
  Variant (36)..(36): xaa in position 36 is Val, Ile, Thr or Leu
  Variant (37)..(37): xaa in position 37 is Met or Leu
  Variant (39)..(39): xaa in position 39 is Ser or Thr
  Variant (40)..(40): xaa in position 40 is Gly, Ala, Asn or Glu
  Variant (42)..(42): xaa in position 42 is Thr or Ser
  Variant (43)..(43): xaa in position 43 is Ala, Ser or Thr
  Variant (44)..(44): xaa in position 44 is any amino acid
  Variant (46)..(46): xaa in position 46 is any amino acid
  Variant (47)..(47): xaa in position 47 is Tyr, Phe, His, Asp or Trp
  Variant (49)..(50): xaa in position 49 to 50 is any amino acid
  Variant (51)..(51): xaa in position 51 is Ala, Thr, Ser, Val or Cys
  Variant (52)..(52): xaa in position 52 is Val, Ile, Leu or Ala
  Variant (53)..(54): xaa in position 53 to 54 is any amino acid
  Variant (55)..(55): xaa in position 55 is Met, Leu or Gln
  Variant (56)..(57): xaa in position 56 to 57 is any amino acid
  Variant (58)..(58): xaa in position 58 is Ile, Val, Thr or Ala
  Variant (59)..(61): xaa in position 59 to 61 is any amino acid
  Variant (62)..(62): xaa in position 62 is Ala, Thr, Val, Ile or Ser
  Variant (63)..(63): xaa in position 63 is Glu, Asp or Gln

SEQ ID NO: 33853 - DNA, 2420 bp, Saccharomyces cerevisiae; identical to SEQ ID NO: 4987
  CDS (739)..(2115)

SEQ ID NO: 33854 - protein, 458 aa, Saccharomyces cerevisiae; identical to SEQ ID NO: 4988

SEQ ID NO: 33855 - DNA, 1345 bp, Arabidopsis thaliana (mouse-ear cress); identical to SEQ ID NO: 4989
  CDS (29)..(1345)

SEQ ID NO: 33856 - protein, 438 aa, Arabidopsis thaliana (mouse-ear cress); identical to SEQ ID NO: 4990

SEQ ID NO: 33857 - DNA, 1533 bp, Drosophila melanogaster; identical to SEQ ID NO: 4991
  CDS (1)..(1533)

SEQ ID NO: 33858 - protein, 510 aa, Drosophila melanogaster; identical to SEQ ID NO: 4992

SEQ ID NO: 33859 - DNA, 1221 bp, Schizosaccharomyces pombe; identical to SEQ ID NO: 4993
  CDS (1)..(1221)

SEQ ID NO: 33860 - protein, 406 aa, Schizosaccharomyces pombe; identical to SEQ ID NO: 4994

SEQ ID NO: 33861 - DNA, 1446 bp, Debaryomyces hansenii; identical to SEQ ID NO: 4995
  CDS (1)..(1446)

SEQ ID NO: 33862 - protein, 481 aa, Debaryomyces hansenii; identical to SEQ ID NO: 4996

SEQ ID NO: 33863 - DNA, 1617 bp, Yarrowia lipolytica; identical to SEQ ID NO: 4997
  CDS (1)..(1617)

SEQ ID NO: 33864 - protein, 538 aa, Yarrowia lipolytica; identical to SEQ ID NO: 4998

SEQ ID NO: 33865 - DNA, 1389 bp, Kluyveromyces lactis; identical to SEQ ID NO: 4999
  CDS (1)..(1389)

SEQ ID NO: 33866 - protein, 462 aa, Kluyveromyces lactis; identical to SEQ ID NO: 5000

SEQ ID NO: 33867 - DNA, 1395 bp, Pichia pastoris; identical to SEQ ID NO: 5001
  CDS (1)..(1395)

SEQ ID NO: 33868 - protein, 464 aa, Pichia pastoris; identical to SEQ ID NO: 5002

SEQ ID NO: 33869 - DNA, 1329 bp, Candida glabrata; identical to SEQ ID NO: 5003
  CDS (1)..(1329)

SEQ ID NO: 33870 - protein, 442 aa, Candida glabrata; identical to SEQ ID NO: 5004

SEQ ID NO: 33871 - DNA, 1299 bp, Ashbya gossypii; identical to SEQ ID NO: 5005
  CDS (1)..(1299)

SEQ ID NO: 33872 - protein, 432 aa, Ashbya gossypii; identical to SEQ ID NO: 5006

SEQ ID NO: 33873 - DNA, 1662 bp, Anopheles gambiae str; identical to SEQ ID NO: 5007
  CDS (1)..(1662)

SEQ ID NO: 33874 - protein, 553 aa, Anopheles gambiae str; identical to SEQ ID NO: 5008

SEQ ID NO: 33875 - DNA, 1446 bp, Mus musculus; identical to SEQ ID NO: 5009
  CDS (7)..(1323)

SEQ ID NO: 33876 - protein, 438 aa, Mus musculus; identical to SEQ ID NO: 5010

SEQ ID NO: 33877 - DNA, 1164 bp, Oryza sativa; identical to SEQ ID NO: 5011
  CDS (1)..(1164)

SEQ ID NO: 33878 - protein, 387 aa, Oryza sativa; identical to SEQ ID NO: 5012

SEQ ID NO: 33879 - DNA, 1329 bp, Neurospora crassa; identical to SEQ ID NO: 5013
  CDS (1)..(1329)

SEQ ID NO: 33880 - protein, 442 aa, Neurospora crassa; identical to SEQ ID NO: 5014

SEQ ID NO: 33881 - DNA, 1923 bp, Caenorhabditis elegans; identical to SEQ ID NO: 5015
  CDS (1)..(1923)

SEQ ID NO: 33882 - protein, 640 aa, Caenorhabditis elegans; identical to SEQ ID NO: 5016

SEQ ID NO: 33883 - DNA, 1507 bp, Homo sapiens; identical to SEQ ID NO: 5017
  CDS (7)..(1323)

SEQ ID NO: 33884 - protein, 438 aa, Homo sapiens; identical to SEQ ID NO: 5018

SEQ ID NO: 33885 - DNA, 1455 bp, Drosophila melanogaster; identical to SEQ ID NO: 5019
  CDS (1)..(1455)

SEQ ID NO: 33886 - protein, 484 aa, Drosophila melanogaster; identical to SEQ ID NO: 5020

SEQ ID NO: 33887 - DNA, 1581 bp, Drosophila virilis; identical to SEQ ID NO: 5021
  CDS (1)..(1581)

SEQ ID NO: 33888 - protein, 526 aa, Drosophila virilis; identical to SEQ ID NO: 5022

SEQ ID NO: 33889 - DNA, 23 bp, Artificial sequence
  (1)..(23): primer
atggaaggtgaacagtctccgca

SEQ ID NO: 33890 - DNA, 25 bp, Artificial sequence
  (1)..(25): primer
tcagttgagctttttttccatagag

SEQ ID NO: 33891 - protein, 492 aa, Artificial sequence
  Variant (2)..(3): xaa in position 2 to 3 is any amino acid
  Variant (5)..(5): xaa in position 5 is any amino acid
  Variant (11)..(12): xaa in position 11 to 12 is any amino acid
  Variant (16)..(24): xaa in position 16 to 24 is any amino acid
  Variant (26)..(28): xaa in position 26 to 28 is any amino acid
  Variant (30)..(33): xaa in position 30 to 33 is any amino acid
  Variant (35)..(35): xaa in position 35 is any amino acid
  Variant (44)..(51): xaa in position 44 to 51 is any amino acid
  Variant (53)..(55): xaa in position 53 to 55 is any amino acid
  Variant (57)..(65): xaa in position 57 to 65 is any amino acid
  Variant (67)..(68): xaa in position 67 to 68 is any amino acid
  Variant (70)..(72): xaa in position 70 to 72 is any amino acid
  Variant (74)..(83): xaa in position 74 to 83 is any amino acid
  Variant (85)..(92): xaa in position 85 to 92 is any amino acid
  Variant (94)..(102): xaa in position 94 to 102 is any amino acid
  Variant (104)..(104): xaa in position 104 is any amino acid
  Variant (106)..(106): xaa in position 106 is any amino acid
  Variant (110)..(110): xaa in position 110 is any amino acid
  Variant (118)..(157): xaa in position 118 to 157 is any amino acid
  Variant (159)..(159): xaa in position 159 is any amino acid
  Variant (161)..(163): xaa in position 161 to 163 is any amino acid
  Variant (167)..(167): xaa in position 167 is any amino acid
  Variant (170)..(171): xaa in position 170 to 171 is any amino acid
  Variant (173)..(199): xaa in position 173 to 199 is any amino acid
  Variant (201)..(206): xaa in position 201 to 206 is any amino acid
  Variant (209)..(223): xaa in position 209 to 223 is any amino acid
  Variant (225)..(228): xaa in position 225 to 228 is any amino acid
  Variant (230)..(232): xaa in position 230 to 232 is any amino acid
  Variant (234)..(234): xaa in position 234 is any amino acid
  Variant (236)..(238): xaa in position 236 to 238 is any amino acid
  Variant (240)..(240): xaa in position 240 is any amino acid
  Variant (243)..(244): xaa in position 243 to 244 is any amino acid
  Variant (246)..(256): xaa in position 246 to 256 is any amino acid
  Variant (258)..(261): xaa in position 258 to 261 is any amino acid
  Variant (263)..(265): xaa in position 263 to 265 is any amino acid
  Variant (268)..(269): xaa in position 268 to 269 is any amino acid
  Variant (271)..(273): xaa in position 271 to 273 is any amino acid
  Variant (275)..(276): xaa in position 275 to 276 is any amino acid
  Variant (278)..(400): xaa in position 278 to 400 is any amino acid
  Variant (402)..(402): xaa in position 402 is any amino acid
  Variant (405)..(408): xaa in position 405 to 408 is any amino acid
  Variant (416)..(417): xaa in position 416 to 417 is any amino acid
  Variant (420)..(423): xaa in position 420 to 423 is any amino acid
  Variant (425)..(425): xaa in position 425 is any amino acid
  Variant (427)..(475): xaa in position 427 to 475 is any amino acid
  Variant (477)..(478): xaa in position 477 to 478 is any amino acid
  Variant (481)..(482): xaa in position 481 to 482 is any amino acid
  Variant (484)..(488): xaa in position 484 to 488 is any amino acid
  Variant (490)..(491): xaa in position 490 to 491 is any amino acid
IXXVXYTEIDXXAYMXXXXXXXXXGXXXYXXXXGXTGPLVYPAXXXXXXXXLXXXTXXXXXXXXXQXXFXXXYXXXXXXXXXXYXXXXXXXXPXXXXXXXXXSXRXHSIXVLRLFNDXXXXXXXXXXXXXXXXXXXXXXXXXXXXXXXXXXXXXXXXSXAXXXKMNXLLXXPXXXXXXXXXXXXXXXXXXXXXXXXXXXQXXXXXXFLXXXXXXXXXXXXXXXYXXXXFXXXRXFXXXWXVNXXFXXXXXXXXXXXFXXXXFXXXLLXXHXXXLXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXIGXXXXRSLHYQFXXWYXXXXPXLXXXXXXXXXXXXXXXXXXXXXXXXXXXXXXXXXXXXXXXXXXXXXXXXXEXXWNXXPXXXXXSXXL

SEQ ID NO: 33892 - protein, 70 aa, Artificial sequence; identical to SEQ ID NO: 6179
  Variant (1)..(1): xaa in position 1 is Val or Ile
  Variant (2)..(2): xaa in position 2 is any amino acid
  Variant (5)..(5): xaa in position 5 is Glu, Asp or Lys
  Variant (8)..(8): xaa in position 8 is Trp, Tyr or Phe
  Variant (9)..(9): xaa in position 9 is any amino acid
  Variant (10)..(10): xaa in position 10 is Ala, Thr or Ser
  Variant (12)..(12): xaa in position 12 is Met or Ile
  Variant (13)..(13): xaa in position 13 is Gln, Glu, Ala or Ser
  Variant (14)..(14): xaa in position 14 is Gln or Glu
  Variant (15)..(17): xaa in position 15 to 17 is any amino acid
  Variant (18)..(18): xaa in position 18 is Ile, Phe, Tyr or Val
  Variant (19)..(20): xaa in position 19 to 20 is any amino acid
  Variant (21)..(21): xaa in position 21 is any or no amino acid
  Variant (23)..(24): xaa in position 23 to 24 is any amino acid
  Variant (25)..(25): xaa in position 25 is Asp or Asn
  Variant (27)..(28): xaa in position 27 to 28 is any amino acid
  Variant (29)..(29): xaa in position 29 is Leu, Ile or Val
  Variant (30)..(30): xaa in position 30 is any amino acid
  Variant (32)..(32): xaa in position 32 is Asp, Gly or Cys
  Variant (35)..(35): xaa in position 35 is Pro or Gln
  Variant (36)..(36): xaa in position 36 is Leu, Met, Cys or Ile
  Variant (40)..(40): xaa in position 40 is Ala or Gly
  Variant (41)..(41): xaa in position 41 is Gly or Ala
  Variant (42)..(42): xaa in position 42 is His or Phe
  Variant (43)..(43): xaa in position 43 is Val, Leu or Ala
  Variant (44)..(44): xaa in position 44 is any amino acid
  Variant (45)..(45): xaa in position 45 is Ile, Val, Ala or Leu
  Variant (46)..(46): xaa in position 46 is Tyr, Phe or His
  Variant (47)..(48): xaa in position 47 to 48 is any amino acid
  Variant (49)..(49): xaa in position 49 is Leu, Phe, Met or Val
  Variant (50)..(51): xaa in position 50 to 51 is any amino acid
  Variant (52)..(52): xaa in position 52 is Leu, Val, Ala, Phe or Tyr
  Variant (53)..(53): xaa in position 53 is Thr or Ser
  Variant (54)..(54): xaa in position 54 is Asp, Ser, Gly or Glu
  Variant (55)..(55): xaa in position 55 is any amino acid
  Variant (56)..(57): xaa in position 56 to 57 is any or no amino acid
  Variant (58)..(58): xaa in position 58 is Asn, Asp, His or Glu
  Variant (59)..(59): xaa in position 59 is Ile or Val
  Variant (60)..(61): xaa in position 60 to 61 is any amino acid
  Variant (62)..(62): xaa in position 62 is Ala, Gly or Val
  Variant (64)..(64): xaa in position 64 is any amino acid
  Variant (65)..(65): xaa in position 65 is Ile, Leu, Ala, Phe or Val
  Variant (66)..(66): xaa in position 66 is Phe or Tyr
  Variant (67)..(68): xaa in position 67 to 68 is any amino acid
  Variant (69)..(69): xaa in position 69 is Leu, Ile, Val or Phe
  Variant (70)..(70): xaa in position 70 is Tyr or Leu

SEQ ID NO: 33893 - protein, 15 aa, Artificial sequence
  Variant (1)..(1): xaa in position 1 is Ser or Gly
  Variant (2)..(2): xaa in position 2 is Lys or Tyr
  Variant (4)..(4): xaa in position 4 is Leu, Ile or Val
  Variant (5)..(5): xaa in position 5 is His or Phe
  Variant (7)..(7): xaa in position 7 is Ile or Val
  Variant (8)..(8): xaa in position 8 is Tyr or Phe
  Variant (9)..(9): xaa in position 9 is Val or Ile
  Variant (12)..(12): xaa in position 12 is Leu or Cys
XXRXXSXXXLRXFND

SEQ ID NO: 33894 - protein, 16 aa, Artificial sequence
  Variant (1)..(1): xaa in position 1 is Ser or Thr
  Variant (2)..(2): xaa in position 2 is any amino acid
  Variant (3)..(3): xaa in position 3 is Ala or Gly
  Variant (4)..(4): xaa in position 4 is Val, Ile, Cys or Leu
  Variant (5)..(5): xaa in position 5 is Ser or Gly
  Variant (6)..(6): xaa in position 6 is Val or Ile
  Variant (9)..(9): xaa in position 9 is Asn, Ser or Thr
  Variant (10)..(10): xaa in position 10 is any amino acid
  Variant (11)..(11): xaa in position 11 is Leu or Met
  Variant (13)..(13): xaa in position 13 is Tyr, Phe or Ser
  Variant (14)..(14): xaa in position 14 is Ala, Leu, Phe or Val
  Variant (16)..(16): xaa in position 16 is Ala, Gly or Thr
XXXXXXKMXXXLXXPX

SEQ ID NO: 33895 - protein, 67 aa, Artificial sequence
  Variant (2)..(2): xaa in position 2 is Val, Leu or Ile
  Variant (3)..(3): xaa in position 3 is any amino acid
  Variant (4)..(4): xaa in position 4 is Leu, Val, Ile, Phe or Met
  Variant (5)..(5): xaa in position 5 is Gly, Ala or Ser
  Variant (6)..(7): xaa in position 6 to 7 is any amino acid
  Variant (9)..(18): xaa in position 9 to 18 is any amino acid
  Variant (19)..(24): xaa in position 19 to 24 is any or no amino acid
  Variant (26)..(26): xaa in position 26 is Leu, Phe, Ile or Trp
  Variant (27)..(28): xaa in position 27 to 28 is any amino acid
  Variant (29)..(29): xaa in position 29 is Ala or Ser
  Variant (31)..(31): xaa in position 31 is Asp, Asn or Glu
  Variant (32)..(32): xaa in position 32 is Leu or Phe
  Variant (33)..(33): xaa in position 33 is any amino acid
  Variant (35)..(35): xaa in position 35 is any amino acid
  Variant (37)..(37): xaa in position 37 is any amino acid
  Variant (38)..(38): xaa in position 38 is Tyr, His, Phe or Trp
  Variant (39)..(39): xaa in position 39 is any amino acid
  Variant (41)..(41): xaa in position 41 is Thr or Ser
  Variant (42)..(42): xaa in position 42 is Val or Ile
  Variant (44)..(44): xaa in position 44 is Trp, Tyr or Phe
  Variant (45)..(45): xaa in position 45 is Arg, Gln or Lys
  Variant (46)..(46): xaa in position 46 is Phe, Met or Leu
  Variant (47)..(47): xaa in position 47 is Leu, Val, Met or Ile
  Variant (48)..(57): xaa in position 48 to 57 is any amino acid
  Variant (58)..(61): xaa in position 58 to 61 is any or no amino acid
  Variant (63)..(66): xaa in position 63 to 66 is any amino acid
QXXXXXXFXXXXXXXXXXXXXXXXYXXXXFXXXRXFXXXWXXNXXXXXXXXXXXXXXXXXXFXXXXF

SEQ ID NO: 33896 - protein, 26 aa, Artificial sequence
  Variant (2)..(2): xaa in position 2 is Phe, Leu, Ala, Ile or Tyr
  Variant (3)..(3): xaa in position 3 is Ile or Val
  Variant (5)..(5): xaa in position 5 is Val, Ile or Leu
  Variant (6)..(6): xaa in position 6 is any amino acid
  Variant (7)..(7): xaa in position 7 is Phe or Cys
  Variant (8)..(8): xaa in position 8 is Ala or Ser
  Variant (9)..(9): xaa in position 9 is Arg or His
  Variant (16)..(16): xaa in position 16 is Tyr or Leu
  Variant (17)..(17): xaa in position 17 is Ser, Val, Ala or Ile
  Variant (18)..(18): xaa in position 18 is Trp or Tyr
  Variant (19)..(19): xaa in position 19 is Tyr, Phe or Val
  Variant (20)..(20): xaa in position 20 is Phe, His, Ala, Cys or Tyr
  Variant (21)..(21): xaa in position 21 is Trp, His, Phe or Tyr
  Variant (22)..(23): xaa in position 22 to 23 is any amino acid
  Variant (25)..(25): xaa in position 25 is any amino acid
  Variant (26)..(26): xaa in position 26 is Leu or Met
NXXGXXXXXSLHYQFXXXXXXXXPXX

SEQ ID NO: 33897 - DNA, 1113 bp, Saccharomyces cerevisiae; identical to SEQ ID NO: 1363
  CDS (1)..(1113)

SEQ ID NO: 33898 - protein, 370 aa, Saccharomyces cerevisiae; identical to SEQ ID NO: 1364

SEQ ID NO: 33899 - DNA, 1086 bp, Deinococcus radiodurans; identical to SEQ ID NO: 1327
  CDS (1)..(1086)

SEQ ID NO: 33900 - protein, 361 aa, Deinococcus radiodurans; identical to SEQ ID NO: 1328

SEQ ID NO: 33901 - DNA, 1071 bp, Salmonella enterica subsp. enterica serovar Typhi; identical to SEQ ID NO: 2245
  CDS (1)..(1071)

SEQ ID NO: 33902 - protein, 356 aa, Salmonella enterica subsp. enterica serovar Typhi; identical to SEQ ID NO: 2246

SEQ ID NO: 33903 - DNA, 1071 bp, Yersinia pestis; identical to SEQ ID NO: 2247
  CDS (1)..(1071)

SEQ ID NO: 33904 - protein, 356 aa, Yersinia pestis; identical to SEQ ID NO: 2248

SEQ ID NO: 33905 - DNA, 1047 bp, Yersinia pestis; identical to SEQ ID NO: 1331
  CDS (1)..(1047)

SEQ ID NO: 33906 - protein, 348 aa, Yersinia pestis; identical to SEQ ID NO: 1332

SEQ ID NO: 33907 - DNA, 1053 bp, Escherichia coli; identical to SEQ ID NO: 2251
  CDS (1)..(1053)

SEQ ID NO: 33908 - protein, 350 aa, Escherichia coli; identical to SEQ ID NO: 1580

SEQ ID NO: 33909 - DNA, 1071 bp, Escherichia coli; identical to SEQ ID NO: 1333
  CDS (1)..(1071)

SEQ ID NO: 33910 - protein, 356 aa, Escherichia coli; identical to SEQ ID NO: 1334

SEQ ID NO: 33911 - DNA, 1131 bp, Nostoc sp. PCC 7120; identical to SEQ ID NO: 1335
  CDS (1)..(1131)

SEQ ID NO: 33912 - protein, 376 aa, Nostoc sp. PCC 7120; identical to SEQ ID NO: 1336

SEQ ID NO: 33913 - DNA, 1053 bp, Salmonella enterica subsp. enterica serovar Typhi; identical to SEQ ID NO: 1337
  CDS (1)..(1053)

SEQ ID NO: 33914 - protein, 350 aa, Salmonella enterica subsp. enterica serovar Typhi; identical to SEQ ID NO: 1338

SEQ ID NO: 33915 - DNA, 1077 bp, Pseudomonas aeruginosa; identical to SEQ ID NO: 1339
  CDS (1)..(1077)

SEQ ID NO: 33916 - protein, 358 aa, Pseudomonas aeruginosa; identical to SEQ ID NO: 1340

SEQ ID NO: 33917 - DNA, 1074 bp, Vibrio cholerae; identical to SEQ ID NO: 1343
  CDS (1)..(1074)

SEQ ID NO: 33918 - protein, 357 aa, Vibrio cholerae; identical to SEQ ID NO: 1344

SEQ ID NO: 33919 - DNA, 1038 bp, Lactococcus lactis subsp. lactis; identical to SEQ ID NO: 1345
  CDS (1)..(1038)

SEQ ID NO: 33920 - protein, 345 aa, Lactococcus lactis subsp. lactis; identical to SEQ ID NO: 1346

SEQ ID NO: 33921 - DNA, 1023 bp, Lactococcus lactis subsp. lactis; identical to SEQ ID NO: 1347
  CDS (1)..(1023)

SEQ ID NO: 33922 - protein, 340 aa, Lactococcus lactis subsp. lactis; identical to SEQ ID NO: 1348

SEQ ID NO: 33923 - DNA, 1032 bp, Streptococcus pneumoniae; identical to SEQ ID NO: 1349
  CDS (1)..(1032)

SEQ ID NO: 33924 - protein, 343 aa, Streptococcus pneumoniae; identical to SEQ ID NO: 1350

SEQ ID NO: 33925 - DNA, 1056 bp, Neisseria meningitidis; identical to SEQ ID NO: 2269
  CDS (1)..(1056)

SEQ ID NO: 33926 - protein, 351 aa, Neisseria meningitidis; identical to SEQ ID NO: 2270

SEQ ID NO: 33927 - DNA, 1095 bp, Pseudomonas aeruginosa; identical to SEQ ID NO: 1351
  CDS (1)..(1095)

SEQ ID NO: 33928 - protein, 364 aa, Pseudomonas aeruginosa; identical to SEQ ID NO: 1352

SEQ ID NO: 33929 - DNA, 1032 bp, Streptococcus pneumoniae; identical to SEQ ID NO: 1355
  CDS (1)..(1032)

SEQ ID NO: 33930 - protein, 343 aa, Streptococcus pneumoniae; identical to SEQ ID NO: 1356

SEQ ID NO: 33931 - DNA, 1143 bp, Xylella fastidiosa; identical to SEQ ID NO: 1603
  CDS (1)..(1143)

SEQ ID NO: 33932 - protein, 380 aa, Xylella fastidiosa; identical to SEQ ID NO: 1604

SEQ ID NO: 33933 - DNA, 1047 bp, Buchnera aphidicola; identical to SEQ ID NO: 1357
  CDS (1)..(1047)

SEQ ID NO: 33934 - protein, 348 aa, Buchnera aphidicola; identical to SEQ ID NO: 1358

SEQ ID NO: 33935 - DNA, 1104 bp, Corynebacterium glutamicum; identical to SEQ ID NO: 2279
  CDS (1)..(1104)

SEQ ID NO: 33936 - protein, 367 aa, Corynebacterium glutamicum; identical to SEQ ID NO: 2280

SEQ ID NO: 33937 - DNA, 1089 bp, Haemophilus influenzae; identical to SEQ ID NO: 1359
  CDS (1)..(1089)

SEQ ID NO: 33938 - protein, 362 aa, Haemophilus influenzae; identical to SEQ ID NO: 1360

SEQ ID NO: 33939 - DNA, 1502 bp, Candida albicans; identical to SEQ ID NO: 1361
  CDS (336)..(1442)

SEQ ID NO: 33940 - protein, 368 aa, Candida albicans; identical to SEQ ID NO: 1362

SEQ ID NO: 33941 - DNA, 2048 bp, Saccharomyces cerevisiae; identical to SEQ ID NO: 1365
  CDS (619)..(1731)

SEQ ID NO: 33942 - protein, 370 aa, Saccharomyces cerevisiae; identical to SEQ ID NO: 1366

SEQ ID NO: 33943 - DNA, 1107 bp, Schizosaccharomyces pombe; identical to SEQ ID NO: 1367
  CDS (1)..(1107)

SEQ ID NO: 33944 - protein, 368 aa, Schizosaccharomyces pombe; identical to SEQ ID NO: 1368

SEQ ID NO: 33945 - DNA, 1089 bp, Amycolatopsis orientalis; identical to SEQ ID NO: 1369
  CDS (1)..(1089)

SEQ ID NO: 33946 - protein, 362 aa, Amycolatopsis orientalis; identical to SEQ ID NO: 1370

SEQ ID NO: 33947 - DNA, 1119 bp, Schizosaccharomyces pombe; identical to SEQ ID NO: 1371
  CDS (1)..(1119)

SEQ ID NO: 33948 - protein, 372 aa, Schizosaccharomyces pombe; identical to SEQ ID NO: 1372

SEQ ID NO: 33949 - DNA, 1083 bp, Methylophilus methylotrophus; identical to SEQ ID NO: 1375
  CDS (1)..(1083)

SEQ ID NO: 33950 - protein, 360 aa, Methylophilus methylotrophus; identical to SEQ ID NO: 1376

SEQ ID NO: 33951 - DNA, 1770 bp, Debaryomyces hansenii; identical to SEQ ID NO: 2295
  CDS (1)..(1770)

SEQ ID NO: 33952 - protein, 589 aa, Debaryomyces hansenii; identical to SEQ ID NO: 2296

SEQ ID NO: 33953 - DNA, 1107 bp, Debaryomyces hansenii; identical to SEQ ID NO: 1377
  CDS (1)..(1107)

SEQ ID NO: 33954 - protein, 368 aa, Debaryomyces hansenii; identical to SEQ ID NO: 1378

SEQ ID NO: 33955 - DNA, 1074 bp, Yarrowia lipolytica; identical to SEQ ID NO: 1379
  CDS (1)..(1074)

SEQ ID NO: 33956 - protein, 357 aa, Yarrowia lipolytica; identical to SEQ ID NO: 1380

SEQ ID NO: 33957 - DNA, 1089 bp, Yarrowia lipolytica; identical to SEQ ID NO: 1381
  CDS (1)..(1089)

SEQ ID NO: 33958 - protein, 362 aa, Yarrowia lipolytica; identical to SEQ ID NO: 1382

SEQ ID NO: 33959 - DNA, 1119 bp, Kluyveromyces lactis; identical to SEQ ID NO: 1383
  CDS (1)..(1119)

SEQ ID NO: 33960 - protein, 372 aa, Kluyveromyces lactis; identical to SEQ ID NO: 1384

SEQ ID NO: 33961 - DNA, 1095 bp, Kluyveromyces lactis; identical to SEQ ID NO: 1385
  CDS (1)..(1095)

SEQ ID NO: 33962 - protein, 364 aa, Kluyveromyces lactis; identical to SEQ ID NO: 1386

SEQ ID NO: 33963 - DNA, 1074 bp, Erwinia carotovora subsp; identical to SEQ ID NO: 1387
  CDS (1)..(1074)

SEQ ID NO: 33964 - protein, 357 aa, Erwinia carotovora subsp; identical to SEQ ID NO: 1388

SEQ ID NO: 33965 - DNA, 1047 bp, Erwinia carotovora subsp; identical to SEQ ID NO: 1389
  CDS (1)..(1047)

SEQ ID NO: 33966 - protein, 348 aa, Erwinia carotovora subsp; identical to SEQ ID NO: 1390

SEQ ID NO: 33967 - DNA, 1056 bp, Erwinia carotovora subsp; identical to SEQ ID NO: 1391
  CDS (1)..(1056)

SEQ ID NO: 33968 - protein, 351 aa, Erwinia carotovora subsp; identical to SEQ ID NO: 1392

SEQ ID NO: 33969 - DNA, 1113 bp, Acinetobacter sp; identical to SEQ ID NO: 1393
  CDS (1)..(1113)

SEQ ID NO: 33970 - protein, 370 aa, Acinetobacter sp; identical to SEQ ID NO: 1394

SEQ ID NO: 33971 - DNA, 1056 bp, Acinetobacter sp; identical to SEQ ID NO: 1395
  CDS (1)..(1056)

SEQ ID NO: 33972 - protein, 351 aa, Acinetobacter sp; identical to SEQ ID NO: 1396

SEQ ID NO: 33973 - DNA, 1119 bp, Candida glabrata; identical to SEQ ID NO: 1397
  CDS (1)..(1119)

SEQ ID NO: 33974 - protein, 372 aa, Candida glabrata; identical to SEQ ID NO: 1398

SEQ ID NO: 33975 - DNA, 1071 bp, Candida glabrata; identical to SEQ ID NO: 1399
  CDS (1)..(1071)

SEQ ID NO: 33976 - protein, 356 aa, Candida glabrata; identical to SEQ ID NO: 1400

SEQ ID NO: 33977 - DNA, 1083 bp, Photobacterium profundum; identical to SEQ ID NO: 1401
  CDS (1)..(1083)

SEQ ID NO: 33978 - protein, 360 aa, Photobacterium profundum; identical to SEQ ID NO: 1402

SEQ ID NO: 33979 - DNA, 1053 bp, Photobacterium profundum; identical to SEQ ID NO: 1403
  CDS (1)..(1053)

SEQ ID NO: 33980 - protein, 350 aa, Photobacterium profundum; identical to SEQ ID NO: 1404

SEQ ID NO: 33981 - DNA, 1113 bp, Photobacterium profundum; identical to SEQ ID NO: 1405
  CDS (1)..(1113)

SEQ ID NO: 33982 - protein, 370 aa, Photobacterium profundum; identical to SEQ ID NO: 1406

SEQ ID NO: 33983 - DNA, 1056 bp, Photobacterium profundum; identical to SEQ ID NO: 1407
  CDS (1)..(1056)

SEQ ID NO: 33984 - protein, 351 aa, Photobacterium profundum; identical to SEQ ID NO: 1408

SEQ ID NO: 33985 - DNA, 1092 bp, Parachlamydia sp; identical to SEQ ID NO: 1409
  CDS (1)..(1092)

SEQ ID NO: 33986 - protein, 363 aa, Parachlamydia sp; identical to SEQ ID NO: 1410

SEQ ID NO: 33987 - DNA, 1095 bp, Rhodopseudomonas palustris; identical to SEQ ID NO: 1411
  CDS (1)..(1095)

SEQ ID NO: 33988 - protein, 364 aa, Rhodopseudomonas palustris; identical to SEQ ID NO: 1412

SEQ ID NO: 33989 - DNA, 1100 bp, Amycolatopsis methanolica; identical to SEQ ID NO: 1413
  CDS (1)..(1086)

SEQ ID NO: 33990 - protein, 361 aa, Amycolatopsis methanolica; identical to SEQ ID NO: 1414

SEQ ID NO: 33991 - DNA, 1071 bp, Treponema denticola; identical to SEQ ID NO: 1415
  CDS (1)..(1071)

SEQ ID NO: 33992 - protein, 356 aa, Treponema denticola; identical to SEQ ID NO: 1416

SEQ ID NO: 33993 - DNA, 1068 bp, Geobacter sulfurreducens; identical to SEQ ID NO: 1417
  CDS (1)..(1068)

SEQ ID NO: 33994 - protein, 355 aa, Geobacter sulfurreducens; identical to SEQ ID NO: 1418

SEQ ID NO: 33995 - DNA, 1095 bp, Ashbya gossypii; identical to SEQ ID NO: 1419
  CDS (1)..(1095)

SEQ ID NO: 33996 - protein, 364 aa, Ashbya gossypii; identical to SEQ ID NO: 1420

SEQ ID NO: 33997 - DNA, 1122 bp, Ashbya gossypii; identical to SEQ ID NO: 1421
  CDS (1)..(1122)

SEQ ID NO: 33998 - protein, 373 aa, Ashbya gossypii; identical to SEQ ID NO: 1422

SEQ ID NO: 33999 - DNA, 1098 bp, Amycolatopsis balhimycina; identical to SEQ ID NO: 1423
  CDS (1)..(1098)

SEQ ID NO: 34000 - protein, 365 aa, Amycolatopsis balhimycina; identical to SEQ ID NO: 1424

SEQ ID NO: 34001 - DNA, 1053 bp, Vibrio vulnificus; identical to SEQ ID NO: 2345
  CDS (1)..(1053)

SEQ ID NO: 34002 - protein, 350 aa, Vibrio vulnificus; identical to SEQ ID NO: 2346

SEQ ID NO: 34003 - DNA, 1047 bp, Photorhabdus luminescens; identical to SEQ ID NO: 1427
  CDS (1)..(1047)

SEQ ID NO: 34004 - protein, 348 aa, Photorhabdus luminescens; identical to SEQ ID NO: 1428

SEQ ID NO: 34005 - DNA, 1053 bp, Photorhabdus luminescens; identical to SEQ ID NO: 1429
  CDS (1)..(1053)

SEQ ID NO: 34006 - protein, 350 aa, Photorhabdus luminescens; identical to SEQ ID NO: 1430

SEQ ID NO: 34007 - DNA, 1095 bp, Photorhabdus luminescens; identical to SEQ ID NO: 1431
  CDS (1)..(1095)

SEQ ID NO: 34008 - protein, 364 aa, Photorhabdus luminescens; identical to SEQ ID NO: 1432

SEQ ID NO: 34009 - DNA, 1119 bp, Gloeobacter violaceus; identical to SEQ ID NO: 1433
  CDS (1)..(1119)

SEQ ID NO: 34010 - protein, 372 aa, Gloeobacter violaceus; identical to SEQ ID NO: 1434

SEQ ID NO: 34011 - DNA, 1107 bp, Chromobacterium violaceum; identical to SEQ ID NO: 1435
  CDS (1)..(1107)

SEQ ID NO: 34012 - protein, 368 aa, Chromobacterium violaceum; identical to SEQ ID NO: 1436

SEQ ID NO: 34013 - DNA, 1059 bp, Chromobacterium violaceum; identical to SEQ ID NO: 1437
  CDS (1)..(1059)

SEQ ID NO: 34014 - protein, 352 aa, Chromobacterium violaceum; identical to SEQ ID NO: 1438

SEQ ID NO: 34015 - DNA, 1140 bp, Neurospora crassa; identical to SEQ ID NO: 1439
  CDS (1)..(1140)

SEQ ID NO: 34016 - protein, 379 aa, Neurospora crassa; identical to SEQ ID NO: 1440

SEQ ID NO: 34017 - DNA, 1092 bp, Neurospora crassa; identical to SEQ ID NO: 1441
  CDS (1)..(1092)

SEQ ID NO: 34018 - protein, 363 aa, Neurospora crassa; identical to SEQ ID NO: 1442

SEQ ID NO: 34019 - DNA, 1068 bp, Synechococcus sp; identical to SEQ ID NO: 1443
  CDS (1)..(1068)

SEQ ID NO: 34020 - protein, 355 aa, Synechococcus sp; identical to SEQ ID NO: 1444

SEQ ID NO: 34021 - DNA, 1053 bp, Rhodopirellula baltica; identical to SEQ ID NO: 1445
  CDS (1)..(1053)

SEQ ID NO: 34022 - protein, 350 aa, Rhodopirellula baltica; identical to SEQ ID NO: 1446

SEQ ID NO: 34023 - DNA, 1068 bp, Prochlorococcus marinus subsp; identical to SEQ ID NO: 1447
  CDS (1)..(1068)

SEQ ID NO: 34024 - protein, 355 aa, Prochlorococcus marinus subsp; identical to SEQ ID NO: 1448

SEQ ID NO: 34025 - DNA, 1083 bp, Prochlorococcus marinus; identical to SEQ ID NO: 1449
  CDS (1)..(1083)

SEQ ID NO: 34026 - protein, 360 aa, Prochlorococcus marinus; identical to SEQ ID NO: 1450

SEQ ID NO: 34027 - DNA, 1074 bp, Prochlorococcus marinus; identical to SEQ ID NO: 1451
  CDS (1)..(1074)

SEQ ID NO: 34028 - protein, 357 aa, Prochlorococcus marinus; identical to SEQ ID NO: 1452

SEQ ID NO: 34029 - DNA, 1113 bp, Haemophilus ducreyi; identical to SEQ ID NO: 1453
  CDS (1)..(1113)

SEQ ID NO: 34030 - protein, 370 aa, Haemophilus ducreyi; identical to SEQ ID NO: 1454

SEQ ID NO: 34031 - DNA, 1080 bp, Haemophilus ducreyi; identical to SEQ ID NO: 1455
  CDS (1)..(1080)

SEQ ID NO: 34032 - protein, 359 aa, Haemophilus ducreyi; identical to SEQ ID NO: 1456

SEQ ID NO: 34033 - DNA, 1086 bp, Candidatus Blochmannia floridanus; identical to SEQ ID NO: 1457
  CDS (1)..(1086)

SEQ ID NO: 34034 - protein, 361 aa, Candidatus Blochmannia floridanus; identical to SEQ ID NO: 1458

SEQ ID NO: 34035 - DNA, 1074 bp, Bordetella pertussis; identical to SEQ ID NO: 2379
  CDS (1)..(1074)

SEQ ID NO: 34036 - protein, 357 aa, Bordetella pertussis; identical to SEQ ID NO: 1460

SEQ ID NO: 34037 - DNA, 1119 bp, Bordetella bronchiseptica; identical to SEQ ID NO: 1461
  CDS (1)..(1119)

SEQ ID NO: 34038 - protein, 372 aa, Bordetella bronchiseptica; identical to SEQ ID NO: 1462

SEQ ID NO: 34039 - DNA, 1179 bp, Nitrosomonas europaea; identical to SEQ ID NO: 1463
  CDS (1)..(1179)

SEQ ID NO: 34040 - protein, 392 aa, Nitrosomonas europaea; identical to SEQ ID NO: 1464

SEQ ID NO: 34041 - DNA, 1083 bp, Coxiella burnetii; identical to SEQ ID NO: 1465
  CDS (1)..(1083)

SEQ ID NO: 34042 - protein, 360 aa, Coxiella burnetii; identical to SEQ ID NO: 1466

SEQ ID NO: 34043 - DNA, 1053 bp, Vibrio parahaemolyticus; identical to SEQ ID NO: 1471
  CDS (1)..(1053)

SEQ ID NO: 34044 - protein, 350 aa, Vibrio parahaemolyticus; identical to SEQ ID NO: 1472

SEQ ID NO: 34045 - DNA, 1053 bp, Vibrio parahaemolyticus; identical to SEQ ID NO: 1473
  CDS (1)..(1053)

SEQ ID NO: 34046 - protein, 350 aa, Vibrio parahaemolyticus; identical to SEQ ID NO: 1474

SEQ ID NO: 34047 - DNA, 1074 bp, Vibrio parahaemolyticus; identical to SEQ ID NO: 1475
  CDS (1)..(1074)

SEQ ID NO: 34048 - protein, 357 aa, Vibrio parahaemolyticus; identical to SEQ ID NO: 1476

SEQ ID NO: 34049 - DNA, 1083 bp, Pseudomonas syringae; identical to SEQ ID NO: 1477
  CDS (1)..(1083)

SEQ ID NO: 34050 - protein, 360 aa, Pseudomonas syringae; identical to SEQ ID NO: 1478

SEQ ID NO: 34051 - DNA, 1077 bp, Pseudomonas syringae; identical to SEQ ID NO: 1479
  CDS (1)..(1077)

SEQ ID NO: 34052 - protein, 358 aa, Pseudomonas syringae; identical to SEQ ID NO: 1480

SEQ ID NO: 34053 - DNA, 1062 bp, Pseudomonas putida; identical to SEQ ID NO: 1481
  CDS (1)..(1062)

SEQ ID NO: 34054 - protein, 353 aa, Pseudomonas putida; identical to SEQ ID NO: 1482

SEQ ID NO: 34055 - DNA, 1113 bp, Pseudomonas putida; identical to SEQ ID NO: 1483
  CDS (1)..(1113)

SEQ ID NO: 34056 - protein, 370 aa, Pseudomonas putida; identical to SEQ ID NO: 1484

SEQ ID NO: 34057 - DNA, 1086 bp, Bradyrhizobium japonicum; identical to SEQ ID NO: 1485
  CDS (1)..(1086)

SEQ ID NO: 34058 - protein, 361 aa, Bradyrhizobium japonicum; identical to SEQ ID NO: 1486

SEQ ID NO: 34059 - DNA, 1053 bp, Yersinia pestis; identical to SEQ ID NO: 1487
  CDS (1)..(1053)

SEQ ID NO: 34060 - protein, 350 aa, Yersinia pestis; identical to SEQ ID NO: 1488

SEQ ID NO: 34061 - DNA, 1038 bp, Wigglesworthia glossinidia brevipalpis; identical to SEQ ID NO: 1491
  CDS (1)..(1038)

SEQ ID NO: 34062 - protein, 345 aa, Wigglesworthia glossinidia brevipalpis; identical to SEQ ID NO: 1492

SEQ ID NO: 34063 - DNA, 1071 bp, Vibrio vulnificus; identical to SEQ ID NO: 1739
  CDS (1)..(1071)

SEQ ID NO: 34064 - protein, 356 aa, Vibrio vulnificus; identical to SEQ ID NO: 1740

SEQ ID NO: 34065 - DNA, 1053 bp, Vibrio vulnificus; identical to SEQ ID NO: 1493
  CDS (1)..(1053)

SEQ ID NO: 34066 - protein, 350 aa, Vibrio vulnificus; identical to SEQ ID NO: 1494

SEQ ID NO: 34067 - DNA, 1071 bp, Vibrio vulnificus; identical to SEQ ID NO: 1497
  CDS (1)..(1071)

SEQ ID NO: 34068 - protein, 356 aa, Vibrio vulnificus; identical to SEQ ID NO: 1498

SEQ ID NO: 34069 - DNA, 1062 bp, Synechococcus elongatus; identical to SEQ ID NO: 1499
  CDS (1)..(1062)

SEQ ID NO: 34070 - protein, 353 aa, Synechococcus elongatus; identical to SEQ ID NO: 1500

SEQ ID NO: 34071 - DNA, 1032 bp, Streptococcus mutans; identical to SEQ ID NO: 1501
  CDS (1)..(1032)

SEQ ID NO: 34072 - protein, 343 aa, Streptococcus mutans; identical to SEQ ID NO: 1502

SEQ ID NO: 34073 - DNA, 1035 bp, Streptococcus mutans; identical to SEQ ID NO: 1503
  CDS (1)..(1035)

SEQ ID NO: 34074 - protein, 344 aa, Streptococcus mutans; identical to SEQ ID NO: 1504

SEQ ID NO: 34075 - DNA, 1008 bp, Streptococcus agalactiae; identical to SEQ ID NO: 1505
  CDS (1)..(1008)

SEQ ID NO: 34076 - protein, 335 aa, Streptococcus agalactiae; identical to SEQ ID NO: 1506

SEQ ID NO: 34077 - DNA, 1065 bp, Shewanella oneidensis; identical to SEQ ID NO: 1507
  CDS (1)..(1065)

SEQ ID NO: 34078 - protein, 354 aa, Shewanella oneidensis; identical to SEQ ID NO: 1508

SEQ ID NO: 34079 - DNA, 1092 bp, Shewanella oneidensis; identical to SEQ ID NO: 1509
  CDS (1)..(1092)

SEQ ID NO: 34080 - protein, 363 aa, Shewanella oneidensis; identical to SEQ ID NO: 1510

SEQ ID NO: 34081 - DNA, 1059 bp, Shewanella oneidensis; identical to SEQ ID NO: 1511
  CDS (1)..(1059)

SEQ ID NO: 34082 - protein, 352 aa, Shewanella oneidensis; identical to SEQ ID NO: 1512

SEQ ID NO: 34083 - DNA, 1170 bp, Corynebacterium efficiens; identical to SEQ ID NO: 1515
  CDS (1)..(1170)

SEQ ID NO: 34084 - protein, 389 aa, Corynebacterium efficiens; identical to SEQ ID NO: 1516

SEQ ID NO: 34085 - DNA, 1134 bp, Bifidobacterium longum; identical to SEQ ID NO: 1517
  CDS (1)..(1134)

SEQ ID NO: 34086 - protein, 377 aa, Bifidobacterium longum; identical to SEQ ID NO: 1518

SEQ ID NO: 34087 - DNA, 1233 bp, Bifidobacterium longum; identical to SEQ ID NO: 1519
  CDS (1)..(1233)

SEQ ID NO: 34088 - protein, 410 aa, Bifidobacterium longum; identical to SEQ ID NO: 1520

SEQ ID NO: 34089 - DNA, 1221 bp, Phytophthora infestans; identical to SEQ ID NO: 1521
  CDS (20)..(1153)

SEQ ID NO: 34090 - protein, 377 aa, Phytophthora infestans; identical to SEQ ID NO: 1522

SEQ ID NO: 34091 - DNA, 1062 bp, Chlorobium tepidum; identical to SEQ ID NO: 1523
  CDS (1)..(1062)

SEQ ID NO: 34092 - protein, 353 aa, Chlorobium tepidum; identical to SEQ ID NO: 1524

SEQ ID NO: 34093 - DNA, 1074 bp, Xanthomonas campestris; identical to SEQ ID NO: 1525
  CDS (1)..(1074)

SEQ ID NO: 34094 - protein, 357 aa, Xanthomonas campestris; identical to SEQ ID NO: 1526

SEQ ID NO: 34095 - DNA, 1074 bp, Xanthomonas axonopodis; identical to SEQ ID NO: 1527
  CDS (1)..(1074)

SEQ ID NO: 34096 - protein, 357 aa, Xanthomonas axonopodis; identical to SEQ ID NO: 1528

SEQ ID NO: 34097 - DNA, 1080 bp, Ralstonia solanacearum; identical to SEQ ID NO: 1529
  CDS (1)..(1080)

SEQ ID NO: 34098 - protein, 359 aa, Ralstonia solanacearum; identical to SEQ ID NO: 1530

SEQ ID NO: 34099 - DNA, 1179 bp, Ralstonia solanacearum; identical to SEQ ID NO: 1531
  CDS (1)..(1179)

SEQ ID NO: 34100 - protein, 392 aa, Ralstonia solanacearum; identical to SEQ ID NO: 1532

SEQ ID NO: 34101 - DNA, 1065 bp, Synechococcus sp; identical to SEQ ID NO: 1533
  CDS (1)..(1065)

SEQ ID NO: 34102 - protein, 354 aa, Synechococcus sp; identical to SEQ ID NO: 1534

SEQ ID NO: 34103 - DNA, 1035 bp, Escherichia coli; identical to SEQ ID NO: 1535
  CDS (1)..(1035)

SEQ ID NO: 34104 - protein, 344 aa, Escherichia coli; identical to SEQ ID NO: 1536

SEQ ID NO: 34105 - DNA, 1200 bp, Stigmatella aurantiaca; identical to SEQ ID NO: 1537
  CDS (62)..(1147)

SEQ ID NO: 34106 - protein, 361 aa, Stigmatella aurantiaca; identical to SEQ ID NO: 1538

SEQ ID NO: 34107 - DNA, 1083 bp, Amycolatopsis mediterranei; identical to SEQ ID NO: 1541
  CDS (1)..(1083)

SEQ ID NO: 34108 - protein, 360 aa, Amycolatopsis mediterranei; identical to SEQ ID NO: 1542

SEQ ID NO: 34109 - DNA, 1053 bp, Pasteurella multocida; identical to SEQ ID NO: 1543
  CDS (1)..(1053)

SEQ ID NO: 34110 - protein, 350 aa, Pasteurella multocida; identical to SEQ ID NO: 1544

SEQ ID NO: 34111 - DNA, 1086 bp, Pasteurella multocida; identical to SEQ ID NO: 1545
  CDS (1)..(1086)

SEQ ID NO: 34112 - protein, 361 aa, Pasteurella multocida; identical to SEQ ID NO: 1546

SEQ ID NO: 34113 - DNA, 1125 bp, Emericella nidulans; identical to SEQ ID NO: 1547
  CDS (1)..(1125)

SEQ ID NO: 34114 - protein, 374 aa, Emericella nidulans; identical to SEQ ID NO: 1548

SEQ ID NO: 34115 - DNA, 1089 bp, Emericella nidulans; identical to SEQ ID NO: 1549
  CDS (1)..(1089)

SEQ ID NO: 34116 - protein, 362 aa, Emericella nidulans; identical to SEQ ID NO: 1550

SEQ ID NO: 34117 - DNA, 1239 bp, Vibrio cholerae; identical to SEQ ID NO: 1551
  CDS (114)..(1175)

SEQ ID NO: 34118 - protein, 353 aa, Vibrio cholerae; identical to SEQ ID NO: 1552

SEQ ID NO: 34119 - DNA, 2184 bp, Candida albicans; identical to SEQ ID NO: 1553
  CDS (461)..(1573)

SEQ ID NO: 34120 - protein, 370 aa, Candida albicans; identical to SEQ ID NO: 1554

SEQ ID NO: 34121 - DNA, 1047 bp, Buchnera aphidicola; identical to SEQ ID NO: 1555
  CDS (1)..(1047)

SEQ ID NO: 34122 - protein, 348 aa, Buchnera aphidicola; identical to SEQ ID NO: 1556

SEQ ID NO: 34123 - DNA, 1047 bp, Buchnera aphidicola; identical to SEQ ID NO: 1557
  CDS (1)..(1047)

SEQ ID NO: 34124 - protein, 348 aa, Buchnera aphidicola; identical to SEQ ID NO: 1558

SEQ ID NO: 34125 - DNA, 1047 bp, Erwinia herbicola; identical to SEQ ID NO: 1559
  CDS (1)..(1047)

SEQ ID NO: 34126 - protein, 348 aa, Erwinia herbicola; identical to SEQ ID NO: 1560

SEQ ID NO: 34127 - DNA, 1047 bp, Salmonella typhimurium; identical to SEQ ID NO: 1561
  CDS (1)..(1047)

SEQ ID NO: 34128 - protein, 348 aa, Salmonella typhimurium; identical to SEQ ID NO: 1562

SEQ ID NO: 34129 - DNA, 1047 bp, Shigella flexneri; identical to SEQ ID NO: 2473
  CDS (1)..(1047)

SEQ ID NO: 34130 - protein, 348 aa, Shigella flexneri; identical to SEQ ID NO: 2474

SEQ ID NO: 34131 - DNA, 25 bp, Artificial sequence
  (1)..(25): primer
atgttcattaaaaacgatcacgccg

SEQ ID NO: 34132 - DNA, 25 bp, Artificial sequence
  (1)..(25): primer
ctattttttcaaggcctttcttctg

SEQ ID NO: 34133 - protein, 353 aa, Artificial sequence; identical to SEQ ID NO: 24922
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(37): xaa in position 37 is any amino acid
  Variant (39)..(46): xaa in position 39 to 46 is any amino acid
  Variant (51)..(51): xaa in position 51 is any amino acid
  Variant (54)..(56): xaa in position 54 to 56 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(168): xaa in position 166 to 168 is any amino acid
  Variant (171)..(171): xaa in position 171 is any amino acid
  Variant (174)..(174): xaa in position 174 is any amino acid
  Variant (176)..(176): xaa in position 176 is any amino acid
  Variant (181)..(181): xaa in position 181 is any amino acid
  Variant (183)..(183): xaa in position 183 is any amino acid
  Variant (185)..(188): xaa in position 185 to 188 is any amino acid
  Variant (190)..(191): xaa in position 190 to 191 is any amino acid
  Variant (193)..(195): xaa in position 193 to 195 is any amino acid
  Variant (197)..(199): xaa in position 197 to 199 is any amino acid
  Variant (201)..(201): xaa in position 201 is any amino acid
  Variant (203)..(208): xaa in position 203 to 208 is any amino acid
  Variant (210)..(215): xaa in position 210 to 215 is any amino acid
  Variant (217)..(217): xaa in position 217 is any amino acid
  Variant (220)..(222): xaa in position 220 to 222 is any amino acid
  Variant (224)..(225): xaa in position 224 to 225 is any amino acid
  Variant (230)..(238): xaa in position 230 to 238 is any amino acid
  Variant (241)..(269): xaa in position 241 to 269 is any amino acid
  Variant (271)..(271): xaa in position 271 is any amino acid
  Variant (274)..(274): xaa in position 274 is any amino acid
  Variant (277)..(277): xaa in position 277 is any amino acid
  Variant (279)..(282): xaa in position 279 to 282 is any amino acid
  Variant (284)..(285): xaa in position 284 to 285 is any amino acid
  Variant (287)..(292): xaa in position 287 to 292 is any amino acid
  Variant (294)..(296): xaa in position 294 to 296 is any amino acid
  Variant (298)..(305): xaa in position 298 to 305 is any amino acid
  Variant (307)..(307): xaa in position 307 is any amino acid
  Variant (309)..(309): xaa in position 309 is any amino acid
  Variant (312)..(315): xaa in position 312 to 315 is any amino acid
  Variant (317)..(317): xaa in position 317 is any amino acid
  Variant (319)..(334): xaa in position 319 to 334 is any amino acid
  Variant (337)..(337): xaa in position 337 is any amino acid
  Variant (339)..(339): xaa in position 339 is any amino acid
  Variant (342)..(342): xaa in position 342 is any amino acid
  Variant (344)..(345): xaa in position 344 to 345 is any amino acid
  Variant (347)..(348): xaa in position 347 to 348 is any amino acid
  Variant (350)..(352): xaa in position 350 to 352 is any amino acid

SEQ ID NO: 34134 - protein, 72 aa, Artificial sequence; identical to SEQ ID NO: 2906
  Variant (5)..(5): xaa in position 5 is Ile, Val, Ser or Leu
  Variant (6)..(6): xaa in position 6 is His or Asp
  Variant (7)..(7): xaa in position 7 is Asp or Asn
  Variant (8)..(10): xaa in position 8 to 10 is any amino acid
  Variant (11)..(11): xaa in position 11 is Ala, Val or Gly
  Variant (12)..(12): xaa in position 12 is any amino acid
  Variant (13)..(13): xaa in position 13 is Glu, Asp, Ala or Gln
  Variant (15)..(15): xaa in position 15 is Ala, Gly or Cys
  Variant (16)..(17): xaa in position 16 to 17 is any amino acid
  Variant (18)..(18): xaa in position 18 is Leu, Ile or Phe
  Variant (19)..(28): xaa in position 19 to 28 is any amino acid
  Variant (29)..(30): xaa in position 29 to 30 is any or no amino acid
  Variant (31)..(31): xaa in position 31 is Leu, Ile, Phe or Met
  Variant (32)..(32): xaa in position 32 is any amino acid
  Variant (33)..(33): xaa in position 33 is Ile, Val, Leu or Met
  Variant (34)..(34): xaa in position 34 is Val, Ile or Leu
  Variant (37)..(37): xaa in position 37 is Val, Ala or Thr
  Variant (39)..(39): xaa in position 39 is Phe, Leu, Thr or Val
  Variant (40)..(40): xaa in position 40 is Glu or Ala
  Variant (45)..(46): xaa in position 45 to 46 is any amino acid
  Variant (47)..(47): xaa in position 47 is any or no amino acid
  Variant (49)..(49): xaa in position 49 is Trp or Tyr
  Variant (50)..(50): xaa in position 50 is Lys or Arg
  Variant (52)..(52): xaa in position 52 is Leu, Phe, Met or Tyr
  Variant (53)..(53): xaa in position 53 is Ile, Val, Ala or Leu
  Variant (54)..(54): xaa in position 54 is any amino acid
  Variant (55)..(55): xaa in position 55 is Asp, Glu or Gln
  Variant (57)..(57): xaa in position 57 is any amino acid
  Variant (58)..(58): xaa in position 58 is Leu, Met, Ile, Val, Ala or Thr
  Variant (59)..(59): xaa in position 59 is Asp, Asn or Ser
  Variant (60)..(63): xaa in position 60 to 63 is any amino acid
  Variant (64)..(64): xaa in position 64 is Ile, Val, Leu or Met
  Variant (65)..(66): xaa in position 65 to 66 is any amino acid
  Variant (68)..(68): xaa in position 68 is Leu, Ile, Met or Val
  Variant (69)..(70): xaa in position 69 to 70 is any amino acid
  Variant (71)..(71): xaa in position 71 is Ala, Ser, Gly, Val or Thr

SEQ ID NO: 34135 - protein, 76 aa, Artificial sequence; identical to SEQ ID NO: 2907
  Variant (1)..(1): xaa in position 1 is Ala or Ser
  Variant (2)..(2): xaa in position 2 is Ile or Val
  Variant (6)..(6): xaa in position 6 is Thr, Ser or Asn
  Variant (7)..(7): xaa in position 7 is Thr, Val, Ala, Ser or Ile
  Variant (8)..(8): xaa in position 8 is Glu or Ala
  Variant (9)..(9): xaa in position 9 is Ser, Asp or Asn
  Variant (11)..(11): xaa in position 11 is any amino acid
  Variant (14)..(14): xaa in position 14 is Glu, Gln, Phe or Met
  Variant (15)..(15): xaa in position 15 is Leu, Met, Val, Phe or Ile
  Variant (16)..(16): xaa in position 16 is Ala, Ser, Thr, Cys or Val
  Variant (18)..(18): xaa in position 18 is Gly, Ala or Asn
  Variant (19)..(21): xaa in position 19 to 21 is any amino acid
  Variant (22)..(22): xaa in position 22 is Pro or Ala
  Variant (23)..(23): xaa in position 23 is Val, Ile, Thr or Leu
  Variant (25)..(25): xaa in position 25 is Phe, Met, Tyr or Ile
  Variant (28)..(28): xaa in position 28 is any amino acid
  Variant (29)..(29): xaa in position 29 is Thr, Ser or Arg
  Variant (30)..(30): xaa in position 30 is any amino acid
  Variant (32)..(35): xaa in position 32 to 35 is any amino acid
  Variant (36)..(36): xaa in position 36 is Ala or Met
  Variant (37)..(37): xaa in position 37 is any amino acid
  Variant (38)..(38): xaa in position 38 is Asp, Asn or Glu
  Variant (39)..(39): xaa in position 39 is Ala or Gly
  Variant (40)..(41): xaa in position 40 to 41 is any amino acid
  Variant (42)..(42): xaa in position 42 is Ala or Ser
  Variant (43)..(43): xaa in position 43 is Ala, Ser, Val or Thr
  Variant (44)..(46): xaa in position 44 to 46 is any amino acid
  Variant (47)..(47): xaa in position 47 is His or Gln
  Variant (48)..(48): xaa in position 48 is any amino acid
  Variant (49)..(49): xaa in position 49 is Phe, Tyr, His or Val
  Variant (50)..(51): xaa in position 50 to 51 is any amino acid
  Variant (52)..(55): xaa in position 52 to 55 is any or no amino acid
  Variant (57)..(60): xaa in position 57 to 60 is any amino acid
  Variant (61)..(62): xaa in position 61 to 62 is any or no amino acid
  Variant (63)..(63): xaa in position 63 is Thr or Ser
  Variant (64)..(64): xaa in position 64 is any amino acid
  Variant (67)..(69): xaa in position 67 to 69 is any amino acid
  Variant (70)..(70): xaa in position 70 is His or Phe
  Variant (71)..(71): xaa in position 71 is Val, Ile, Leu or Ala
  Variant (72)..(72): xaa in position 72 is Ile or Val
  Variant (73)..(73): xaa in position 73 is Leu or Met
  Variant (76)..(76): xaa in position 76 is Gly, Ala or Ser

SEQ ID NO: 34136 - protein, 83 aa, Artificial sequence; identical to SEQ ID NO: 2908
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is Cys, Phe, Ala, Thr or Tyr
  Variant (6)..(6): xaa in position 6 is Ser, Asn or Ala
  Variant (8)..(8): xaa in position 8 is Gly, Ala or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(26): xaa in position 21 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(32): xaa in position 32 is any amino acid
  Variant (33)..(37): xaa in position 33 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid
  Variant (53)..(57): xaa in position 53 to 57 is any amino acid
  Variant (58)..(69): xaa in position 58 to 69 is any or no amino acid
  Variant (71)..(71): xaa in position 71 is any amino acid
  Variant (73)..(73): xaa in position 73 is Ile or Val
  Variant (76)..(76): xaa in position 76 is any amino acid
  Variant (78)..(78): xaa in position 78 is Ile, Leu or Val
  Variant (79)..(79): xaa in position 79 is any amino acid
  Variant (80)..(80): xaa in position 80 is Trp, Ile, Leu or Phe
  Variant (81)..(82): xaa in position 81 to 82 is any amino acid
  Variant (83)..(83): xaa in position 83 is Thr or Ser

SEQ ID NO: 34137 - DNA, 2970 bp, Saccharomyces cerevisiae
  CDS (1)..(2970)
atgttgcggtttcagcgatttgcgtcctcgtatgcccaagcacaggccgttagaaaatatccagttggaggtatattccatggttatgaagtgagaagaattctaccggttccggagctgagactcactgcggtagatttggtgcactcccagacaggagccgagcatttgcatattgatagagacgacaagaataatgtgttcagcattgcttttaaaaccaaccctccagattccactggggtccctcatattctagagcatacaacgttgtgtgggtctgttaaatatccagttagggacccttttttcaaaatgctaaataaatctctagctaatttcatgaacgctatgacaggtccagattatacattttttcccttttccactacgaaccctcaagatttcgctaatttaagaggtgtttatttagactccaccttgaatccgctacttaaacaagaagattttgatcaggagggttggaggttggagcataaaaacatcacagacccggagagtaacattgttttcaaaggtgttgtctataacgaaatgaaaggtcaaatatcaaatgccaattactatttctggagtaaatttcaacagtctatttatccttccctgaataactccggcggagatcctatgaaaattacagacttgagatacggcgatctcttggatttccatcacaaaaattaccatccctccaatgcaaaaactttcacgtacggtaacttgccattggtggatacgttaaagcaattaaatgagcagttcagtggttacgggaagagagctcgaaaggataagttgttaatgcctattgatttaaaaaaagacatagatgtcaagttactgggtcaaatagatactatgcttccaccggagaagcagacaaaagcctcaatgacgtggatttgtggagcgccacaggacacatatgatacctttttgttaaaagtactggggaatttattaatggatggccattcttctgtaatgtatcaaaaattaatagaatcaggaattggtttggagttctccgtaaattcaggtgttgaaccaactacagcagtaaatttgctaactgttggtatacagggcgtgagtgatattgaaatatttaaagacactgtaaataatatttttcaaaacctgttggaaacagaacatccttttgaccgcaagcgtatcgatgccataattgaacaattggaattatctaagaaggatcaaaaggctgactttggacttcaattactctattctatactacctggttggacaaacaaaatcgatccttttgagagcttgttgtttgaggacgttttgcaaagatttagaggtgacttagaaacgaaaggtgatactttattccaagatttaatccgtaaatatatcgttcataaaccttgtttcacgttttccattcagggatctgaagagttctctaaatctttggatgatgaagaacaaacaagactgagagaaaaaattactgccttggatgaacaagacaagaaaaacatctttaaacgtggtatactgttacaggagaaacaaaatgaaaaagaagatttatcctgtttacctaccttacaaataaaagacatcccaagagctggtgataaatattcaatcgaacagaagaataatacaatgtctaggattactgataccaatggtatcacatatgtcagaggtaaacgtttactaaatgacataataccctttgaactcttcccatacttacctttatttgctgaatcgttaactaacctagggacaacaacagaatccttcagtgaaatagaagatcagataaaattacatacgggtggtatatcaacacatgtagaggttacatctgaccctaacaccacagagcctcgcctgattttcgggtttgacggatggtctttaaattcgaagaccgaccacatttttgaattctggtctaagatcttactagaaactgatttccataaaaacagcgataaattgaaagttcttatccgcttattagcatcttcaaacacatcttctgtagcagatgccggtcatgcatttgcaaggggctattctgccgcacattatagatcaagtggagctataaatgagaccctcaatggtattgagcaactacaatttataaatagattgcacagcttgttagacaatgaagaaactttccaaagagaagttgtcgacaagctaactgaattgcaaaagtacattgttgataccaataacatgaatttttttatcacctcagactctgatgttcaagcgaaaacagtagaaagccaaatttcaaaattcatggagagattacctcatggcagctgcttgcccaatggaccaaagacttcagattatcctcttattggatccaaatgtaaacatactttgataaaatttcctttccaggtccattacacatcccaagctttattgggtgtgccgtatacacataaggatggctctgcacttcaagttatgtcaaatatgctaacattcaaacatttgcacagagaagtcagagaaaagggtggtgcttatggtggtggtgcttcttatagcgccttagcgggtattttcagtttctattcctatagggatcctcagcctttgaagagtttagaaaccttcaagaatagcgggcgttatatactgaacgatgccaagtggggcgtcacagaccttgatgaagctaaattgacaatatttcaacaagtagacgcacctaaaagtcccaaaggagaaggcgtgacgtatttcatgagcggtgttacagacgatatgaaacaagcaagaagggaacaactcttagacgtatctctcctggacgttcatagagtcgccgaaaaatatctactaaacaaagaaggggtgagtacggtcattggacctggaatcgaggggaagactgtttcaccaaattgggaggtgaaggaactgtag

SEQ ID NO: 34138 - protein, 989 aa, Saccharomyces cerevisiae
MLRFQRFASSYAQAQAVRKYPVGGIFHGYEVRRILPVPELRLTAVDLVHSQTGAEHLHIDRDDKNNVFSIAFKTNPPDSTGVPHILEHTTLCGSVKYPVRDPFFKMLNKSLANFMNAMTGPDYTFFPFSTTNPQDFANLRGVYLDSTLNPLLKQEDFDQEGWRLEHKNITDPESNIVFKGVVYNEMKGQISNANYYFWSKFQQSIYPSLNNSGGDPMKITDLRYGDLLDFHHKNYHPSNAKTFTYGNLPLVDTLKQLNEQFSGYGKRARKDKLLMPIDLKKDIDVKLLGQIDTMLPPEKQTKASMTWICGAPQDTYDTFLLKVLGNLLMDGHSSVMYQKLIESGIGLEFSVNSGVEPTTAVNLLTVGIQGVSDIEIFKDTVNNIFQNLLETEHPFDRKRIDAIIEQLELSKKDQKADFGLQLLYSILPGWTNKIDPFESLLFEDVLQRFRGDLETKGDTLFQDLIRKYIVHKPCFTFSIQGSEEFSKSLDDEEQTRLREKITALDEQDKKNIFKRGILLQEKQNEKEDLSCLPTLQIKDIPRAGDKYSIEQKNNTMSRITDTNGITYVRGKRLLNDIIPFELFPYLPLFAESLTNLGTTTESFSEIEDQIKLHTGGISTHVEVTSDPNTTEPRLIFGFDGWSLNSKTDHIFEFWSKILLETDFHKNSDKLKVLIRLLASSNTSSVADAGHAFARGYSAAHYRSSGAINETLNGIEQLQFINRLHSLLDNEETFQREVVDKLTELQKYIVDTNNMNFFITSDSDVQAKTVESQISKFMERLPHGSCLPNGPKTSDYPLIGSKCKHTLIKFPFQVHYTSQALLGVPYTHKDGSALQVMSNMLTFKHLHREVREKGGAYGGGASYSALAGIFSFYSYRDPQPLKSLETFKNSGRYILNDAKWGVTDLDEAKLTIFQQVDAPKSPKGEGVTYFMSGVTDDMKQARREQLLDVSLLDVHRVAEKYLLNKEGVSTVIGPGIEGKTVSPNWEVKEL

SEQ ID NO: 34139 - DNA, 2973 bp, Eremothecium gossypii
  CDS (1)..(2973)
atgttgaggttccaacgaacagtgccacgagtggccataaggaggcttgcgaatgtatattcggagggagcagtactgcacgggtacaaggtgcggcgggcgcaagagattccagagatgcgaatggctgcggtggagctggagcacgagatgaccggggccagacacctacacctggagcgagaggaccagaacaacgttttcagtgtcgggttccggactccgccgcccgatgcgacgggggtgccgcacattcttgagcacacgacgctgtgcgggtcgcagaagtacccggtgcgggatccgttcttcaagatgctgaaccggtcgctggcgaacttcatgaatgcgatgacggcgcacgaccacacattctacccgtttgcaacgacgaaccaaaaggactttgcgaacctgcgggacctgtacctggacgcgacgcttcggccgctgctgcggcacgcggactttctgcaggaggggtggaggctggagcaccgggacgtcggggacgcgagcagcgagctggtcttcaagggcgtagtgtacaacgagatgaagggccaggtgtcgaacgcggactactacttttggatccggttccaggaggccatctatccggcgctgcacaactcgggcggcgacccggagcacatcaccgacctgagctacgaggatcttgtggcttttcaccagaaccactaccatccgtcgaacgcgaagacgttcacgtatgggaacttcccgcttcgcgatacgctgcgcaagctggacgacgaattccgcggcttcgggcgccgcgcgatcccgcagatgcacgagaagccgttgcagctgcgcgaggctgtgtcggtggaggagccctgccagatcgatcctatgctccccgcagataaacagtgccgcacatccatgacgtggatatgcggaaacccgaatgatgtatacgagacattcctgttgaagattctcgggtctctgttgtttgatggtcattcttcggccttttacaagaagctggtcgaggaaactggacttgcgtatgagctgtcagtgaacacgggtgtggaatcccagacggcggcaaacttcttgaccgtcggtgtgcaaggatgcaccaatgtaggcaaggtccataaggttattatggagaccttcacggcgcttttggcccagccctttgagaaacacagggtcgaagcaatcctgcaccaactagagctctccaaaaaggatcagaagtctgactttggcctccaactgctgtacggcatcctcccaggatgggtcaacaacacagatccgttcgatctcttatctttgaacagtgcactgcagagattcagggccgactgggacagagagggcgatggtttgttccagcgcctgctgaacaagtacgtaattggcaagcccagtttcacgtttaccatggtgggcagttcggactttaaccaggtgaaggaccaaaacgagcagtcgaaactaaaggcgaaggtgtcctcgttaaccgagagtgataaggaagtgatttacaagcgtggtttgcatcttcaggaactgcagaatagtgagcaggacctttcaaaactaccaacgttgaccacagcggacatccctcattcgagtgggcactattttgtttctcgcgacggaccgatcacaactcgtcaaactgacacgaacggtataacgtacattagaatgaagcgtccgctcaagggagccataccttacgatgcatatccctacatcccactttactccgacggactaatgaacatcggcaccctacttgaagatgcctctgcaattgaggagcagattcgtctgcacacaggtgggatctccgtgtccataggtgtccatccaaacgtcgaaactcgcctttctgagctgtatctggaaatcagtgcctgtgcattgaattctaaaacgcagtatgtgtttgacataataaacaaaattatgaacgagacagccctcagcgttaggtcggagaagatgaaggtcttgattagggccgctgcatcctccttcacgtcctacgcagctgaaaacggacatgatttggccaggctacataccggagcccatttttcgcagactcaggcaattatggagcagactgctggtattgagcaagtgcgccacatgaacaacctcatgagtataattgaaaaagaggcagagttcaacactgtcctccagaacttggaagccatgcatcgtaagatctttgtcgcggatggcttggaggtgatgatcacaactgacaaccggcaaacgtcggacgtcgtcaaagatcaggctttgaagttcattgctggtgtgcagcagtcagcaggcgcggaatcctggcttccggaaaagtattcccgccgcgcgctcgagaagccgtacccggcactgcttcagttcccattccaggtacactatactgcccagtccacccaaggtgtctcctacacccatccagatggcgcacatctccaggtcttggcgtcgctgcttacgtttaagcacctgcatcgcgaagtacgcgagaagggcggcgcgtacggcggaggcgctacgtacaacgccacagatggtatcttcaacttcttctcgtacagggatccgcagcccgttcgctctctcaacatcttcagaaacgcagggaaatacgtgctgaatgaggcccgttggacggcggacgacctcaatgaggccaaactgagtatctttcagcgcgtggacgccccgatcagccccagctcggaggggctgctccagttccggcataacatcagcgatgaacagcgcgacagacgtcgccagcagctgctaaaatcaacgcttgacgacgtccgtcgtgttgcagacatttatcttgtgcagccgtctccttcgcaacatatgagtgctgtggttggcccagaacttccccgcgaagtttggtcgagccaatggccagtgataaaagtctga

SEQ ID NO: 34140 - protein, 990 aa, Eremothecium gossypii
MLRFQRTVPRVAIRRLANVYSEGAVLHGYKVRRAQEIPEMRMAAVELEHEMTGARHLHLEREDQNNVFSVGFRTPPPDATGVPHILEHTTLCGSQKYPVRDPFFKMLNRSLANFMNAMTAHDHTFYPFATTNQKDFANLRDLYLDATLRPLLRHADFLQEGWRLEHRDVGDASSELVFKGVVYNEMKGQVSNADYYFWIRFQEAIYPALHNSGGDPEHITDLSYEDLVAFHQNHYHPSNAKTFTYGNFPLRDTLRKLDDEFRGFGRRAIPQMHEKPLQLREAVSVEEPCQIDPMLPADKQCRTSMTWICGNPNDVYETFLLKILGSLLFDGHSSAFYKKLVEETGLAYELSVNTGVESQTAANFLTVGVQGCTNVGKVHKVIMETFTALLAQPFEKHRVEAILHQLELSKKDQKSDFGLQLLYGILPGWVNNTDPFDLLSLNSALQRFRADWDREGDGLFQRLLNKYVIGKPSFTFTMVGSSDFNQVKDQNEQSKLKAKVSSLTESDKEVIYKRGLHLQELQNSEQDLSKLPTLTTADIPHSSGHYFVSRDGPITTRQTDTNGITYIRMKRPLKGAIPYDAYPYIPLYSDGLMNIGTLLEDASAIEEQIRLHTGGISVSIGVHPNVETRLSELYLEISACALNSKTQYVFDIINKIMNETALSVRSEKMKVLIRAAASSFTSYAAENGHDLARLHTGAHFSQTQAIMEQTAGIEQVRHMNNLMSIIEKEAEFNTVLQNLEAMHRKIFVADGLEVMITTDNRQTSDVVKDQALKFIAGVQQSAGAESWLPEKYSRRALEKPYPALLQFPFQVHYTAQSTQGVSYTHPDGAHLQVLASLLTFKHLHREVREKGGAYGGGATYNATDGIFNFFSYRDPQPVRSLNIFRNAGKYVLNEARWTADDLNEAKLSIFQRVDAPISPSSEGLLQFRHNISDEQRDRRRQQLLKSTLDDVRRVADIYLVQPSPSQHMSAVVGPELPREVWSSQWPVIKV

SEQ ID NO: 34141 - DNA, 3039 bp, Neurospora crassa
  CDS (1)..(3039)
atgctgcgcaacgcgaccaaaggtgcagcgcgccgcgccgtcaccgagctctcccagtacccgaaacccggcgagaaactccacggcttcacccttctccggtcaaagcatgtcccggagctggagttgactgctttgcacttgcaacacgacaagaccggagcagagcatttgcacattgcccgtgacgacagcaacaatgtcttctctatcggcttcaaaacgaatcccccggacgacaccggtgtcccacatatcctggagcacaccactctgtgtggcagccaaaaataccctatccgagaccccttcttcaagatgcttccgcgaacgctttcgaatttcatgaacgcctttacagcatcagatcacaccttttacccgttcgccaccaccaatgctcaggactttaagaacctcatgtctgtctaccttgacgcgactctgcatcctctcttgaaggagacggactttacacaggaaggatggcgtattggacccgagaatccccaggctcttgttgcggctgagggcaacgcaaagcccgaggacaggaagcttgtcttcaagggtgtcgtttataacgagatgaaggggcagatgtcggatgctgcctacctcttctggattcggttccaagaccacattttcccagacatccacaactctggtggtgatccccagaaaatcacagacttgacataccaacagctcaagaagttccatgctgatcactaccacccgagcaacgccaaagtctttacttatggcgatatgccactggcagatcacttgaaggaaatcggtgcccagctcgacgtatttgagaagatccgggctgatgtggcacaccatagccctatcgacctcagcagtggccccagggaagtcaagctctatggacctattgacccccttgtggacgccaataagcagttcaagacttccgtttcgtgggttctgggtgaaaccaacaatgtcgtcgagtccttttcgctggcgctgatttctgctctgctcatggatggttatggctcgcctctctacaagggattgattgaatccgggctaggaacggactggagccccaacaccggatatgacagttcgggcaagcttggtatcttctccattggcctcagcggtgttcaagaagaagatgtgcccaaggtcaaggccaaggtacaggagattcttcgcagcatgcgggacaagggttttgagagatcaaagattgatggctatctccaccagcttgagctcggccttaagcacaagactgccaactttggcatgtctttgctccaccgtttgaagccaaagtggtttgttggagtcgatccatttgactctcttgcctggaacgacacgattgctgcttttgagaccgagcttgccaaaggtggttatcttgagggcttgattgataagtatctgatcaacgacaatactctctccttcacgatggcgccttcgccaacctttagccaggagctggcccaagaggaggaaactcgcttaagcaccaagatttcggaagttgtcaaagctgctggtagcgaagaggaagctcgtgctgctctcgaagctcgggaactcaaattgttggccgagcaaagcaagaccaacaccgaagatcttggctgccttcctagcgtgcatgtcaaggacattccccgccagaaggactcggttatcttgagacacgataacacagcaagagtcaagacacagtggcacgaggctcccacgaacgggctgacctacttccgtgctatcaatcagctggagaacctgcccgatgagctccgaagcctgatccccctcttcactgactccatcatgcgtttgggtacgaaggacatgacaatggagcagcttgaggatttgatcaagctcaaaactggaggtgtctcggtcggctaccattcggcttctcatccaactgacttcactcgggccacagaaggtctgatgttctcgggcatggcattggatcgtcatgtgccaacgatgtttgaccttttgcgcaagctggtcgtagagactgacttcgacagtcctcaagcagctcaacagatccgtcagctgttgcaagcatctgctgatggcgtcgtgaacgacattgcttcatcgggacacgcttacgctcggagagccgccgaatctggccttacgtgggattccttcctcaaggagcaggttagcggtctctcgcaggtaaagctggtgactagcttggcaagccggcccgagtcagacccgttggaggatgttattgcaaagctgaagcaaatccaacagttcgcactggctggcaatctccgtaccgccatcacctgcgacagcggaagtgtctctgacaacgcaaaggcgctcttaaattttgtcaactcgctgccttcggaagcggtgaccttcccaagccggggaccccctaactttacccgtgatatcaagacgttttatcccttgccttatcaggtttactatggtgctttagcccttcctacggcttcttacacggcttccgtgaatgcccctctccagattctctcgcagctcttgacccacaagcacttgcatcacgagattcgtgagaagggtggcgcctacggcggcggatcttacgcccgccccctcgacggtatcttcggcttctactcgtaccgcgaccctaatcctgtgaacacgctcaaaatcatgcggaacgctggccagtgggcggttgacaaggagtggactgatcgtgatcttgaggatgccaagatctctgtcttccaaggcgttgacgcacccaaggctgttaatgaagaaggcatggcccaattcctctacggcattaccgacgagatgaaacagaagcgccgcgaagagctcttggatgtcaccaaggatcaggtccgggaagtggcgcaggagtatgttgtcaaggcccttaacaacggctctgagcgtgtcgtcttccttggcgagaagcgcgactgggtcgacaagtcttgggcggtcaaagagatggacatcaacggttccacttag

SEQ ID NO: 34142 - protein, 1012 aa, Neurospora crassa
MLRNATKGAARRAVTELSQYPKPGEKLHGFTLLRSKHVPELELTALHLQHDKTGAEHLHIARDDSNNVFSIGFKTNPPDDTGVPHILEHTTLCGSQKYPIRDPFFKMLPRTLSNFMNAFTASDHTFYPFATTNAQDFKNLMSVYLDATLHPLLKETDFTQEGWRIGPENPQALVAAEGNAKPEDRKLVFKGVVYNEMKGQMSDAAYLFWIRFQDHIFPDIHNSGGDPQKITDLTYQQLKKFHADHYHPSNAKVFTYGDMPLADHLKEIGAQLDVFEKIRADVAHHSPIDLSSGPREVKLYGPIDPLVDANKQFKTSVSWVLGETNNVVESFSLALISALLMDGYGSPLYKGLIESGLGTDWSPNTGYDSSGKLGIFSIGLSGVQEEDVPKVKAKVQEILRSMRDKGFERSKIDGYLHQLELGLKHKTANFGMSLLHRLKPKWFVGVDPFDSLAWNDTIAAFETELAKGGYLEGLIDKYLINDNTLSFTMAPSPTFSQELAQEEETRLSTKISEVVKAAGSEEEARAALEARELKLLAEQSKTNTEDLGCLPSVHVKDIPRQKDSVILRHDNTARVKTQWHEAPTNGLTYFRAINQLENLPDELRSLIPLFTDSIMRLGTKDMTMEQLEDLIKLKTGGVSVGYHSASHPTDFTRATEGLMFSGMALDRHVPTMFDLLRKLVVETDFDSPQAAQQIRQLLQASADGVVNDIASSGHAYARRAAESGLTWDSFLKEQVSGLSQVKLVTSLASRPESDPLEDVIAKLKQIQQFALAGNLRTAITCDSGSVSDNAKALLNFVNSLPSEAVTFPSRGPPNFTRDIKTFYPLPYQVYYGALALPTASYTASVNAPLQILSQLLTHKHLHHEIREKGGAYGGGSYARPLDGIFGFYSYRDPNPVNTLKIMRNAGQWAVDKEWTDRDLEDAKISVFQGVDAPKAVNEEGMAQFLYGITDEMKQKRREELLDVTKDQVREVAQEYVVKALNNGSERVVFLGEKRDWVDKSWAVKEMDINGST

SEQ ID NO: 34143 - DNA, 2967 bp, Magnaporthe grisea 70-15
  CDS (1)..(2967)
atgctgcggcgcgcagcactaggcgcgaggggcgccggcaggtcttatgcaaccgtcacccagcagtttccgcagccaggcgaacgcctccatggcttcacaatgaagcgcatcaagcacgttcccgagctcaaactcacggccttggagcttcaacacgacaaaacaggtgccgaacacttgcacatcgctaggaacgacagcaataatgtcttttctattggtttcaagacaaatcccccggatgacacgggtttgcctcatatcctcgagcataccactctttgtggaagcgaaaaatatcccatacgagatccgttcttcaagatgctcccaaggacgttgtccaactttatgaacgccttcacagcgtctgaccataccttttaccccttcgcaactaccaatgccaaagactttcagaacctcatgtccgtatacatggacgccacactcaacccattattgaaaaagaccgacttttggcaagagggatggagggttggaccagaaaaccccgaggccctagctgctgcgggcgcagaagccacaccggaagacaagcgcctggtcttcaagggagtcgtatacaacgagatgaagggtcaaatgtcggatgcttcctatctgttctacatccgcttccaggaccacatctttcccgatataaacaactctggtggcgacccccaaaagatcacagacctgacttacgagcagctcaagcgcttccacgcggaccactaccacccaagcaacgccaaactcttcacatacggtgacatgccgcttgctgatcatttgcaggaaatcgatgcccagttgagcgcctttaacaaactctcgtcggaagacgtggccaagtcgtctgtatcctgggtattgggtgatacgggagacattgtggagtcgttttcactgtccctgatttcggctctacttatggacggttacggttctcccatgtacaagggtctcattgagtctggtctcggcatagcttggactcccaactctggctatgacaattcggcgaaagacggcatattctccattggtttgactggccttcaggagcaggatgtgcctaaagtcaagaccgaggtccaaagaatactccgggaggcttgtgaacaaggcttcaagaggtccaagattgatggctacttgcatcagatcgagctgggacttaagcacaagactgccaactttggaatgtctttattgcagcgggtcaagccaaagtggttcaacggtgtcgatgtgtttgacacgcttgcctggaacgaaaccattgaagcatttgagaacaaaatggccgagggaggttatctcgagggattgatggaccgctacctcctcaacgataacactttgaccttcaccatgacaccttctgccgactttggcgcagaactgggcaaggaggaagagaccaggctggcggccaaaatttctgaagtccgagaaagcttgggcggtgaagcagaggcacaaaaggcactcgaagaacgagagctccaactacttgccgaacagagcaagtcaacttccgaagacctcagctgcctccctaccgtgcgcgtatctgacatacccagacggaaagagccggcagtcgtgagacacgacgagactgacggcttcaggaccatgtggcacgaggcgccaactaatggcttgacttacttccgttccatcaacacgttcgagaacctcccacaagacttgcgcgagatgattcctttgttcacagatgcgataaatcgtcttggaaccaaggatctaacgatggaagagctggaagaccgtataaaactactcactggtggcaacctgtcagttggttaccacgccgcgtcgtctccaaacgattttacgcaggcatctgaaggccttacattcagcgggatggtcttggaccgaaatgttcaagaaatgtacgagcttctgcggctgttggttctggaaacgaactttgacagcccggatgccgtctctcacatccggcaattgttgaaggcgtctacggaggaagcgataaaccagatcgccgactcaggccattcgtacgcacgatcggctgccgaggctggtttgagtaccaagaatcattacaacgagcaagttggtggattgtcacagatcaagcttctcacatctctggccggtagaccggagtcagatcagctggaagacgttattggaaaactcaagaccattcagcgtctggcattcaacgccgacagcatgcgcacctttatcacgtgcggtagcgaaagtgtccagcagaaccagacagcgctttccaaattcataggtactctgcccaggaataacagtgtcaacttgtcgtccactggacagaccgcccaaagctttgcaagggatgtcaaggctttttacccattgccttaccaggtctactacggcgcacttgccgtccccacgtcttcgtatacctcgaaagacagcgcgccgctgctcatcctgtcgcagatgctcacgcacaggcacctgcaccacgagattcgtgagaaaggtggtgcctatggtggtggtgcatacgcacgctcgctggaaggcatcttcggcttctattcgtaccgggacccgaacccagtaaataccctcaagatcatgcgcaatgccggccgttgggccgttgacaagcagtggacagatcgtgatcttgaggaggccaagatctctgtgttcaagagcgttgacgcacccaaggacatcaacgcggagggcatgggtcagttcctttacggcgtcaccgaagagatggctcatgaacgccgggctcgtctcctcgatgtcacacgcgaacagatacaagaggtggcaaacaagtatgtcgtcgaatcgcttgacaaacaggccgagagggtcgccttcctcggtcagaaggcggactgggtcgacggttcttgggccacaaaagagatgaacgtcgactag

SEQ ID NO: 34144 - protein, 988 aa, Magnaporthe grisea 70-15
MLRRAALGARGAGRSYATVTQQFPQPGERLHGFTMKRIKHVPELKLTALELQHDKTGAEHLHIARNDSNNVFSIGFKTNPPDDTGLPHILEHTTLCGSEKYPIRDPFFKMLPRTLSNFMNAFTASDHTFYPFATTNAKDFQNLMSVYMDATLNPLLKKTDFWQEGWRVGPENPEALAAAGAEATPEDKRLVFKGVVYNEMKGQMSDASYLFYIRFQDHIFPDINNSGGDPQKITDLTYEQLKRFHADHYHPSNAKLFTYGDMPLADHLQEIDAQLSAFNKLSSEDVAKSSVSWVLGDTGDIVESFSLSLISALLMDGYGSPMYKGLIESGLGIAWTPNSGYDNSAKDGIFSIGLTGLQEQDVPKVKTEVQRILREACEQGFKRSKIDGYLHQIELGLKHKTANFGMSLLQRVKPKWFNGVDVFDTLAWNETIEAFENKMAEGGYLEGLMDRYLLNDNTLTFTMTPSADFGAELGKEEETRLAAKISEVRESLGGEAEAQKALEERELQLLAEQSKSTSEDLSCLPTVRVSDIPRRKEPAVVRHDETDGFRTMWHEAPTNGLTYFRSINTFENLPQDLREMIPLFTDAINRLGTKDLTMEELEDRIKLLTGGNLSVGYHAASSPNDFTQASEGLTFSGMVLDRNVQEMYELLRLLVLETNFDSPDAVSHIRQLLKASTEEAINQIADSGHSYARSAAEAGLSTKNHYNEQVGGLSQIKLLTSLAGRPESDQLEDVIGKLKTIQRLAFNADSMRTFITCGSESVQQNQTALSKFIGTLPRNNSVNLSSTGQTAQSFARDVKAFYPLPYQVYYGALAVPTSSYTSKDSAPLLILSQMLTHRHLHHEIREKGGAYGGGAYARSLEGIFGFYSYRDPNPVNTLKIMRNAGRWAVDKQWTDRDLEEAKISVFKSVDAPKDINAEGMGQFLYGVTEEMAHERRARLLDVTREQIQEVANKYVVESLDKQAERVAFLGQKADWVDGSWATKEMNVD

SEQ ID NO: 34145 - DNA, 3015 bp, Gibberella zeae PH-1
  CDS (1)..(3015)
atgcttcgcaacgccgctgctggcgctcgcaaggccgtgacggagctgtcacaattcccaaaacctggcgagaagctccacggtttcacccttgttcgatccaagcacgtcccggagctcgagttgacggctctacaccttcaacacgacaagaccggcgccgactatctccatatcgctcgtgatgacagcaacaatgtcttctcaatcggtttcaagacgaaccctccggatgataccggtattcctcatatcctcgagcacaccacgctgtgcggtagcgaaaaataccccattagagatccctttttcaagatgttgccacgaacgctatcgaacttcatgaacgccttcacagcctcggatcacaccttctaccccttcgcaacaaccaacgcgcaagatttcaagaacctcatgtctgtgtatctggactcaacgttgcatccgctgctcaaaaagtccgactttacccaggagggctggagaattgggccggagaacccccttgctgaggacgaggcgagcaagaagcttgtgttcaagggtgttgtgtacaacgagatgaagggccaaatgtcggacgctggctacctatactatatccgatttcacgatcatattttccccgatatcaacaactctggtggcgatccccagaagatcaccgacctcacatacgagcaactgcaaaagttccatgcggaacactaccaccctagcaacgccaaggtcttcacctatggtgatatgcccctgatcgaccacctcaagcaggttgacacgcagctccaagctttcgagaagattcaaggcgataagcaggttcatgagccagttactctcaatggccccaaggaagtgaccctctacggtcccctcgacccccttgttgatcaagatcgccagtacaagacgtccgtctcatggattatgggcgataccactgatgttctcgaatcattttctctggctcttctttccactcttttgatggatggttacggttcccccctataccgtggtcttatcgaggctggtatgggagctgattggagccctaacgccggctatgacagttctgccaagaagggcatcttctccattggcttgactggtgtccaggagggtgatgtgcccaagctcaaggagaaagttcagcaaatcttgcgagatgcgcgcaacaagggtttcgacaagaccaagattgacggctccctgcaccaattggagctgtcgctgaagcataagactgccaactttggtttctctatgctgaaccgtcttaagccaaagtggttcaacggtgtcgaccctttcgactcattggcatggaatgacaccatcaatggcttccaggccaagatggccgagggcaactacttggagggtcttattgacaagtacctcctcaacgataatactctgactttcactatggccccttcaacaacttatggtgaggacttggtaaaggaggagcaggagaggctttcaactagaatccaggcggcgatcaaggaggctggaagcgaggagaaggcgcgaaagcacttcgagaagcaagagcaagaattgttggtcgagcaaaacaagacaaacaccgaagatcttggttgcttgccaactgtccatgtcaaggatattccccgaagcaaagaggctgttgttgttcgagacgagaacgccaacggaacaaagatccaatggcacgaggcacccaccaacggcttgacatacttccgtgctatcaacacgctggagaacttgccagatgagcttcgtgagttggttcctctgttcactgacagcatcatgcgcctcggtaccaaggacttgaacatggaacagcttgaggatttgatcaagcttaagactggcggcgtttcggttggataccactgcacaccatctcccacagatttccatgctgccagtgagggcatcatctttactggtatggcattggaccacaacgttcctgttatgtttgacatcatccagaaactcgttttgggaaccgacttcgatagtcctgaagctgcccttagaattcgccagcttctccaggcttctgctgacggtgttgttaatgacattgcatcaaccggacacagatttgccatgggaagcgcagagtctggtctcacccgatctgcgtggttgcgacagcaagtgtctggtctttcacaagtgcagctggtgacttcgctggccagccgccctgagactgataagcttgaggacgtcatctctaagctaaagcagattcagaaccttgcacttgtcggtggaaatctccgcaccgcgatcacttgtggctcggagagcgttgcggcaaacggggcttcgctgcagaactttgtgggcaacctttctcgtgaccccttgaacttgaagaacccttcgccccgacagcttcccaaggatagcaagaccttctaccctctaccttaccaagtctactatggtggattatcactaccgaccacctcatacacatcggcagagggtgcacctcttcaaattctgtcccagctcctcacacacaagcatcttcatcatgagatccgtgagaagggtggcgcatacggtggcggtgcttactctcgagccttggacggcctcttcggcttctactcttaccgggatcccaacccccagaacaccctcagcatcatgcgaaatgctggccaatgggctgtcgataagaagtggtcagaccgcgatttggaggaggccaagatctctgtgttccaaggagtcgatgcgcccaagtctgtgaaccaggagggcatgggccgtttcctctcgggcatcaccgaagagatgaagcagaagaagcgagagcagtttctggatgttaccaaggatcaggttcgcgaggctgcgcagcgttaccttgttgacggactggccaagggtgaaggccgagtggctttccttggagagaagcaggcgtgggttgacggcgagtggcagatccgcgagatggatgtcaagggcgctgagtaa

SEQ ID NO: 34146 - protein, 1004 aa, Gibberella zeae PH-1
MLRNAAAGARKAVTELSQFPKPGEKLHGFTLVRSKHVPELELTALHLQHDKTGADYLHIARDDSNNVFSIGFKTNPPDDTGIPHILEHTTLCGSEKYPIRDPFFKMLPRTLSNFMNAFTASDHTFYPFATTNAQDFKNLMSVYLDSTLHPLLKKSDFTQEGWRIGPENPLAEDEASKKLVFKGVVYNEMKGQMSDAGYLYYIRFHDHIFPDINNSGGDPQKITDLTYEQLQKFHAEHYHPSNAKVFTYGDMPLIDHLKQVDTQLQAFEKIQGDKQVHEPVTLNGPKEVTLYGPLDPLVDQDRQYKTSVSWIMGDTTDVLESFSLALLSTLLMDGYGSPLYRGLIEAGMGADWSPNAGYDSSAKKGIFSIGLTGVQEGDVPKLKEKVQQILRDARNKGFDKTKIDGSLHQLELSLKHKTANFGFSMLNRLKPKWFNGVDPFDSLAWNDTINGFQAKMAEGNYLEGLIDKYLLNDNTLTFTMAPSTTYGEDLVKEEQERLSTRIQAAIKEAGSEEKARKHFEKQEQELLVEQNKTNTEDLGCLPTVHVKDIPRSKEAVVVRDENANGTKIQWHEAPTNGLTYFRAINTLENLPDELRELVPLFTDSIMRLGTKDLNMEQLEDLIKLKTGGVSVGYHCTPSPTDFHAASEGIIFTGMALDHNVPVMFDIIQKLVLGTDFDSPEAALRIRQLLQASADGVVNDIASTGHRFAMGSAESGLTRSAWLRQQVSGLSQVQLVTSLASRPETDKLEDVISKLKQIQNLALVGGNLRTAITCGSESVAANGASLQNFVGNLSRDPLNLKNPSPRQLPKDSKTFYPLPYQVYYGGLSLPTTSYTSAEGAPLQILSQLLTHKHLHHEIREKGGAYGGGAYSRALDGLFGFYSYRDPNPQNTLSIMRNAGQWAVDKKWSDRDLEEAKISVFQGVDAPKSVNQEGMGRFLSGITEEMKQKKREQFLDVTKDQVREAAQRYLVDGLAKGEGRVAFLGEKQAWVDGEWQIREMDVKGAE

SEQ ID NO: 34147 - DNA, 2973 bp, Candida glabrata CBS138
  CDS (1)..(2973)
atgttacggtttcagagatttgcgtcgacgtataatcagcgtgcggtgttgcgtaagtaccctgtcggagggattatacatgggtttcaagttcggagagcggtaccagtacctgagttgaaacttactgcggtggatttgatacatgaacagactggtgctgagcatctacatatcgacagagatgataagaacaatgtgttcagcattgcgttcaggactttgccacctgatgctacaggtgtcccgcatatattggagcatactacgctatgtggttccgagaagtatccagtgcgtgatcctttctttaagatgctaaataagtcgctagcaaactttatgaatgccatgactgggcctgactatacattctttcccttcgctactaccaacgcacgtgactttgtgaacttaagagatgtataccttaactcgacgcttagaccgcttttgaaggagcaggatttctaccaagaaggttggagacttgagcattcggaagtcaccaatccaaaaagtgatataatcttcaaaggtgtggttttcaatgagatgaagggtcaagtatctaatgctgattatcatttctggtcacagttccaacaaaatatctacccatcgctaaataactctggaggcgatccccaaaagattacagatcttcactatcaggacttagttgactttcatcacgcaaattatcacccttcaaatgcacgtacttttacttatggttcgttccctcttgaagacactttgaaaaaggtaaacgaagaattcagggcatatggcaaacgaattattaataagaagcttcctaaacctttggaattaattgagacaaaggagttaacgcttgaaggacagatagacccaatgttaccagccgaaaagcagacgaagacatccttaacctggaaatgtggtgagcctactgatctttacgagacatttctactgaaaatattaggtaatctattactggatggacatgattccataatgtataagggattgattgaatctggactaggacatgactttagtgttaacactggtgtcgaatcaatgactgctgcaaacttcctaactgttggtattcaaggctctcagaatgtagaagagtttaagtctaaagtttttgatctgtttaaagaatttattgaaaatgatgttgactcgaataaagttgatgctattatacatcaattggaattatcaaagaaagaccaaaaagcagatttcgggcttcaaattttatactcaattcttcccggatggaccaacggtatcgacccaattgaaggacttgaattcgatgaattgatagggagactcaaatcagatttcaaagagaatggaacgaagatcttcaaaaacatattagataagtacataatagaccaaccatatttccatttcacgatgaaaggttcggaagagttcagttctaagttagcagcggaagaatccaccaaattggacaaaaagttgaaagagctagacgagaccgaccggaaagctatttttgagcgtggattattgctagaggcagctcaaaatcacaaggaggatctgtcttgccttccaactttaggtgttgcagatatatcaagaaaggtagatacttatgacttgaacacaaatgctaacatcacggtcagaaatacggcaaccaatggaataagttatattagaggcaagaagttaatcaatgatatgattccattggaattatacccgtttttaagcttgtttgcagcctcgttgacccatctgggcaccaaaacaacaccatatggtgcaattgacaacgaaataaaactacacactggcggtatatcaacaaatatttctgttaatgctgatcctaccacattgcagcctaatctgtactttgatatgagcgggttttctctgaacgaaaaatcggactacatattcaattttttaaaaacaattttaatggaaactgactttagcactcacaaggataagctaaaagtgttgataaattctattgcatcttcgaatacatcgcatatagctgattctggtcacactgttgctagatcgtttgccagtggtcatttgagtacggttgctgcaattcaagagcatatctcaggtgtcgaacattacaaactgatttctagactatgttccattatgaatgacgataaattatttcaatcagaggttatagataaactagtgatgctacaaagaataatagttaattctcagaatatggaattttttgcgtctgttgactgtcaagcacaagagaataaaatcagaaaagaggttgactattttgtaagcactttacctaatacaagctccgatatctcaggggctattcagactgcgtgtgtgcctagatattcagactcccaagttttaaacttgataaaatttcctttccaagtccattacacagctcaagcatataatggggtttcatacacccataaagatggtgctgcactacaagttcttgctaatatgctgacatttaagcacttgcataaagaaattagagaaaaaggtggtgcatatggtggtggagccactttcagtgccttgtctggtatttttagttattattcttatagagatccaaacccgttggcaagtatccaaacatttgaaaaatctgcctcatatgtcttaaatgatgcaaagtggacacagtctgacttagatgagtcaaaactttctattttccaacaagtcgacgctcctattagtcctaagagcgagggatccacattcttcaacttaggagttactgatgaaatgagacaagtaagacgggagcagctgttggacacttcgttgctggatattcatagagttgcagagaggtatattctaccgaacaaatctatcgctacagtcgtcggaccaggtattgatggggagactgtatctccaaaatggcatatcgaagatataaaggtatga

SEQ ID NO: 34148 - protein, 990 aa, Candida glabrata CBS138
MLRFQRFASTYNQRAVLRKYPVGGIIHGFQVRRAVPVPELKLTAVDLIHEQTGAEHLHIDRDDKNNVFSIAFRTLPPDATGVPHILEHTTLCGSEKYPVRDPFFKMLNKSLANFMNAMTGPDYTFFPFATTNARDFVNLRDVYLNSTLRPLLKEQDFYQEGWRLEHSEVTNPKSDIIFKGVVFNEMKGQVSNADYHFWSQFQQNIYPSLNNSGGDPQKITDLHYQDLVDFHHANYHPSNARTFTYGSFPLEDTLKKVNEEFRAYGKRIINKKLPKPLELIETKELTLEGQIDPMLPAEKQTKTSLTWKCGEPTDLYETFLLKILGNLLLDGHDSIMYKGLIESGLGHDFSVNTGVESMTAANFLTVGIQGSQNVEEFKSKVFDLFKEFIENDVDSNKVDAIIHQLELSKKDQKADFGLQILYSILPGWTNGIDPIEGLEFDELIGRLKSDFKENGTKIFKNILDKYIIDQPYFHFTMKGSEEFSSKLAAEESTKLDKKLKELDETDRKAIFERGLLLEAAQNHKEDLSCLPTLGVADISRKVDTYDLNTNANITVRNTATNGISYIRGKKLINDMIPLELYPFLSLFAASLTHLGTKTTPYGAIDNEIKLHTGGISTNISVNADPTTLQPNLYFDMSGFSLNEKSDYIFNFLKTILMETDFSTHKDKLKVLINSIASSNTSHIADSGHTVARSFASGHLSTVAAIQEHISGVEHYKLISRLCSIMNDDKLFQSEVIDKLVMLQRIIVNSQNMEFFASVDCQAQENKIRKEVDYFVSTLPNTSSDISGAIQTACVPRYSDSQVLNLIKFPFQVHYTAQAYNGVSYTHKDGAALQVLANMLTFKHLHKEIREKGGAYGGGATFSALSGIFSYYSYRDPNPLASIQTFEKSASYVLNDAKWTQSDLDESKLSIFQQVDAPISPKSEGSTFFNLGVTDEMRQVRREQLLDTSLLDIHRVAERYILPNKSIATVVGPGIDGETVSPKWHIEDIKV

SEQ ID NO: 34149 - DNA, 2949 bp, Kluyveromyces lactis NRRL Y-1140
  CDS (1)..(2949)
atgtttcaaattcgtaactatgccacaaaatatgcacagtctcgggcgctgaggaagtacccagtaggtggcgtttttcacggatatgaagtgaaacgattacttcctgtccctgaactaaagctaacagccgtggatttattgcataaccaaaccggttcacaacatttacatattgatagagatgataacaacaacgtgttcagtatcggattcaaaaccaatcccccggattcaactggtgtgccacatattttggaacacacaactctttgcggttctcataagtatcctgttcgcgatccgttcttcaagatgttaaacagatcgttggcaaacttcatgaacgctatgactggtcatgactatactttttacccgtttgctaccactaatgagacggattttgctaatctaagagacgtttaccttgatgcaactctaaatccattgttgaatcagcaagatttcctacaagaaggttggaggcttgaacacactaaggttgatgatccaaacagcgatataggtttcaaaggtgttgtatacaatgaaatgaagggtcaagtatccaatgctaactattatttctggattaagtttcaagaaagctattatccatccttgaataactctggtggtgacccaactaaaatgactgatcttcaatatgaagatttaatcagtttccacagaaataattaccatccttctaatgctaagacgtttacatacgggaacttcgatttgaacaataccttacagaggttgaataaagaatatcaaggttatggtagaaggggttctaagaagagggaactattaccaatccaaatgaaagaagatgtttctgtagaaaccgaaggacaggttgatcctatgttaccaccggataaacagatcaagacctctgtgacttggatttgtggtaaacctgaagacacgtaccaaacatttctattgaagatcttgggtaatttattattagacggacattcctctcctttctatcaaaaactaattgaaagtgggctggcgtacgacttttcagttaacactggtgtagagtcgcagactgctgcaaactttatcactattggtgttcaaggatgtgatgaagtggattcgatatatgaagttattaacaaagtatgggaagaagtattacagaatccgtttgaggagtctaggatccaagcaatcattcaacaattagagttatctaagaaagaccaaagggcagatttcggtttacaattactgtactcggttttaccaggatgggttaacaagactgatccatttgattctttattgttcgatgagacactagaaagattccaagaagattgggccactaagggtgataatttattcaaagacttaatcaaagaattcgtgatttcaaaacctgtattcaaattcaccatgaagggctcagaaacgttctctcagaaacttgatgctgaggaacaagaacgtttggagagaaagttaaagctccttgacgaagaagacaaaaaggtcattttcgaacgtggtaaacaattgcaagaactacaggacctcaaagaggatttgagttgccttccttcattgcaaattagtgcaattccaagagtttcaaagacatacccattgttagagaaggataatgttttaaatcgtattaccgataccaatggtattacatacgtcagaggtaagcgtttactaaaccaccatattccaagagaactttatcctttcctaccattatacgcagactcattgacgaaccttggtacttcaactgaagagttttccaccattgaagaacaaatcaaattgcacactggcggtgtctcaactcgcgtatctgtaaatccagatgcacagactggtaagcctatgctgctattccaagttgatggatgggctttgaacagcaaaaccgatcacatcttcaagttttggaagaaacttttatgtgaaactgatttccataagcacaaagaaaagctaaaggtcttaataagatcattagcatcttcaaacacagcgtctgtggctgagactggtcatgcttttgcccggaacttcggtgctgctcatttaagtgtaactaaagccatcaacgaaagtttaaacggtatcgaacagttacagttaatcaataagttatctcaatgtttggatgatgaagcactatttgagaaagaagtggtttcaaaattggttgagcttcaatcatatataaatggcagttcagacatgaaattcatgatcaccagtgattctcaagttcaaatcgatgcagttcaccaacaaatcacgggctttttgagctccttacccaaggattcaaaaccatgtgacttctactctgagaattactcaatgttggaaaacccaggtaaaccaaccctactccagttcccatttcaggttcattacaccgccaagtgttacccaggcgtttcctatacccatcctgatggcgctaagctacaaatcctttctaacatgttgacacacaaatatttgcaccgtgaaattcgtgaaaaaggtggcgcatatggtggtggtgctacttacagcgctttggatggtactttcagtttctattcttacagggatcctcacgctttaaattctttgtccacattcgatagcgttccagaattcatattgaacaagtcttcgtggggtgaaccagacttgaatgaagcgaaattgagtgtcttccaacaagtagactccccaatgagcgccaaaaacgaaggtaccattttattccattacgacgtaacagacgaaatgaaacaacgtcgtagagagcaacttttagacgtcaacttgaatgatatacatcaagtggcagaggaatacctcaagcaagataaatccattgcctccatagttggtccggaaatcccaaattttgatgccttagttcaaaccgtgtaa

SEQ ID NO: 34150 - protein, 982 aa, Kluyveromyces lactis NRRL Y-1140
MFQIRNYATKYAQSRALRKYPVGGVFHGYEVKRLLPVPELKLTAVDLLHNQTGSQHLHIDRDDNNNVFSIGFKTNPPDSTGVPHILEHTTLCGSHKYPVRDPFFKMLNRSLANFMNAMTGHDYTFYPFATTNETDFANLRDVYLDATLNPLLNQQDFLQEGWRLEHTKVDDPNSDIGFKGVVYNEMKGQVSNANYYFWIKFQESYYPSLNNSGGDPTKMTDLQYEDLISFHRNNYHPSNAKTFTYGNFDLNNTLQRLNKEYQGYGRRGSKKRELLPIQMKEDVSVETEGQVDPMLPPDKQIKTSVTWICGKPEDTYQTFLLKILGNLLLDGHSSPFYQKLIESGLAYDFSVNTGVESQTAANFITIGVQGCDEVDSIYEVINKVWEEVLQNPFEESRIQAIIQQLELSKKDQRADFGLQLLYSVLPGWVNKTDPFDSLLFDETLERFQEDWATKGDNLFKDLIKEFVISKPVFKFTMKGSETFSQKLDAEEQERLERKLKLLDEEDKKVIFERGKQLQELQDLKEDLSCLPSLQISAIPRVSKTYPLLEKDNVLNRITDTNGITYVRGKRLLNHHIPRELYPFLPLYADSLTNLGTSTEEFSTIEEQIKLHTGGVSTRVSVNPDAQTGKPMLLFQVDGWALNSKTDHIFKFWKKLLCETDFHKHKEKLKVLIRSLASSNTASVAETGHAFARNFGAAHLSVTKAINESLNGIEQLQLINKLSQCLDDEALFEKEVVSKLVELQSYINGSSDMKFMITSDSQVQIDAVHQQITGFLSSLPKDSKPCDFYSENYSMLENPGKPTLLQFPFQVHYTAKCYPGVSYTHPDGAKLQILSNMLTHKYLHREIREKGGAYGGGATYSALDGTFSFYSYRDPHALNSLSTFDSVPEFILNKSSWGEPDLNEAKLSVFQQVDSPMSAKNEGTILFHYDVTDEMKQRRREQLLDVNLNDIHQVAEEYLKQDKSIASIVGPEIPNFDALVQTV

SEQ ID NO: 34151 - DNA, 3192 bp, Debaryomyces hansenii CBS767
  CDS (1)..(3192)
atgttaaggttggctaatagagtttccagaaaggacagtgggaacttggggatagcccaattgaagaagagactcttggccacttcaggtgtgtcacaaggtgagattttgagtaaatatcctatcggtcttaatatgcatgggtatgtgattgaacaagttcaacctataccagaattttcacttgtagcagtcaaattgaaacattctagaactggatcagaacacttacatttggatacacctaatgataaaaataatgtattcctggtagcgtttaagacgaatgctcctgacgccactggggttcctcacatattggaacatacaacgctttgtgggtcattcaaataccctgttagagacccgtttttcaagatgcttaatagatcgttgagtaattttatgaatgctatgacgggacatgattacacatattatccgtttgctactactaatgcgaaggactttgaaaacttgatggatgtatatttatcgtcagttttcgagccgctccttactcatgagagttttatgcaagaaggatggagattagagaattcagatctttccgatcctaaaagtcctataatctttaaaggggttgtttataatgagatgaaaggtcaatattctaactcggcatattattattggatcaaattccaagaagccatatacgggtcgttaaataattctgggggaaatccaaatgaaattactgatttaaggtatgaagatttagttgatttccactcttcaaattaccatccatccaatgcaaaaacctttacttacggtaatattgaattggttaatcatttgaacaaactaaatgagttttttgaatcttttggtagccgtggaataaggacaaatgttagaaaaccaataactgaacttaatccaaattatgaatcagacgtcactgttaagggtccccttgatacgatgtcaagtaggccaatcgaagaacaatacaaatcttcgattacttgggtgattgggaacccattagatgaatccaaattgtatgacgtatttaagtggaaagttttgagttctttgttatgtgatggtcataactcgccgttctatcaggaattaattgaaaaagaatatggagaggacttcgctgtcaattatggtttagatgctaccacagctttattatcttttacaattggcttaaataacttatctttagaaaaagctaaaaatttagaggataaagtacgtggaattttcgttgagaagatcatccctgaacttcaaaaggggaaagaaagtggcttcaacgatagaattgaagcaattttacatcaaattgaattgaacttcaaaaatcataaaccagaatttggtataggtctattaagttcagtcgtttctacttgggttaatggattaaatcctgttaagtcactacaaattgaccatattttaaacaggttcaaagaagactataaactcaatggcttaaagatgtttcaagatttgcttgatgaatcagttttaaaggatgatactccaaagtttaagttcacaatggaacccgatgaaagttttggaaaaaacttgacatctcaagaaactgaaagattgaataagaaaattgaggccttaaccgaagaagataaagagataatctacaaaagaagcatagagttggctgagaagcagaagaaagaggaagatgtatcagccttaccgactttgacggttaaagacattccacgagaaggcgatttttatcctcttgattttgcagacataaattctaaaaaacttcaaaaaagaattgttgatacgaacgggttaatttacatgaacgctactaaggatatttcatatttaccttctaaatactatgaatacttaccattattcgactgttgtcttactaatttagccggtacaagtaagacaccaataactgaattggagataaaaatccaaaagttgacaggtggtgttacattcaatgtttcggctaagactgatccatttgatatctccaagactaatatgaaatttatgttatcgggtatggctttgaaagacaaatctcagaacgtgtatgacttatggtttgaaattttaactcaaacgaaattcgattccgaggatgagcaagttgttgataaattattcactttggttaaaaacttaggacaaaatcaaatgaatacaatcgccgattcaggtcattcttatgcaaattcttacagtaattctcaacttacacctacaaagtatattcataatttaattggtggaataggccaagtttcgtttattctggatttgaatagaaaattagaaacagaaggcagagactttttaaagaaagagcttttgccagtgttaaaggatattcaacgccatttggttaatggtttcactgatggaaatcattcaggattcgaatacagcttagttggtgatagtgaatctgttattaaaaatgaaaaaatgattaaagaatttgacgatttattgacagcaaattctaatcgagtagctggcaccaatgaattatcttccttgatttctcaattcaatagcaacaaattgggtttaaataacaatggtcgtagtacgttgatcgacttgcctttccaagtcggatatgcttcgttagctaagttaggagctgcatatactagtaaagatggagctgcattgcgtgttttatcacaattattaaccttcaaacacttacattctgttattagagaagcaaatggggcatatggtggaggattactgtttgatggtttaggtggatgtttgaatttctactcatatagagaccctaatccacttacatcagttcagtcttttaaggattcgacttcagttgcattaggtaaaatgataaattctgagaataatggttggagtccaaaagatttgcaagaagcaaaattaaccatattccaaggcgtggatgcacctagccatatttctctgcagggatccttagatttccttgagcatatcacggacgagatgaggcaagaaagaagagaacggtttttggatgttacttatgaagacttgaagaatgttactgagaagtacttgttaaatggttcacaggatattgttacggtgattggagataatgaaactctcaaaattgattctagcgatgctcagtggaacattaagaaattaactgcctaa

SEQ ID NO: 34152 - protein, 1063 aa, Debaryomyces hansenii CBS767
MLRLANRVSRKDSGNLGIAQLKKRLLATSGVSQGEILSKYPIGLNMHGYVIEQVQPIPEFSLVAVKLKHSRTGSEHLHLDTPNDKNNVFLVAFKTNAPDATGVPHILEHTTLCGSFKYPVRDPFFKMLNRSLSNFMNAMTGHDYTYYPFATTNAKDFENLMDVYLSSVFEPLLTHESFMQEGWRLENSDLSDPKSPIIFKGVVYNEMKGQYSNSAYYYWIKFQEAIYGSLNNSGGNPNEITDLRYEDLVDFHSSNYHPSNAKTFTYGNIELVNHLNKLNEFFESFGSRGIRTNVRKPITELNPNYESDVTVKGPLDTMSSRPIEEQYKSSITWVIGNPLDESKLYDVFKWKVLSSLLCDGHNSPFYQELIEKEYGEDFAVNYGLDATTALLSFTIGLNNLSLEKAKNLEDKVRGIFVEKIIPELQKGKESGFNDRIEAILHQIELNFKNHKPEFGIGLLSSVVSTWVNGLNPVKSLQIDHILNRFKEDYKLNGLKMFQDLLDESVLKDDTPKFKFTMEPDESFGKNLTSQETERLNKKIEALTEEDKEIIYKRSIELAEKQKKEEDVSALPTLTVKDIPREGDFYPLDFADINSKKLQKRIVDTNGLIYMNATKDISYLPSKYYEYLPLFDCCLTNLAGTSKTPITELEIKIQKLTGGVTFNVSAKTDPFDISKTNMKFMLSGMALKDKSQNVYDLWFEILTQTKFDSEDEQVVDKLFTLVKNLGQNQMNTIADSGHSYANSYSNSQLTPTKYIHNLIGGIGQVSFILDLNRKLETEGRDFLKKELLPVLKDIQRHLVNGFTDGNHSGFEYSLVGDSESVIKNEKMIKEFDDLLTANSNRVAGTNELSSLISQFNSNKLGLNNNGRSTLIDLPFQVGYASLAKLGAAYTSKDGAALRVLSQLLTFKHLHSVIREANGAYGGGLLFDGLGGCLNFYSYRDPNPLTSVQSFKDSTSVALGKMINSENNGWSPKDLQEAKLTIFQGVDAPSHISLQGSLDFLEHITDEMRQERRERFLDVTYEDLKNVTEKYLLNGSQDIVTVIGDNETLKIDSSDAQWNIKKLTA

SEQ ID NO: 34153 - DNA, 2973 bp, Yarrowia lipolytica CLIB99
  CDS (1)..(2973)
atgttacgtctaaagtcgctcaaaaaaccggtccaggccgtggttcgacgtttcgccaccacctccgcacccactctctctgtcggcgacaatatccatggcttcaatgttctcagaaccaaagagatccccgagtttgatctgcaggctaccctgctagagcactccactggagcccagcatctgcacattgctcgagatgactccaacaacgtcttttccatcggcttcaagactaatcctcccgatcgaaccggagttccccatattctggagcatacaacgttgtgtggatcggaaaagtaccaagtccgagatcccttcttcaagatgcttaaccgatctcttgccaacttcatgaacgcgatgaccgcccaggactacaccttttacccctttgctaccaccaacgctaccgacatgaagaatctgcgagatgtgtacctcgatgctaccctgaagcctctgcttcgagagctggacttttctcaggaaggctggagactggaaaacgaggactccaaggacaagaccagtcccatcatcctcaagggtgtcgttttcaacgagatgaaaggtcaaatgtccaatgctgcttacgctttctacattcggtacctggagaagatctaccccagtttgaacaactctggaggagaccctcttgttattcccgaactcacctacgagggtctcaagaagtttcatgctgatcactacaaccccagcaacgccaagacgttttcttatggagatatctctgttgctgaccatttggaggctctgaacgccaaatttgagaattgtgagatctccaaaactcccggaaacaccgagagattgcctctcgaattttcttctgccgctgagaacacccgtatcgttgaagagggtcctattgacactcttctggatacgtctaagcagcacaagatgtccatgtcgtggttgatgggttctcccaaggacatttacgagtctttctgcgtcaagatcatctcttctctactcattgacggtcattcttccccccttcatcagaagctgattgattccggtcttggatcttcctactctcccaacactggccttgacagtgctcctggagctaacattttctctgttggtcttcagggagtgaccgagagcgatcttacaaaggtcgagactgttattctcgacaccatcaagactaccgttgctgagggcttcgacaagggccgaatcgacggtcttttgcatcagactgagcttgctcgaaaggaccagaacgccaagttcggtatggctcttatgaacggtgttcttcctggctggtttaaccaggtcgaccccctggaggctctggagtggaattctgtgctcgatcggttcaacaaagacatggaggccgaccctgagttcctgcagaaggtgatgaagaagtacttgctcgacaacaagtacttccactttcagatgaaccccaatcccgactatgagaagaatgtgcaggaaaaggaggacgagattctgaccgacaagctggccaaactgactgaatctgataaggaggaaatcttcgagaccggggccaacctggaaaagatgcaggaagagcctgagaaccttgactgtctgcccactcttcacgtctcagacatccccagaagcaagcctcgagttgccttggagcataccaagaatccctatcccatccagtggcgacttgcccccaccaacggtctgacttacttccactccatctcttctctagagggtcttccccacgagtactaccccttccttcctctgttcacctcgtccctaacctttttgggaaccaaggacaagactatgggccaactggaagacgaaatcaaactcaacactggtggtcttgatttctctgtctcctgctcttcttctcctctttctctgccgtcgtcccagctcaactttgctatggatggtgtggctttggacaaaaatgtggagaccatgtttggcctgtttcaggagctgcttcgaaacactgatttcaccaacgttgagaagcttaagaccatgattgcagcctccaccgctaacctgtccaacgcgttggctcagtctggacactcgttcgccatgcttcgagctgcttccgatatttcccctgtcaagaagattgacgacattctggggggtgtggcccaggtgcgcttcctgtctgagctggctgccaagtccgagcagcagcttgtcgacgaggtcatccccaagctccaggagattgccaagtttgctctgacccgtgagcagcgatttgccgtcacttgtggccaggacatgcagaccaagaacgacgagttggtgcgaaagttcgctgagtccttcgagaccaatgagtcgcccttcaatatctcgtcgttgtctatccccatgaccactcccacaagcaccttgttcaagttaccgttccaggtcaactacgctggtattgccatccccggagtgccctacactcatgctgacggagctcccctgcaggtactcgccaacatgctgacccacaagcatctgcatcgagaaatccgagaaaagggaggcgcttacggtggaggagcctcttataaccccactgacggcttcttctcatattattcataccgagaccccaacttggaacgaaccctgcagacctgccaggaggctggagagtggtctgtcaagaaggactggagctcttccgatctgcaggaggccaagctgtcccttttccagcgaatcgatgcccccatctccgtcaagtcagagggaatggctctctatgccaacggacttacctacgagcagcgagagaagcgacgacggcagctgcttgatgtggctgttgatgacgtcaagcgggttgccaagcagtatctcgtcaacccctccgggtactcagtggccgctctcggccccggatacgaaaccatggacaaaaagaagtggactgtgctggagtag

SEQ ID NO: 34154 - protein, 990 aa, Yarrowia lipolytica CLIB99
MLRLKSLKKPVQAVVRRFATTSAPTLSVGDNIHGFNVLRTKEIPEFDLQATLLEHSTGAQHLHIARDDSNNVFSIGFKTNPPDRTGVPHILEHTTLCGSEKYQVRDPFFKMLNRSLANFMNAMTAQDYTFYPFATTNATDMKNLRDVYLDATLKPLLRELDFSQEGWRLENEDSKDKTSPIILKGVVFNEMKGQMSNAAYAFYIRYLEKIYPSLNNSGGDPLVIPELTYEGLKKFHADHYNPSNAKTFSYGDISVADHLEALNAKFENCEISKTPGNTERLPLEFSSAAENTRIVEEGPIDTLLDTSKQHKMSMSWLMGSPKDIYESFCVKIISSLLIDGHSSPLHQKLIDSGLGSSYSPNTGLDSAPGANIFSVGLQGVTESDLTKVETVILDTIKTTVAEGFDKGRIDGLLHQTELARKDQNAKFGMALMNGVLPGWFNQVDPLEALEWNSVLDRFNKDMEADPEFLQKVMKKYLLDNKYFHFQMNPNPDYEKNVQEKEDEILTDKLAKLTESDKEEIFETGANLEKMQEEPENLDCLPTLHVSDIPRSKPRVALEHTKNPYPIQWRLAPTNGLTYFHSISSLEGLPHEYYPFLPLFTSSLTFLGTKDKTMGQLEDEIKLNTGGLDFSVSCSSSPLSLPSSQLNFAMDGVALDKNVETMFGLFQELLRNTDFTNVEKLKTMIAASTANLSNALAQSGHSFAMLRAASDISPVKKIDDILGGVAQVRFLSELAAKSEQQLVDEVIPKLQEIAKFALTREQRFAVTCGQDMQTKNDELVRKFAESFETNESPFNISSLSIPMTTPTSTLFKLPFQVNYAGIAIPGVPYTHADGAPLQVLANMLTHKHLHREIREKGGAYGGGASYNPTDGFFSYYSYRDPNLERTLQTCQEAGEWSVKKDWSSSDLQEAKLSLFQRIDAPISVKSEGMALYANGLTYEQREKRRRQLLDVAVDDVKRVAKQYLVNPSGYSVAALGPGYETMDKKKWTVLE

SEQ ID NO: 34155 - DNA, 3150 bp, Aspergillus nidulans FGSC A4
  CDS (1)..(3150)
atgctccggtcatacttgcacctaggcaggcatcgaacgccggcttttcgccagccactcggacgattgctaagaccaaccgcgtcgatactgcagtatgctcagtctcggacgctcgcttcagtatctagcttggagagcttgccggaggtgggagaccagctccatgggtttacagttcaggaaaagaaacaagtgccggaattgcaccttacagctatccgtttaaggcatgacaaaacccacgcggattacctgcatatcgcacgagaagacaagaacaatgttttcggcatcggtttcaagacaaaccctccggacgccacaggtgtgccccatattctggagcataccactctctgcggcagcgagaaatatcctatccgcgatccgtttttcaaaatgttaccgcggtccctctcaaatttcatgaacgcttttacttcgtccgaccacactatgtatccgtttgccacaacgaatcaacaagattttcagaacctcttgtcggtctacctagacgccactatgcatcctctgcttaaagaggaagactttaggcaggaaggatggcgtttgggacctgaggatccccgtgcaatccaaactcaggagggaaatctgaagcctgaagacattctgtttaagggtgttgtgtacaacgaaatgaagggtcagatgtcagatgcgaactacttatattggattaggttccaggaaagcatctttccggccatcaataactccggaggagacccccaacatatcacggatctgacgcacaagcaactcgtggagttttccaagaagaactacaatcccagtaatgctaagatcatcacttacggcgacatgcctttggccgatcatctgaagcaggtcggtggcgtcctaaacgacttttcgaaaggggctgtcgacacaacggtgaagttgcccattgagctccgaggccccataaatgtgactgtcccgggaccaatcgacactttcgtaagtgaagacagacaattcaaaacatccacttcttggtacatgggcgatatcacggatactgtcgagaccttttcggccggcatcctctcgtcccttttgttagatggttatgggtctcccatgtacaaagctctgattgaaagtggcttgggctcctcgttcactcctaacacgggactcgacacttctggtaaaatccctattttttcgattggagttacaggtgtgagcgaggagcaagctcctcgggtcaaagaagagattcagcgagtccttcaggaaactcttcagaggggcttcaacgatgaaaaggtccaaggatttctccaccagctggagcttgctctgcgtcataagacagcgaactttggcctcggtgttattcagaaaaccttcacctcttggttcaacggctccgatcctatgaaggagcttgcatggaacgaggttatcaatgccttcaaaagtaggtacgaaaaaggaggctacttagaggcgttgatgcaaaagtacctcatcaacgataactgcctgacttttacgatggttggtaccccttcatttaacaaggaattggatgataaggaaatggcgcggaaggagaaaaagtttgagcaattaactcagcaacatggttctgttgagaaggctgtgactgagcttgctaaagcagagctgcagctgcttgaagttcaggaaaaggcccagcatgctgacctgagctgtttgccgtctttgcgtgtggaggatatttcacggcagaaagagcacaagccagtccgcgaatctaaggtcgaaggcacagatattgtttggcgcgaagctccaaccaatggactgacctattttcaagctgtgaatgccttcgccgatcttcctgatgatctccgcctgctcctgccacttttcaacgatgcaatcatgcggcttggaacaccaactaggaccatggagcagtgggaagacctgataaaactcaaaacgggtggtgtctcgacctcgaatttccatactacatcgccaacagagatgggcaaatacactgagggacttcaattttctggtttcgctctggacaaaaatgtccccgacatgttggaaattctcacagctctcgttactgagacagacttcaccagcccttctgctccggccatgatccaggagcttttgcggctgactaccaacggggcattggatgctgttgcaggaactggtcaccgatacgctctaaacgcagctgctgccggtctttctcgtagcttctgggcacaagagcagacctcaggtctagcacagctgcaagctacggcgaatctcctgcgtgatgccgaaacttctccagaacgcctagccgagctgatcgaaaagcttcgtctcattcaatcattcgctatctcgaagacatctggtcttcgtgttcgcctcgtctgcgaaccggccagctcgacccagaatgaatctgttctgcaaaggtgggttactggactgcctaaggtcccgtcgcccacgtcccaacctcaaaggtttgacttgagcacaccttccaagaaggcgttctatgatctaccttacaaggtttactattctggtctggctttgcctaccgtgccatttacacactcatccagcgcgactctgagcgtcctttctcagcttctgacgcacaattacctccatcctgagatcagagagaaaggtggcgcctatggtgcaggagcaagcaacggtccggtcaagggattattcgcattcaccagctaccgcgaccccaaccctgccaacaccctcaaggtcttcaagaacagtggggtcttcgcgcgtgaccgggcttggtcagaccgtgaaatcaacgaggctaagcttggtatcttccaaggactcgatgcccccgttagcgttgatgaggaaggatctagatacttcctgaatggtatcacgcatgagatggaccagcgctggagagaacaggtcctagacgtcaccgccaaggacgtcaacgaggttgcgcagaccttcctggtagatggcacccggcggtctgtctgtctcctcggtgagaagaaggactgggccgaatctgagggctgggaggtccgcaagctctctatgaatcccaatggttccaacattccctccggtgatgccgcataa

SEQ ID NO: 34156 - protein, 1049 aa, Aspergillus nidulans FGSC A4
MLRSYLHLGRHRTPAFRQPLGRLLRPTASILQYAQSRTLASVSSLESLPEVGDQLHGFTVQEKKQVPELHLTAIRLRHDKTHADYLHIAREDKNNVFGIGFKTNPPDATGVPHILEHTTLCGSEKYPIRDPFFKMLPRSLSNFMNAFTSSDHTMYPFATTNQQDFQNLLSVYLDATMHPLLKEEDFRQEGWRLGPEDPRAIQTQEGNLKPEDILFKGVVYNEMKGQMSDANYLYWIRFQESIFPAINNSGGDPQHITDLTHKQLVEFSKKNYNPSNAKIITYGDMPLADHLKQVGGVLNDFSKGAVDTTVKLPIELRGPINVTVPGPIDTFVSEDRQFKTSTSWYMGDITDTVETFSAGILSSLLLDGYGSPMYKALIESGLGSSFTPNTGLDTSGKIPIFSIGVTGVSEEQAPRVKEEIQRVLQETLQRGFNDEKVQGFLHQLELALRHKTANFGLGVIQKTFTSWFNGSDPMKELAWNEVINAFKSRYEKGGYLEALMQKYLINDNCLTFTMVGTPSFNKELDDKEMARKEKKFEQLTQQHGSVEKAVTELAKAELQLLEVQEKAQHADLSCLPSLRVEDISRQKEHKPVRESKVEGTDIVWREAPTNGLTYFQAVNAFADLPDDLRLLLPLFNDAIMRLGTPTRTMEQWEDLIKLKTGGVSTSNFHTTSPTEMGKYTEGLQFSGFALDKNVPDMLEILTALVTETDFTSPSAPAMIQELLRLTTNGALDAVAGTGHRYALNAAAAGLSRSFWAQEQTSGLAQLQATANLLRDAETSPERLAELIEKLRLIQSFAISKTSGLRVRLVCEPASSTQNESVLQRWVTGLPKVPSPTSQPQRFDLSTPSKKAFYDLPYKVYYSGLALPTVPFTHSSSATLSVLSQLLTHNYLHPEIREKGGAYGAGASNGPVKGLFAFTSYRDPNPANTLKVFKNSGVFARDRAWSDREINEAKLGIFQGLDAPVSVDEEGSRYFLNGITHEMDQRWREQVLDVTAKDVNEVAQTFLVDGTRRSVCLLGEKKDWAESEGWEVRKLSMNPNGSNIPSGDAA

SEQ ID NO: 34157 - DNA, 3105 bp, Candida albicans SC5314
  CDS (1)..(3105): transl_table=12
atgttgaaaactagattaaaacaaagcagggccataagtcgggttgtaagaagatatgcatgctcacaccccatttctcccaatcttgataagtacccagttggtctaaaattgcatggttacgaagttacccaaacatcacctatcccagaattttccctcactgctgtatcattaaaacacacagagagtggtgcaactcacttacatttggattcccctaatgacagtaataatgtatttctgattgccttcaaaacaaatcctccagataatactggggttccccatattttagaacatacaactttgtgtggtagtaaaaagtttccggtccgtgatccattttttaaaatgaccaacaggtcgttgagtaactttatgaatgcaatgacaggccatgattacacattttatccatttgctaccaccaattcaaaggattttgaaaacctaatggatgtgtatttatcgtcagtgtttgaaccgcaattaaaccataccgatttcttgcaagaaggatggagaatagaaaatcaaaatgttcatgacatatcgtccaagcttgaattcaagggagttgtatataatgaaatgaagggccagtattcgaactctgcatactacttttatatcaagttccttgagagtatatatccatccttgaataattcagggggtgatcccaagaaaattgttgatttgctgtacgagggtttactagagtttcacctgaaaaattatcatccatcaaatgcaaaaacatttacttatggaaaattaccattggaagacagtttaagtaaaataagcaaatactatgaatcattcgaaaaaaaggtgtcttcagttgacgtcaaacaacctatattttctacagataaatcagaaatctttgatgtcaccatcccgggtccagttgatacaatgaatggtaaagagacttcagaacagtactgcacatctatcacctggaacttgggtaatccattggatccaaacatgcagtatgatatttttaaatggaaaatattgagctcattattgtttgatggacacaactctcctttctatcaagagttaattgaaagtggatacggtgacgatttttctgcaaatactgggttggactcaaccaccgcgttgctttcgtttactgttggtctcaactacttaaccaagcaaaaagttgataattttaatgaaaaagttatggaaatcattaataataaaatcattcccgaattaagtaacgaagagtcctcttcatatcatggtagaattgatgctatattgcatcaaatagaaataggattcaaaagacacaagcccgattttggatttggattattgagctctattgttccgtcatgggtgaatggagttgatccaattgacaccttgcaagtggaaaagatattgtcgcattttaaagaagattataaacaaaatggtttaaggatctttaaagaattattagaaaagacattgtgtaaccctcattcgcaaaaatttaaattcaccatggagccaagagaagattttaccaaacaattggtaaaagatgagaatttgatgatcgagaaaagagtaagtgaactcacagaagataacaagaaggcaatctatgagcaaaacttggaattagctaaattacaattggaggatcaaaatacagaagttttacccacattgactattgatgacattccaaagagaggtgatttttatgccattgatttgggccaagtaaataagaaagttgtacatgaaagggtagttgataccaatggcttggtttatgccaacgctttaaaagatatttcctatttacccaccaaactttacaagtaccttccattgtttaacaactgtttgacgaaccttgctggaacagaaaacacacccattacggagttggaaactaaaatacaaatgttaactggcgggataacatttagttctaaaatatcgactgacccctataatattgagcaactaaaattacagtatgtgttaagtggaatggctttgaaagaaaagtcatcctcagtttatgatttatggttggagattttaactactaccaaattcgacaccagtgatgaggtattagaaaagttgtcagttttgattaaaaacatgggacaaaaccaaatcaataatattgctgatcgcggtcattcttatgcggctgctgtgagctcactgaaattgacaccgctgaaatacatcagtgacatcgtttcaggtttgagtcaagttcaatttgtaatggagttgaactccaaattagaatcagaagggaaagagtacttggccaaagagattattccgatattgcaagaaatacaaaagtatgtattgcaaggtgaattcaggtatagactagttggaaatcaagagattattgttgaaaacgaaaagcttattgagaaatttgataaggatatttcttcgaacagaccaactttatcgttaacagtaacagatggtttactggcattgttgaactcattcaattacaatcatacaagtgaaaatgtcttagttaacttaccatttcaagtgggatactcttcattaggtaagattggctcttcgtattcatcaaaggatggtgcttctttacaaatattatctcagttatattcctttaaaaatctacattccaaaataagagaaagcaatggtgcatatggaggtggtttgacatatgatgggttgaacgggacattaaacttttattcgtatcgtgatcctaatcctgttaagtcgattcaaacttttagagattccttactgtatggacttgatgctaattggaacgataaggatttacaagaggctaagttgcgggttttccaaagcgtcgatgctccaattaatatctcttctcagggtgctagtgccttctttgaaaatatagatgattacttgagacaggaaagaagagaaaactttttgggtaccactttaaaggatctcagagatgtgactgaaaagtatcttgttgataaccaaaacaaccttgtcactgttattggtgacaatgaaattttaaatgtcgataataaatggcaaattagaaattttcaagtatag

SEQ ID NO: 34158 - protein, 1034 aa, Candida albicans SC5314
MLKTRLKQSRAISRVVRRYACSHPISPNLDKYPVGLKLHGYEVTQTSPIPEFSLTAVSLKHTESGATHLHLDSPNDSNNVFSIAFKTNPPDNTGVPHILEHTTLCGSKKFPVRDPFFKMTNRSLSNFMNAMTGHDYTFYPFATTNSKDFENLMDVYLSSVFEPQLNHTDFLQEGWRIENQNVHDISSKLEFKGVVYNEMKGQYSNSAYYFYIKFLESIYPSLNNSGGDPKKIVDLSYEGLLEFHSKNYHPSNAKTFTYGKLPLEDSLSKISKYYESFEKKVSSVDVKQPIFSTDKSEIFDVTIPGPVDTMNGKETSEQYCTSITWNLGNPLDPNMQYDIFKWKILSSLLFDGHNSPFYQELIESGYGDDFSANTGLDSTTALLSFTVGLNYLTKQKVDNFNEKVMEIINNKIIPELSNEESSSYHGRIDAILHQIEIGFKRHKPDFGFGLLSSIVPSWVNGVDPIDTLQVEKILSHFKEDYKQNGLRIFKELLEKTLCNPHSQKFKFTMEPREDFTKQLVKDENLMIEKRVSELTEDNKKAIYEQNLELAKLQLEDQNTEVLPTLTIDDIPKRGDFYAIDLGQVNKKVVHERVVDTNGLVYANALKDISYLPTKLYKYLPLFNNCLTNLAGTENTPITELETKIQMLTGGITFSSKISTDPYNIEQLKLQYVLSGMALKEKSSSVYDLWLEILTTTKFDTSDEVLEKLSVLIKNMGQNQINNIADRGHSYAAAVSSSKLTPSKYISDIVSGLSQVQFVMELNSKLESEGKEYLAKEIIPILQEIQKYVLQGEFRYRLVGNQEIIVENEKLIEKFDKDISSNRPTLSLTVTDGLSALLNSFNYNHTSENVLVNLPFQVGYSSLGKIGSSYSSKDGASLQILSQLYSFKNLHSKIRESNGAYGGGLTYDGLNGTLNFYSYRDPNPVKSIQTFRDSLSYGLDANWNDKDLQEAKLRVFQSVDAPINISSQGASAFFENIDDYLRQERRENFLGTTLKDLRDVTEKYLVDNQNNLVTVIGDNEILNVDNKWQIRNFQV

SEQ ID NO: 34159 - DNA, 3198 bp, Aspergillus fumigatus Af293
  CDS (1)..(3198)
atgttgcgctctttctcaggggcaggtaaatgcaagtgccgaataccggtctcgaggcagccagtctgtggtcggtcgctgagaatcagcagcacactcactccatggaatcaatctcggagagctgcgtcgaccgtcactagcttggacagttttccgaatgtcggggagaaacttcatgggtttacagtccaggagaagaaacatgtgccagagttgcaccttacagcagtacggttaaagcacgacaagacagacgcagattaccttcatgtcgctagggaggataagaacaatgtctttggtattgggtttaagacgaaccccccagatgcgactggtgtaccacatattttggagcacaccacgttgtgtggaagtgaaaaatacccaattcgcgacccgttcttcaagatgcttccgcggtcattgtcgaattttatgaatgctttcacctccgccgaccacactacgtacccattcgccacaacaaatcggcaggactttcaaaacctactatcagtatatttggacgctaccctacacccattgctgaaagaagaagacttcagacaggagggttggcggctgggaccagaggaccctcgttctattctaacccagggagagcaatccaagggaaacctgcagtcagaagatgtggttttcaaaggtgtcgtctacaacgaaatgaagggacagatatcagatgccaattatctctactacatcaaataccgtgaaagtatctgcccgtcgctgaataactctggcggagaccctcagtacatcaccgatttgacgcaccagcagctggtagacttctccaagcggaattaccatcccagtaacgccaagatcttgacatacggagacatgcctctgagcgtacacttgaaacagatcggtgaggtactggatggttttgaaaagggacaggccgatacagatgtcaagctgcccttggacctgagtcgcgggcccctgaatgtcactgttcccggacccatcgacacattcgccagtgaggacaagcagtacaagacctccacctcttggtacatgggcgacactaccgacgtcgtcgagacgttctcggtcggaattctgtcttccttgctcctcgatggctatggttcgccaatgtatcgtgcgttgatcgagggtgggttagggtcttcttttactcccaacacgggccttgattcctctggtagagtgccaatcttttcagtcggtcttactggcgtgagcgaagcggacgcaccaaaggtcaagtcgactatcaaaagggttttcgaggagtctctttcctccgggttcaatgatgagaaagtccaaggcttccttcatcaacttgaactcgcgttgagacacaagacggctaattttggtattggtgtcatggagaaaaccctttcatcatggttcaatggttcgaaccctatgaaggagttgtcttggaatgaagtcatcgatgagttcaagaaaaaatatgaacaaggaggctaccttgagtcattaatgcaaaaatatcttatgaacgataactgcctgacatttacgatggtgggaactccctcgtataacaaagatctcgatgatcaggaaatggtgcgcaaggaaaagaaactaagtgagctcgttgaacgccatggctcagttgagcaggctgtctctgcgcttgctgaagaagagcttcagttgctcaagattcaagaagaggcgcaaaacgccgatttgagctgcttaccctctctacgcgttgaggatatctccagggagaaggaacgcaaacccgtgcgggagtccaagatggacgatatagacgtcgtctggcgcgaagccccaacaaatgggctcacatatttccaagcattgaattctttcgaggagctcccggatgacctgcgattgctattgccgctgttcaacgattgtatcatgcgactaggcactggagacaaaaccatggaacagtgggaagatctgataaagttgaagaccggcggaatcacaacatccactctccacacatcttctcctacggagttgggtaaattcagggagggcctgcagttctcaggatatgctctggacaacaacattccggatatgctgcagattcttactacactcgtcactgagacagatttcaccagcccgcatgcgcccgccatgatccaggaattactgcgcatgaccaccaacggcgcgttggacgctgttgccgggtcaggccatcgttacgccctgaatgcggcagcggctggtttgtctcggagtttttgggttcaggaacagcagtcaggcctggcgcaattgcaagctacggcgaacctcctccgcgacgcggagagttctccagaacgtcttgctgagctgatcgataagctccggctgatccagtcatttgctatttccaaaggctcaggcctccgtgttcgcatggtttgtgagcccagcagtgcatcgcagaacgagattgtgctccagaaatggctggcaggactacctcgtaataggtctcccacttcgccacttgatcataccagcgtgaattcagtagctaatcgggtgttctatgacctgccttacaaggtttactactctggacttgctatgcagacggtccctttcattgatccctctagtgcacctctcagcgtcctttctcaacttctgacacacaaatacctgcaccctgaaatccgagagaagggaggtgcgtatggcgcgggggccagcaacggccctatcaagggattcttcgcctttaccagctaccgggatcccaatccagtgaacagtctcaaagtcttccagaacagtgggatctttgctcgggatcgtgcctggtcagaccgcgaacttgctgaggccaagctgggcatcttccagggacttgatgctcctatgagtgtcgatgaggagggtgccaggtatttcatgagtggtgttacccatgaaatggaccaacgttggcgagagcaagtgctcgatgtgactgcaaaggatgtcaacgaggtcgctcagaagttcttggttgaaggctctcggcaatccatctgtctgctcggcgagaagaaggattgggctgattccgacgactgggaagttcggaagctctctatgaatgcctcaggcgagccggtaatcgatcccctgagccaagatggcgccgtggcgtcggcttaa

SEQ ID NO: 34160 - protein, 1065 aa, Aspergillus fumigatus Af293
MLRSFSGAGKCKCRIPVSRQPVCGRSLRISSTLTPWNQSRRAASTVTSLDSFPNVGEKLHGFTVQEKKHVPELHLTAVRLKHDKTDADYLHVAREDKNNVFGIGFKTNPPDATGVPHILEHTTLCGSEKYPIRDPFFKMLPRSLSNFMNAFTSADHTTYPFATTNRQDFQNLLSVYLDATLHPLLKEEDFRQEGWRLGPEDPRSILTQGEQSKGNLQSEDVVFKGVVYNEMKGQISDANYLYYIKYRESICPSLNNSGGDPQYITDLTHQQLVDFSKRNYHPSNAKILTYGDMPLSVHLKQIGEVLDGFEKGQADTDVKLPLDLSRGPLNVTVPGPIDTFASEDKQYKTSTSWYMGDTTDVVETFSVGILSSLLLDGYGSPMYRALIEGGLGSSFTPNTGLDSSGRVPIFSVGLTGVSEADAPKVKSTIKRVFEESLSSGFNDEKVQGFLHQLELALRHKTANFGIGVMEKTLSSWFNGSNPMKELSWNEVIDEFKKKYEQGGYLESLMQKYLMNDNCLTFTMVGTPSYNKDLDDQEMVRKEKKLSELVERHGSVEQAVSALAEEELQLLKIQEEAQNADLSCLPSLRVEDISREKERKPVRESKMDDIDVVWREAPTNGLTYFQALNSFEELPDDLRLLLPLFNDCIMRLGTGDKTMEQWEDLIKLKTGGITTSTLHTSSPTELGKFREGLQFSGYALDNNIPDMLQILTTLVTETDFTSPHAPAMIQELLRMTTNGALDAVAGSGHRYALNAAAAGLSRSFWVQEQQSGLAQLQATANLLRDAESSPERLAELIDKLRLIQSFAISKGSGLRVRMVCEPSSASQNEIVLQKWLAGLPRNRSPTSPLDHTSVNSVANRVFYDLPYKVYYSGLAMQTVPFIDPSSAPLSVLSQLLTHKYLHPEIREKGGAYGAGASNGPIKGFFAFTSYRDPNPVNSLKVFQNSGIFARDRAWSDRELAEAKLGIFQGLDAPMSVDEEGARYFMSGVTHEMDQRWREQVLDVTAKDVNEVAQKFLVEGSRQSICLLGEKKDWADSDDWEVRKLSMNASGEPVIDPLSQDGAVASA

SEQ ID NO: 34161 - DNA, 23 bp, Artificial sequence
  (1)..(23): primer
atgttgcggtttcagcgatttgc

SEQ ID NO: 34162 - DNA, 24 bp, Artificial sequence
  (1)..(24): primer
ctacagttccttcacctcccaatt

SEQ ID NO: 34163 - protein, 1038 aa, Artificial sequence
  Variant (2)..(3): xaa in position 2 to 3 is any amino acid
  Variant (8)..(8): xaa in position 8 is any amino acid
  Variant (10)..(14): xaa in position 10 to 14 is any amino acid
  Variant (18)..(19): xaa in position 18 to 19 is any amino acid
  Variant (21)..(21): xaa in position 21 is any amino acid
  Variant (24)..(24): xaa in position 24 is any amino acid
  Variant (26)..(26): xaa in position 26 is any amino acid
  Variant (28)..(28): xaa in position 28 is any amino acid
  Variant (29)..(29): xaa in position 29 is any or no amino acid
  Variant (33)..(33): xaa in position 33 is any amino acid
  Variant (38)..(38): xaa in position 38 is any amino acid
  Variant (40)..(40): xaa in position 40 is any amino acid
  Variant (41)..(41): xaa in position 41 is any or no amino acid
  Variant (43)..(43): xaa in position 43 is any amino acid
  Variant (48)..(48): xaa in position 48 is any amino acid
  Variant (58)..(58): xaa in position 58 is any amino acid
  Variant (74)..(74): xaa in position 74 is any amino acid
  Variant (87)..(87): xaa in position 87 is any amino acid
  Variant (97)..(97): xaa in position 97 is any amino acid
  Variant (100)..(100): xaa in position 100 is any amino acid
  Variant (112)..(113): xaa in position 112 to 113 is any amino acid
  Variant (116)..(116): xaa in position 116 is any amino acid
  Variant (119)..(120): xaa in position 119 to 120 is any amino acid
  Variant (124)..(124): xaa in position 124 is any amino acid
  Variant (128)..(128): xaa in position 128 is any amino acid
  Variant (132)..(134): xaa in position 132 to 134 is any amino acid
  Variant (137)..(137): xaa in position 137 is any amino acid
  Variant (144)..(154): xaa in position 144 to 154 is any amino acid
  Variant (155)..(166): xaa in position 155 to 166 is any or no amino acid
  Variant (183)..(183): xaa in position 183 is any amino acid
  Variant (185)..(185): xaa in position 185 is any amino acid
  Variant (187)..(187): xaa in position 187 is any amino acid
  Variant (193)..(193): xaa in position 193 is any amino acid
  Variant (195)..(195): xaa in position 195 is any amino acid
  Variant (199)..(199): xaa in position 199 is any amino acid
  Variant (208)..(209): xaa in position 208 to 209 is any amino acid
  Variant (214)..(214): xaa in position 214 is any amino acid
  Variant (216)..(217): xaa in position 216 to 217 is any amino acid
  Variant (219)..(220): xaa in position 219 to 220 is any amino acid
  Variant (223)..(225): xaa in position 223 to 225 is any amino acid
  Variant (233)..(233): xaa in position 233 is any amino acid
  Variant (238)..(240): xaa in position 238 to 240 is any amino acid
  Variant (242)..(244): xaa in position 242 to 244 is any amino acid
  Variant (246)..(247): xaa in position 246 to 247 is any amino acid
  Variant (249)..(254): xaa in position 249 to 254 is any amino acid
  Variant (256)..(256): xaa in position 256 is any amino acid
  Variant (258)..(262): xaa in position 258 to 262 is any amino acid
  Variant (263)..(280): xaa in position 263 to 280 is any or no amino acid
  Variant (282)..(295): xaa in position 282 to 295 is any or no amino acid
  Variant (297)..(297): xaa in position 297 is any amino acid
  Variant (304)..(305): xaa in position 304 to 305 is any amino acid
  Variant (307)..(309): xaa in position 307 to 309 is any amino acid
  Variant (311)..(312): xaa in position 311 to 312 is any amino acid
  Variant (313)..(315): xaa in position 313 to 315 is any or no amino acid
  Variant (319)..(321): xaa in position 319 to 321 is any amino acid
  Variant (324)..(325): xaa in position 324 to 325 is any amino acid
  Variant (328)..(328): xaa in position 328 is any amino acid
  Variant (332)..(332): xaa in position 332 is any amino acid
  Variant (334)..(335): xaa in position 334 to 335 is any amino acid
  Variant (337)..(338): xaa in position 337 to 338 is any amino acid
  Variant (342)..(342): xaa in position 342 is any amino acid
  Variant (343)..(343): xaa in position 343 is any or no amino acid
  Variant (347)..(348): xaa in position 347 to 348 is any amino acid
  Variant (351)..(351): xaa in position 351 is any amino acid
  Variant (355)..(355): xaa in position 355 is any amino acid
  Variant (357)..(364): xaa in position 357 to 364 is any amino acid
  Variant (369)..(369): xaa in position 369 is any amino acid
  Variant (371)..(396): xaa in position 371 to 396 is any amino acid
  Variant (397)..(405): xaa in position 397 to 405 is any or no amino acid
  Variant (408)..(408): xaa in position 408 is any amino acid
  Variant (410)..(410): xaa in position 410 is any amino acid
  Variant (417)..(418): xaa in position 417 to 418 is any amino acid
  Variant (420)..(422): xaa in position 420 to 422 is any amino acid
  Variant (424)..(424): xaa in position 424 is any amino acid
  Variant (428)..(428): xaa in position 428 is any amino acid
  Variant (431)..(432): xaa in position 431 to 432 is any amino acid
  Variant (434)..(436): xaa in position 434 to 436 is any amino acid
  Variant (438)..(438): xaa in position 438 is any amino acid
  Variant (440)..(441): xaa in position 440 to 441 is any amino acid
  Variant (444)..(446): xaa in position 444 to 446 is any amino acid
  Variant (448)..(452): xaa in position 448 to 452 is any amino acid
  Variant (454)..(455): xaa in position 454 to 455 is any amino acid
  Variant (457)..(463): xaa in position 457 to 463 is any amino acid
  Variant (465)..(468): xaa in position 465 to 468 is any amino acid
  Variant (469)..(470): xaa in position 469 to 470 is any or no amino acid
  Variant (473)..(473): xaa in position 473 is any amino acid
  Variant (478)..(483): xaa in position 478 to 483 is any amino acid
  Variant (484)..(485): xaa in position 484 to 485 is any or no amino acid
  Variant (489)..(493): xaa in position 489 to 493 is any amino acid
  Variant (495)..(497): xaa in position 495 to 497 is any amino acid
  Variant (499)..(501): xaa in position 499 to 501 is any amino acid
  Variant (503)..(504): xaa in position 503 to 504 is any amino acid
  Variant (507)..(508): xaa in position 507 to 508 is any amino acid
  Variant (511)..(512): xaa in position 511 to 512 is any amino acid
  Variant (514)..(525): xaa in position 514 to 525 is any amino acid
  Variant (526)..(533): xaa in position 526 to 533 is any or no amino acid
  Variant (535)..(544): xaa in position 535 to 544 is any amino acid
  Variant (547)..(548): xaa in position 547 to 548 is any amino acid
  Variant (553)..(553): xaa in position 553 is any amino acid
  Variant (555)..(555): xaa in position 555 is any amino acid
  Variant (558)..(558): xaa in position 558 is any amino acid
  Variant (560)..(565): xaa in position 560 to 565 is any amino acid
  Variant (567)..(578): xaa in position 567 to 578 is any amino acid
  Variant (579)..(582): xaa in position 579 to 582 is any or no amino acid
  Variant (589)..(597): xaa in position 589 to 597 is any amino acid
  Variant (598)..(598): xaa in position 598 is any or no amino acid
  Variant (601)..(601): xaa in position 601 is any amino acid
  Variant (603)..(606): xaa in position 603 to 606 is any amino acid
  Variant (611)..(613): xaa in position 611 to 613 is any amino acid
  Variant (615)..(616): xaa in position 615 to 616 is any amino acid
  Variant (620)..(627): xaa in position 620 to 627 is any amino acid
  Variant (630)..(630): xaa in position 630 is any amino acid
  Variant (634)..(634): xaa in position 634 is any amino acid
  Variant (638)..(638): xaa in position 638 is any or no amino acid
  Variant (641)..(648): xaa in position 641 to 648 is any amino acid
  Variant (650)..(661): xaa in position 650 to 661 is any amino acid
  Variant (662)..(662): xaa in position 662 is any or no amino acid
  Variant (664)..(664): xaa in position 664 is any amino acid
  Variant (667)..(672): xaa in position 667 to 672 is any amino acid
  Variant (675)..(679): xaa in position 675 to 679 is any amino acid
  Variant (682)..(683): xaa in position 682 to 683 is any amino acid
  Variant (685)..(685): xaa in position 685 is any amino acid
  Variant (687)..(691): xaa in position 687 to 691 is any amino acid
  Variant (692)..(696): xaa in position 692 to 696 is any or no amino acid
  Variant (698)..(699): xaa in position 698 to 699 is any amino acid
  Variant (702)..(711): xaa in position 702 to 711 is any amino acid
  Variant (714)..(715): xaa in position 714 to 715 is any amino acid
  Variant (718)..(718): xaa in position 718 is any amino acid
  Variant (721)..(723): xaa in position 721 to 723 is any amino acid
  Variant (725)..(725): xaa in position 725 is any amino acid
  Variant (727)..(727): xaa in position 727 is any amino acid
  Variant (730)..(733): xaa in position 730 to 733 is any amino acid
  Variant (735)..(735): xaa in position 735 is any amino acid
  Variant (737)..(739): xaa in position 737 to 739 is any amino acid
  Variant (742)..(742): xaa in position 742 is any amino acid
  Variant (745)..(746): xaa in position 745 to 746 is any amino acid
  Variant (748)..(749): xaa in position 748 to 749 is any amino acid
  Variant (751)..(760): xaa in position 751 to 760 is any amino acid
  Variant (761)..(764): xaa in position 761 to 764 is any or no amino acid
  Variant (768)..(769): xaa in position 768 to 769 is any amino acid
  Variant (771)..(772): xaa in position 771 to 772 is any amino acid
  Variant (775)..(799): xaa in position 775 to 799 is any amino acid
  Variant (800)..(806): xaa in position 800 to 806 is any or no amino acid
  Variant (808)..(809): xaa in position 808 to 809 is any amino acid
  Variant (811)..(813): xaa in position 811 to 813 is any amino acid
  Variant (815)..(839): xaa in position 815 to 839 is any amino acid
  Variant (840)..(852): xaa in position 840 to 852 is any or no amino acid
  Variant (857)..(857): xaa in position 857 is any amino acid
  Variant (859)..(861): xaa in position 859 to 861 is any amino acid
  Variant (863)..(867): xaa in position 863 to 867 is any amino acid
  Variant (870)..(873): xaa in position 870 to 873 is any amino acid
  Variant (875)..(875): xaa in position 875 is any amino acid
  Variant (877)..(877): xaa in position 877 is any amino acid
  Variant (885)..(885): xaa in position 885 is any amino acid
  Variant (890)..(890): xaa in position 890 is any amino acid
  Variant (904)..(907): xaa in position 904 to 907 is any amino acid
  Variant (909)..(909): xaa in position 909 is any amino acid
  Variant (911)..(911): xaa in position 911 is any amino acid
  Variant (913)..(913): xaa in position 913 is any amino acid
  Variant (923)..(924): xaa in position 923 to 924 is any amino acid
  Variant (927)..(931): xaa in position 927 to 931 is any amino acid
  Variant (933)..(934): xaa in position 933 to 934 is any amino acid
  Variant (936)..(936): xaa in position 936 is any amino acid
  Variant (938)..(940): xaa in position 938 to 940 is any amino acid
  Variant (941)..(947): xaa in position 941 to 947 is any or no amino acid
  Variant (949)..(951): xaa in position 949 to 951 is any amino acid
  Variant (954)..(954): xaa in position 954 is any amino acid
  Variant (959)..(959): xaa in position 959 is any amino acid
  Variant (963)..(963): xaa in position 963 is any amino acid
  Variant (968)..(972): xaa in position 968 to 972 is any amino acid
  Variant (975)..(977): xaa in position 975 to 977 is any amino acid
  Variant (979)..(981): xaa in position 979 to 981 is any amino acid
  Variant (984)..(984): xaa in position 984 is any amino acid
  Variant (987)..(989): xaa in position 987 to 989 is any amino acid
  Variant (992)..(994): xaa in position 992 to 994 is any amino acid
  Variant (997)..(997): xaa in position 997 is any amino acid
  Variant (999)..(1001): xaa in position 999 to 1001 is any amino acid
  Variant (1003)..(1004): xaa in position 1003 to 1004 is any amino acid
  Variant (1007)..(1008): xaa in position 1007 to 1008 is any amino acid
  Variant (1012)..(1032): xaa in position 1012 to 1032 is any amino acid
  Variant (1033)..(1035): xaa in position 1033 to 1035 is any or no amino acid
  Variant (1037)..(1037): xaa in position 1037 is any amino acid
GXXLHGFXVXXXXXVPEXXLXAVXLXHXXTGAXHLHIXRXXDXNNVFXIGFKTNPPDXTGVPHILEHTTLCGSXKYPVRDPFFKMLXRSLSNFMNAXTAXDHTFYPFATTNXXDFXNLXXVYLXATLXPLLXXXDFXQEGWRLXXXXXXXXXXXXXXXXXXXXXXXIVFKGVVYNEMKGQMSXAXYXFWIRFXEXIYPXLNNSGGDPXXITDLXYXXLXXFHXXXYHPSNAKXFTYGXXXLXXXLXXLXXXXXXFXKXXXXXXXXXXXXXXXXXXXXXXXVXXXXXXXXXXXXXXQXKTSVSWXXGXXXDXXXXXETFXXXILXXLLXDGHXSXXYXXLIEXXGLGXXFSXNTGXDXXXXXXXXSIGLXGXXXXXXXXXXXXXXXXXXXXXXXXXXXXXXXXXXXKIXAXLHQLELXXKXXXAXFGLXLLXXIXXXWXNXXDPXXXLXXXXXIXXFXXXXXXXGXXXXXXLIXKYLIXXXXXXXXFTMXXXXXFXXXLXXXEXXRLXXKIXXLXXXXXXXXXXXXXXXXXXXXLXXXXXXXXXXDLXXLPTLXVXDIXRXXXXXXLXXXXXXXXXXXXXXXXTNGLTYXXXXXXXXXXLPXEXXXXLPLFXXXLXXLGTXXXXXXXXEDXIKLXTGGXISXXXXXXXXPXXXXXXXXXXXXXGXALXXXXXXMFXXXXXLLXXTXFXXXXXXXXXXLXXLIXXXXXXXXXXIAXXGHXYAXXXAXAXLSXXXXIXEXXXGLXQVXXIXXLXXXXXXXXXXXXXXEVIXXLXXIQXXXXXXXXXXXXXXXXXXXXXXXXXXXXXXXXLXXFXXXLXXXXXXXXXXXXXXXXXXXXXXXXXXXXXXXXXXXXXXPFQVXYXXXAXXXXXYTXXXXAXLXVLSQLLTXKHLHXEIREKGGAYGGGAXXXXLXGXFXFYSYRDPNPXXSLXXXXXSXXWXLXXXXXXXXXXWXXXDLXEAKLXIFQXVDAPXXXXXEGXXXFXXXITXEMXXXRRXXXLDXTXXXVXXVAXXYLVXXXXXXXXXXXXXXXXXXXXXXXXWXV

SEQ ID NO: 34164 - protein, 101 aa, Artificial sequence
  Variant (2)..(2): xaa in position 2 is any amino acid
  Variant (3)..(3): xaa in position 3 is Ala or Ser
  Variant (4)..(4): xaa in position 4 is Asp, Glu, Gln or Arg
  Variant (5)..(5): xaa in position 5 is His or Tyr
  Variant (8)..(8): xaa in position 8 is Ile, Leu or Val
  Variant (9)..(9): xaa in position 9 is Ala, Asp or Glu
  Variant (11)..(11): xaa in position 11 is Asp, Glu or Asn
  Variant (13)..(13): xaa in position 13 is any amino acid
  Variant (18)..(18): xaa in position 18 is Gly or Ser
  Variant (19)..(19): xaa in position 19 is Ile or Val
  Variant (20)..(20): xaa in position 20 is Ala or Gly
  Variant (22)..(22): xaa in position 22 is Lys or Arg
  Variant (24)..(24): xaa in position 24 is any or no amino acid
  Variant (27)..(27): xaa in position 27 is any or no amino acid
  Variant (29)..(29): xaa in position 29 is any amino acid
  Variant (32)..(32): xaa in position 32 is Ile, Leu or Val
  Variant (45)..(45): xaa in position 45 is any amino acid
  Variant (48)..(48): xaa in position 48 is Pro or Gln
  Variant (49)..(49): xaa in position 49 is Ile or Val
  Variant (58)..(58): xaa in position 58 is Asn or Pro
  Variant (59)..(59): xaa in position 59 is Lys or Arg
  Variant (60)..(60): xaa in position 60 is Ser or Thr
  Variant (62)..(62): xaa in position 62 is Ala or Ser
  Variant (68)..(68): xaa in position 68 is Phe or Met
  Variant (70)..(70): xaa in position 70 is Ala, Gly or Ser
  Variant (71)..(71): xaa in position 71 is any amino acid
  Variant (73)..(73): xaa in position 73 is His or Tyr
  Variant (75)..(75): xaa in position 75 is any amino acid
  Variant (76)..(76): xaa in position 76 is Phe or Tyr
  Variant (79)..(79): xaa in position 79 is Ala or Ser
  Variant (83)..(84): xaa in position 83 to 84 is any amino acid
  Variant (86)..(86): xaa in position 86 is Phe or Met
  Variant (87)..(87): xaa in position 87 is any amino acid
  Variant (90)..(90): xaa in position 90 is any amino acid
  Variant (91)..(91): xaa in position 91 is Asp, Gly or Ser
  Variant (92)..(92): xaa in position 92 is Leu or Val
  Variant (94)..(94): xaa in position 94 is Leu or Met
  Variant (95)..(95): xaa in position 95 is Asp or Asn
  Variant (96)..(96): xaa in position 96 is Ala or Ser
  Variant (98)..(98): xaa in position 98 is Leu or Met
  Variant (99)..(99): xaa in position 99 is any amino acid
TXXXXLHXXRXDXNNVFXXXFXTXPPXDXTGXPHILEHTTLCGSXKYXXRDPFFKMLXXXLXNFMNAXTXXDXTXXPFXTTNXXDXXNLXXXYXXXTXXPL

SEQ ID NO: 34165 - protein, 17 aa, Artificial sequence
  Variant (5)..(5): xaa in position 5 is Phe or Tyr
  Variant (12)..(12): xaa in position 12 is Ile, Met or Val
  Variant (14)..(14): xaa in position 14 is Asp or Asn
  Variant (16)..(16): xaa in position 16 is Ala, Asp, Gly, Asn or Ser
KGVVXNEMKGQXSXAXY

SEQ ID NO: 34166 - protein, 44 aa, Artificial sequence
  Variant (2)..(2): xaa in position 2 is any amino acid
  Variant (7)..(8): xaa in position 7 to 8 is any amino acid
  Variant (10)..(10): xaa in position 10 is Pro, Thr or Val
  Variant (11)..(11): xaa in position 11 is Asp or Glu
  Variant (13)..(13): xaa in position 13 is any amino acid
  Variant (14)..(14): xaa in position 14 is His or Tyr
  Variant (15)..(15): xaa in position 15 is any amino acid
  Variant (16)..(16): xaa in position 16 is Asp, Gly or Gln
  Variant (18)..(19): xaa in position 18 to 19 is any amino acid
  Variant (21)..(24): xaa in position 21 to 24 is any amino acid
  Variant (26)..(26): xaa in position 26 is any amino acid
  Variant (31)..(31): xaa in position 31 is Lys or Arg
  Variant (32)..(32): xaa in position 32 is any amino acid
  Variant (33)..(33): xaa in position 33 is Phe, Ile or Leu
  Variant (34)..(34): xaa in position 34 is Ser or Thr
  Variant (37)..(37): xaa in position 37 is any amino acid
  Variant (38)..(38): xaa in position 38 is Phe, Ile, Leu or Met
  Variant (39)..(39): xaa in position 39 is Pro or Ser
  Variant (40)..(40): xaa in position 40 is Leu or Val
  Variant (41)..(41): xaa in position 41 is any amino acid
  Variant (42)..(42): xaa in position 42 is Asp or Val
  Variant (43)..(43): xaa in position 43 is any amino acid
NXGGDPXXIXXLXXXXLXXFXXXXYXPSNAXXXXYGXXXXXXXL

SEQ ID NO: 34167 - protein, 66 aa, Artificial sequence
  Variant (2)..(2): xaa in position 2 is any amino acid
  Variant (3)..(3): xaa in position 3 is Ser or Thr
  Variant (5)..(6): xaa in position 5 to 6 is any amino acid
  Variant (8)..(10): xaa in position 8 to 10 is any amino acid
  Variant (11)..(11): xaa in position 11 is Asp or Asn
  Variant (12)..(13): xaa in position 12 to 13 is any amino acid
  Variant (14)..(14): xaa in position 14 is Asp, Glu or Gln
  Variant (15)..(15): xaa in position 15 is Ser or Thr
  Variant (17)..(17): xaa in position 17 is any amino acid
  Variant (18)..(18): xaa in position 18 is Ala, Leu or Val
  Variant (19)..(19): xaa in position 19 is any amino acid
  Variant (20)..(20): xaa in position 20 is Ile, Leu or Val
  Variant (21)..(21): xaa in position 21 is Ile or Leu
  Variant (22)..(22): xaa in position 22 is Gly or Ser
  Variant (23)..(23): xaa in position 23 is Ala, Asn, Ser or Thr
  Variant (26)..(26): xaa in position 26 is Phe, Ile, Leu or Met
  Variant (29)..(29): xaa in position 29 is His or Tyr
  Variant (30)..(30): xaa in position 30 is Asp, Gly or Ser
  Variant (32)..(32): xaa in position 32 is Ala, Ile, Pro or Val
  Variant (33)..(33): xaa in position 33 is Phe, Leu or Met
  Variant (34)..(34): xaa in position 34 is His or Tyr
  Variant (35)..(36): xaa in position 35 to 36 is any amino acid
  Variant (38)..(39): xaa in position 38 to 39 is any amino acid
  Variant (40)..(41): xaa in position 40 to 41 is any or no amino acid
  Variant (43)..(49): xaa in position 43 to 49 is any amino acid
  Variant (50)..(50): xaa in position 50 is any or no amino acid
  Variant (52)..(52): xaa in position 52 is Ala, Ser or Thr
  Variant (54)..(54): xaa in position 54 is any amino acid
  Variant (55)..(55): xaa in position 55 is Asp or Glu
  Variant (56)..(56): xaa in position 56 is Asn, Pro, Ser or Thr
  Variant (57)..(57): xaa in position 57 is any amino acid
  Variant (58)..(58): xaa in position 58 is Ala, Gly, Pro or Thr
  Variant (59)..(60): xaa in position 59 to 60 is any amino acid
  Variant (61)..(61): xaa in position 61 is Gly, Asn or Pro
  Variant (62)..(63): xaa in position 62 to 63 is Phe, Ile or Leu
  Variant (64)..(64): xaa in position 64 is Ser or Thr
  Variant (65)..(65): xaa in position 65 is Ile or Val
SXXWXXGXXXXXXXXFXXXXXXXLLXDGXXSXXXXXLXXXXGXXXXXXXXNXGXXXXXXXXXXXXG

SEQ ID NO: 34168 - protein, 89 aa, Artificial sequence
  Variant (2)..(2): xaa in position 2 is Phe or Tyr
  Variant (3)..(3): xaa in position 3 is any amino acid
  Variant (5)..(5): xaa in position 5 is any amino acid
  Variant (7)..(7): xaa in position 7 is Ala, Gly, Ser or Thr
  Variant (8)..(8): xaa in position 8 is Ala, Gly or Ser
  Variant (9)..(9): xaa in position 9 is any amino acid
  Variant (10)..(10): xaa in position 10 is Ala, Cys or Ser
  Variant (11)..(12): xaa in position 11 to 12 is any amino acid
  Variant (13)..(13): xaa in position 13 is Gly or Thr
  Variant (14)..(14): xaa in position 14 is Ala, Ser, Thr or Val
  Variant (15)..(15): xaa in position 15 is Pro or Ser
  Variant (16)..(16): xaa in position 16 is Phe or Tyr
  Variant (17)..(20): xaa in position 17 to 20 is any amino acid
  Variant (21)..(21): xaa in position 21 is Gly, Asn or Ser
  Variant (22)..(22): xaa in position 22 is Ala or Ser
  Variant (23)..(23): xaa in position 23 is any amino acid
  Variant (25)..(25): xaa in position 25 is any amino acid
  Variant (26)..(26): xaa in position 26 is Ile or Val
  Variant (27)..(27): xaa in position 27 is Leu or Met
  Variant (28)..(28): xaa in position 28 is Ala or Ser
  Variant (29)..(29): xaa in position 29 is Asn, Gln or Ser
  Variant (30)..(30): xaa in position 30 is Leu or Met
  Variant (33)..(34): xaa in position 33 to 34 is any or no amino acid
  Variant (36)..(37): xaa in position 36 to 37 is any or no amino acid
  Variant (40)..(40): xaa in position 40 is any amino acid
  Variant (42)..(42): xaa in position 42 is Ile or Val
  Variant (51)..(51): xaa in position 51 is Ala or Gly
  Variant (53)..(53): xaa in position 53 is Ala or Ser
  Variant (54)..(56): xaa in position 54 to 56 is any amino acid
  Variant (57)..(57): xaa in position 57 is Ala, Pro or Ser
  Variant (58)..(59): xaa in position 58 to 59 is any amino acid
  Variant (61)..(61): xaa in position 61 is any amino acid
  Variant (63)..(63): xaa in position 63 is Ala, Gly, Asn or Ser
  Variant (64)..(64): xaa in position 64 is Phe or Tyr
  Variant (65)..(65): xaa in position 65 is any amino acid
  Variant (71)..(71): xaa in position 71 is any amino acid
  Variant (72)..(72): xaa in position 72 is Ala, Leu or Pro
  Variant (73)..(74): xaa in position 73 to 74 is any amino acid
  Variant (75)..(75): xaa in position 75 is Ser or Thr
  Variant (76)..(76): xaa in position 76 is Ile or Leu
  Variant (77)..(81): xaa in position 77 to 81 is any amino acid
  Variant (82)..(82): xaa in position 82 is Ala, Ser or Val
  Variant (83)..(83): xaa in position 83 is Ala, Gly or Pro
  Variant (84)..(84): xaa in position 84 is any amino acid
  Variant (85)..(85): xaa in position 85 is Phe, Trp or Tyr
  Variant (86)..(88): xaa in position 86 to 88 is any amino acid
  Variant (89)..(89): xaa in position 89 is Asp, Glu, Lys or Arg
PXXVXYXXXXXXXXXXXXXXXXXLXXXXXXLTXXHXXLHXEXREKGGAYGXGXXXXXXXGXFXXXSYRDPXXXXXXXXXXXXXXXXXXX

SEQ ID NO: 34169 - DNA, 1755 bp, Saccharomyces cerevisiae; identical to SEQ ID NO: 7718
  CDS (1)..(1755)

SEQ ID NO: 34170 - protein, 584 aa, Saccharomyces cerevisiae; identical to SEQ ID NO: 7719

SEQ ID NO: 34171 - DNA, 1560 bp, Glycine max; identical to SEQ ID NO: 7720
  CDS (1)..(1560)

SEQ ID NO: 34172 - protein, 519 aa, Glycine max; identical to SEQ ID NO: 7721

SEQ ID NO: 34173 - DNA, 1536 bp, Glycine max; identical to SEQ ID NO: 7722
  CDS (1)..(1536)

SEQ ID NO: 34174 - protein, 511 aa, Glycine max; identical to SEQ ID NO: 7723

SEQ ID NO: 34175 - DNA, 2856 bp, Homo sapiens (man); identical to SEQ ID NO: 7724
  CDS (180)..(1658)

SEQ ID NO: 34176 - protein, 492 aa, Homo sapiens (man); identical to SEQ ID NO: 7725

SEQ ID NO: 34177 - DNA, 2487 bp, Oryctolagus cuniculus (domestic rabbit); identical to SEQ ID NO: 7726
  CDS (124)..(1602)

SEQ ID NO: 34178 - protein, 492 aa, Oryctolagus cuniculus (domestic rabbit); identical to SEQ ID NO: 7727

SEQ ID NO: 34179 - DNA, 3642 bp, Saccharomyces cerevisiae; identical to SEQ ID NO: 7728
  CDS (551)..(3205)

SEQ ID NO: 34180 - protein, 884 aa, Saccharomyces cerevisiae; identical to SEQ ID NO: 168

SEQ ID NO: 34181 - DNA, 1774 bp, Mus musculus (house mouse); identical to SEQ ID NO: 7730
  CDS (80)..(1561)

SEQ ID NO: 34182 - protein, 493 aa, Mus musculus (house mouse); identical to SEQ ID NO: 7731

SEQ ID NO: 34183 - DNA, 2798 bp, Leishmania donovani; identical to SEQ ID NO: 7732
  CDS (676)..(2319)

SEQ ID NO: 34184 - protein, 547 aa, Leishmania donovani; identical to SEQ ID NO: 7733

SEQ ID NO: 34185 - DNA, 1536 bp, Arabidopsis thaliana (mouse-ear cress); identical to SEQ ID NO: 7734
  CDS (1)..(1536)

SEQ ID NO: 34186 - protein, 511 aa, Arabidopsis thaliana (mouse-ear cress); identical to SEQ ID NO: 7735

SEQ ID NO: 34187 - DNA, 1482 bp, Arabidopsis thaliana (mouse-ear cress); identical to SEQ ID NO: 7736
  CDS (1)..(1482)

SEQ ID NO: 34188 - protein, 493 aa, Arabidopsis thaliana (mouse-ear cress); identical to SEQ ID NO: 172

SEQ ID NO: 34189 - DNA, 1395 bp, Salmonella enterica subsp. enterica serovar Typhi; identical to SEQ ID NO: 7738
  CDS (1)..(1395)

SEQ ID NO: 34190 - protein, 464 aa, Salmonella enterica subsp. enterica serovar Typhi; identical to SEQ ID NO: 7739

SEQ ID NO: 34191 - DNA, 2568 bp, Saccharomyces cerevisiae; identical to SEQ ID NO: 7740
  CDS (461)..(2299)

SEQ ID NO: 34192 - protein, 612 aa, Saccharomyces cerevisiae; identical to SEQ ID NO: 7741

SEQ ID NO: 34193 - DNA, 1449 bp, Bacillus subtilis; identical to SEQ ID NO: 173
  CDS (1)..(1449)

SEQ ID NO: 34194 - protein, 482 aa, Bacillus subtilis; identical to SEQ ID NO: 174

SEQ ID NO: 34195 - DNA, 1644 bp, Arabidopsis thaliana (mouse-ear cress); identical to SEQ ID NO: 175
  CDS (1)..(1644)

SEQ ID NO: 34196 - protein, 547 aa, Arabidopsis thaliana (mouse-ear cress); identical to SEQ ID NO: 176

SEQ ID NO: 34197 - DNA, 1560 bp, Caulobacter crescentus; identical to SEQ ID NO: 7746
  CDS (1)..(1560)

SEQ ID NO: 34198 - protein, 519 aa, Caulobacter crescentus; identical to SEQ ID NO: 7747

SEQ ID NO: 34199 - DNA, 1386 bp, Bacillus subtilis; identical to SEQ ID NO: 7748
  CDS (1)..(1386)

SEQ ID NO: 34200 - protein, 461 aa, Bacillus subtilis; identical to SEQ ID NO: 7749

SEQ ID NO: 34201 - DNA, 1743 bp, Arabidopsis thaliana (mouse-ear cress); identical to SEQ ID NO: 7750
  CDS (1)..(1743)

SEQ ID NO: 34202 - protein, 580 aa, Arabidopsis thaliana (mouse-ear cress); identical to SEQ ID NO: 7751

SEQ ID NO: 34203 - DNA, 1774 bp, Arabidopsis thaliana (mouse-ear cress); identical to SEQ ID NO: 7752
  CDS (1)..(1743)

SEQ ID NO: 34204 - protein, 580 aa, Arabidopsis thaliana (mouse-ear cress); identical to SEQ ID NO: 7753

SEQ ID NO: 34205 - DNA, 1554 bp, Arabidopsis thaliana (mouse-ear cress); identical to SEQ ID NO: 7754
  CDS (1)..(1554)

SEQ ID NO: 34206 - protein, 517 aa, Arabidopsis thaliana (mouse-ear cress); identical to SEQ ID NO: 7755

SEQ ID NO: 34207 - DNA, 1260 bp, Bacillus subtilis; identical to SEQ ID NO: 7756
  CDS (1)..(1260)

SEQ ID NO: 34208 - protein, 419 aa, Bacillus subtilis; identical to SEQ ID NO: 7757

SEQ ID NO: 34209 - DNA, 1518 bp, Bacillus subtilis; identical to SEQ ID NO: 7758
  CDS (16)..(1389)

SEQ ID NO: 34210 - protein, 457 aa, Bacillus subtilis; identical to SEQ ID NO: 7759

SEQ ID NO: 34211 - DNA, 1695 bp, Arabidopsis thaliana (mouse-ear cress); identical to SEQ ID NO: 7760
  CDS (12)..(1475)

SEQ ID NO: 34212 - protein, 487 aa, Arabidopsis thaliana (mouse-ear cress); identical to SEQ ID NO: 7761

SEQ ID NO: 34213 - DNA, 1395 bp, Bacillus subtilis; identical to SEQ ID NO: 177
  CDS (1)..(1395)

SEQ ID NO: 34214 - protein, 464 aa, Bacillus subtilis; identical to SEQ ID NO: 178

SEQ ID NO: 34215 - DNA, 1780 bp, Arabidopsis thaliana (mouse-ear cress); identical to SEQ ID NO: 7764
  CDS (1)..(1749)

SEQ ID NO: 34216 - protein, 582 aa, Arabidopsis thaliana (mouse-ear cress); identical to SEQ ID NO: 7765

SEQ ID NO: 34217 - DNA, 1368 bp, Clostridium acetobutylicum; identical to SEQ ID NO: 7766
  CDS (1)..(1368)

SEQ ID NO: 34218 - protein, 455 aa, Clostridium acetobutylicum; identical to SEQ ID NO: 7767

SEQ ID NO: 34219 - DNA, 1422 bp, Bacillus subtilis; identical to SEQ ID NO: 7768
  CDS (1)..(1422)

SEQ ID NO: 34220 - protein, 473 aa, Bacillus subtilis; identical to SEQ ID NO: 7769

SEQ ID NO: 34221 - DNA, 1566 bp, Arabidopsis thaliana (mouse-ear cress); identical to SEQ ID NO: 181
  CDS (1)..(1566)

SEQ ID NO: 34222 - protein, 521 aa, Arabidopsis thaliana (mouse-ear cress); identical to SEQ ID NO: 182

SEQ ID NO: 34223 - DNA, 1302 bp, Lactococcus lactis subsp. lactis; identical to SEQ ID NO: 7772
  CDS (1)..(1302)

SEQ ID NO: 34224 - protein, 433 aa, Lactococcus lactis subsp. lactis; identical to SEQ ID NO: 7773

SEQ ID NO: 34225 - DNA, 1536 bp, Arabidopsis thaliana (mouse-ear cress); identical to SEQ ID NO: 183
  CDS (1)..(1536)

SEQ ID NO: 34226 - protein, 511 aa, Arabidopsis thaliana (mouse-ear cress); identical to SEQ ID NO: 184

SEQ ID NO: 34227 - DNA, 1410 bp, Clostridium acetobutylicum; identical to SEQ ID NO: 185
  CDS (1)..(1410)

SEQ ID NO: 34228 - protein, 469 aa, Clostridium acetobutylicum; identical to SEQ ID NO: 186

SEQ ID NO: 34229 - DNA, 2890 bp, Saccharomyces cerevisiae; identical to SEQ ID NO: 189
  CDS (818)..(2443)

SEQ ID NO: 34230 - protein, 541 aa, Saccharomyces cerevisiae; identical to SEQ ID NO: 190

SEQ ID NO: 34231 - DNA, 2613 bp, Mus musculus (house mouse); identical to SEQ ID NO: 7780
  CDS (180)..(1658)

SEQ ID NO: 34232 - protein, 492 aa, Mus musculus (house mouse); identical to SEQ ID NO: 7781

SEQ ID NO: 34233 - DNA, 1559 bp, Synechocystis sp; identical to SEQ ID NO: 7782
  CDS (92)..(1498)

SEQ ID NO: 34234 - protein, 468 aa, Synechocystis sp; identical to SEQ ID NO: 7783

SEQ ID NO: 34235 - DNA, 1704 bp, Kluyveromyces marxianus var. lactis, Candida sphaerica; identical to SEQ ID NO: 193
  CDS (1)..(1704)

SEQ ID NO: 34236 - protein, 567 aa, Kluyveromyces marxianus var. lactis, Candida sphaerica; identical to SEQ ID NO: 194

SEQ ID NO: 34237 - DNA, 1545 bp, Arabidopsis thaliana (mouse-ear cress); identical to SEQ ID NO: 7786
  CDS (1)..(1545)

SEQ ID NO: 34238 - protein, 514 aa, Arabidopsis thaliana (mouse-ear cress); identical to SEQ ID NO: 7787

SEQ ID NO: 34239 - DNA, 1853 bp, Nicotiana tabacum (common tobacco); identical to SEQ ID NO: 7788
  CDS (103)..(1674)

SEQ ID NO: 34240 - protein, 523 aa, Nicotiana tabacum (common tobacco); identical to SEQ ID NO: 7789

SEQ ID NO: 34241 - DNA, 2114 bp, Saccharomyces cerevisiae; identical to SEQ ID NO: 7790
  CDS (373)..(2076)

SEQ ID NO: 34242 - protein, 567 aa, Saccharomyces cerevisiae; identical to SEQ ID NO: 196

SEQ ID NO: 34243 - DNA, 1605 bp, Chlorella kessleri; identical to SEQ ID NO: 7792
  CDS (1)..(1605)

SEQ ID NO: 34244 - protein, 534 aa, Chlorella kessleri; identical to SEQ ID NO: 7793

SEQ ID NO: 34245 - DNA, 2160 bp, Saccharomyces cerevisiae; identical to SEQ ID NO: 197
  CDS (216)..(1928)

SEQ ID NO: 34246 - protein, 570 aa, Saccharomyces cerevisiae; identical to SEQ ID NO: 198

SEQ ID NO: 34247 - DNA, 1673 bp, Rattus norvegicus (Norway rat); identical to SEQ ID NO: 7796
  CDS (85)..(1566)

SEQ ID NO: 34248 - protein, 493 aa, Rattus norvegicus (Norway rat); identical to SEQ ID NO: 7797

SEQ ID NO: 34249 - DNA, 2209 bp, Saccharomyces cerevisiae; identical to SEQ ID NO: 7798
  CDS (213)..(1925)

SEQ ID NO: 34250 - protein, 570 aa, Saccharomyces cerevisiae; identical to SEQ ID NO: 7799

SEQ ID NO: 34251 - DNA, 3025 bp, Saccharomyces cerevisiae; identical to SEQ ID NO: 201
  CDS (510)..(2288)

SEQ ID NO: 34252 - protein, 592 aa, Saccharomyces cerevisiae; identical to SEQ ID NO: 202

SEQ ID NO: 34253 - DNA, 1683 bp, Saccharomyces cerevisiae; identical to SEQ ID NO: 7802
  CDS (1)..(1683)

SEQ ID NO: 34254 - protein, 560 aa, Saccharomyces cerevisiae; identical to SEQ ID NO: 7803

SEQ ID NO: 34255 - DNA, 1463 bp, Klebsiella oxytoca; identical to SEQ ID NO: 7804
  CDS (27)..(1445)

SEQ ID NO: 34256 - protein, 472 aa, Klebsiella oxytoca; identical to SEQ ID NO: 7805

SEQ ID NO: 34257 - DNA, 1641 bp, Saccharomyces cerevisiae; identical to SEQ ID NO: 203
  CDS (1)..(1641)

SEQ ID NO: 34258 - protein, 546 aa, Saccharomyces cerevisiae; identical to SEQ ID NO: 204

SEQ ID NO: 34259 - DNA, 1695 bp, Saccharomyces cerevisiae; identical to SEQ ID NO: 205
  CDS (1)..(1695)

SEQ ID NO: 34260 - protein, 564 aa, Saccharomyces cerevisiae; identical to SEQ ID NO: 206

SEQ ID NO: 34261 - DNA, 3277 bp, Saccharomyces cerevisiae; identical to SEQ ID NO: 207
  CDS (802)..(2505)

SEQ ID NO: 34262 - protein, 567 aa, Saccharomyces cerevisiae; identical to SEQ ID NO: 208

SEQ ID NO: 34263 - DNA, 1710 bp, Saccharomyces cerevisiae; identical to SEQ ID NO: 209
  CDS (1)..(1710)

SEQ ID NO: 34264 - protein, 569 aa, Saccharomyces cerevisiae; identical to SEQ ID NO: 210

SEQ ID NO: 34265 - DNA, 1701 bp, Kluyveromyces marxianus var. lactis, Candida sphaerica; identical to SEQ ID NO: 211
  CDS (1)..(1701)

SEQ ID NO: 34266 - protein, 566 aa, Kluyveromyces marxianus var. lactis, Candida sphaerica; identical to SEQ ID NO: 212

SEQ ID NO: 34267 - DNA, 1704 bp, Saccharomyces cerevisiae; identical to SEQ ID NO: 7816
  CDS (1)..(1704)

SEQ ID NO: 34268 - protein, 567 aa, Saccharomyces cerevisiae; identical to SEQ ID NO: 7817

SEQ ID NO: 34269 - DNA, 3323 bp, Saccharomyces cerevisiae; identical to SEQ ID NO: 217
  CDS (1189)..(2883)

SEQ ID NO: 34270 - protein, 564 aa, Saccharomyces cerevisiae; identical to SEQ ID NO: 218

SEQ ID NO: 34271 - DNA, 3143 bp, Saccharomyces cerevisiae; identical to SEQ ID NO: 219
  CDS (962)..(2686)

SEQ ID NO: 34272 - protein, 574 aa, Saccharomyces cerevisiae; identical to SEQ ID NO: 220

SEQ ID NO: 34273 - DNA, 4409 bp, Saccharomyces cerevisiae; identical to SEQ ID NO: 221
  CDS (1233)..(3524)

SEQ ID NO: 34274 - protein, 763 aa, Saccharomyces cerevisiae; identical to SEQ ID NO: 222

SEQ ID NO: 34275 - DNA, 1668 bp, Saccharomyces cerevisiae; identical to SEQ ID NO: 7824
  CDS (1)..(1668)

SEQ ID NO: 34276 - protein, 555 aa, Saccharomyces cerevisiae; identical to SEQ ID NO: 7825

SEQ ID NO: 34277 - DNA, 1542 bp, Arabidopsis thaliana (mouse-ear cress); identical to SEQ ID NO: 7826
  CDS (1)..(1542)

SEQ ID NO: 34278 - protein, 513 aa, Arabidopsis thaliana (mouse-ear cress); identical to SEQ ID NO: 7827

SEQ ID NO: 34279 - DNA, 1524 bp, Arabidopsis thaliana (mouse-ear cress); identical to SEQ ID NO: 7828
  CDS (1)..(1524)

SEQ ID NO: 34280 - protein, 507 aa, Arabidopsis thaliana (mouse-ear cress); identical to SEQ ID NO: 7829

SEQ ID NO: 34281 - DNA, 1868 bp, Arabidopsis thaliana (mouse-ear cress); identical to SEQ ID NO: 7830
  CDS (73)..(1653)

SEQ ID NO: 34282 - protein, 526 aa, Arabidopsis thaliana (mouse-ear cress); identical to SEQ ID NO: 7831

SEQ ID NO: 34283 - DNA, 1527 bp, Arabidopsis thaliana (mouse-ear cress); identical to SEQ ID NO: 7832
  CDS (1)..(1527)

SEQ ID NO: 34284 - protein, 508 aa, Arabidopsis thaliana (mouse-ear cress); identical to SEQ ID NO: 7833

SEQ ID NO: 34285 - DNA, 2118 bp, Lycopersicon esculentum (tomato); identical to SEQ ID NO: 7834
  CDS (93)..(1664)

SEQ ID NO: 34286 - protein, 523 aa, Lycopersicon esculentum (tomato); identical to SEQ ID NO: 7835

SEQ ID NO: 34287 - DNA, 1779 bp, Ricinus communis (castor bean); identical to SEQ ID NO: 7836
  CDS (86)..(1657)

SEQ ID NO: 34288 - protein, 523 aa, Ricinus communis (castor bean); identical to SEQ ID NO: 7837

SEQ ID NO: 34289 - DNA, 1966 bp, Ricinus communis (castor bean); identical to SEQ ID NO: 7838
  CDS (63)..(1595): n means a or g or c or t/u, s means g or c

SEQ ID NO: 34290 - protein, 510 aa, Ricinus communis (castor bean); identical to SEQ ID NO: 7839
  Xaa in positions 117 and 122 is unknown

SEQ ID NO: 34291 - DNA, 1861 bp, Ricinus communis (castor bean); identical to SEQ ID NO: 7840
  CDS (102)..(1670)

SEQ ID NO: 34292 - protein, 522 aa, Ricinus communis (castor bean); identical to SEQ ID NO: 7841

SEQ ID NO: 34293 - DNA, 1672 bp, Vicia faba (fava bean); identical to SEQ ID NO: 7842
  CDS (18)..(1568)

SEQ ID NO: 34294 - protein, 516 aa, Vicia faba (fava bean); identical to SEQ ID NO: 7843

SEQ ID NO: 34295 - DNA, 2020 bp, Beta vulgaris (beet); identical to SEQ ID NO: 229
  CDS (190)..(1662)

SEQ ID NO: 34296 - protein, 490 aa, Beta vulgaris (beet); identical to SEQ ID NO: 230

SEQ ID NO: 34297 - DNA, 1925 bp, Beta vulgaris (beet); identical to SEQ ID NO: 7846
  CDS (40)..(1689)

SEQ ID NO: 34298 - protein, 549 aa, Beta vulgaris (beet); identical to SEQ ID NO: 7847

SEQ ID NO: 34299 - DNA, 1820 bp, Picea abies (Norway spruce); identical to SEQ ID NO: 7848
  CDS (33)..(1574)

SEQ ID NO: 34300 - protein, 513 aa, Picea abies (Norway spruce); identical to SEQ ID NO: 7849

SEQ ID NO: 34301 - DNA, 1920 bp, Caenorhabditis elegans; identical to SEQ ID NO: 7850
  CDS (1)..(1920)

SEQ ID NO: 34302 - protein, 639 aa, Caenorhabditis elegans; identical to SEQ ID NO: 7851

SEQ ID NO: 34303 - DNA, 1821 bp, Caenorhabditis elegans; identical to SEQ ID NO: 7852
  CDS (1)..(1821)

SEQ ID NO: 34304 - protein, 606 aa, Caenorhabditis elegans; identical to SEQ ID NO: 7853

SEQ ID NO: 34305 - DNA, 1842 bp, Caenorhabditis elegans; identical to SEQ ID NO: 7854
  CDS (1)..(1842)

SEQ ID NO: 34306 - protein, 613 aa, Caenorhabditis elegans; identical to SEQ ID NO: 7855

SEQ ID NO: 34307 - DNA, 1419 bp, Streptomyces coelicolor; identical to SEQ ID NO: 7856
  CDS (1)..(1419)

SEQ ID NO: 34308 - protein, 472 aa, Streptomyces coelicolor; identical to SEQ ID NO: 7857

SEQ ID NO: 34309 - DNA, 1674 bp, Schizosaccharomyces pombe; identical to SEQ ID NO: 233
  CDS (1)..(1674)

SEQ ID NO: 34310 - protein, 557 aa, Schizosaccharomyces pombe; identical to SEQ ID NO: 234

SEQ ID NO: 34311 - DNA, 2407 bp, Schizosaccharomyces pombe; identical to SEQ ID NO: 7860
  CDS (401)..(2128)

SEQ ID NO: 34312 - protein, 575 aa, Schizosaccharomyces pombe; identical to SEQ ID NO: 7861

SEQ ID NO: 34313 - DNA, 1998 bp, Neurospora crassa; identical to SEQ ID NO: 7862
  CDS (1)..(1998)

SEQ ID NO: 34314 - protein, 665 aa, Neurospora crassa; identical to SEQ ID NO: 7863

SEQ ID NO: 34315 - DNA, 1678 bp, Arabidopsis thaliana (mouse-ear cress); identical to SEQ ID NO: 7864
  CDS (40)..(1530)

SEQ ID NO: 34316 - protein, 496 aa, Arabidopsis thaliana (mouse-ear cress); identical to SEQ ID NO: 7865

SEQ ID NO: 34317 - DNA, 2072 bp, Mus sp; identical to SEQ ID NO: 7866
  CDS (21)..(1454)

SEQ ID NO: 34318 - protein, 477 aa, Mus sp; identical to SEQ ID NO: 7867

SEQ ID NO: 34319 - DNA, 2177 bp, Homo sapiens; identical to SEQ ID NO: 7868
  CDS (288)..(2177)

SEQ ID NO: 34320 - protein, 629 aa, Homo sapiens; identical to SEQ ID NO: 7869

SEQ ID NO: 34321 - DNA, 1422 bp, Bacillus megaterium; identical to SEQ ID NO: 7870
  CDS (1)..(1422)

SEQ ID NO: 34322 - protein, 473 aa, Bacillus megaterium; identical to SEQ ID NO: 7871

SEQ ID NO: 34323 - DNA, 1711 bp, Amanita muscaria; identical to SEQ ID NO: 247
  CDS (38)..(1600)

SEQ ID NO: 34324 - protein, 520 aa, Amanita muscaria; identical to SEQ ID NO: 248

SEQ ID NO: 34325 - DNA, 2700 bp, Kluyveromyces lactis; identical to SEQ ID NO: 7874
  CDS (453)..(2603)

SEQ ID NO: 34326 - protein, 716 aa, Kluyveromyces lactis; identical to SEQ ID NO: 7875

SEQ ID NO: 34327 - DNA, 2065 bp, Prunus armeniaca; identical to SEQ ID NO: 7876
  CDS (363)..(1790)

SEQ ID NO: 34328 - protein, 475 aa, Prunus armeniaca; identical to SEQ ID NO: 7877

SEQ ID NO: 34329 - DNA, 1893 bp, Petunia hybrida; identical to SEQ ID NO: 7878
  CDS (253)..(1785)

SEQ ID NO: 34330 - protein, 510 aa, Petunia hybrida; identical to SEQ ID NO: 7879

SEQ ID NO: 34331 - DNA, 1425 bp, Tetragenococcus halophilus; identical to SEQ ID NO: 249
  CDS (1)..(1425)

SEQ ID NO: 34332 - protein, 474 aa, Tetragenococcus halophilus; identical to SEQ ID NO: 250

SEQ ID NO: 34333 - DNA, 2846 bp, Pichia stipitis; identical to SEQ ID NO: 251
  CDS (175)..(1836)

SEQ ID NO: 34334 - protein, 553 aa, Pichia stipitis; identical to SEQ ID NO: 252

SEQ ID NO: 34335 - DNA, 2054 bp, Beta vulgaris subsp; identical to SEQ ID NO: 253
  CDS (94)..(1731)

SEQ ID NO: 34336 - protein, 545 aa, Beta vulgaris subsp; identical to SEQ ID NO: 254

SEQ ID NO: 34337 - DNA, 1708 bp, Taenia solium; identical to SEQ ID NO: 7886
  CDS (46)..(1548)

SEQ ID NO: 34338 - protein, 500 aa, Taenia solium; identical to SEQ ID NO: 7887

SEQ ID NO: 34339 - DNA, 1753 bp, Medicago truncatula; identical to SEQ ID NO: 7888
  CDS (29)..(1585)

SEQ ID NO: 34340 - protein, 518 aa, Medicago truncatula; identical to SEQ ID NO: 7889

SEQ ID NO: 34341 - DNA, 1726 bp, Saccharum hybrid; identical to SEQ ID NO: 7890
  CDS (73)..(1629)

SEQ ID NO: 34342 - protein, 518 aa, Saccharum hybrid; identical to SEQ ID NO: 7891

SEQ ID NO: 34343 - DNA, 1638 bp, Debaryomyces hansenii; identical to SEQ ID NO: 265
  CDS (1)..(1638)

SEQ ID NO: 34344 - protein, 545 aa, Debaryomyces hansenii; identical to SEQ ID NO: 266

SEQ ID NO: 34345 - DNA, 1737 bp, Debaryomyces hansenii; identical to SEQ ID NO: 277
  CDS (1)..(1737)

SEQ ID NO: 34346 - protein, 578 aa, Debaryomyces hansenii; identical to SEQ ID NO: 278

SEQ ID NO: 34347 - DNA, 1584 bp, Debaryomyces hansenii; identical to SEQ ID NO: 279
  CDS (1)..(1584)

SEQ ID NO: 34348 - protein, 527 aa, Debaryomyces hansenii; identical to SEQ ID NO: 280

SEQ ID NO: 34349 - DNA, 1674 bp, Debaryomyces hansenii; identical to SEQ ID NO: 281
  CDS (1)..(1674)

SEQ ID NO: 34350 - protein, 557 aa, Debaryomyces hansenii; identical to SEQ ID NO: 282

SEQ ID NO: 34351 - DNA, 1671 bp, Debaryomyces hansenii; identical to SEQ ID NO: 7900
  CDS (1)..(1671)

SEQ ID NO: 34352 - protein, 556 aa, Debaryomyces hansenii; identical to SEQ ID NO: 7901

SEQ ID NO: 34353 - DNA, 1947 bp, Debaryomyces hansenii; identical to SEQ ID NO: 7902
  CDS (1)..(1947)

SEQ ID NO: 34354 - protein, 648 aa, Debaryomyces hansenii; identical to SEQ ID NO: 7903

SEQ ID NO: 34355 - DNA, 2196 bp, Debaryomyces hansenii; identical to SEQ ID NO: 287
  CDS (1)..(2196)

SEQ ID NO: 34356 - protein, 731 aa, Debaryomyces hansenii; identical to SEQ ID NO: 288

SEQ ID NO: 34357 - DNA, 1659 bp, Debaryomyces hansenii; identical to SEQ ID NO: 291
  CDS (1)..(1659)

SEQ ID NO: 34358 - protein, 552 aa, Debaryomyces hansenii; identical to SEQ ID NO: 292

SEQ ID NO: 34359 - DNA, 1623 bp, Yarrowia lipolytica; identical to SEQ ID NO: 293
  CDS (1)..(1623)

SEQ ID NO: 34360 - protein, 540 aa, Yarrowia lipolytica; identical to SEQ ID NO: 294

SEQ ID NO: 34361 - DNA, 1602 bp, Yarrowia lipolytica; identical to SEQ ID NO: 295
  CDS (1)..(1602)

SEQ ID NO: 34362 - protein, 533 aa, Yarrowia lipolytica; identical to SEQ ID NO: 296

SEQ ID NO: 34363 - DNA, 1980 bp, Yarrowia lipolytica; identical to SEQ ID NO: 7912
  CDS (1)..(1980)

SEQ ID NO: 34364 - protein, 659 aa, Yarrowia lipolytica; identical to SEQ ID NO: 7913

SEQ ID NO: 34365 - DNA, 1548 bp, Yarrowia lipolytica; identical to SEQ ID NO: 305
  CDS (1)..(1548)

SEQ ID NO: 34366 - protein, 515 aa, Yarrowia lipolytica; identical to SEQ ID NO: 306

SEQ ID NO: 34367 - DNA, 1665 bp, Yarrowia lipolytica; identical to SEQ ID NO: 309
  CDS (1)..(1665)

SEQ ID NO: 34368 - protein, 554 aa, Yarrowia lipolytica; identical to SEQ ID NO: 310

SEQ ID NO: 34369 - DNA, 2364 bp, Kluyveromyces lactis; identical to SEQ ID NO: 317
  CDS (1)..(2364)

SEQ ID NO: 34370 - protein, 787 aa, Kluyveromyces lactis; identical to SEQ ID NO: 318

SEQ ID NO: 34371 - DNA, 1710 bp, Kluyveromyces lactis; identical to SEQ ID NO: 7920
  CDS (1)..(1710)

SEQ ID NO: 34372 - protein, 569 aa, Kluyveromyces lactis; identical to SEQ ID NO: 7921

SEQ ID NO: 34373 - DNA, 1530 bp, Equus caballus; identical to SEQ ID NO: 7922
  CDS (1)..(1530): n means a or g or c or t/u, s means g or c

SEQ ID NO: 34374 - protein, 509 aa, Equus caballus; identical to SEQ ID NO: 7923
  Xaa in position 16 is unknown

SEQ ID NO: 34375 - DNA, 1850 bp, Oryza sativa; identical to SEQ ID NO: 7924
  CDS (99)..(1634)

SEQ ID NO: 34376 - protein, 511 aa, Oryza sativa; identical to SEQ ID NO: 7925

SEQ ID NO: 34377 - DNA, 1644 bp, Candida glabrata; identical to SEQ ID NO: 7926
  CDS (1)..(1644)

SEQ ID NO: 34378 - protein, 547 aa, Candida glabrata; identical to SEQ ID NO: 7927

SEQ ID NO: 34379 - DNA, 2571 bp, Candida glabrata; identical to SEQ ID NO: 329
  CDS (1)..(2571)

SEQ ID NO: 34380 - protein, 856 aa, Candida glabrata; identical to SEQ ID NO: 330

SEQ ID NO: 34381 - DNA, 1713 bp, Candida glabrata; identical to SEQ ID NO: 7930
  CDS (1)..(1713)

SEQ ID NO: 34382 - protein, 570 aa, Candida glabrata; identical to SEQ ID NO: 7931

SEQ ID NO: 34383 - DNA, 2289 bp, Candida glabrata; identical to SEQ ID NO: 331
  CDS (1)..(2289)

SEQ ID NO: 34384 - protein, 762 aa, Candida glabrata; identical to SEQ ID NO: 332

SEQ ID NO: 34385 - DNA, 1695 bp, Candida glabrata; identical to SEQ ID NO: 335
  CDS (1)..(1695)

SEQ ID NO: 34386 - protein, 564 aa, Candida glabrata; identical to SEQ ID NO: 336

SEQ ID NO: 34387 - DNA, 1692 bp, Candida glabrata; identical to SEQ ID NO: 341
  CDS (1)..(1692)

SEQ ID NO: 34388 - protein, 563 aa, Candida glabrata; identical to SEQ ID NO: 342

SEQ ID NO: 34389 - DNA, 1707 bp, Candida glabrata; identical to SEQ ID NO: 343
  CDS (1)..(1707)

SEQ ID NO: 34390 - protein, 568 aa, Candida glabrata; identical to SEQ ID NO: 344

SEQ ID NO: 34391 - DNA, 1671 bp, Candida glabrata; identical to SEQ ID NO: 345
  CDS (1)..(1671)

SEQ ID NO: 34392 - protein, 556 aa, Candida glabrata; identical to SEQ ID NO: 346

SEQ ID NO: 34393 - DNA, 1754 bp, Oryza sativa; identical to SEQ ID NO: 7942
  CDS (115)..(1677)

SEQ ID NO: 34394 - protein, 520 aa, Oryza sativa; identical to SEQ ID NO: 7943

SEQ ID NO: 34395 - DNA, 2196 bp, Oryza sativa; identical to SEQ ID NO: 7944
  CDS (301)..(1746)

SEQ ID NO: 34396 - protein, 481 aa, Oryza sativa; identical to SEQ ID NO: 7945

SEQ ID NO: 34397 - DNA, 2048 bp, Equus caballus; identical to SEQ ID NO: 355
  CDS (178)..(1752): n means a or g or c or t/u, s means g or c

SEQ ID NO: 34398 - protein, 524 aa, Equus caballus; identical to SEQ ID NO: 356

SEQ ID NO: 34399 - DNA, 1443 bp, Photobacterium profundum; identical to SEQ ID NO: 7948
  CDS (1)..(1443)

SEQ ID NO: 34400 - protein, 480 aa, Photobacterium profundum; identical to SEQ ID NO: 7949

SEQ ID NO: 34401 - DNA, 2181 bp, Drosophila melanogaster; identical to SEQ ID NO: 7950
  CDS (549)..(2015)

SEQ ID NO: 34402 - protein, 488 aa, Drosophila melanogaster; identical to SEQ ID NO: 7951

SEQ ID NO: 34403 - DNA, 2536 bp, Pichia angusta; identical to SEQ ID NO: 7952
  CDS (578)..(2203)

SEQ ID NO: 34404 - protein, 541 aa, Pichia angusta; identical to SEQ ID NO: 7953

SEQ ID NO: 34405 - DNA, 1544 bp, Bos taurus; identical to SEQ ID NO: 7954
  CDS (12)..(1541)

SEQ ID NO: 34406 - protein, 509 aa, Bos taurus; identical to SEQ ID NO: 7955

SEQ ID NO: 34407 - DNA, 1590 bp, Oryza sativa; identical to SEQ ID NO: 7956
  CDS (1)..(1590)

SEQ ID NO: 34408 - protein, 529 aa, Oryza sativa; identical to SEQ ID NO: 7957

SEQ ID NO: 34409 - DNA, 1548 bp, Oryza sativa; identical to SEQ ID NO: 7958
  CDS (1)..(1548)

SEQ ID NO: 34410 - protein, 515 aa, Oryza sativa; identical to SEQ ID NO: 7959

SEQ ID NO: 34411 - DNA, 2355 bp, Oryctolagus cuniculus; identical to SEQ ID NO: 7960
  CDS (1)..(1530)

SEQ ID NO: 34412 - protein, 509 aa, Oryctolagus cuniculus; identical to SEQ ID NO: 7961

SEQ ID NO: 34413 - DNA, 2073 bp, Bos taurus; identical to SEQ ID NO: 7962
  CDS (96)..(1532)

SEQ ID NO: 34414 - protein, 478 aa, Bos taurus; identical to SEQ ID NO: 7963

SEQ ID NO: 34415 - DNA, 1560 bp, Oryza sativa; identical to SEQ ID NO: 7964
  CDS (1)..(1560)

SEQ ID NO: 34416 - protein, 519 aa, Oryza sativa; identical to SEQ ID NO: 7965

SEQ ID NO: 34417 - DNA, 1891 bp, Plantago major; identical to SEQ ID NO: 369
  CDS (146)..(1738)

SEQ ID NO: 34418 - protein, 530 aa, Plantago major; identical to SEQ ID NO: 370

SEQ ID NO: 34419 - DNA, 1987 bp, Plantago major; identical to SEQ ID NO: 371
  CDS (116)..(1705)

SEQ ID NO: 34420 - protein, 529 aa, Plantago major; identical to SEQ ID NO: 372

SEQ ID NO: 34421 - DNA, 1407 bp, Bacillus cereus; identical to SEQ ID NO: 7970
  CDS (1)..(1407)

SEQ ID NO: 34422 - protein, 468 aa, Bacillus cereus; identical to SEQ ID NO: 7971

SEQ ID NO: 34423 - DNA, 1431 bp, Mycobacterium paratuberculosis; identical to SEQ ID NO: 7972
  CDS (1)..(1431)

SEQ ID NO: 34424 - protein, 476 aa, Mycobacterium paratuberculosis; identical to SEQ ID NO: 7973

SEQ ID NO: 34425 - DNA, 1716 bp, Ashbya gossypii; identical to SEQ ID NO: 7974
  CDS (1)..(1716)

SEQ ID NO: 34426 - protein, 571 aa, Ashbya gossypii; identical to SEQ ID NO: 7975

SEQ ID NO: 34427 - DNA, 1608 bp, Ashbya gossypii; identical to SEQ ID NO: 375
  CDS (1)..(1608)

SEQ ID NO: 34428 - protein, 535 aa, Ashbya gossypii; identical to SEQ ID NO: 376

SEQ ID NO: 34429 - DNA, 1641 bp, Ashbya gossypii; identical to SEQ ID NO: 377
  CDS (1)..(1641)

SEQ ID NO: 34430 - protein, 546 aa, Ashbya gossypii; identical to SEQ ID NO: 378

SEQ ID NO: 34431 - DNA, 1620 bp, Ashbya gossypii; identical to SEQ ID NO: 379
  CDS (1)..(1620)

SEQ ID NO: 34432 - protein, 539 aa, Ashbya gossypii; identical to SEQ ID NO: 380

SEQ ID NO: 34433 - DNA, 1644 bp, Ashbya gossypii; identical to SEQ ID NO: 381
  CDS (1)..(1644)

SEQ ID NO: 34434 - protein, 547 aa, Ashbya gossypii; identical to SEQ ID NO: 382

SEQ ID NO: 34435 - DNA, 1995 bp, Ashbya gossypii; identical to SEQ ID NO: 383
  CDS (1)..(1995)

SEQ ID NO: 34436 - protein, 664 aa, Ashbya gossypii; identical to SEQ ID NO: 384

SEQ ID NO: 34437 - DNA, 1476 bp, Shigella flexneri; identical to SEQ ID NO: 7986
  CDS (1)..(1476)

SEQ ID NO: 34438 - protein, 491 aa, Shigella flexneri; identical to SEQ ID NO: 7987

SEQ ID NO: 34439 - DNA, 1557 bp, Oryza sativa; identical to SEQ ID NO: 7988
  CDS (1)..(1557)

SEQ ID NO: 34440 - protein, 518 aa, Oryza sativa; identical to SEQ ID NO: 7989

SEQ ID NO: 34441 - DNA, 1774 bp, Anopheles gambiae str; identical to SEQ ID NO: 7990
  CDS (94)..(1542)

SEQ ID NO: 34442 - protein, 482 aa, Anopheles gambiae str; identical to SEQ ID NO: 7991

SEQ ID NO: 34443 - DNA, 1785 bp, Neurospora crassa; identical to SEQ ID NO: 7992
  CDS (1)..(1785)

SEQ ID NO: 34444 - protein, 594 aa, Neurospora crassa; identical to SEQ ID NO: 7993

SEQ ID NO: 34445 - DNA, 1620 bp, Neurospora crassa; identical to SEQ ID NO: 387
  CDS (1)..(1620)

SEQ ID NO: 34446 - protein, 539 aa, Neurospora crassa; identical to SEQ ID NO: 388

SEQ ID NO: 34447 - DNA, 1752 bp, Neurospora crassa; identical to SEQ ID NO: 401
  CDS (1)..(1752)

SEQ ID NO: 34448 - protein, 583 aa, Neurospora crassa; identical to SEQ ID NO: 402

SEQ ID NO: 34449 - DNA, 1464 bp, Neurospora crassa; identical to SEQ ID NO: 7998
  CDS (1)..(1464)

SEQ ID NO: 34450 - protein, 487 aa, Neurospora crassa; identical to SEQ ID NO: 7999

SEQ ID NO: 34451 - DNA, 1509 bp, Mycobacterium bovis; identical to SEQ ID NO: 425
  CDS (1)..(1509)

SEQ ID NO: 34452 - protein, 502 aa, Mycobacterium bovis; identical to SEQ ID NO: 426

SEQ ID NO: 34453 - DNA, 1455 bp, Rhodopirellula baltica; identical to SEQ ID NO: 8002
  CDS (1)..(1455)

SEQ ID NO: 34454 - protein, 484 aa, Rhodopirellula baltica; identical to SEQ ID NO: 8003

SEQ ID NO: 34455 - DNA, 1847 bp, Oryza sativa; identical to SEQ ID NO: 8004
  CDS (94)..(1647)

SEQ ID NO: 34456 - protein, 517 aa, Oryza sativa; identical to SEQ ID NO: 8005

SEQ ID NO: 34457 - DNA, 2251 bp, Oryza sativa; identical to SEQ ID NO: 427
  CDS (152)..(1723)

SEQ ID NO: 34458 - protein, 523 aa, Oryza sativa; identical to SEQ ID NO: 428

SEQ ID NO: 34459 - DNA, 1894 bp, Glycine max; identical to SEQ ID NO: 8008
  CDS (163)..(1734)

SEQ ID NO: 34460 - protein, 523 aa, Glycine max; identical to SEQ ID NO: 8009

SEQ ID NO: 34461 - DNA, 1648 bp, Orobanche ramosa; identical to SEQ ID NO: 429
  CDS (46)..(1605)

SEQ ID NO: 34462 - protein, 519 aa, Orobanche ramosa; identical to SEQ ID NO: 430

SEQ ID NO: 34463 - DNA, 1975 bp, Oryza sativa; identical to SEQ ID NO: 8012
  CDS (96)..(1604)

SEQ ID NO: 34464 - protein, 502 aa, Oryza sativa; identical to SEQ ID NO: 8013

SEQ ID NO: 34465 - DNA, 2458 bp, Oryza sativa; identical to SEQ ID NO: 8014
  CDS (510)..(2255)

SEQ ID NO: 34466 - protein, 581 aa, Oryza sativa; identical to SEQ ID NO: 8015

SEQ ID NO: 34467 - DNA, 2574 bp, Oryza sativa; identical to SEQ ID NO: 435
  CDS (569)..(2089)

SEQ ID NO: 34468 - protein, 506 aa, Oryza sativa; identical to SEQ ID NO: 436

SEQ ID NO: 34469 - DNA, 1413 bp, Streptomyces avermitilis; identical to SEQ ID NO: 8018
  CDS (1)..(1413)

SEQ ID NO: 34470 - protein, 470 aa, Streptomyces avermitilis; identical to SEQ ID NO: 8019

SEQ ID NO: 34471 - DNA, 1230 bp, Coxiella burnetii; identical to SEQ ID NO: 8020
  CDS (1)..(1230)

SEQ ID NO: 34472 - protein, 409 aa, Coxiella burnetii; identical to SEQ ID NO: 8021

SEQ ID NO: 34473 - DNA, 1407 bp, Shigella flexneri; identical to SEQ ID NO: 8022
  CDS (1)..(1407)

SEQ ID NO: 34474 - protein, 468 aa, Shigella flexneri; identical to SEQ ID NO: 8023

SEQ ID NO: 34475 - DNA, 1927 bp, Prunus cerasus; identical to SEQ ID NO: 441
  CDS (56)..(1585)

SEQ ID NO: 34476 - protein, 509 aa, Prunus cerasus; identical to SEQ ID NO: 442

SEQ ID NO: 34477 - DNA, 1838 bp, Medicago truncatula; identical to SEQ ID NO: 8026
  CDS (112)..(1650)

SEQ ID NO: 34478 - protein, 512 aa, Medicago truncatula; identical to SEQ ID NO: 8027

SEQ ID NO: 34479 - DNA, 1764 bp, Datisca glomerata; identical to SEQ ID NO: 8028
  CDS (79)..(1650)

SEQ ID NO: 34480 - protein, 523 aa, Datisca glomerata; identical to SEQ ID NO: 8029

SEQ ID NO: 34481 - DNA, 2032 bp, Prunus cerasus; identical to SEQ ID NO: 443
  CDS (74)..(1690)

SEQ ID NO: 34482 - protein, 538 aa, Prunus cerasus; identical to SEQ ID NO: 444

SEQ ID NO: 34483 - DNA, 1784 bp, Malus domestica; identical to SEQ ID NO: 8032
  CDS (116)..(1561)

SEQ ID NO: 34484 - protein, 481 aa, Malus domestica; identical to SEQ ID NO: 8033

SEQ ID NO: 34485 - DNA, 2012 bp, Malus domestica; identical to SEQ ID NO: 445
  CDS (104)..(1579)

SEQ ID NO: 34486 - protein, 491 aa, Malus domestica; identical to SEQ ID NO: 446

SEQ ID NO: 34487 - DNA, 2178 bp, Mesembryanthemum crystallinum; identical to SEQ ID NO: 8036
  CDS (512)..(2008)

SEQ ID NO: 34488 - protein, 498 aa, Mesembryanthemum crystallinum; identical to SEQ ID NO: 8037

SEQ ID NO: 34489 - DNA, 1569 bp, Oryza sativa; identical to SEQ ID NO: 8038
  CDS (1)..(1569)

SEQ ID NO: 34490 - protein, 522 aa, Oryza sativa; identical to SEQ ID NO: 8039

SEQ ID NO: 34491 - DNA, 1724 bp, Oryza sativa; identical to SEQ ID NO: 8040
  CDS (1)..(1578)

SEQ ID NO: 34492 - protein, 525 aa, Oryza sativa; identical to SEQ ID NO: 8041

SEQ ID NO: 34493 - DNA, 1422 bp, Pseudomonas syringae; identical to SEQ ID NO: 8042
  CDS (1)..(1422)

SEQ ID NO: 34494 - protein, 473 aa, Pseudomonas syringae; identical to SEQ ID NO: 8043

SEQ ID NO: 34495 - DNA, 1467 bp, Lactobacillus plantarum; identical to SEQ ID NO: 8044
  CDS (1)..(1467)

SEQ ID NO: 34496 - protein, 488 aa, Lactobacillus plantarum; identical to SEQ ID NO: 8045

SEQ ID NO: 34497 - DNA, 1413 bp, Lactobacillus plantarum; identical to SEQ ID NO: 8046
  CDS (1)..(1413)

SEQ ID NO: 34498 - protein, 470 aa, Lactobacillus plantarum; identical to SEQ ID NO: 8047

SEQ ID NO: 34499 - DNA, 1401 bp, Lactobacillus plantarum; identical to SEQ ID NO: 8048
  CDS (1)..(1401)

SEQ ID NO: 34500 - protein, 466 aa, Lactobacillus plantarum; identical to SEQ ID NO: 8049

SEQ ID NO: 34501 - DNA, 1383 bp, Bacteroides thetaiotaomicron; identical to SEQ ID NO: 8050
  CDS (1)..(1383)

SEQ ID NO: 34502 - protein, 460 aa, Bacteroides thetaiotaomicron; identical to SEQ ID NO: 8051

SEQ ID NO: 34503 - DNA, 1407 bp, Bacteroides thetaiotaomicron; identical to SEQ ID NO: 453
  CDS (1)..(1407)

SEQ ID NO: 34504 - protein, 468 aa, Bacteroides thetaiotaomicron; identical to SEQ ID NO: 454

SEQ ID NO: 34505 - DNA, 1455 bp, Bacteroides thetaiotaomicron; identical to SEQ ID NO: 8054
  CDS (1)..(1455)

SEQ ID NO: 34506 - protein, 484 aa, Bacteroides thetaiotaomicron; identical to SEQ ID NO: 8055

SEQ ID NO: 34507 - DNA, 1407 bp, Bacteroides thetaiotaomicron; identical to SEQ ID NO: 455
  CDS (1)..(1407)

SEQ ID NO: 34508 - protein, 468 aa, Bacteroides thetaiotaomicron; identical to SEQ ID NO: 456

SEQ ID NO: 34509 - DNA, 1404 bp, Staphylococcus epidermidis; identical to SEQ ID NO: 457
  CDS (1)..(1404)

SEQ ID NO: 34510 - protein, 467 aa, Staphylococcus epidermidis; identical to SEQ ID NO: 458

SEQ ID NO: 34511 - DNA, 1392 bp, Oceanobacillus iheyensis; identical to SEQ ID NO: 8060
  CDS (1)..(1392)

SEQ ID NO: 34512 - protein, 463 aa, Oceanobacillus iheyensis; identical to SEQ ID NO: 8061

SEQ ID NO: 34513 - DNA, 1548 bp, Escherichia coli O6; identical to SEQ ID NO: 8062
  CDS (1)..(1548)

SEQ ID NO: 34514 - protein, 515 aa, Escherichia coli O6; identical to SEQ ID NO: 8063

SEQ ID NO: 34515 - DNA, 1554 bp, Bifidobacterium longum; identical to SEQ ID NO: 8064
  CDS (1)..(1554)

SEQ ID NO: 34516 - protein, 517 aa, Bifidobacterium longum; identical to SEQ ID NO: 8065

SEQ ID NO: 34517 - DNA, 1515 bp, Arabidopsis thaliana; identical to SEQ ID NO: 8066
  CDS (1)..(1515)

SEQ ID NO: 34518 - protein, 504 aa, Arabidopsis thaliana; identical to SEQ ID NO: 8067

SEQ ID NO: 34519 - DNA, 1545 bp, Aspergillus niger; identical to SEQ ID NO: 459
  CDS (1)..(1545)

SEQ ID NO: 34520 - protein, 514 aa, Aspergillus niger; identical to SEQ ID NO: 460

SEQ ID NO: 34521 - DNA, 1752 bp, Aspergillus niger; identical to SEQ ID NO: 463
  CDS (1)..(1752)

SEQ ID NO: 34522 - protein, 583 aa, Aspergillus niger; identical to SEQ ID NO: 464

SEQ ID NO: 34523 - DNA, 1584 bp, Emericella nidulans; identical to SEQ ID NO: 467
  CDS (1)..(1584)

SEQ ID NO: 34524 - protein, 527 aa, Emericella nidulans; identical to SEQ ID NO: 468

SEQ ID NO: 34525 - DNA, 1512 bp, Arabidopsis thaliana; identical to SEQ ID NO: 8074
  CDS (1)..(1512)

SEQ ID NO: 34526 - protein, 503 aa, Arabidopsis thaliana; identical to SEQ ID NO: 472

SEQ ID NO: 34527 - DNA, 1837 bp, Arabidopsis thaliana; identical to SEQ ID NO: 8076
  CDS (131)..(1699)

SEQ ID NO: 34528 - protein, 522 aa, Arabidopsis thaliana; identical to SEQ ID NO: 8077

SEQ ID NO: 34529 - DNA, 1536 bp, Oryza sativa; identical to SEQ ID NO: 8078
  CDS (1)..(1536)

SEQ ID NO: 34530 - protein, 511 aa, Oryza sativa; identical to SEQ ID NO: 8079

SEQ ID NO: 34531 - DNA, 1673 bp, Drosophila melanogaster; identical to SEQ ID NO: 8080
  CDS (88)..(1554)

SEQ ID NO: 34532 - protein, 488 aa, Drosophila melanogaster; identical to SEQ ID NO: 8081

SEQ ID NO: 34533 - DNA, 2234 bp, Kluyveromyces lactis; identical to SEQ ID NO: 473
  CDS (402)..(2102)

SEQ ID NO: 34534 - protein, 566 aa, Kluyveromyces lactis; identical to SEQ ID NO: 474

SEQ ID NO: 34535 - DNA, 1476 bp, Corynebacterium glutamicum; identical to SEQ ID NO: 8084
  CDS (1)..(1476)

SEQ ID NO: 34536 - protein, 491 aa, Corynebacterium glutamicum; identical to SEQ ID NO: 476

SEQ ID NO: 34537 - DNA, 1446 bp, Xanthomonas campestris; identical to SEQ ID NO: 8086
  CDS (1)..(1446)

SEQ ID NO: 34538 - protein, 481 aa, Xanthomonas campestris; identical to SEQ ID NO: 8087

SEQ ID NO: 34539 - DNA, 1428 bp, Xanthomonas axonopodis; identical to SEQ ID NO: 8088
  CDS (1)..(1428)

SEQ ID NO: 34540 - protein, 475 aa, Xanthomonas axonopodis; identical to SEQ ID NO: 8089

SEQ ID NO: 34541 - DNA, 1778 bp, Apium graveolens var; identical to SEQ ID NO: 8090
  CDS (79)..(1650)

SEQ ID NO: 34542 - protein, 523 aa, Apium graveolens var; identical to SEQ ID NO: 8091

SEQ ID NO: 34543 - DNA, 2118 bp, Homo sapiens; identical to SEQ ID NO: 8092
  CDS (110)..(1603)

SEQ ID NO: 34544 - protein, 497 aa, Homo sapiens; identical to SEQ ID NO: 8093

SEQ ID NO: 34545 - DNA, 1449 bp, Arabidopsis thaliana; identical to SEQ ID NO: 8094
  CDS (1)..(1449)

SEQ ID NO: 34546 - protein, 482 aa, Arabidopsis thaliana; identical to SEQ ID NO: 482

SEQ ID NO: 34547 - DNA, 1561 bp, Arabidopsis thaliana; identical to SEQ ID NO: 8096
  CDS (1)..(1530)

SEQ ID NO: 34548 - protein, 509 aa, Arabidopsis thaliana; identical to SEQ ID NO: 8097

SEQ ID NO: 34549 - DNA, 1420 bp, Arabidopsis thaliana; identical to SEQ ID NO: 8098
  CDS (1)..(1389)

SEQ ID NO: 34550 - protein, 462 aa, Arabidopsis thaliana; identical to SEQ ID NO: 8099

SEQ ID NO: 34551 - DNA, 1998 bp, Oryza sativa; identical to SEQ ID NO: 8100
  CDS (197)..(1717)

SEQ ID NO: 34552 - protein, 506 aa, Oryza sativa; identical to SEQ ID NO: 8101

SEQ ID NO: 34553 - DNA, 2145 bp, Homo sapiens; identical to SEQ ID NO: 8102
  CDS (46)..(1479)

SEQ ID NO: 34554 - protein, 477 aa, Homo sapiens; identical to SEQ ID NO: 8103

SEQ ID NO: 34555 - DNA, 1419 bp, Salmonella typhimurium; identical to SEQ ID NO: 8104
  CDS (1)..(1419)

SEQ ID NO: 34556 - protein, 472 aa, Salmonella typhimurium; identical to SEQ ID NO: 8105

SEQ ID NO: 34557 - DNA, 2039 bp, Olea europaea; identical to SEQ ID NO: 8106
  CDS (133)..(1767)

SEQ ID NO: 34558 - protein, 544 aa, Olea europaea; identical to SEQ ID NO: 8107

SEQ ID NO: 34559 - DNA, 1521 bp, Arabidopsis thaliana; identical to SEQ ID NO: 8108
  CDS (1)..(1521)

SEQ ID NO: 34560 - protein, 506 aa, Arabidopsis thaliana; identical to SEQ ID NO: 8109

SEQ ID NO: 34561 - DNA, 1557 bp, Arabidopsis thaliana; identical to SEQ ID NO: 8110
  CDS (1)..(1467)

SEQ ID NO: 34562 - protein, 488 aa, Arabidopsis thaliana; identical to SEQ ID NO: 8111

SEQ ID NO: 34563 - DNA, 1876 bp, Arabidopsis thaliana; identical to SEQ ID NO: 8112
  CDS (87)..(1727)

SEQ ID NO: 34564 - protein, 546 aa, Arabidopsis thaliana; identical to SEQ ID NO: 8113

SEQ ID NO: 34565 - DNA, 1377 bp, Arabidopsis thaliana; identical to SEQ ID NO: 8114
  CDS (1)..(1377)

SEQ ID NO: 34566 - protein, 458 aa, Arabidopsis thaliana; identical to SEQ ID NO: 8115

SEQ ID NO: 34567 - DNA, 1608 bp, Oryza sativa; identical to SEQ ID NO: 8116
  CDS (1)..(1608)

SEQ ID NO: 34568 - protein, 535 aa, Oryza sativa; identical to SEQ ID NO: 8117

SEQ ID NO: 34569 - DNA, 1606 bp, Arabidopsis thaliana; identical to SEQ ID NO: 8118
  CDS (18)..(1454)

SEQ ID NO: 34570 - protein, 478 aa, Arabidopsis thaliana; identical to SEQ ID NO: 8119

SEQ ID NO: 34571 - DNA, 1787 bp, Arabidopsis thaliana; identical to SEQ ID NO: 8120
  CDS (100)..(1524)

SEQ ID NO: 34572 - protein, 474 aa, Arabidopsis thaliana; identical to SEQ ID NO: 8121

SEQ ID NO: 34573 - DNA, 1539 bp, Oryza sativa; identical to SEQ ID NO: 8122
  CDS (1)..(1539)

SEQ ID NO: 34574 - protein, 512 aa, Oryza sativa; identical to SEQ ID NO: 8123

SEQ ID NO: 34575 - DNA, 1702 bp, Oryza sativa; identical to SEQ ID NO: 8124
  CDS (87)..(1628)

SEQ ID NO: 34576 - protein, 513 aa, Oryza sativa; identical to SEQ ID NO: 8125

SEQ ID NO: 34577 - DNA, 1569 bp, Uromyces fabae; identical to SEQ ID NO: 487
  CDS (1)..(1569)

SEQ ID NO: 34578 - protein, 522 aa, Uromyces fabae; identical to SEQ ID NO: 488

SEQ ID NO: 34579 - DNA, 1380 bp, Sulfolobus tokodaii; identical to SEQ ID NO: 8128
  CDS (1)..(1380)

SEQ ID NO: 34580 - protein, 459 aa, Sulfolobus tokodaii; identical to SEQ ID NO: 8129

SEQ ID NO: 34581 - DNA, 1503 bp, Thermoplasma volcanium; identical to SEQ ID NO: 8130
  CDS (1)..(1503)

SEQ ID NO: 34582 - protein, 500 aa, Thermoplasma volcanium; identical to SEQ ID NO: 8131

SEQ ID NO: 34583 - DNA, 1440 bp, Zymomonas mobilis; identical to SEQ ID NO: 493
  CDS (1)..(1440)

SEQ ID NO: 34584 - protein, 479 aa, Zymomonas mobilis; identical to SEQ ID NO: 494

SEQ ID NO: 34585 - DNA, 1865 bp, Arabidopsis thaliana; identical to SEQ ID NO: 8134
  CDS (66)..(1742)

SEQ ID NO: 34586 - protein, 558 aa, Arabidopsis thaliana; identical to SEQ ID NO: 8135

SEQ ID NO: 34587 - DNA, 1545 bp, Arabidopsis thaliana; identical to SEQ ID NO: 8136
  CDS (1)..(1545)

SEQ ID NO: 34588 - protein, 514 aa, Arabidopsis thaliana; identical to SEQ ID NO: 8137

SEQ ID NO: 34589 - DNA, 1766 bp, Apium graveolens var; identical to SEQ ID NO: 495
  CDS (17)..(1558)

SEQ ID NO: 34590 - protein, 513 aa, Apium graveolens var; identical to SEQ ID NO: 496

SEQ ID NO: 34591 - DNA, 2041 bp, Mesembryanthemum crystallinum; identical to SEQ ID NO: 497
  CDS (118)..(1785)

SEQ ID NO: 34592 - protein, 555 aa, Mesembryanthemum crystallinum; identical to SEQ ID NO: 498

SEQ ID NO: 34593 - DNA, 1961 bp, Saccharomyces pastorianus; identical to SEQ ID NO: 8142
  CDS (192)..(1904)

SEQ ID NO: 34594 - protein, 570 aa, Saccharomyces pastorianus; identical to SEQ ID NO: 8143

SEQ ID NO: 34595 - DNA, 1458 bp, Thermoplasma acidophilum; identical to SEQ ID NO: 8144
  CDS (1)..(1458)

SEQ ID NO: 34596 - protein, 485 aa, Thermoplasma acidophilum; identical to SEQ ID NO: 8145

SEQ ID NO: 34597 - DNA, 1413 bp, Lactobacillus casei; identical to SEQ ID NO: 8146
  CDS (1)..(1413)

SEQ ID NO: 34598 - protein, 470 aa, Lactobacillus casei; identical to SEQ ID NO: 8147

SEQ ID NO: 34599 - DNA, 1699 bp, Lycopersicon esculentum; identical to SEQ ID NO: 8148
  CDS (24)..(1466)

SEQ ID NO: 34600 - protein, 480 aa, Lycopersicon esculentum; identical to SEQ ID NO: 8149

SEQ ID NO: 34601 - DNA, 2013 bp, Mesembryanthemum crystallinum; identical to SEQ ID NO: 8150
  CDS (131)..(1876)

SEQ ID NO: 34602 - protein, 581 aa, Mesembryanthemum crystallinum; identical to SEQ ID NO: 8151

SEQ ID NO: 34603 - DNA, 2422 bp, Mesembryanthemum crystallinum; identical to SEQ ID NO: 8152
  CDS (386)..(2131)

SEQ ID NO: 34604 - protein, 581 aa, Mesembryanthemum crystallinum; identical to SEQ ID NO: 8153

SEQ ID NO: 34605 - DNA, 1864 bp, Spinacia oleracea; identical to SEQ ID NO: 501
  CDS (61)..(1716)

SEQ ID NO: 34606 - protein, 551 aa, Spinacia oleracea; identical to SEQ ID NO: 502

SEQ ID NO: 34607 - DNA, 1822 bp, Arabidopsis thaliana; identical to SEQ ID NO: 503
  CDS (65)..(1684)

SEQ ID NO: 34608 - protein, 539 aa, Arabidopsis thaliana; identical to SEQ ID NO: 504

SEQ ID NO: 34609 - DNA, 1545 bp, Arabidopsis thaliana; identical to SEQ ID NO: 8158
  CDS (1)..(1545)

SEQ ID NO: 34610 - protein, 514 aa, Arabidopsis thaliana; identical to SEQ ID NO: 8159

SEQ ID NO: 34611 - DNA, 1624 bp, Arabidopsis thaliana; identical to SEQ ID NO: 8160
  CDS (73)..(1464)

SEQ ID NO: 34612 - protein, 463 aa, Arabidopsis thaliana; identical to SEQ ID NO: 8161

SEQ ID NO: 34613 - DNA, 1578 bp, Arabidopsis thaliana; identical to SEQ ID NO: 8162
  CDS (1)..(1434)

SEQ ID NO: 34614 - protein, 477 aa, Arabidopsis thaliana; identical to SEQ ID NO: 8163

SEQ ID NO: 34615 - DNA, 1524 bp, Arabidopsis thaliana; identical to SEQ ID NO: 8164
  CDS (1)..(1524)

SEQ ID NO: 34616 - protein, 507 aa, Arabidopsis thaliana; identical to SEQ ID NO: 8165

SEQ ID NO: 34617 - DNA, 1976 bp, Lycopersicon esculentum; identical to SEQ ID NO: 8166
  CDS (87)..(1658)

SEQ ID NO: 34618 - protein, 523 aa, Lycopersicon esculentum; identical to SEQ ID NO: 8167

SEQ ID NO: 34619 - DNA, 1653 bp, Pichia stipitis; identical to SEQ ID NO: 505
  CDS (1)..(1653)

SEQ ID NO: 34620 - protein, 550 aa, Pichia stipitis; identical to SEQ ID NO: 506

SEQ ID NO: 34621 - DNA, 2169 bp, Drosophila melanogaster; identical to SEQ ID NO: 8170
  CDS (579)..(2024)

SEQ ID NO: 34622 - protein, 481 aa, Drosophila melanogaster; identical to SEQ ID NO: 8171

SEQ ID NO: 34623 - DNA, 1587 bp, Drosophila melanogaster; identical to SEQ ID NO: 8172
  CDS (47)..(1444)

SEQ ID NO: 34624 - protein, 465 aa, Drosophila melanogaster; identical to SEQ ID NO: 8173

SEQ ID NO: 34625 - DNA, 2514 bp, Drosophila melanogaster; identical to SEQ ID NO: 8174
  CDS (463)..(2082)

SEQ ID NO: 34626 - protein, 539 aa, Drosophila melanogaster; identical to SEQ ID NO: 8175

SEQ ID NO: 34627 - DNA, 1560 bp, Vitis vinifera; identical to SEQ ID NO: 8176
  CDS (1)..(1560)

SEQ ID NO: 34628 - protein, 519 aa, Vitis vinifera; identical to SEQ ID NO: 8177

SEQ ID NO: 34629 - DNA, 1686 bp, Arabidopsis thaliana; identical to SEQ ID NO: 8178
  CDS (130)..(1521)

SEQ ID NO: 34630 - protein, 463 aa, Arabidopsis thaliana; identical to SEQ ID NO: 8179

SEQ ID NO: 34631 - DNA, 2468 bp, Mus musculus; identical to SEQ ID NO: 515
  CDS (34)..(1605)

SEQ ID NO: 34632 - protein, 523 aa, Mus musculus; identical to SEQ ID NO: 516

SEQ ID NO: 34633 - DNA, 2355 bp, Canis familiaris; identical to SEQ ID NO: 517
  CDS (201)..(1688)

SEQ ID NO: 34634 - protein, 495 aa, Canis familiaris; identical to SEQ ID NO: 518

SEQ ID NO: 34635 - DNA, 1485 bp, Ovis aries; identical to SEQ ID NO: 519
  CDS (1)..(1485)

SEQ ID NO: 34636 - protein, 494 aa, Ovis aries; identical to SEQ ID NO: 520

SEQ ID NO: 34637 - DNA, 2425 bp, Kluyveromyces lactis; identical to SEQ ID NO: 523
  CDS (539)..(2194)

SEQ ID NO: 34638 - protein, 551 aa, Kluyveromyces lactis; identical to SEQ ID NO: 524

SEQ ID NO: 34639 - DNA, 2353 bp, Chlorella kessleri; identical to SEQ ID NO: 8188
  CDS (57)..(1679)

SEQ ID NO: 34640 - protein, 540 aa, Chlorella kessleri; identical to SEQ ID NO: 8189

SEQ ID NO: 34641 - DNA, 1731 bp, Saccharomyces cerevisiae; identical to SEQ ID NO: 8190
  CDS (1)..(1731)

SEQ ID NO: 34642 - protein, 576 aa, Saccharomyces cerevisiae; identical to SEQ ID NO: 526

SEQ ID NO: 34643 - DNA, 3261 bp, Homo sapiens; identical to SEQ ID NO: 8192
  CDS (109)..(1998): n means a or g or c or t/u, s means g or c

SEQ ID NO: 34644 - protein, 629 aa, Homo sapiens; identical to SEQ ID NO: 8193
  Xaa in positions 227 and 436 is unknown

SEQ ID NO: 34645 - DNA, 2504 bp, Rattus norvegicus; identical to SEQ ID NO: 8194
  CDS (145)..(2001)

SEQ ID NO: 34646 - protein, 618 aa, Rattus norvegicus; identical to SEQ ID NO: 8195

SEQ ID NO: 34647 - DNA, 3642 bp, Saccharomyces cerevisiae; identical to SEQ ID NO: 7728
  CDS (749)..(3205)

SEQ ID NO: 34648 - protein, 818 aa, Saccharomyces cerevisiae; identical to SEQ ID NO: 8197

SEQ ID NO: 34649 - DNA, 1374 bp, Lactobacillus brevis; identical to SEQ ID NO: 8198
  CDS (1)..(1374)

SEQ ID NO: 34650 - protein, 457 aa, Lactobacillus brevis; identical to SEQ ID NO: 8199

SEQ ID NO: 34651 - DNA, 1500 bp, Xenopus laevis; identical to SEQ ID NO: 8200
  CDS (1)..(1500)

SEQ ID NO: 34652 - protein, 499 aa, Xenopus laevis; identical to SEQ ID NO: 8201

SEQ ID NO: 34653 - DNA, 1470 bp, Gadus morhua; identical to SEQ ID NO: 8202
  CDS (1)..(1470)

SEQ ID NO: 34654 - protein, 489 aa, Gadus morhua; identical to SEQ ID NO: 8203

SEQ ID NO: 34655 - DNA, 25 bp, Artificial sequence
  (1)..(25): primer
atgggaatacacataccatatctca

SEQ ID NO: 34656 - DNA, 26 bp, Artificial sequence
  (1)..(26): primer
ctatatatcctctataatctcttgag

SEQ ID NO: 34657 - protein, 728 aa, Artificial sequence
  Variant (2)..(3): xaa in position 2 to 3 is any amino acid
  Variant (8)..(9): xaa in position 8 to 9 is any amino acid
  Variant (10)..(44): xaa in position 10 to 44 is any or no amino acid
  Variant (46)..(46): xaa in position 46 is any amino acid
  Variant (48)..(67): xaa in position 48 to 67 is any amino acid
  Variant (68)..(88): xaa in position 68 to 88 is any or no amino acid
  Variant (90)..(93): xaa in position 90 to 93 is any amino acid
  Variant (95)..(97): xaa in position 95 to 97 is any amino acid
  Variant (99)..(109): xaa in position 99 to 109 is any amino acid
  Variant (113)..(114): xaa in position 113 to 114 is any amino acid
  Variant (116)..(124): xaa in position 116 to 124 is any amino acid
  Variant (126)..(131): xaa in position 126 to 131 is any amino acid
  Variant (133)..(136): xaa in position 133 to 136 is any amino acid
  Variant (137)..(155): xaa in position 137 to 155 is any or no amino acid
  Variant (157)..(158): xaa in position 157 to 158 is any amino acid
  Variant (161)..(161): xaa in position 161 is any amino acid
  Variant (163)..(163): xaa in position 163 is any amino acid
  Variant (165)..(165): xaa in position 165 is any amino acid
  Variant (169)..(174): xaa in position 169 to 174 is any amino acid
  Variant (181)..(181): xaa in position 181 is any amino acid
  Variant (184)..(184): xaa in position 184 is any amino acid
  Variant (185)..(186): xaa in position 185 to 186 is any or no amino acid
  Variant (189)..(189): xaa in position 189 is any or no amino acid
  Variant (191)..(195): xaa in position 191 to 195 is any amino acid
  Variant (197)..(197): xaa in position 197 is any amino acid
  Variant (199)..(200): xaa in position 199 to 200 is any amino acid
  Variant (203)..(212): xaa in position 203 to 212 is any amino acid
  Variant (213)..(256): xaa in position 213 to 256 is any or no amino acid
  Variant (259)..(261): xaa in position 259 to 261 is any amino acid
  Variant (264)..(267): xaa in position 264 to 267 is any amino acid
  Variant (269)..(277): xaa in position 269 to 277 is any amino acid
  Variant (278)..(278): xaa in position 278 is any or no amino acid
  Variant (287)..(294): xaa in position 287 to 294 is any amino acid
  Variant (295)..(338): xaa in position 295 to 338 is any or no amino acid
  Variant (340)..(342): xaa in position 340 to 342 is any amino acid
  Variant (344)..(363): xaa in position 344 to 363 is any amino acid
  Variant (364)..(411): xaa in position 364 to 411 is any or no amino acid
  Variant (413)..(414): xaa in position 413 to 414 is any amino acid
  Variant (416)..(417): xaa in position 416 to 417 is any amino acid
  Variant (419)..(421): xaa in position 419 to 421 is any amino acid
  Variant (424)..(425): xaa in position 424 to 425 is any amino acid
  Variant (427)..(427): xaa in position 427 is any amino acid
  Variant (429)..(429): xaa in position 429 is any amino acid
  Variant (431)..(431): xaa in position 431 is any amino acid
  Variant (434)..(436): xaa in position 434 to 436 is any amino acid
  Variant (439)..(452): xaa in position 439 to 452 is any amino acid
  Variant (453)..(465): xaa in position 453 to 465 is any or no amino acid
  Variant (467)..(479): xaa in position 467 to 479 is any amino acid
  Variant (483)..(483): xaa in position 483 is any amino acid
  Variant (487)..(487): xaa in position 487 is any amino acid
  Variant (489)..(489): xaa in position 489 is any amino acid
  Variant (491)..(491): xaa in position 491 is any amino acid
  Variant (492)..(502): xaa in position 492 to 502 is any or no amino acid
  Variant (504)..(522): xaa in position 504 to 522 is any amino acid
  Variant (523)..(622): xaa in position 523 to 622 is any or no amino acid
  Variant (624)..(627): xaa in position 624 to 627 is any amino acid
  Variant (628)..(628): xaa in position 628 is any or no amino acid
  Variant (631)..(632): xaa in position 631 to 632 is any amino acid
  Variant (634)..(637): xaa in position 634 to 637 is any amino acid
  Variant (639)..(639): xaa in position 639 is any amino acid
  Variant (641)..(641): xaa in position 641 is any amino acid
  Variant (643)..(643): xaa in position 643 is any amino acid
  Variant (645)..(646): xaa in position 645 to 646 is any amino acid
  Variant (648)..(648): xaa in position 648 is any amino acid
  Variant (650)..(650): xaa in position 650 is any or no amino acid
  Variant (652)..(654): xaa in position 652 to 654 is any amino acid
  Variant (656)..(657): xaa in position 656 to 657 is any or no amino acid
  Variant (659)..(660): xaa in position 659 to 660 is any or no amino acid
  Variant (662)..(665): xaa in position 662 to 665 is any amino acid
  Variant (667)..(672): xaa in position 667 to 672 is any amino acid
  Variant (674)..(679): xaa in position 674 to 679 is any amino acid
  Variant (681)..(687): xaa in position 681 to 687 is any amino acid
  Variant (688)..(698): xaa in position 688 to 698 is any or no amino acid
  Variant (700)..(701): xaa in position 700 to 701 is any amino acid
  Variant (703)..(711): xaa in position 703 to 711 is any amino acid
  Variant (713)..(716): xaa in position 713 to 716 is any amino acid
  Variant (723)..(724): xaa in position 723 to 724 is any amino acid
  Variant (727)..(727): xaa in position 727 is any amino acid
GXXLFGYXXXXXXXXXXXXXXXXXXXXXXXXXXXXXXXXXXXXXGXIXXXXXXXXXXXXXXXXXXXXXXXXXXXXXXXXXXXXXXXXXSXXXXGXXXGXXXXXXXXXXXGRRXXLXXXXXXXXXGXXXXXXAXXXXXXXXXXXXXXXXXXXXXXXLXXGRXLXGXGVGXXXXXXPLYISEXAPXXXRGXLXXXXXLXIXXGIXXXXXXXXXXXXXXXXXXXXXXXXXXXXXXXXXXXXXXXXXXXXXXXXXXXXXXWRXXXGLXXXXAXXXXXXXXXXLPESPRWLXXXXXXXXXXXXXXXXXXXXXXXXXXXXXXXXXXXXXXXXXXXXXXXXXXXXAXXXLXXXXXXXXXXXXXXXXXXXXXXXXXXXXXXXXXXXXXXXXXXXXXXXXXXXXXXXXXXXXXXXXXXXXLXXGXXLXXXQQXXGXNXIXYYXXXIFXXXXXXXXXXXXXXXXXXXXXXXXXXXGXXXXXXXXXXXXXVDRXGRRXLXLXXXXXXXXXXXXMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXYVXXFXXXXGXIXWXIXXEXFXPXXXRXXAXXIXXXXNXXXXXXIXXXXXXLXXXXXXXXXXXXXXXXXXFXXFXXXXXXXXXFXXXXVPETKGXXLEXI

SEQ ID NO: 34658 - protein, 20 aa, Artificial sequence
  Variant (1)..(1): xaa in position 1 is Leu, Val, Ile, Met, Phe or Ala
  Variant (2)..(4): xaa in position 2 to 4 is any amino acid
  Variant (5)..(5): xaa in position 5 is Gln, Asn, Gly or Leu
  Variant (6)..(6): xaa in position 6 is Gln or Ile
  Variant (7)..(8): xaa in position 7 to 8 is any amino acid
  Variant (10)..(10): xaa in position 10 is any amino acid
  Variant (11)..(11): xaa in position 11 is Asn, Asp, Ser, Pro or Glu
  Variant (12)..(14): xaa in position 12 to 14 is any amino acid
  Variant (15)..(15): xaa in position 15 is Tyr, Phe, Leu or Ser
  Variant (16)..(16): xaa in position 16 is Tyr or Phe
  Variant (17)..(19): xaa in position 17 to 19 is any amino acid
  Variant (20)..(20): xaa in position 20 is Ile, Leu, Val or Phe
XXXXXXXXGXXXXXXXXXXX

SEQ ID NO: 34659 - DNA, 1164 bp, Saccharomyces cerevisiae; identical to SEQ ID NO: 1121
  CDS (1)..(1164)

SEQ ID NO: 34660 - protein, 387 aa, Saccharomyces cerevisiae; identical to SEQ ID NO: 1122

SEQ ID NO: 34661 - DNA, 1041 bp, Pseudomonas aeruginosa; identical to SEQ ID NO: 1123
  CDS (1)..(1041)

SEQ ID NO: 34662 - protein, 346 aa, Pseudomonas aeruginosa; identical to SEQ ID NO: 1124

SEQ ID NO: 34663 - DNA, 1077 bp, Listeria monocytogenes; identical to SEQ ID NO: 1125
  CDS (1)..(1077)

SEQ ID NO: 34664 - protein, 358 aa, Listeria monocytogenes; identical to SEQ ID NO: 1126

SEQ ID NO: 34665 - DNA, 1053 bp, Agrobacterium tumefaciens; identical to SEQ ID NO: 1127
  CDS (1)..(1053)

SEQ ID NO: 34666 - protein, 350 aa, Agrobacterium tumefaciens; identical to SEQ ID NO: 1128

SEQ ID NO: 34667 - DNA, 1002 bp, Salmonella enterica subsp. enterica serovar Typhi; identical to SEQ ID NO: 1129
  CDS (1)..(1002)

SEQ ID NO: 34668 - protein, 333 aa, Salmonella enterica subsp. enterica serovar Typhi; identical to SEQ ID NO: 1130

SEQ ID NO: 34669 - DNA, 1038 bp, Nostoc sp. PCC 7120; identical to SEQ ID NO: 1131
  CDS (1)..(1038)

SEQ ID NO: 34670 - protein, 345 aa, Nostoc sp. PCC 7120; identical to SEQ ID NO: 1132

SEQ ID NO: 34671 - DNA, 1032 bp, Thermotoga maritima; identical to SEQ ID NO: 1133
  CDS (1)..(1032)

SEQ ID NO: 34672 - protein, 343 aa, Thermotoga maritima; identical to SEQ ID NO: 1134

SEQ ID NO: 34673 - DNA, 978 bp, Bacillus halodurans; identical to SEQ ID NO: 1135
  CDS (1)..(978)

SEQ ID NO: 34674 - protein, 325 aa, Bacillus halodurans; identical to SEQ ID NO: 1136

SEQ ID NO: 34675 - DNA, 1032 bp, Caulobacter crescentus; identical to SEQ ID NO: 1137
  CDS (1)..(1032)

SEQ ID NO: 34676 - protein, 343 aa, Caulobacter crescentus; identical to SEQ ID NO: 1138

SEQ ID NO: 34677 - DNA, 1035 bp, Clostridium acetobutylicum; identical to SEQ ID NO: 1139
  CDS (1)..(1035)

SEQ ID NO: 34678 - protein, 344 aa, Clostridium acetobutylicum; identical to SEQ ID NO: 1140

SEQ ID NO: 34679 - DNA, 1074 bp, Halobacterium sp. NRC-1; identical to SEQ ID NO: 1141
  CDS (1)..(1074)

SEQ ID NO: 34680 - protein, 357 aa, Halobacterium sp. NRC-1; identical to SEQ ID NO: 1142

SEQ ID NO: 34681 - DNA, 1029 bp, Deinococcus radiodurans; identical to SEQ ID NO: 1143
  CDS (1)..(1029)

SEQ ID NO: 34682 - protein, 342 aa, Deinococcus radiodurans; identical to SEQ ID NO: 1144

SEQ ID NO: 34683 - DNA, 1032 bp, Vibrio cholerae; identical to SEQ ID NO: 1145
  CDS (1)..(1032)

SEQ ID NO: 34684 - protein, 343 aa, Vibrio cholerae; identical to SEQ ID NO: 1146

SEQ ID NO: 34685 - DNA, 1280 bp, Escherichia coli; identical to SEQ ID NO: 1147
  CDS (61)..(1062)

SEQ ID NO: 34686 - protein, 333 aa, Escherichia coli; identical to SEQ ID NO: 1148

SEQ ID NO: 34687 - DNA, 1005 bp, Pseudomonas aeruginosa; identical to SEQ ID NO: 1149
  CDS (1)..(1005)

SEQ ID NO: 34688 - protein, 334 aa, Pseudomonas aeruginosa; identical to SEQ ID NO: 1150

SEQ ID NO: 34689 - DNA, 1080 bp, Leishmania major; identical to SEQ ID NO: 1151
  CDS (1)..(1080)

SEQ ID NO: 34690 - protein, 359 aa, Leishmania major; identical to SEQ ID NO: 1152

SEQ ID NO: 34691 - DNA, 1302 bp, Caenorhabditis elegans; identical to SEQ ID NO: 1153
  CDS (1)..(1302)

SEQ ID NO: 34692 - protein, 433 aa, Caenorhabditis elegans; identical to SEQ ID NO: 1154

SEQ ID NO: 34693 - DNA, 1212 bp, Streptomyces coelicolor; identical to SEQ ID NO: 1155
  CDS (1)..(1212)

SEQ ID NO: 34694 - protein, 403 aa, Streptomyces coelicolor; identical to SEQ ID NO: 1156

SEQ ID NO: 34695 - DNA, 1131 bp, Schizosaccharomyces pombe; identical to SEQ ID NO: 1157
  CDS (1)..(1131)

SEQ ID NO: 34696 - protein, 376 aa, Schizosaccharomyces pombe; identical to SEQ ID NO: 1158

SEQ ID NO: 34697 - DNA, 1017 bp, Aeromonas jandaei; identical to SEQ ID NO: 1159
  CDS (1)..(1017)

SEQ ID NO: 34698 - protein, 338 aa, Aeromonas jandaei; identical to SEQ ID NO: 1160

SEQ ID NO: 34699 - DNA, 1152 bp, Tolypocladium inflatum; identical to SEQ ID NO: 1161
  CDS (1)..(1152)

SEQ ID NO: 34700 - protein, 383 aa, Tolypocladium inflatum; identical to SEQ ID NO: 1162

SEQ ID NO: 34701 - DNA, 1104 bp, Debaryomyces hansenii; identical to SEQ ID NO: 1163
  CDS (1)..(1104)

SEQ ID NO: 34702 - protein, 367 aa, Debaryomyces hansenii; identical to SEQ ID NO: 1164

SEQ ID NO: 34703 - DNA, 1128 bp, Debaryomyces hansenii; identical to SEQ ID NO: 1165
  CDS (1)..(1128)

SEQ ID NO: 34704 - protein, 375 aa, Debaryomyces hansenii; identical to SEQ ID NO: 1166

SEQ ID NO: 34705 - DNA, 1071 bp, Yarrowia lipolytica; identical to SEQ ID NO: 1167
  CDS (1)..(1071)

SEQ ID NO: 34706 - protein, 356 aa, Yarrowia lipolytica; identical to SEQ ID NO: 1168

SEQ ID NO: 34707 - DNA, 1188 bp, Kluyveromyces lactis; identical to SEQ ID NO: 1169
  CDS (1)..(1188)

SEQ ID NO: 34708 - protein, 395 aa, Kluyveromyces lactis; identical to SEQ ID NO: 1170

SEQ ID NO: 34709 - DNA, 1182 bp, Kluyveromyces lactis; identical to SEQ ID NO: 1171
  CDS (1)..(1182)

SEQ ID NO: 34710 - protein, 393 aa, Kluyveromyces lactis; identical to SEQ ID NO: 1172

SEQ ID NO: 34711 - DNA, 1161 bp, Candida glabrata; identical to SEQ ID NO: 1173
  CDS (1)..(1161)

SEQ ID NO: 34712 - protein, 386 aa, Candida glabrata; identical to SEQ ID NO: 1174

SEQ ID NO: 34713 - DNA, 1026 bp, Staphylococcus aureus subsp; identical to SEQ ID NO: 1175
  CDS (1)..(1026)

SEQ ID NO: 34714 - protein, 341 aa, Staphylococcus aureus subsp; identical to SEQ ID NO: 1176

SEQ ID NO: 34715 - DNA, 1008 bp, Photobacterium profundum; identical to SEQ ID NO: 1177
  CDS (1)..(1008)

SEQ ID NO: 34716 - protein, 335 aa, Photobacterium profundum; identical to SEQ ID NO: 1178

SEQ ID NO: 34717 - DNA, 1026 bp, Bdellovibrio bacteriovorus; identical to SEQ ID NO: 1179
  CDS (1)..(1026)

SEQ ID NO: 34718 - protein, 341 aa, Bdellovibrio bacteriovorus; identical to SEQ ID NO: 1180

SEQ ID NO: 34719 - DNA, 1101 bp, Rhodopseudomonas palustris; identical to SEQ ID NO: 1181
  CDS (1)..(1101)

SEQ ID NO: 34720 - protein, 366 aa, Rhodopseudomonas palustris; identical to SEQ ID NO: 1182

SEQ ID NO: 34721 - DNA, 1083 bp, Rhodopseudomonas palustris; identical to SEQ ID NO: 1183
  CDS (1)..(1083)

SEQ ID NO: 34722 - protein, 360 aa, Rhodopseudomonas palustris; identical to SEQ ID NO: 1184

SEQ ID NO: 34723 - DNA, 1855 bp, Mus musculus; identical to SEQ ID NO: 1185
  CDS (128)..(1330)

SEQ ID NO: 34724 - protein, 400 aa, Mus musculus; identical to SEQ ID NO: 1186

SEQ ID NO: 34725 - DNA, 1080 bp, Listeria monocytogenes; identical to SEQ ID NO: 1187
  CDS (1)..(1080)

SEQ ID NO: 34726 - protein, 359 aa, Listeria monocytogenes; identical to SEQ ID NO: 1188

SEQ ID NO: 34727 - DNA, 1023 bp, Desulfovibrio vulgaris; identical to SEQ ID NO: 1189
  CDS (1)..(1023)

SEQ ID NO: 34728 - protein, 340 aa, Desulfovibrio vulgaris; identical to SEQ ID NO: 1190

SEQ ID NO: 34729 - DNA, 1023 bp, Thermus thermophilus; identical to SEQ ID NO: 1191
  CDS (1)..(1023)

SEQ ID NO: 34730 - protein, 340 aa, Thermus thermophilus; identical to SEQ ID NO: 1192

SEQ ID NO: 34731 - DNA, 1053 bp, Wolbachia pipientis wMel; identical to SEQ ID NO: 1193
  CDS (1)..(1053)

SEQ ID NO: 34732 - protein, 350 aa, Wolbachia pipientis wMel; identical to SEQ ID NO: 1194

SEQ ID NO: 34733 - DNA, 1050 bp, Wolbachia pipientis wMel; identical to SEQ ID NO: 1195
  CDS (1)..(1050)

SEQ ID NO: 34734 - protein, 349 aa, Wolbachia pipientis wMel; identical to SEQ ID NO: 1196

SEQ ID NO: 34735 - DNA, 1056 bp, Treponema denticola; identical to SEQ ID NO: 1197
  CDS (1)..(1056)

SEQ ID NO: 34736 - protein, 351 aa, Treponema denticola; identical to SEQ ID NO: 1198

SEQ ID NO: 34737 - DNA, 1056 bp, Geobacter sulfurreducens; identical to SEQ ID NO: 1199
  CDS (1)..(1056)

SEQ ID NO: 34738 - protein, 351 aa, Geobacter sulfurreducens; identical to SEQ ID NO: 1200

SEQ ID NO: 34739 - DNA, 1047 bp, Geobacter sulfurreducens; identical to SEQ ID NO: 1201
  CDS (1)..(1047)

SEQ ID NO: 34740 - protein, 348 aa, Geobacter sulfurreducens; identical to SEQ ID NO: 1202

SEQ ID NO: 34741 - DNA, 1056 bp, Yersinia pestis; identical to SEQ ID NO: 1203
  CDS (1)..(1056)

SEQ ID NO: 34742 - protein, 351 aa, Yersinia pestis; identical to SEQ ID NO: 1204

SEQ ID NO: 34743 - DNA, 1140 bp, Ashbya gossypii; identical to SEQ ID NO: 1205
  CDS (1)..(1140)

SEQ ID NO: 34744 - protein, 379 aa, Ashbya gossypii; identical to SEQ ID NO: 1206

SEQ ID NO: 34745 - DNA, 1008 bp, Vibrio vulnificus; identical to SEQ ID NO: 1207
  CDS (1)..(1008)

SEQ ID NO: 34746 - protein, 335 aa, Vibrio vulnificus; identical to SEQ ID NO: 1208

SEQ ID NO: 34747 - DNA, 1038 bp, Porphyromonas gingivalis; identical to SEQ ID NO: 1209
  CDS (1)..(1038)

SEQ ID NO: 34748 - protein, 345 aa, Porphyromonas gingivalis; identical to SEQ ID NO: 1210

SEQ ID NO: 34749 - DNA, 1035 bp, Gloeobacter violaceus; identical to SEQ ID NO: 1211
  CDS (1)..(1035)

SEQ ID NO: 34750 - protein, 344 aa, Gloeobacter violaceus; identical to SEQ ID NO: 1212

SEQ ID NO: 34751 - DNA, 1029 bp, Chromobacterium violaceum; identical to SEQ ID NO: 1213
  CDS (1)..(1029)

SEQ ID NO: 34752 - protein, 342 aa, Chromobacterium violaceum; identical to SEQ ID NO: 1214

SEQ ID NO: 34753 - DNA, 1047 bp, Fusobacterium nucleatum subsp; identical to SEQ ID NO: 1215
  CDS (1)..(1047)

SEQ ID NO: 34754 - protein, 348 aa, Fusobacterium nucleatum subsp; identical to SEQ ID NO: 1216

SEQ ID NO: 34755 - DNA, 1083 bp, Neurospora crassa; identical to SEQ ID NO: 1217
  CDS (1)..(1083)

SEQ ID NO: 34756 - protein, 360 aa, Neurospora crassa; identical to SEQ ID NO: 1218

SEQ ID NO: 34757 - DNA, 1020 bp, Bordetella pertussis; identical to SEQ ID NO: 1219
  CDS (1)..(1020)

SEQ ID NO: 34758 - protein, 339 aa, Bordetella pertussis; identical to SEQ ID NO: 1220

SEQ ID NO: 34759 - DNA, 1376 bp, Oryza sativa; identical to SEQ ID NO: 1221
  CDS (115)..(1233)

SEQ ID NO: 34760 - protein, 372 aa, Oryza sativa; identical to SEQ ID NO: 1222

SEQ ID NO: 34761 - DNA, 1242 bp, Streptomyces avermitilis; identical to SEQ ID NO: 1223
  CDS (1)..(1242)

SEQ ID NO: 34762 - protein, 413 aa, Streptomyces avermitilis; identical to SEQ ID NO: 1224

SEQ ID NO: 34763 - DNA, 1071 bp, Streptomyces avermitilis; identical to SEQ ID NO: 1225
  CDS (1)..(1071)

SEQ ID NO: 34764 - protein, 356 aa, Streptomyces avermitilis; identical to SEQ ID NO: 1226

SEQ ID NO: 34765 - DNA, 1005 bp, Vibrio parahaemolyticus; identical to SEQ ID NO: 1227
  CDS (1)..(1005)

SEQ ID NO: 34766 - protein, 334 aa, Vibrio parahaemolyticus; identical to SEQ ID NO: 1228

SEQ ID NO: 34767 - DNA, 1077 bp, Vibrio parahaemolyticus; identical to SEQ ID NO: 1229
  CDS (1)..(1077)

SEQ ID NO: 34768 - protein, 358 aa, Vibrio parahaemolyticus; identical to SEQ ID NO: 1230

SEQ ID NO: 34769 - DNA, 1005 bp, Pseudomonas syringae; identical to SEQ ID NO: 1231
  CDS (1)..(1005)

SEQ ID NO: 34770 - protein, 334 aa, Pseudomonas syringae; identical to SEQ ID NO: 1232

SEQ ID NO: 34771 - DNA, 1041 bp, Pseudomonas syringae; identical to SEQ ID NO: 1233
  CDS (1)..(1041)

SEQ ID NO: 34772 - protein, 346 aa, Pseudomonas syringae; identical to SEQ ID NO: 1234

SEQ ID NO: 34773 - DNA, 1041 bp, Pseudomonas putida; identical to SEQ ID NO: 1235
  CDS (1)..(1041)

SEQ ID NO: 34774 - protein, 346 aa, Pseudomonas putida; identical to SEQ ID NO: 1236

SEQ ID NO: 34775 - DNA, 1026 bp, Clostridium tetani; identical to SEQ ID NO: 1237
  CDS (1)..(1026)

SEQ ID NO: 34776 - protein, 341 aa, Clostridium tetani; identical to SEQ ID NO: 1238

SEQ ID NO: 34777 - DNA, 1083 bp, Bradyrhizobium japonicum; identical to SEQ ID NO: 1239
  CDS (1)..(1083)

SEQ ID NO: 34778 - protein, 360 aa, Bradyrhizobium japonicum; identical to SEQ ID NO: 1240

SEQ ID NO: 34779 - DNA, 1044 bp, Bradyrhizobium japonicum; identical to SEQ ID NO: 1241
  CDS (1)..(1044)

SEQ ID NO: 34780 - protein, 347 aa, Bradyrhizobium japonicum; identical to SEQ ID NO: 1242

SEQ ID NO: 34781 - DNA, 1014 bp, Bacteroides thetaiotaomicron; identical to SEQ ID NO: 1243
  CDS (1)..(1014)

SEQ ID NO: 34782 - protein, 337 aa, Bacteroides thetaiotaomicron; identical to SEQ ID NO: 1244

SEQ ID NO: 34783 - DNA, 1077 bp, Vibrio vulnificus; identical to SEQ ID NO: 1245
  CDS (1)..(1077)

SEQ ID NO: 34784 - protein, 358 aa, Vibrio vulnificus; identical to SEQ ID NO: 1246

SEQ ID NO: 34785 - DNA, 1026 bp, Streptococcus agalactiae; identical to SEQ ID NO: 1247
  CDS (1)..(1026)

SEQ ID NO: 34786 - protein, 341 aa, Streptococcus agalactiae; identical to SEQ ID NO: 1248

SEQ ID NO: 34787 - DNA, 1014 bp, Shewanella oneidensis; identical to SEQ ID NO: 1249
  CDS (1)..(1014)

SEQ ID NO: 34788 - protein, 337 aa, Shewanella oneidensis; identical to SEQ ID NO: 1250

SEQ ID NO: 34789 - DNA, 1002 bp, Escherichia coli O6; identical to SEQ ID NO: 1251
  CDS (1)..(1002)

SEQ ID NO: 34790 - protein, 333 aa, Escherichia coli O6; identical to SEQ ID NO: 1252

SEQ ID NO: 34791 - DNA, 1026 bp, Bifidobacterium longum; identical to SEQ ID NO: 1253
  CDS (1)..(1026)

SEQ ID NO: 34792 - protein, 341 aa, Bifidobacterium longum; identical to SEQ ID NO: 1254

SEQ ID NO: 34793 - DNA, 1116 bp, Rhizobium loti; identical to SEQ ID NO: 1255
  CDS (1)..(1116)

SEQ ID NO: 34794 - protein, 371 aa, Rhizobium loti; identical to SEQ ID NO: 1256

SEQ ID NO: 34795 - DNA, 1074 bp, Xanthomonas campestris; identical to SEQ ID NO: 1257
  CDS (1)..(1074)

SEQ ID NO: 34796 - protein, 357 aa, Xanthomonas campestris; identical to SEQ ID NO: 1258

SEQ ID NO: 34797 - DNA, 1065 bp, Xanthomonas axonopodis; identical to SEQ ID NO: 1259
  CDS (1)..(1065)

SEQ ID NO: 34798 - protein, 354 aa, Xanthomonas axonopodis; identical to SEQ ID NO: 1260

SEQ ID NO: 34799 - DNA, 1041 bp, Thermoanaerobacter tengcongensis; identical to SEQ ID NO: 1261
  CDS (1)..(1041)

SEQ ID NO: 34800 - protein, 346 aa, Thermoanaerobacter tengcongensis; identical to SEQ ID NO: 1262

SEQ ID NO: 34801 - DNA, 1023 bp, Fusobacterium nucleatum; identical to SEQ ID NO: 1263
  CDS (1)..(1023)

SEQ ID NO: 34802 - protein, 340 aa, Fusobacterium nucleatum; identical to SEQ ID NO: 1264

SEQ ID NO: 34803 - DNA, 1533 bp, Arabidopsis thaliana; identical to SEQ ID NO: 1265
  CDS (303)..(1379)

SEQ ID NO: 34804 - protein, 358 aa, Arabidopsis thaliana; identical to SEQ ID NO: 1266

SEQ ID NO: 34805 - DNA, 1098 bp, Ralstonia solanacearum; identical to SEQ ID NO: 1267
  CDS (1)..(1098)

SEQ ID NO: 34806 - protein, 365 aa, Ralstonia solanacearum; identical to SEQ ID NO: 1268

SEQ ID NO: 34807 - DNA, 1038 bp, Ralstonia solanacearum; identical to SEQ ID NO: 1269
  CDS (1)..(1038)

SEQ ID NO: 34808 - protein, 345 aa, Ralstonia solanacearum; identical to SEQ ID NO: 1270

SEQ ID NO: 34809 - DNA, 1002 bp, Salmonella typhimurium; identical to SEQ ID NO: 1271
  CDS (1)..(1002)

SEQ ID NO: 34810 - protein, 333 aa, Salmonella typhimurium; identical to SEQ ID NO: 1272

SEQ ID NO: 34811 - DNA, 1047 bp, Rhizobium meliloti; identical to SEQ ID NO: 1273
  CDS (1)..(1047)

SEQ ID NO: 34812 - protein, 348 aa, Rhizobium meliloti; identical to SEQ ID NO: 1274

SEQ ID NO: 34813 - DNA, 1092 bp, Rhizobium loti; identical to SEQ ID NO: 1275
  CDS (1)..(1092)

SEQ ID NO: 34814 - protein, 363 aa, Rhizobium loti; identical to SEQ ID NO: 1276

SEQ ID NO: 34815 - DNA, 1313 bp, Arabidopsis thaliana; identical to SEQ ID NO: 1277
  CDS (91)..(1158)

SEQ ID NO: 34816 - protein, 355 aa, Arabidopsis thaliana; identical to SEQ ID NO: 1278

SEQ ID NO: 34817 - DNA, 1059 bp, Arabidopsis thaliana; identical to SEQ ID NO: 1279
  CDS (1)..(1059)

SEQ ID NO: 34818 - protein, 352 aa, Arabidopsis thaliana; identical to SEQ ID NO: 1280

SEQ ID NO: 34819 - DNA, 1071 bp, Streptomyces coelicolor; identical to SEQ ID NO: 1281
  CDS (1)..(1071)

SEQ ID NO: 34820 - protein, 356 aa, Streptomyces coelicolor; identical to SEQ ID NO: 1282

SEQ ID NO: 34821 - DNA, 1113 bp, Arabidopsis thaliana; identical to SEQ ID NO: 1283
  CDS (1)..(1113)

SEQ ID NO: 34822 - protein, 370 aa, Arabidopsis thaliana; identical to SEQ ID NO: 1284

SEQ ID NO: 34823 - DNA, 1327 bp, Drosophila melanogaster; identical to SEQ ID NO: 1285
  CDS (79)..(1230)

SEQ ID NO: 34824 - protein, 383 aa, Drosophila melanogaster; identical to SEQ ID NO: 1286

SEQ ID NO: 34825 - DNA, 1014 bp, Zymomonas mobilis; identical to SEQ ID NO: 1287
  CDS (1)..(1014)

SEQ ID NO: 34826 - protein, 337 aa, Zymomonas mobilis; identical to SEQ ID NO: 1288

SEQ ID NO: 34827 - DNA, 1149 bp, Ashbya gossypii; identical to SEQ ID NO: 1289
  CDS (1)..(1149)

SEQ ID NO: 34828 - protein, 382 aa, Ashbya gossypii; identical to SEQ ID NO: 1290

SEQ ID NO: 34829 - DNA, 1530 bp, Candida albicans; identical to SEQ ID NO: 1291
  CDS (117)..(1241)

SEQ ID NO: 34830 - protein, 374 aa, Candida albicans; identical to SEQ ID NO: 1292

SEQ ID NO: 34831 - DNA, 1041 bp, Pseudomonas sp; identical to SEQ ID NO: 1293
  CDS (1)..(1041)

SEQ ID NO: 34832 - protein, 346 aa, Pseudomonas sp; identical to SEQ ID NO: 1294

SEQ ID NO: 34833 - DNA, 1170 bp, Cochliobolus carbonum; identical to SEQ ID NO: 1295
  CDS (1)..(1170)

SEQ ID NO: 34834 - protein, 389 aa, Cochliobolus carbonum; identical to SEQ ID NO: 1296

SEQ ID NO: 34835 - DNA, 25 bp, Artificial sequence
  (1)..(25): primer
atgactgaattcgaattgcctccaa

SEQ ID NO: 34836 - DNA, 26 bp, Artificial sequence
  (1)..(26): primer
tcagtatttgtaggtttttatttcgc

SEQ ID NO: 34837 - protein, 333 aa, Artificial sequence
  Variant (4)..(5): xaa in position 4 to 5 is any amino acid
  Variant (7)..(7): xaa in position 7 is any amino acid
  Variant (9)..(24): xaa in position 9 to 24 is any amino acid
  Variant (26)..(26): xaa in position 26 is any amino acid
  Variant (28)..(29): xaa in position 28 to 29 is any amino acid
  Variant (32)..(33): xaa in position 32 to 33 is any amino acid
  Variant (35)..(37): xaa in position 35 to 37 is any amino acid
  Variant (39)..(45): xaa in position 39 to 45 is any amino acid
  Variant (47)..(61): xaa in position 47 to 61 is any amino acid
  Variant (63)..(64): xaa in position 63 to 64 is any amino acid
  Variant (67)..(87): xaa in position 67 to 87 is any amino acid
  Variant (89)..(92): xaa in position 89 to 92 is any amino acid
  Variant (94)..(102): xaa in position 94 to 102 is any amino acid
  Variant (104)..(106): xaa in position 104 to 106 is any amino acid
  Variant (108)..(111): xaa in position 108 to 111 is any amino acid
  Variant (113)..(136): xaa in position 113 to 136 is any amino acid
  Variant (139)..(143): xaa in position 139 to 143 is any amino acid
  Variant (147)..(148): xaa in position 147 to 148 is any amino acid
  Variant (150)..(152): xaa in position 150 to 152 is any amino acid
  Variant (154)..(155): xaa in position 154 to 155 is any amino acid
  Variant (157)..(171): xaa in position 157 to 171 is any amino acid
  Variant (173)..(173): xaa in position 173 is any amino acid
  Variant (178)..(200): xaa in position 178 to 200 is any amino acid
  Variant (202)..(208): xaa in position 202 to 208 is any amino acid
  Variant (210)..(212): xaa in position 210 to 212 is any amino acid
  Variant (215)..(215): xaa in position 215 is any amino acid
  Variant (217)..(236): xaa in position 217 to 236 is any amino acid
  Variant (240)..(240): xaa in position 240 is any amino acid
  Variant (242)..(243): xaa in position 242 to 243 is any amino acid
  Variant (245)..(289): xaa in position 245 to 289 is any amino acid
  Variant (291)..(328): xaa in position 291 to 328 is any amino acid
  Variant (330)..(332): xaa in position 330 to 332 is any amino acid
RSDXXTXPXXXXXXXXXXXXXXXXDXVXXEDXXTXXXEXXXXXXXGXXXXXXXXXXXXXXXTXXNQXXXXXXXXXXXXXXXXXXXXXHXXXXEXXXXXXXXXAXXXPXXXXNXXXXXXXXXXXXXXXXXXXXXXXXPTXXXXXENTXXGXXXPXXEXXXXXXXXXXXXXXXHXDGARXXXXXXXXXXXXXXXXXXXXXXXDXXXXXXXKXXXAPXGXXXXXXXXXXXXXXXXXXXXGGGXRXXGXXXXXXXXXXXXXXXXXXXXXXXXXXXXXXXXXXXXXXXXXXXXXLXXXXXXXXXXXXXXXXXXXXXXXXXXXXXXXXXXXXXXRXXXH

SEQ ID NO: 34838 - protein, 357 aa, Artificial sequence
  Variant (3)..(26): xaa in position 3 to 26 is any amino acid
  Variant (29)..(29): xaa in position 29 is any amino acid
  Variant (31)..(55): xaa in position 31 to 55 is any amino acid
  Variant (57)..(59): xaa in position 57 to 59 is any amino acid
  Variant (62)..(63): xaa in position 62 to 63 is any amino acid
  Variant (65)..(86): xaa in position 65 to 86 is any amino acid
  Variant (88)..(91): xaa in position 88 to 91 is any amino acid
  Variant (93)..(93): xaa in position 93 is any amino acid
  Variant (95)..(134): xaa in position 95 to 134 is any amino acid
  Variant (136)..(152): xaa in position 136 to 152 is any amino acid
  Variant (154)..(176): xaa in position 154 to 176 is any amino acid
  Variant (178)..(178): xaa in position 178 is any amino acid
  Variant (183)..(185): xaa in position 183 to 185 is any amino acid
  Variant (187)..(205): xaa in position 187 to 205 is any amino acid
  Variant (207)..(213): xaa in position 207 to 213 is any amino acid
  Variant (215)..(238): xaa in position 215 to 238 is any amino acid
  Variant (240)..(241): xaa in position 240 to 241 is any amino acid
  Variant (243)..(280): xaa in position 243 to 280 is any amino acid
  Variant (282)..(307): xaa in position 282 to 307 is any amino acid
  Variant (309)..(356): xaa in position 309 to 356 is any amino acid
SDXXXXXXXXXXXXXXXXXXXXXXXXYGXDXXXXXXXXXXXXXXXXXXXXXXXXXFXXXGTXXNXXXXXXXXXXXXXXXXXXXXXXHXXXXEXGXXXXXXXXXXXXXXXXXXXXXXXXXXXXXXXXXXXXXXXXHXXXXXXXXXXXXXXXXXGXXXXXXXXXXXXXXXXXXXXXXXHXDGARXXXAXXXXXXXXXXXXXXXXXXXDXXXXXXXKXXXXXXXXXXXXXXXXXXXXXXXXKXXGXXXXXXXXXXXXXXXXXXXXXXXXXXXXXXXXXXXXXXAXXXXXXXXXXXXXXXXXXXXXXXXXXNXXXXXXXXXXXXXXXXXXXXXXXXXXXXXXXXXXXXXXXXXXXXXXXXR

SEQ ID NO: 34839 - protein, 346 aa, Artificial sequence
  Variant (5)..(5): xaa in position 5 is any amino acid
  Variant (7)..(7): xaa in position 7 is any amino acid
  Variant (10)..(11): xaa in position 10 to 11 is any amino acid
  Variant (13)..(23): xaa in position 13 to 23 is any amino acid
  Variant (26)..(26): xaa in position 26 is any amino acid
  Variant (29)..(29): xaa in position 29 is any amino acid
  Variant (32)..(33): xaa in position 32 to 33 is any amino acid
  Variant (35)..(37): xaa in position 35 to 37 is any amino acid
  Variant (39)..(45): xaa in position 39 to 45 is any amino acid
  Variant (47)..(53): xaa in position 47 to 53 is any amino acid
  Variant (55)..(56): xaa in position 55 to 56 is any amino acid
  Variant (58)..(58): xaa in position 58 is any amino acid
  Variant (63)..(64): xaa in position 63 to 64 is any amino acid
  Variant (67)..(69): xaa in position 67 to 69 is any amino acid
  Variant (71)..(72): xaa in position 71 to 72 is any amino acid
  Variant (74)..(76): xaa in position 74 to 76 is any amino acid
  Variant (79)..(79): xaa in position 79 is any amino acid
  Variant (85)..(85): xaa in position 85 is any amino acid
  Variant (89)..(92): xaa in position 89 to 92 is any amino acid
  Variant (95)..(95): xaa in position 95 is any amino acid
  Variant (97)..(97): xaa in position 97 is any amino acid
  Variant (99)..(99): xaa in position 99 is any amino acid
  Variant (104)..(106): xaa in position 104 to 106 is any amino acid
  Variant (108)..(109): xaa in position 108 to 109 is any amino acid
  Variant (111)..(111): xaa in position 111 is any amino acid
  Variant (114)..(114): xaa in position 114 is any amino acid
  Variant (116)..(116): xaa in position 116 is any amino acid
  Variant (118)..(118): xaa in position 118 is any amino acid
  Variant (121)..(131): xaa in position 121 to 131 is any amino acid
  Variant (133)..(133): xaa in position 133 is any amino acid
  Variant (135)..(136): xaa in position 135 to 136 is any amino acid
  Variant (139)..(142): xaa in position 139 to 142 is any amino acid
  Variant (147)..(148): xaa in position 147 to 148 is any amino acid
  Variant (150)..(152): xaa in position 150 to 152 is any amino acid
  Variant (154)..(155): xaa in position 154 to 155 is any amino acid
  Variant (157)..(159): xaa in position 157 to 159 is any amino acid
  Variant (161)..(171): xaa in position 161 to 171 is any amino acid
  Variant (173)..(173): xaa in position 173 is any amino acid
  Variant (178)..(178): xaa in position 178 is any amino acid
  Variant (180)..(180): xaa in position 180 is any amino acid
  Variant (182)..(199): xaa in position 182 to 199 is any amino acid
  Variant (203)..(203): xaa in position 203 is any amino acid
  Variant (205)..(205): xaa in position 205 is any amino acid
  Variant (210)..(212): xaa in position 210 to 212 is any amino acid
  Variant (215)..(215): xaa in position 215 is any amino acid
  Variant (218)..(219): xaa in position 218 to 219 is any amino acid
  Variant (222)..(233): xaa in position 222 to 233 is any amino acid
  Variant (235)..(236): xaa in position 235 to 236 is any amino acid
  Variant (240)..(240): xaa in position 240 is any amino acid
  Variant (243)..(243): xaa in position 243 is any amino acid
  Variant (245)..(249): xaa in position 245 to 249 is any amino acid
  Variant (251)..(272): xaa in position 251 to 272 is any amino acid
  Variant (274)..(275): xaa in position 274 to 275 is any amino acid
  Variant (277)..(286): xaa in position 277 to 286 is any amino acid
  Variant (288)..(289): xaa in position 288 to 289 is any amino acid
  Variant (291)..(292): xaa in position 291 to 292 is any amino acid
  Variant (294)..(295): xaa in position 294 to 295 is any amino acid
  Variant (298)..(298): xaa in position 298 is any amino acid
  Variant (300)..(301): xaa in position 300 to 301 is any amino acid
  Variant (303)..(324): xaa in position 303 to 324 is any amino acid
  Variant (326)..(328): xaa in position 326 to 328 is any amino acid
  Variant (330)..(332): xaa in position 330 to 332 is any amino acid
  Variant (334)..(334): xaa in position 334 is any amino acid
  Variant (336)..(345): xaa in position 336 to 345 is any amino acid
RSDTXTXPTXXMXXXXXXXXXXXGDXVYXEDXXTXXXEXXXXXXXGXXXXXXXAXXFXVSGTXXNQXXXRXXLXXXPPXSILCDXRAHXXXXEAXGXAXLSQAXXXPXXPXNGXYXTXEDXXXXXXXXXXXDXHXXPTXXXXLENTXXGXXXPXXEXXXIXXXXXXXXXXXHXDGARXWXAXXXXXXXXXXXXXXXXXXFDSXSXCLSKXXXAPXGSXXVGXXXXXXXXXXXXKXXGGGXRQXGXXXXXAXXXXXXXXXXXXXXXXXXXXXXHXXAXXXXXXXXXXGXXLXXPXXTNXVXXDXXXXXXXXXXXXXXXXXXXXXXLXXXRXXXHXQXXXXXXXXXXK

SEQ ID NO: 34840 - protein, 101 aa, Artificial sequence; identical to SEQ ID NO: 1322
  Variant (2)..(23): xaa in position 2 to 23 is any amino acid
  Variant (24)..(30): xaa in position 24 to 30 is any or no amino acid
  Variant (32)..(32): xaa in position 32 is any amino acid
  Variant (37)..(39): xaa in position 37 to 39 is any amino acid
  Variant (41)..(55): xaa in position 41 to 55 is any amino acid
  Variant (56)..(57): xaa in position 56 to 57 is any or no amino acid
  Variant (59)..(62): xaa in position 59 to 62 is any amino acid
  Variant (64)..(64): xaa in position 64 is any amino acid
  Variant (67)..(70): xaa in position 67 to 70 is any amino acid
  Variant (72)..(72): xaa in position 72 is any amino acid
  Variant (75)..(77): xaa in position 75 to 77 is any amino acid
  Variant (79)..(85): xaa in position 79 to 85 is any amino acid
  Variant (87)..(90): xaa in position 87 to 90 is any amino acid
  Variant (92)..(93): xaa in position 92 to 93 is any amino acid
  Variant (97)..(97): xaa in position 97 is any amino acid
  Variant (100)..(100): xaa in position 100 is any amino acid

SEQ ID NO: 34841 - protein, 94 aa, Artificial sequence; identical to SEQ ID NO: 1313
  Variant (1)..(1): xaa in position 1 is Asp or Gly
  Variant (2)..(9): xaa in position 2 to 9 is any amino acid
  Variant (10)..(10): xaa in position 10 is Met, Val, Ile, Leu or Ser
  Variant (11)..(26): xaa in position 11 to 26 is any amino acid
  Variant (27)..(28): xaa in position 27 to 28 is any or no amino acid
  Variant (29)..(29): xaa in position 29 is Asp, Gly or Ser
  Variant (30)..(34): xaa in position 30 to 34 is any amino acid
  Variant (35)..(35): xaa in position 35 is Leu, Ala, Phe, Val or Ile
  Variant (36)..(52): xaa in position 36 to 52 is any amino acid
  Variant (53)..(57): xaa in position 53 to 57 is any or no amino acid
  Variant (58)..(58): xaa in position 58 is Ser, Thr, Asn or Gly
  Variant (60)..(60): xaa in position 60 is Thr or Ser
  Variant (61)..(61): xaa in position 61 is any amino acid
  Variant (62)..(62): xaa in position 62 is Ala, Ser, Thr, Gly or Cys
  Variant (63)..(63): xaa in position 63 is Asn or Gln
  Variant (64)..(66): xaa in position 64 to 66 is any amino acid
  Variant (67)..(67): xaa in position 67 is Leu, Ile, Val, Met or Thr
  Variant (68)..(72): xaa in position 68 to 72 is any amino acid
  Variant (73)..(74): xaa in position 73 to 74 is any or no amino acid
  Variant (75)..(75): xaa in position 75 is Pro, Arg or Ser
  Variant (76)..(84): xaa in position 76 to 84 is any amino acid
  Variant (85)..(85): xaa in position 85 is Ala, Ser, Gly or Cys
  Variant (87)..(90): xaa in position 87 to 90 is any amino acid
  Variant (92)..(92): xaa in position 92 is any amino acid
  Variant (93)..(93): xaa in position 93 is Gly, Ala, Gln or Asp
  Variant (94)..(94): xaa in position 94 is Gly, Ala or Ser

SEQ ID NO: 34842 - protein, 89 aa, Artificial sequence; identical to SEQ ID NO: 1314
  Variant (2)..(2): xaa in position 2 is any amino acid
  Variant (3)..(3): xaa in position 3 is Val, Ile, Leu or Cys
  Variant (4)..(8): xaa in position 4 to 8 is any amino acid
  Variant (9)..(9): xaa in position 9 is Leu, Ile, Met, Val or Thr
  Variant (10)..(20): xaa in position 10 to 20 is any amino acid
  Variant (21)..(21): xaa in position 21 is Leu, Val, Ile or Met
  Variant (22)..(22): xaa in position 22 is any amino acid
  Variant (23)..(23): xaa in position 23 is Leu, Val, Ile, Met or Thr
  Variant (24)..(24): xaa in position 24 is His, Tyr or Phe
  Variant (25)..(25): xaa in position 25 is Leu, Met, Ile, Val or Cys
  Variant (28)..(28): xaa in position 28 is Ala or Ser
  Variant (30)..(30): xaa in position 30 is Leu, Ile, Phe or Val
  Variant (31)..(32): xaa in position 31 to 32 is any amino acid
  Variant (33)..(33): xaa in position 33 is Ala, Gly, Ser or Ile
  Variant (34)..(48): xaa in position 34 to 48 is any amino acid
  Variant (49)..(52): xaa in position 49 to 52 is any or no amino acid
  Variant (54)..(57): xaa in position 54 to 57 is any amino acid
  Variant (58)..(58): xaa in position 58 is Cys, Gly or Ser
  Variant (59)..(59): xaa in position 59 is Leu, Gly, Phe or Ala
  Variant (60)..(60): xaa in position 60 is Ser, Thr or Tyr
  Variant (62)..(62): xaa in position 62 is any amino acid
  Variant (63)..(63): xaa in position 63 is Leu, Gly, Ile, Met or Val
  Variant (64)..(67): xaa in position 64 to 67 is any amino acid
  Variant (68)..(68): xaa in position 68 is Gly or Glu
  Variant (69)..(69): xaa in position 69 is Ser or Ala
  Variant (70)..(70): xaa in position 70 is Val, Leu, Ile or Met
  Variant (71)..(71): xaa in position 71 is Leu, Val or Ile
  Variant (72)..(85): xaa in position 72 to 85 is any amino acid
  Variant (86)..(86): xaa in position 86 is Lys, Arg or Gln
  Variant (87)..(88): xaa in position 87 to 88 is any amino acid
  Variant (89)..(89): xaa in position 89 is Gly, Ala or Met

SEQ ID NO: 34843 - protein, 122 aa, Artificial sequence; identical to SEQ ID NO: 1316
  Variant (1)..(1): xaa in position 1 is Asp or Glu
  Variant (2)..(2): xaa in position 2 is Phe or Leu
  Variant (6)..(7): xaa in position 6 to 7 is any amino acid
  Variant (9)..(9): xaa in position 9 is any amino acid
  Variant (11)..(11): xaa in position 11 is Thr or Ser
  Variant (12)..(13): xaa in position 12 to 13 is any amino acid
  Variant (14)..(14): xaa in position 14 is Met or Val
  Variant (15)..(20): xaa in position 15 to 20 is any amino acid
  Variant (21)..(22): xaa in position 21 to 22 is any or no amino acid
  Variant (23)..(23): xaa in position 23 is Ala, Ser or Thr
  Variant (24)..(24): xaa in position 24 is Thr, Ser or Ala
  Variant (25)..(25): xaa in position 25 is any amino acid
  Variant (26)..(26): xaa in position 26 is Gly or Asn
  Variant (28)..(28): xaa in position 28 is any amino acid
  Variant (30)..(30): xaa in position 30 is Tyr or Phe
  Variant (31)..(31): xaa in position 31 is any amino acid
  Variant (34)..(35): xaa in position 34 to 35 is any amino acid
  Variant (37)..(38): xaa in position 37 to 38 is any amino acid
  Variant (39)..(39): xaa in position 39 is Leu or Phe
  Variant (41)..(42): xaa in position 41 to 42 is any amino acid
  Variant (43)..(43): xaa in position 43 is Val, Met or Ile
  Variant (44)..(47): xaa in position 44 to 47 is any amino acid
  Variant (49)..(50): xaa in position 49 to 50 is any amino acid
  Variant (51)..(55): xaa in position 51 to 55 is any or no amino acid
  Variant (56)..(56): xaa in position 56 is Ala or Glu
  Variant (57)..(57): xaa in position 57 is Gly or Ala
  Variant (58)..(58): xaa in position 58 is Leu, Met or Val
  Variant (59)..(59): xaa in position 59 is Phe or Met
  Variant (60)..(61): xaa in position 60 to 61 is any amino acid
  Variant (62)..(62): xaa in position 62 is Ser or Thr
  Variant (63)..(63): xaa in position 63 is Gly or Thr
  Variant (65)..(66): xaa in position 65 to 66 is any amino acid
  Variant (69)..(69): xaa in position 69 is Ile or Leu
  Variant (70)..(70): xaa in position 70 is any amino acid
  Variant (71)..(71): xaa in position 71 is Leu, Val or Ile
  Variant (72)..(74): xaa in position 72 to 74 is any amino acid
  Variant (75)..(75): xaa in position 75 is Leu, Val or Ser
  Variant (76)..(76): xaa in position 76 is any amino acid
  Variant (77)..(78): xaa in position 77 to 78 is any or no amino acid
  Variant (79)..(79): xaa in position 79 is Pro or Arg
  Variant (80)..(80): xaa in position 80 is Pro or Cys
  Variant (81)..(81): xaa in position 81 is any amino acid
  Variant (82)..(82): xaa in position 82 is Ser or Gly
  Variant (83)..(83): xaa in position 83 is Ile or Val
  Variant (84)..(84): xaa in position 84 is Leu or Ile
  Variant (85)..(85): xaa in position 85 is any amino acid
  Variant (86)..(86): xaa in position 86 is Asp or Ser
  Variant (87)..(88): xaa in position 87 to 88 is any amino acid
  Variant (89)..(89): xaa in position 89 is Ala or Ser
  Variant (91)..(91): xaa in position 91 is Val, Ile or Ala
  Variant (92)..(94): xaa in position 92 to 94 is any amino acid
  Variant (96)..(96): xaa in position 96 is Ala or Cys
  Variant (97)..(98): xaa in position 97 to 98 is Gly or Ala
  Variant (99)..(99): xaa in position 99 is any amino acid
  Variant (100)..(100): xaa in position 100 is Ala, Ser or Gly
  Variant (101)..(101): xaa in position 101 is any amino acid
  Variant (102)..(102): xaa in position 102 is Leu or Phe
  Variant (103)..(103): xaa in position 103 is Ser, Thr or Cys
  Variant (104)..(104): xaa in position 104 is Gln or Gly
  Variant (106)..(106): xaa in position 106 is any amino acid
  Variant (107)..(107): xaa in position 107 is Val, Leu, Ile or Ala
  Variant (108)..(108): xaa in position 108 is any amino acid
  Variant (110)..(110): xaa in position 110 is Val, Ile or Ala
  Variant (111)..(111): xaa in position 111 is any amino acid
  Variant (112)..(112): xaa in position 112 is Pro or Ala
  Variant (113)..(113): xaa in position 113 is any amino acid
  Variant (115)..(115): xaa in position 115 is Gly or Asn
  Variant (116)..(116): xaa in position 116 is any amino acid
  Variant (117)..(117): xaa in position 117 is Tyr or His
  Variant (118)..(118): xaa in position 118 is Leu, Ile or Met
  Variant (119)..(119): xaa in position 119 is Thr or Arg
  Variant (120)..(120): xaa in position 120 is any amino acid
  Variant (121)..(121): xaa in position 121 is Glu or Asp
  Variant (122)..(122): xaa in position 122 is Asp or Glu

SEQ ID NO: 34844 - protein, 50 aa, Artificial sequence; identical to SEQ ID NO: 1317
  Variant (1)..(1): xaa in position 1 is Asp, Glu or Met
  Variant (2)..(2): xaa in position 2 is Ile, Val or Thr
  Variant (3)..(3): xaa in position 3 is His or Glu
  Variant (4)..(5): xaa in position 4 to 5 is any amino acid
  Variant (8)..(8): xaa in position 8 is any amino acid
  Variant (9)..(9): xaa in position 9 is Leu, Ile or Val
  Variant (10)..(10): xaa in position 10 is Ile, Val or Leu
  Variant (11)..(11): xaa in position 11 is any amino acid
  Variant (12)..(12): xaa in position 12 is Leu or Met
  Variant (16)..(17): xaa in position 16 to 17 is any amino acid
  Variant (19)..(21): xaa in position 19 to 21 is any amino acid
  Variant (23)..(23): xaa in position 23 is Leu, Val or Ile
  Variant (24)..(24): xaa in position 24 is any amino acid
  Variant (26)..(26): xaa in position 26 is Leu, Ile, Val or Met
  Variant (27)..(27): xaa in position 27 is any amino acid
  Variant (28)..(28): xaa in position 28 is Arg or Lys
  Variant (29)..(29): xaa in position 29 is Ile or Met
  Variant (30)..(31): xaa in position 30 to 31 is any amino acid
  Variant (32)..(32): xaa in position 32 is Trp, Phe or Leu
  Variant (33)..(33): xaa in position 33 is Ala or Cys
  Variant (34)..(35): xaa in position 34 to 35 is any amino acid
  Variant (36)..(36): xaa in position 36 is Asn, Gln or His
  Variant (37)..(37): xaa in position 37 is any amino acid
  Variant (38)..(38): xaa in position 38 is Ile, Val, Leu or Met
  Variant (39)..(39): xaa in position 39 is any amino acid
  Variant (40)..(40): xaa in position 40 is Leu, Val, Ile or Thr
  Variant (42)..(42): xaa in position 42 is any amino acid
  Variant (47)..(47): xaa in position 47 is Leu or Ile
  Variant (48)..(48): xaa in position 48 is Trp or Phe
  Variant (49)..(49): xaa in position 49 is any amino acid
  Variant (50)..(50): xaa in position 50 is Ala or Ser

SEQ ID NO: 34845 - protein, 62 aa, Artificial sequence; identical to SEQ ID NO: 1318
  Variant (1)..(1): xaa in position 1 is Leu, Ile or Met
  Variant (2)..(2): xaa in position 2 is Lys, Arg or Glu
  Variant (3)..(8): xaa in position 3 to 8 is any amino acid
  Variant (10)..(10): xaa in position 10 is Ser, Ala or Leu
  Variant (11)..(11): xaa in position 11 is Val, Ile or Met
  Variant (12)..(12): xaa in position 12 is Ser or Thr
  Variant (13)..(13): xaa in position 13 is Leu, Ile or Val
  Variant (14)..(14): xaa in position 14 is any amino acid
  Variant (15)..(15): xaa in position 15 is Leu or Phe
  Variant (16)..(16): xaa in position 16 is Ser or Gly
  Variant (18)..(18): xaa in position 18 is any amino acid
  Variant (19)..(19): xaa in position 19 is Leu, Met, Ile or Val
  Variant (20)..(20): xaa in position 20 is Gly, Ala or Cys
  Variant (23)..(23): xaa in position 23 is Ile, Val or Met
  Variant (25)..(25): xaa in position 25 is Ser, Thr or Ala
  Variant (26)..(26): xaa in position 26 is Val, Ile, Met or Ala
  Variant (27)..(27): xaa in position 27 is Leu or Ile
  Variant (28)..(28): xaa in position 28 is Val, Leu or Ile
  Variant (29)..(29): xaa in position 29 is Gly or Ala
  Variant (30)..(32): xaa in position 30 to 32 is any amino acid
  Variant (33)..(33): xaa in position 33 is Phe or Leu
  Variant (34)..(34): xaa in position 34 is Ile or Val
  Variant (35)..(40): xaa in position 35 to 40 is any amino acid
  Variant (41)..(41): xaa in position 41 is Arg, Lys or Gln
  Variant (42)..(42): xaa in position 42 is Lys or Gln
  Variant (43)..(44): xaa in position 43 to 44 is any amino acid
  Variant (48)..(48): xaa in position 48 is Ile, Val, Leu or Met
  Variant (50)..(50): xaa in position 50 is Gln or Lys
  Variant (51)..(51): xaa in position 51 is Ser, Ala or Gly
  Variant (53)..(53): xaa in position 53 is any amino acid
  Variant (54)..(54): xaa in position 54 is Leu, Ile or Met
  Variant (55)..(56): xaa in position 55 to 56 is any amino acid
  Variant (57)..(57): xaa in position 57 is Met or Ala
  Variant (58)..(58): xaa in position 58 is Ala or Gly
  Variant (59)..(61): xaa in position 59 to 61 is any amino acid
  Variant (62)..(62): xaa in position 62 is Ile, Leu, Met or Val

SEQ ID NO: 34846 - protein, 65 aa, Artificial sequence; identical to SEQ ID NO: 1319
  Variant (1)..(1): xaa in position 1 is Gly or Gln
  Variant (2)..(2): xaa in position 2 is Ile, Gly or Leu
  Variant (3)..(3): xaa in position 3 is any amino acid
  Variant (5)..(6): xaa in position 5 to 6 is any amino acid
  Variant (7)..(7): xaa in position 7 is Pro or Glu
  Variant (8)..(9): xaa in position 8 to 9 is any amino acid
  Variant (10)..(10): xaa in position 10 is Thr or Ser
  Variant (11)..(11): xaa in position 11 is Asn or Ser
  Variant (12)..(12): xaa in position 12 is any amino acid
  Variant (13)..(13): xaa in position 13 is Val, Phe or Ile
  Variant (14)..(14): xaa in position 14 is Phe, Trp, Tyr or Thr
  Variant (15)..(15): xaa in position 15 is Leu, Ile or Val
  Variant (16)..(16): xaa in position 16 is Asp, Ala or Asn
  Variant (17)..(20): xaa in position 17 to 20 is any amino acid
  Variant (21)..(21): xaa in position 21 is any or no amino acid
  Variant (22)..(22): xaa in position 22 is Met, Ile, Leu or Phe
  Variant (23)..(24): xaa in position 23 to 24 is any amino acid
  Variant (25)..(25): xaa in position 25 is Asp, Ser or Asn
  Variant (26)..(26): xaa in position 26 is any amino acid
  Variant (27)..(27): xaa in position 27 is Leu, Phe or Ala
  Variant (28)..(31): xaa in position 28 to 31 is any amino acid
  Variant (32)..(36): xaa in position 32 to 36 is any or no amino acid
  Variant (37)..(37): xaa in position 37 is Val, Ile or Cys
  Variant (38)..(38): xaa in position 38 is Lys, Ile or Arg
  Variant (39)..(39): xaa in position 39 is Leu or Ile
  Variant (40)..(40): xaa in position 40 is any amino acid
  Variant (41)..(41): xaa in position 41 is Gly, Ala or Asp
  Variant (42)..(42): xaa in position 42 is any amino acid
  Variant (44)..(44): xaa in position 44 is Ile, Val or Leu
  Variant (45)..(45): xaa in position 45 is Ala, Ser or Val
  Variant (46)..(46): xaa in position 46 is Phe, Cys or Leu
  Variant (48)..(48): xaa in position 48 is any amino acid
  Variant (49)..(49): xaa in position 49 is Gln or His
  Variant (50)..(50): xaa in position 50 is any or no amino acid
  Variant (51)..(51): xaa in position 51 is Val, Leu, Ile or Thr
  Variant (52)..(54): xaa in position 52 to 54 is any amino acid
  Variant (55)..(55): xaa in position 55 is Ser, Ala or Thr
  Variant (56)..(58): xaa in position 56 to 58 is any amino acid
  Variant (59)..(59): xaa in position 59 is Val, Leu, Ile or Cys
  Variant (60)..(60): xaa in position 60 is Lys, Ile or Glu
  Variant (61)..(61): xaa in position 61 is any amino acid
  Variant (62)..(62): xaa in position 62 is Val, Ala or Cys
  Variant (63)..(64): xaa in position 63 to 64 is any amino acid
  Variant (65)..(65): xaa in position 65 is Glu, Asp or Arg

SEQ ID NO: 34847 - DNA, 1390 bp, Saccharomyces cerevisiae; identical to SEQ ID NO: 531
  CDS (303)..(1118)

SEQ ID NO: 34848 - protein, 271 aa, Saccharomyces cerevisiae; identical to SEQ ID NO: 532

SEQ ID NO: 34849 - DNA, 714 bp, Deinococcus radiodurans; identical to SEQ ID NO: 533
  CDS (1)..(714)

SEQ ID NO: 34850 - protein, 237 aa, Deinococcus radiodurans; identical to SEQ ID NO: 534

SEQ ID NO: 34851 - DNA, 1350 bp, Nostoc sp. PCC 7120; identical to SEQ ID NO: 535
  CDS (1)..(1350)

SEQ ID NO: 34852 - protein, 449 aa, Nostoc sp. PCC 7120; identical to SEQ ID NO: 536

SEQ ID NO: 34853 - DNA, 636 bp, Listeria monocytogenes; identical to SEQ ID NO: 537
  CDS (1)..(636)

SEQ ID NO: 34854 - protein, 211 aa, Listeria monocytogenes; identical to SEQ ID NO: 538

SEQ ID NO: 34855 - DNA, 636 bp, Listeria innocua; identical to SEQ ID NO: 539
  CDS (1)..(636)

SEQ ID NO: 34856 - protein, 211 aa, Listeria innocua; identical to SEQ ID NO: 540

SEQ ID NO: 34857 - DNA, 654 bp, Brucella melitensis; identical to SEQ ID NO: 541
  CDS (1)..(654)

SEQ ID NO: 34858 - protein, 217 aa, Brucella melitensis; identical to SEQ ID NO: 542

SEQ ID NO: 34859 - DNA, 813 bp, Nostoc sp. PCC 7120; identical to SEQ ID NO: 543
  CDS (1)..(813)

SEQ ID NO: 34860 - protein, 270 aa, Nostoc sp. PCC 7120; identical to SEQ ID NO: 544

SEQ ID NO: 34861 - DNA, 615 bp, Deinococcus radiodurans; identical to SEQ ID NO: 545
  CDS (1)..(615)

SEQ ID NO: 34862 - protein, 204 aa, Deinococcus radiodurans; identical to SEQ ID NO: 546

SEQ ID NO: 34863 - DNA, 714 bp, Caulobacter crescentus; identical to SEQ ID NO: 547
  CDS (1)..(714)

SEQ ID NO: 34864 - protein, 237 aa, Caulobacter crescentus; identical to SEQ ID NO: 548

SEQ ID NO: 34865 - DNA, 756 bp, Treponema pallidum subsp. pallidum (syphilis spirochete); identical to SEQ ID NO: 549
  CDS (1)..(756)

SEQ ID NO: 34866 - protein, 251 aa, Treponema pallidum subsp. pallidum (syphilis spirochete); identical to SEQ ID NO: 550

SEQ ID NO: 34867 - DNA, 645 bp, Xylella fastidiosa; identical to SEQ ID NO: 551
  CDS (1)..(645)

SEQ ID NO: 34868 - protein, 214 aa, Xylella fastidiosa; identical to SEQ ID NO: 552

SEQ ID NO: 34869 - DNA, 2034 bp, Arabidopsis thaliana (mouse-ear cress); identical to SEQ ID NO: 553
  CDS (1)..(2034)

SEQ ID NO: 34870 - protein, 677 aa, Arabidopsis thaliana (mouse-ear cress); identical to SEQ ID NO: 554

SEQ ID NO: 34871 - DNA, 582 bp, Bacillus subtilis; identical to SEQ ID NO: 555
  CDS (1)..(582)

SEQ ID NO: 34872 - protein, 193 aa, Bacillus subtilis; identical to SEQ ID NO: 556

SEQ ID NO: 34873 - DNA, 606 bp, Thermotoga maritima; identical to SEQ ID NO: 557
  CDS (1)..(606)

SEQ ID NO: 34874 - protein, 201 aa, Thermotoga maritima; identical to SEQ ID NO: 558

SEQ ID NO: 34875 - DNA, 660 bp, Clostridium acetobutylicum; identical to SEQ ID NO: 559
  CDS (1)..(660)

SEQ ID NO: 34876 - protein, 219 aa, Clostridium acetobutylicum; identical to SEQ ID NO: 560

SEQ ID NO: 34877 - DNA, 744 bp, Saccharomyces cerevisiae; identical to SEQ ID NO: 561
  CDS (1)..(744)

SEQ ID NO: 34878 - protein, 247 aa, Saccharomyces cerevisiae; identical to SEQ ID NO: 562

SEQ ID NO: 34879 - DNA, 1050 bp, Synechocystis sp; identical to SEQ ID NO: 563
  CDS (1)..(1050)

SEQ ID NO: 34880 - protein, 349 aa, Synechocystis sp; identical to SEQ ID NO: 564

SEQ ID NO: 34881 - DNA, 875 bp, Arabidopsis thaliana (mouse-ear cress); identical to SEQ ID NO: 565
  CDS (30)..(722)

SEQ ID NO: 34882 - protein, 230 aa, Arabidopsis thaliana (mouse-ear cress); identical to SEQ ID NO: 566

SEQ ID NO: 34883 - DNA, 741 bp, Debaryomyces hansenii; identical to SEQ ID NO: 567
  CDS (1)..(741)

SEQ ID NO: 34884 - protein, 246 aa, Debaryomyces hansenii; identical to SEQ ID NO: 568

SEQ ID NO: 34885 - DNA, 741 bp, Yarrowia lipolytica; identical to SEQ ID NO: 569
  CDS (1)..(741)

SEQ ID NO: 34886 - protein, 246 aa, Yarrowia lipolytica; identical to SEQ ID NO: 570

SEQ ID NO: 34887 - DNA, 816 bp, Kluyveromyces lactis; identical to SEQ ID NO: 571
  CDS (1)..(816)

SEQ ID NO: 34888 - protein, 271 aa, Kluyveromyces lactis; identical to SEQ ID NO: 572

SEQ ID NO: 34889 - DNA, 687 bp, Kluyveromyces lactis; identical to SEQ ID NO: 573
  CDS (1)..(687)

SEQ ID NO: 34890 - protein, 228 aa, Kluyveromyces lactis; identical to SEQ ID NO: 574

SEQ ID NO: 34891 - DNA, 651 bp, Erwinia carotovora subsp; identical to SEQ ID NO: 575
  CDS (1)..(651)

SEQ ID NO: 34892 - protein, 216 aa, Erwinia carotovora subsp; identical to SEQ ID NO: 576

SEQ ID NO: 34893 - DNA, 840 bp, Candida glabrata; identical to SEQ ID NO: 577
  CDS (1)..(840)

SEQ ID NO: 34894 - protein, 279 aa, Candida glabrata; identical to SEQ ID NO: 578

SEQ ID NO: 34895 - DNA, 744 bp, Candida glabrata; identical to SEQ ID NO: 579
  CDS (1)..(744)

SEQ ID NO: 34896 - protein, 247 aa, Candida glabrata; identical to SEQ ID NO: 580

SEQ ID NO: 34897 - DNA, 621 bp, Bartonella quintana; identical to SEQ ID NO: 581
  CDS (1)..(621)

SEQ ID NO: 34898 - protein, 206 aa, Bartonella quintana; identical to SEQ ID NO: 582

SEQ ID NO: 34899 - DNA, 648 bp, Parachlamydia sp; identical to SEQ ID NO: 583
  CDS (1)..(648)

SEQ ID NO: 34900 - protein, 215 aa, Parachlamydia sp; identical to SEQ ID NO: 584

SEQ ID NO: 34901 - DNA, 636 bp, Listeria monocytogenes; identical to SEQ ID NO: 585
  CDS (1)..(636)

SEQ ID NO: 34902 - protein, 211 aa, Listeria monocytogenes; identical to SEQ ID NO: 586

SEQ ID NO: 34903 - DNA, 633 bp, Thermus thermophilus; identical to SEQ ID NO: 587
  CDS (1)..(633)

SEQ ID NO: 34904 - protein, 210 aa, Thermus thermophilus; identical to SEQ ID NO: 588

SEQ ID NO: 34905 - DNA, 654 bp, Mycobacterium paratuberculosis; identical to SEQ ID NO: 589
  CDS (1)..(654)

SEQ ID NO: 34906 - protein, 217 aa, Mycobacterium paratuberculosis; identical to SEQ ID NO: 590

SEQ ID NO: 34907 - DNA, 1134 bp, Mycobacterium paratuberculosis; identical to SEQ ID NO: 591
  CDS (1)..(1134)

SEQ ID NO: 34908 - protein, 377 aa, Mycobacterium paratuberculosis; identical to SEQ ID NO: 592

SEQ ID NO: 34909 - DNA, 627 bp, Lactobacillus johnsonii; identical to SEQ ID NO: 593
  CDS (1)..(627)

SEQ ID NO: 34910 - protein, 208 aa, Lactobacillus johnsonii; identical to SEQ ID NO: 594

SEQ ID NO: 34911 - DNA, 807 bp, Ashbya gossypii; identical to SEQ ID NO: 595
  CDS (1)..(807)

SEQ ID NO: 34912 - protein, 268 aa, Ashbya gossypii; identical to SEQ ID NO: 596

SEQ ID NO: 34913 - DNA, 687 bp, Mycobacterium tuberculosis; identical to SEQ ID NO: 597
  CDS (1)..(687)

SEQ ID NO: 34914 - protein, 228 aa, Mycobacterium tuberculosis; identical to SEQ ID NO: 598

SEQ ID NO: 34915 - DNA, 618 bp, Photorhabdus luminescens; identical to SEQ ID NO: 599
  CDS (1)..(618)

SEQ ID NO: 34916 - protein, 205 aa, Photorhabdus luminescens; identical to SEQ ID NO: 600

SEQ ID NO: 34917 - DNA, 588 bp, Anopheles gambiae str; identical to SEQ ID NO: 601
  CDS (1)..(588)

SEQ ID NO: 34918 - protein, 195 aa, Anopheles gambiae str; identical to SEQ ID NO: 602

SEQ ID NO: 34919 - DNA, 3762 bp, Neurospora crassa; identical to SEQ ID NO: 603
  CDS (1)..(3762)

SEQ ID NO: 34920 - protein, 1253 aa, Neurospora crassa; identical to SEQ ID NO: 604

SEQ ID NO: 34921 - DNA, 567 bp, Synechococcus sp; identical to SEQ ID NO: 605
  CDS (1)..(567)

SEQ ID NO: 34922 - protein, 188 aa, Synechococcus sp; identical to SEQ ID NO: 606

SEQ ID NO: 34923 - DNA, 612 bp, Rhodopirellula baltica; identical to SEQ ID NO: 607
  CDS (1)..(612)

SEQ ID NO: 34924 - protein, 203 aa, Rhodopirellula baltica; identical to SEQ ID NO: 608

SEQ ID NO: 34925 - DNA, 1329 bp, Prochlorococcus marinus subsp; identical to SEQ ID NO: 609
  CDS (1)..(1329)

SEQ ID NO: 34926 - protein, 442 aa, Prochlorococcus marinus subsp; identical to SEQ ID NO: 610

SEQ ID NO: 34927 - DNA, 1332 bp, Prochlorococcus marinus; identical to SEQ ID NO: 611
  CDS (1)..(1332)

SEQ ID NO: 34928 - protein, 443 aa, Prochlorococcus marinus; identical to SEQ ID NO: 612

SEQ ID NO: 34929 - DNA, 591 bp, Prochlorococcus marinus; identical to SEQ ID NO: 613
  CDS (1)..(591)

SEQ ID NO: 34930 - protein, 196 aa, Prochlorococcus marinus; identical to SEQ ID NO: 614

SEQ ID NO: 34931 - DNA, 618 bp, Streptomyces avermitilis; identical to SEQ ID NO: 615
  CDS (1)..(618)

SEQ ID NO: 34932 - protein, 205 aa, Streptomyces avermitilis; identical to SEQ ID NO: 616

SEQ ID NO: 34933 - DNA, 600 bp, Streptomyces avermitilis; identical to SEQ ID NO: 617
  CDS (1)..(600)

SEQ ID NO: 34934 - protein, 199 aa, Streptomyces avermitilis; identical to SEQ ID NO: 618

SEQ ID NO: 34935 - DNA, 612 bp, Streptomyces avermitilis; identical to SEQ ID NO: 619
  CDS (1)..(612)

SEQ ID NO: 34936 - protein, 203 aa, Streptomyces avermitilis; identical to SEQ ID NO: 620

SEQ ID NO: 34937 - DNA, 645 bp, Enterococcus faecalis; identical to SEQ ID NO: 621
  CDS (1)..(645)

SEQ ID NO: 34938 - protein, 214 aa, Enterococcus faecalis; identical to SEQ ID NO: 622

SEQ ID NO: 34939 - DNA, 666 bp, Lactobacillus plantarum; identical to SEQ ID NO: 623
  CDS (1)..(666)

SEQ ID NO: 34940 - protein, 221 aa, Lactobacillus plantarum; identical to SEQ ID NO: 624

SEQ ID NO: 34941 - DNA, 642 bp, Clostridium tetani; identical to SEQ ID NO: 625
  CDS (1)..(642)

SEQ ID NO: 34942 - protein, 213 aa, Clostridium tetani; identical to SEQ ID NO: 626

SEQ ID NO: 34943 - DNA, 600 bp, Bradyrhizobium japonicum; identical to SEQ ID NO: 627
  CDS (1)..(600)

SEQ ID NO: 34944 - protein, 199 aa, Bradyrhizobium japonicum; identical to SEQ ID NO: 628

SEQ ID NO: 34945 - DNA, 1407 bp, Synechococcus elongatus; identical to SEQ ID NO: 629
  CDS (1)..(1407)

SEQ ID NO: 34946 - protein, 468 aa, Synechococcus elongatus; identical to SEQ ID NO: 630

SEQ ID NO: 34947 - DNA, 582 bp, Oceanobacillus iheyensis; identical to SEQ ID NO: 631
  CDS (1)..(582)

SEQ ID NO: 34948 - protein, 193 aa, Oceanobacillus iheyensis; identical to SEQ ID NO: 632

SEQ ID NO: 34949 - DNA, 648 bp, Bifidobacterium longum; identical to SEQ ID NO: 633
  CDS (1)..(648)

SEQ ID NO: 34950 - protein, 215 aa, Bifidobacterium longum; identical to SEQ ID NO: 634

SEQ ID NO: 34951 - DNA, 1005 bp, Arabidopsis thaliana; identical to SEQ ID NO: 635
  CDS (1)..(1005)

SEQ ID NO: 34952 - protein, 334 aa, Arabidopsis thaliana; identical to SEQ ID NO: 636

SEQ ID NO: 34953 - DNA, 645 bp, Xanthomonas campestris; identical to SEQ ID NO: 637
  CDS (1)..(645)

SEQ ID NO: 34954 - protein, 214 aa, Xanthomonas campestris; identical to SEQ ID NO: 638

SEQ ID NO: 34955 - DNA, 645 bp, Xanthomonas axonopodis; identical to SEQ ID NO: 639
  CDS (1)..(645)

SEQ ID NO: 34956 - protein, 214 aa, Xanthomonas axonopodis; identical to SEQ ID NO: 640

SEQ ID NO: 34957 - DNA, 621 bp, Thermoanaerobacter tengcongensis; identical to SEQ ID NO: 641
  CDS (1)..(621)

SEQ ID NO: 34958 - protein, 206 aa, Thermoanaerobacter tengcongensis; identical to SEQ ID NO: 642

SEQ ID NO: 34959 - DNA, 582 bp, Rhizobium loti; identical to SEQ ID NO: 643
  CDS (1)..(582)

SEQ ID NO: 34960 - protein, 193 aa, Rhizobium loti; identical to SEQ ID NO: 644

SEQ ID NO: 34961 - DNA, 651 bp, Pasteurella multocida; identical to SEQ ID NO: 645
  CDS (1)..(651)

SEQ ID NO: 34962 - protein, 216 aa, Pasteurella multocida; identical to SEQ ID NO: 646

SEQ ID NO: 34963 - DNA, 597 bp, Streptomyces coelicolor; identical to SEQ ID NO: 647
  CDS (1)..(597)

SEQ ID NO: 34964 - protein, 198 aa, Streptomyces coelicolor; identical to SEQ ID NO: 648

SEQ ID NO: 34965 - DNA, 600 bp, Streptomyces coelicolor; identical to SEQ ID NO: 649
  CDS (1)..(600)

SEQ ID NO: 34966 - protein, 199 aa, Streptomyces coelicolor; identical to SEQ ID NO: 650

SEQ ID NO: 34967 - DNA, 660 bp, Gloeobacter violaceus; identical to SEQ ID NO: 651
  CDS (1)..(660)

SEQ ID NO: 34968 - protein, 219 aa, Gloeobacter violaceus; identical to SEQ ID NO: 652

SEQ ID NO: 34969 - DNA, 621 bp, Bartonella henselae; identical to SEQ ID NO: 653
  CDS (1)..(621)

SEQ ID NO: 34970 - protein, 206 aa, Bartonella henselae; identical to SEQ ID NO: 654

SEQ ID NO: 34971 - DNA, 681 bp, Parachlamydia sp; identical to SEQ ID NO: 655
  CDS (1)..(681)

SEQ ID NO: 34972 - protein, 226 aa, Parachlamydia sp; identical to SEQ ID NO: 656

SEQ ID NO: 34973 - DNA, 636 bp, Rhizobium meliloti; identical to SEQ ID NO: 657
  CDS (1)..(636)

SEQ ID NO: 34974 - protein, 211 aa, Rhizobium meliloti; identical to SEQ ID NO: 658

SEQ ID NO: 34975 - DNA, 648 bp, Escherichia coli O6; identical to SEQ ID NO: 659
  CDS (1)..(648)

SEQ ID NO: 34976 - protein, 215 aa, Escherichia coli O6; identical to SEQ ID NO: 660

SEQ ID NO: 34977 - DNA, 648 bp, Photorhabdus luminescens; identical to SEQ ID NO: 661
  CDS (1)..(648)

SEQ ID NO: 34978 - protein, 215 aa, Photorhabdus luminescens; identical to SEQ ID NO: 662

SEQ ID NO: 34979 - DNA, 648 bp, Salmonella typhimurium; identical to SEQ ID NO: 663
  CDS (1)..(648)

SEQ ID NO: 34980 - protein, 215 aa, Salmonella typhimurium; identical to SEQ ID NO: 664

SEQ ID NO: 34981 - DNA, 22 bp, Artificial sequence
  (1)..(22): primer
atgccttcgctaacccccagat

SEQ ID NO: 34982 - DNA, 23 bp, Artificial sequence
  (1)..(23): primer
ttacacatcgccatgctgggatt

SEQ ID NO: 34983 - protein, 289 aa, Artificial sequence
  Variant (2)..(2): xaa in position 2 is any amino acid
  Variant (8)..(8): xaa in position 8 is any amino acid
  Variant (10)..(10): xaa in position 10 is any amino acid
  Variant (12)..(18): xaa in position 12 to 18 is any amino acid
  Variant (20)..(21): xaa in position 20 to 21 is any amino acid
  Variant (22)..(22): xaa in position 22 is any or no amino acid
  Variant (24)..(25): xaa in position 24 to 25 is any amino acid
  Variant (27)..(29): xaa in position 27 to 29 is any amino acid
  Variant (31)..(33): xaa in position 31 to 33 is any amino acid
  Variant (35)..(37): xaa in position 35 to 37 is any amino acid
  Variant (39)..(40): xaa in position 39 to 40 is any amino acid
  Variant (42)..(49): xaa in position 42 to 49 is any amino acid
  Variant (50)..(60): xaa in position 50 to 60 is any or no amino acid
  Variant (62)..(64): xaa in position 62 to 64 is any amino acid
  Variant (66)..(68): xaa in position 66 to 68 is any amino acid
  Variant (70)..(83): xaa in position 70 to 83 is any amino acid
  Variant (84)..(116): xaa in position 84 to 116 is any or no amino acid
  Variant (118)..(118): xaa in position 118 is any amino acid
  Variant (120)..(122): xaa in position 120 to 122 is any amino acid
  Variant (124)..(126): xaa in position 124 to 126 is any amino acid
  Variant (128)..(153): xaa in position 128 to 153 is any amino acid
  Variant (154)..(193): xaa in position 154 to 193 is any or no amino acid
  Variant (195)..(206): xaa in position 195 to 206 is any amino acid
  Variant (207)..(217): xaa in position 207 to 217 is any or no amino acid
  Variant (221)..(221): xaa in position 221 is any amino acid
  Variant (225)..(226): xaa in position 225 to 226 is any amino acid
  Variant (228)..(229): xaa in position 228 to 229 is any amino acid
  Variant (231)..(249): xaa in position 231 to 249 is any amino acid
  Variant (250)..(285): xaa in position 250 to 285 is any or no amino acid
  Variant (287)..(288): xaa in position 287 to 288 is any amino acid
LXLVRHGXTXWXXXXXXXGXXXDXXLXXXGXXXAXXXGXXLXXXXXXXXXXXXXXXXXXXSXXXRXXXTXXXXXXXXXXXXXXXXXXXXXXXXXXXXXXXXXXXXXXXXXXXXXXXLXEXXXGXXXGXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXVLVXAHGXXLXXLXXXXXXXXXXXXXXXXXXXXXXXXXXXXXXXXXXXXXXXXXXXXXXXXXXXXXXXIXXL

SEQ ID NO: 34984 - protein, 65 aa, Artificial sequence; identical to SEQ ID NO: 1307
  Variant (4)..(4): xaa in position 4 is Glu, Gln, Lys or Ala
  Variant (5)..(5): xaa in position 5 is Thr or Ser
  Variant (6)..(6): xaa in position 6 is any amino acid
  Variant (7)..(7): xaa in position 7 is Trp, Phe or Tyr
  Variant (8)..(8): xaa in position 8 is Asn, Ser or Ala
  Variant (9)..(13): xaa in position 9 to 13 is any amino acid
  Variant (14)..(14): xaa in position 14 is Gln or Thr
  Variant (15)..(15): xaa in position 15 is Gly or Ser
  Variant (16)..(16): xaa in position 16 is any amino acid
  Variant (17)..(18): xaa in position 17 to 18 is any or no amino acid
  Variant (19)..(19): xaa in position 19 is Asp, Asn or Glu
  Variant (20)..(21): xaa in position 20 to 21 is any amino acid
  Variant (23)..(25): xaa in position 23 to 25 is any amino acid
  Variant (26)..(26): xaa in position 26 is Gly or Ser
  Variant (27)..(29): xaa in position 27 to 29 is any amino acid
  Variant (30)..(30): xaa in position 30 is Ala, Met, Val or Ile
  Variant (31)..(36): xaa in position 31 to 36 is any amino acid
  Variant (37)..(37): xaa in position 37 is Leu, Ile, Val, Ala or Phe
  Variant (38)..(44): xaa in position 38 to 44 is any amino acid
  Variant (45)..(55): xaa in position 45 to 55 is any or no amino acid
  Variant (56)..(56): xaa in position 56 is Thr, Ser, Ala or Val
  Variant (58)..(60): xaa in position 58 to 60 is any amino acid
  Variant (62)..(62): xaa in position 62 is Ala, Thr or Pro
  Variant (63)..(64): xaa in position 63 to 64 is any amino acid

SEQ ID NO: 34985 - DNA, 1239 bp, Saccharomyces cerevisiae; identical to SEQ ID NO: 5653
  CDS (1)..(1239)

SEQ ID NO: 34986 - protein, 412 aa, Saccharomyces cerevisiae; identical to SEQ ID NO: 5654

SEQ ID NO: 34987 - DNA, 1719 bp, Rattus norvegicus (Norway rat); identical to SEQ ID NO: 5655
  CDS (30)..(1274)

SEQ ID NO: 34988 - protein, 414 aa, Rattus norvegicus (Norway rat); identical to SEQ ID NO: 5656

SEQ ID NO: 34989 - DNA, 1212 bp, Caulobacter crescentus; identical to SEQ ID NO: 5657
  CDS (1)..(1212)

SEQ ID NO: 34990 - protein, 403 aa, Caulobacter crescentus; identical to SEQ ID NO: 5658

SEQ ID NO: 34991 - DNA, 1551 bp, Arabidopsis thaliana (mouse-ear cress); identical to SEQ ID NO: 5659
  CDS (21)..(1271)

SEQ ID NO: 34992 - protein, 416 aa, Arabidopsis thaliana (mouse-ear cress); identical to SEQ ID NO: 5660

SEQ ID NO: 34993 - DNA, 1368 bp, Agrobacterium tumefaciens; identical to SEQ ID NO: 5661
  CDS (1)..(1368)

SEQ ID NO: 34994 - protein, 455 aa, Agrobacterium tumefaciens; identical to SEQ ID NO: 5662

SEQ ID NO: 34995 - DNA, 1230 bp, Mycobacterium tuberculosis; identical to SEQ ID NO: 5663
  CDS (1)..(1230)

SEQ ID NO: 34996 - protein, 409 aa, Mycobacterium tuberculosis; identical to SEQ ID NO: 5664

SEQ ID NO: 34997 - DNA, 1608 bp, Saccharomyces cerevisiae; identical to SEQ ID NO: 5665
  CDS (111)..(1397)

SEQ ID NO: 34998 - protein, 428 aa, Saccharomyces cerevisiae; identical to SEQ ID NO: 5666

SEQ ID NO: 34999 - DNA, 1242 bp, Sulfolobus solfataricus; identical to SEQ ID NO: 5667
  CDS (1)..(1242)

SEQ ID NO: 35000 - protein, 413 aa, Sulfolobus solfataricus; identical to SEQ ID NO: 5668

SEQ ID NO: 35001 - DNA, 1200 bp, Thermotoga maritima; identical to SEQ ID NO: 5669
  CDS (1)..(1200)

SEQ ID NO: 35002 - protein, 399 aa, Thermotoga maritima; identical to SEQ ID NO: 5670

SEQ ID NO: 35003 - DNA, 1221 bp, Sphingomonas yanoikuyae; identical to SEQ ID NO: 5671
  CDS (1)..(1221)

SEQ ID NO: 35004 - protein, 406 aa, Sphingomonas yanoikuyae; identical to SEQ ID NO: 5672

SEQ ID NO: 35005 - DNA, 1740 bp, Bos primigenius taurus (cattle); identical to SEQ ID NO: 5673
  CDS (67)..(1425)

SEQ ID NO: 35006 - protein, 452 aa, Bos primigenius taurus (cattle); identical to SEQ ID NO: 5674

SEQ ID NO: 35007 - DNA, 1569 bp, Solanum tuberosum (potato); identical to SEQ ID NO: 5675
  CDS (69)..(1319)

SEQ ID NO: 35008 - protein, 416 aa, Solanum tuberosum (potato); identical to SEQ ID NO: 5676

SEQ ID NO: 35009 - DNA, 1850 bp, Saccharomyces cerevisiae; identical to SEQ ID NO: 5677
  CDS (461)..(1723)

SEQ ID NO: 35010 - protein, 420 aa, Saccharomyces cerevisiae; identical to SEQ ID NO: 5678

SEQ ID NO: 35011 - DNA, 1584 bp, Nicotiana tabacum (common tobacco); identical to SEQ ID NO: 5679
  CDS (85)..(1332)

SEQ ID NO: 35012 - protein, 415 aa, Nicotiana tabacum (common tobacco); identical to SEQ ID NO: 5680

SEQ ID NO: 35013 - DNA, 1722 bp, Nicotiana tabacum (common tobacco); identical to SEQ ID NO: 5681
  CDS (76)..(1524)

SEQ ID NO: 35014 - protein, 482 aa, Nicotiana tabacum (common tobacco); identical to SEQ ID NO: 5682

SEQ ID NO: 35015 - DNA, 1308 bp, Caenorhabditis elegans; identical to SEQ ID NO: 5683
  CDS (1)..(1308)

SEQ ID NO: 35016 - protein, 435 aa, Caenorhabditis elegans; identical to SEQ ID NO: 5684

SEQ ID NO: 35017 - DNA, 1239 bp, Caenorhabditis elegans; identical to SEQ ID NO: 5685
  CDS (1)..(1239)

SEQ ID NO: 35018 - protein, 412 aa, Caenorhabditis elegans; identical to SEQ ID NO: 5686

SEQ ID NO: 35019 - DNA, 1257 bp, Schizosaccharomyces pombe; identical to SEQ ID NO: 5687
  CDS (1)..(1257)

SEQ ID NO: 35020 - protein, 418 aa, Schizosaccharomyces pombe; identical to SEQ ID NO: 5688

SEQ ID NO: 35021 - DNA, 1827 bp, Glycine max; identical to SEQ ID NO: 5689
  CDS (289)..(1539)

SEQ ID NO: 35022 - protein, 416 aa, Glycine max; identical to SEQ ID NO: 5690

SEQ ID NO: 35023 - DNA, 1645 bp, Eucalyptus globulus; identical to SEQ ID NO: 5691
  CDS (161)..(1411)

SEQ ID NO: 35024 - protein, 416 aa, Eucalyptus globulus; identical to SEQ ID NO: 5692

SEQ ID NO: 35025 - DNA, 1596 bp, Homo sapiens; identical to SEQ ID NO: 5693
  CDS (44)..(1303)

SEQ ID NO: 35026 - protein, 419 aa, Homo sapiens [sequence omitted]

SEQ ID NO: 35027 - DNA, 1233 bp, Debaryomyces hansenii; identical to SEQ ID NO: 5695
  CDS (1)..(1233)

SEQ ID NO: 35028 - protein, 410 aa, Debaryomyces hansenii; identical to SEQ ID NO: 5696

SEQ ID NO: 35029 - DNA, 1296 bp, Debaryomyces hansenii; identical to SEQ ID NO: 5697
  CDS (1)..(1296)

SEQ ID NO: 35030 - protein, 431 aa, Debaryomyces hansenii; identical to SEQ ID NO: 5698

SEQ ID NO: 35031 - DNA, 1326 bp, Yarrowia lipolytica; identical to SEQ ID NO: 5699
  CDS (1)..(1326)

SEQ ID NO: 35032 - protein, 441 aa, Yarrowia lipolytica; identical to SEQ ID NO: 5700

SEQ ID NO: 35033 - DNA, 1248 bp, Kluyveromyces lactis; identical to SEQ ID NO: 5701
  CDS (1)..(1248)

SEQ ID NO: 35034 - protein, 415 aa, Kluyveromyces lactis; identical to SEQ ID NO: 5702

SEQ ID NO: 35035 - DNA, 1290 bp, Kluyveromyces lactis; identical to SEQ ID NO: 5703
  CDS (1)..(1290)

SEQ ID NO: 35036 - protein, 429 aa, Kluyveromyces lactis; identical to SEQ ID NO: 5704

SEQ ID NO: 35037 - DNA, 1257 bp, Candida glabrata; identical to SEQ ID NO: 5705
  CDS (1)..(1257)

SEQ ID NO: 35038 - protein, 418 aa, Candida glabrata; identical to SEQ ID NO: 5706

SEQ ID NO: 35039 - DNA, 1272 bp, Candida glabrata; identical to SEQ ID NO: 5707
  CDS (1)..(1272)

SEQ ID NO: 35040 - protein, 423 aa, Candida glabrata; identical to SEQ ID NO: 5708

SEQ ID NO: 35041 - DNA, 1236 bp, Candida glabrata; identical to SEQ ID NO: 5709
  CDS (1)..(1236)

SEQ ID NO: 35042 - protein, 411 aa, Candida glabrata; identical to SEQ ID NO: 5710

SEQ ID NO: 35043 - DNA, 1215 bp, Bartonella quintana; identical to SEQ ID NO: 5711
  CDS (1)..(1215)

SEQ ID NO: 35044 - protein, 404 aa, Bartonella quintana; identical to SEQ ID NO: 5712

SEQ ID NO: 35045 - DNA, 1215 bp, Bartonella henselae; identical to SEQ ID NO: 5713
  CDS (1)..(1215)

SEQ ID NO: 35046 - protein, 404 aa, Bartonella henselae; identical to SEQ ID NO: 5714

SEQ ID NO: 35047 - DNA, 1212 bp, Rhizobium leguminosarum; identical to SEQ ID NO: 5715
  CDS (1)..(1212)

SEQ ID NO: 35048 - protein, 403 aa, Rhizobium leguminosarum; identical to SEQ ID NO: 5716

SEQ ID NO: 35049 - DNA, 1230 bp, Bdellovibrio bacteriovorus; identical to SEQ ID NO: 5717
  CDS (1)..(1230)

SEQ ID NO: 35050 - protein, 409 aa, Bdellovibrio bacteriovorus; identical to SEQ ID NO: 5718

SEQ ID NO: 35051 - DNA, 1227 bp, Rhodopseudomonas palustris; identical to SEQ ID NO: 5719
  CDS (1)..(1227)

SEQ ID NO: 35052 - protein, 408 aa, Rhodopseudomonas palustris; identical to SEQ ID NO: 5720

SEQ ID NO: 35053 - DNA, 1564 bp, Pisum sativum; identical to SEQ ID NO: 5721
  CDS (79)..(1317)

SEQ ID NO: 35054 - protein, 412 aa, Pisum sativum; identical to SEQ ID NO: 5722

SEQ ID NO: 35055 - DNA, 2254 bp, Ovis aries; identical to SEQ ID NO: 5723
  CDS (167)..(1411)

SEQ ID NO: 35056 - protein, 414 aa, Ovis aries; identical to SEQ ID NO: 5724

SEQ ID NO: 35057 - DNA, 1197 bp, Leptospira interrogans; identical to SEQ ID NO: 5725
  CDS (1)..(1197)

SEQ ID NO: 35058 - protein, 398 aa, Leptospira interrogans; identical to SEQ ID NO: 5726

SEQ ID NO: 35059 - DNA, 1239 bp, Mycobacterium paratuberculosis; identical to SEQ ID NO: 5727
  CDS (1)..(1239)

SEQ ID NO: 35060 - protein, 412 aa, Mycobacterium paratuberculosis; identical to SEQ ID NO: 5728

SEQ ID NO: 35061 - DNA, 1278 bp, Ashbya gossypii; identical to SEQ ID NO: 5729
  CDS (1)..(1278)

SEQ ID NO: 35062 - protein, 425 aa, Ashbya gossypii; identical to SEQ ID NO: 5730

SEQ ID NO: 35063 - DNA, 1248 bp, Ashbya gossypii; identical to SEQ ID NO: 5731
  CDS (1)..(1248)

SEQ ID NO: 35064 - protein, 415 aa, Ashbya gossypii; identical to SEQ ID NO: 5732

SEQ ID NO: 35065 - DNA, 1287 bp, Dictyostelium discoideum; identical to SEQ ID NO: 5733
  CDS (1)..(1287)

SEQ ID NO: 35066 - protein, 428 aa, Dictyostelium discoideum; identical to SEQ ID NO: 5734

SEQ ID NO: 35067 - DNA, 1594 bp, Oryza sativa; identical to SEQ ID NO: 5735
  CDS (66)..(1304)

SEQ ID NO: 35068 - protein, 412 aa, Oryza sativa; identical to SEQ ID NO: 5736

SEQ ID NO: 35069 - DNA, 1230 bp, Gloeobacter violaceus; identical to SEQ ID NO: 5737
  CDS (1)..(1230)

SEQ ID NO: 35070 - protein, 409 aa, Gloeobacter violaceus; identical to SEQ ID NO: 5738

SEQ ID NO: 35071 - DNA, 1410 bp, Plasmodium yoelii yoelii; identical to SEQ ID NO: 5739
  CDS (1)..(1410)

SEQ ID NO: 35072 - protein, 469 aa, Plasmodium yoelii yoelii; identical to SEQ ID NO: 5740

SEQ ID NO: 35073 - DNA, 1389 bp, Neurospora crassa; identical to SEQ ID NO: 5741
  CDS (1)..(1389)

SEQ ID NO: 35074 - protein, 462 aa, Neurospora crassa; identical to SEQ ID NO: 5742

SEQ ID NO: 35075 - DNA, 1765 bp, Oryza sativa; identical to SEQ ID NO: 5743
  CDS (83)..(1489)

SEQ ID NO: 35076 - protein, 468 aa, Oryza sativa; identical to SEQ ID NO: 5744

SEQ ID NO: 35077 - DNA, 1794 bp, Lupinus albus; identical to SEQ ID NO: 5745
  CDS (58)..(1515)

SEQ ID NO: 35078 - protein, 485 aa, Lupinus albus; identical to SEQ ID NO: 5746

SEQ ID NO: 35079 - DNA, 1583 bp, Lupinus albus; identical to SEQ ID NO: 5747
  CDS (43)..(1281)

SEQ ID NO: 35080 - protein, 412 aa, Lupinus albus; identical to SEQ ID NO: 5748

SEQ ID NO: 35081 - DNA, 1627 bp, Lupinus albus; identical to SEQ ID NO: 5749
  CDS (79)..(1317)

SEQ ID NO: 35082 - protein, 412 aa, Lupinus albus; identical to SEQ ID NO: 5750

SEQ ID NO: 35083 - DNA, 2305 bp, Homo sapiens; identical to SEQ ID NO: 5751
  CDS (196)..(1440)

SEQ ID NO: 35084 - protein, 414 aa, Homo sapiens [sequence omitted]

SEQ ID NO: 35085 - DNA, 1215 bp, Bradyrhizobium japonicum; identical to SEQ ID NO: 5753
  CDS (1)..(1215)

SEQ ID NO: 35086 - protein, 404 aa, Bradyrhizobium japonicum; identical to SEQ ID NO: 5754

SEQ ID NO: 35087 - DNA, 1215 bp, Brucella suis; identical to SEQ ID NO: 5755
  CDS (1)..(1215)

SEQ ID NO: 35088 - protein, 404 aa, Brucella suis; identical to SEQ ID NO: 5756

SEQ ID NO: 35089 - DNA, 1221 bp, Bifidobacterium longum; identical to SEQ ID NO: 5757
  CDS (1)..(1221)

SEQ ID NO: 35090 - protein, 406 aa, Bifidobacterium longum; identical to SEQ ID NO: 5758

SEQ ID NO: 35091 - DNA, 1407 bp, Plasmodium falciparum; identical to SEQ ID NO: 5759
  CDS (1)..(1407)

SEQ ID NO: 35092 - protein, 468 aa, Plasmodium falciparum; identical to SEQ ID NO: 5760

SEQ ID NO: 35093 - DNA, 1514 bp, Arabidopsis thaliana; identical to SEQ ID NO: 5761
  CDS (1)..(1458)

SEQ ID NO: 35094 - protein, 485 aa, Arabidopsis thaliana; identical to SEQ ID NO: 5762

SEQ ID NO: 35095 - DNA, 1212 bp, Thermoanaerobacter tengcongensis; identical to SEQ ID NO: 5763
  CDS (1)..(1212)

SEQ ID NO: 35096 - protein, 403 aa, Thermoanaerobacter tengcongensis; identical to SEQ ID NO: 5764

SEQ ID NO: 35097 - DNA, 1551 bp, Cucumis sativus; identical to SEQ ID NO: 5765
  CDS (62)..(1294)

SEQ ID NO: 35098 - protein, 410 aa, Cucumis sativus; identical to SEQ ID NO: 5766

SEQ ID NO: 35099 - DNA, 1610 bp, Arabidopsis thaliana; identical to SEQ ID NO: 5767
  CDS (165)..(1397)

SEQ ID NO: 35100 - protein, 410 aa, Arabidopsis thaliana; identical to SEQ ID NO: 5768

SEQ ID NO: 35101 - DNA, 1215 bp, Rhizobium meliloti; identical to SEQ ID NO: 5769
  CDS (1)..(1215)

SEQ ID NO: 35102 - protein, 404 aa, Rhizobium meliloti; identical to SEQ ID NO: 5770

SEQ ID NO: 35103 - DNA, 1561 bp, Prunus persica; identical to SEQ ID NO: 5771
  CDS (1)..(1245)

SEQ ID NO: 35104 - protein, 414 aa, Prunus persica; identical to SEQ ID NO: 5772

SEQ ID NO: 35105 - DNA, 1242 bp, Emericella nidulans; identical to SEQ ID NO: 5773
  CDS (1)..(1242)

SEQ ID NO: 35106 - protein, 413 aa, Emericella nidulans; identical to SEQ ID NO: 5774

SEQ ID NO: 35107 - DNA, 1212 bp, Rhizobium loti; identical to SEQ ID NO: 5775
  CDS (1)..(1212)

SEQ ID NO: 35108 - protein, 403 aa, Rhizobium loti; identical to SEQ ID NO: 5776

SEQ ID NO: 35109 - DNA, 1679 bp, Mus musculus; identical to SEQ ID NO: 5777
  CDS (46)..(1404)

SEQ ID NO: 35110 - protein, 452 aa, Mus musculus; identical to SEQ ID NO: 5778

SEQ ID NO: 35111 - DNA, 1227 bp, Oryza sativa; identical to SEQ ID NO: 5779
  CDS (1)..(1227)

SEQ ID NO: 35112 - protein, 408 aa, Oryza sativa; identical to SEQ ID NO: 5780

SEQ ID NO: 35113 - DNA, 1554 bp, Solanum tuberosum; identical to SEQ ID NO: 5781
  CDS (61)..(1473)

SEQ ID NO: 35114 - protein, 470 aa, Solanum tuberosum; identical to SEQ ID NO: 5782

SEQ ID NO: 35115 - DNA, 1708 bp, Citrus limon; identical to SEQ ID NO: 5783
  CDS (155)..(1399): n means a or g or c or t/u, s means g or c

SEQ ID NO: 35116 - protein, 414 aa, Citrus limon; identical to SEQ ID NO: 5784

SEQ ID NO: 35117 - DNA, 1782 bp, Drosophila melanogaster; identical to SEQ ID NO: 5785
  CDS (430)..(1782)

SEQ ID NO: 35118 - protein, 450 aa, Drosophila melanogaster; identical to SEQ ID NO: 5786

SEQ ID NO: 35119 - DNA, 1503 bp, Oryza sativa; identical to SEQ ID NO: 5787
  CDS (84)..(1322)

SEQ ID NO: 35120 - protein, 412 aa, Oryza sativa; identical to SEQ ID NO: 5788

SEQ ID NO: 35121 - DNA, 1859 bp, Oryza sativa; identical to SEQ ID NO: 5789
  CDS (201)..(1445)

SEQ ID NO: 35122 - protein, 414 aa, Oryza sativa; identical to SEQ ID NO: 5790

SEQ ID NO: 35123 - DNA, 1488 bp, Daucus carota; identical to SEQ ID NO: 5791
  CDS (91)..(1341)

SEQ ID NO: 35124 - protein, 416 aa, Daucus carota; identical to SEQ ID NO: 5792

SEQ ID NO: 35125 - DNA, 1512 bp, Daucus carota; identical to SEQ ID NO: 5793
  CDS (93)..(1331)

SEQ ID NO: 35126 - protein, 412 aa, Daucus carota; identical to SEQ ID NO: 5794

SEQ ID NO: 35127 - DNA, 1600 bp, Candida tropicalis; identical to SEQ ID NO: 5795
  CDS (201)..(1493)

SEQ ID NO: 35128 - protein, 430 aa, Candida tropicalis; identical to SEQ ID NO: 5796

SEQ ID NO: 35129 - DNA, 1560 bp, Glycine max; identical to SEQ ID NO: 5797
  CDS (87)..(1328)

SEQ ID NO: 35130 - protein, 413 aa, Glycine max; identical to SEQ ID NO: 5798

SEQ ID NO: 35131 - DNA, 1985 bp, Aspergillus niger; identical to SEQ ID NO: 5799
  CDS (288)..(1784)

SEQ ID NO: 35132 - protein, 498 aa, Aspergillus niger; identical to SEQ ID NO: 5800

SEQ ID NO: 35133 - DNA, 1727 bp, Homo sapiens; identical to SEQ ID NO: 5801
  CDS (67)..(1425)

SEQ ID NO: 35134 - protein, 452 aa, Homo sapiens; identical to SEQ ID NO: 5802

SEQ ID NO: 35135 - DNA, 1863 bp, Mus musculus; identical to SEQ ID NO: 5803
  CDS (24)..(1595)

SEQ ID NO: 35136 - protein, 523 aa, Mus musculus; identical to SEQ ID NO: 5804

SEQ ID NO: 35137 - DNA, 1740 bp, Brachydanio rerio; identical to SEQ ID NO: 5805
  CDS (80)..(1429)

SEQ ID NO: 35138 - protein, 449 aa, Brachydanio rerio; identical to SEQ ID NO: 5806

SEQ ID NO: 35139 - DNA, 25 bp, Artificial sequence
  (1)..(25): primer
atgacaaagattaaggtagctaacc

SEQ ID NO: 35140 - DNA, 23 bp, Artificial sequence
  (1)..(23): primer
ttacaatgcagctgcctcgaact

SEQ ID NO: 35141 - protein, 367 aa, Artificial sequence
  Variant (4)..(8): xaa in position 4 to 8 is any amino acid
  Variant (10)..(29): xaa in position 10 to 29 is any amino acid
  Variant (31)..(34): xaa in position 31 to 34 is any amino acid
  Variant (36)..(37): xaa in position 36 to 37 is any amino acid
  Variant (39)..(39): xaa in position 39 is any amino acid
  Variant (41)..(42): xaa in position 41 to 42 is any amino acid
  Variant (44)..(57): xaa in position 44 to 57 is any amino acid
  Variant (65)..(67): xaa in position 65 to 67 is any amino acid
  Variant (69)..(70): xaa in position 69 to 70 is any amino acid
  Variant (72)..(73): xaa in position 72 to 73 is any amino acid
  Variant (75)..(77): xaa in position 75 to 77 is any amino acid
  Variant (79)..(79): xaa in position 79 is any amino acid
  Variant (83)..(83): xaa in position 83 is any amino acid
  Variant (85)..(85): xaa in position 85 is any amino acid
  Variant (87)..(90): xaa in position 87 to 90 is any amino acid
  Variant (92)..(93): xaa in position 92 to 93 is any amino acid
  Variant (96)..(109): xaa in position 96 to 109 is any amino acid
  Variant (111)..(113): xaa in position 111 to 113 is any amino acid
  Variant (115)..(117): xaa in position 115 to 117 is any amino acid
  Variant (121)..(122): xaa in position 121 to 122 is any amino acid
  Variant (124)..(124): xaa in position 124 is any amino acid
  Variant (126)..(173): xaa in position 126 to 173 is any amino acid
  Variant (175)..(177): xaa in position 175 to 177 is any amino acid
  Variant (179)..(181): xaa in position 179 to 181 is any amino acid
  Variant (184)..(200): xaa in position 184 to 200 is any amino acid
  Variant (203)..(203): xaa in position 203 is any amino acid
  Variant (206)..(206): xaa in position 206 is any amino acid
  Variant (208)..(208): xaa in position 208 is any amino acid
  Variant (210)..(212): xaa in position 210 to 212 is any amino acid
  Variant (214)..(216): xaa in position 214 to 216 is any amino acid
  Variant (218)..(235): xaa in position 218 to 235 is any amino acid
  Variant (237)..(239): xaa in position 237 to 239 is any amino acid
  Variant (244)..(245): xaa in position 244 to 245 is any amino acid
  Variant (247)..(252): xaa in position 247 to 252 is any amino acid
  Variant (254)..(257): xaa in position 254 to 257 is any amino acid
  Variant (259)..(261): xaa in position 259 to 261 is any amino acid
  Variant (263)..(263): xaa in position 263 is any amino acid
  Variant (265)..(267): xaa in position 265 to 267 is any amino acid
  Variant (270)..(271): xaa in position 270 to 271 is any amino acid
  Variant (273)..(275): xaa in position 273 to 275 is any amino acid
  Variant (279)..(280): xaa in position 279 to 280 is any amino acid
  Variant (282)..(282): xaa in position 282 is any amino acid
  Variant (284)..(284): xaa in position 284 is any amino acid
  Variant (286)..(289): xaa in position 286 to 289 is any amino acid
  Variant (291)..(295): xaa in position 291 to 295 is any amino acid
  Variant (298)..(298): xaa in position 298 is any amino acid
  Variant (303)..(304): xaa in position 303 to 304 is any amino acid
  Variant (306)..(314): xaa in position 306 to 314 is any amino acid
  Variant (318)..(320): xaa in position 318 to 320 is any amino acid
  Variant (322)..(322): xaa in position 322 is any amino acid
  Variant (327)..(332): xaa in position 327 to 332 is any amino acid
  Variant (334)..(336): xaa in position 334 to 336 is any amino acid
  Variant (338)..(349): xaa in position 338 to 349 is any amino acid
  Variant (351)..(366): xaa in position 351 to 366 is any amino acid
GDEXXXXXWXXXXXXXXXXXXXXXXXXXXLXXXXRXXTXDXXTXXXXXXXXXXXXXXKCATITPXXXRXXEXXLXXXWXSPNXTXRXXXXGXXFRXXXXXXXXXXXXXXWXXXIXXXRHAXXDXYXXXXXXXXXXXXXXXXXXXXXXXXXXXXXXXXXXXXXXXXXXXXXXXXNXXXSXXXFAXXXXXXXXXXXXXXXXXTKXTIXKXYXXXFXXXFXXXXXXXXXXXXXXXXXXYXXXLIDDXXAXXXXXXGXXXXAXXXYXGXXXSDXXAXXXGSLXXMXSXLXXXXGXXXXXEAXHGTVXXHXXXXXXXXXTSTXXXAXIFAWXXXXXXRXXXDXXXXXXXXXXXXEXXXXXXXXXXXXXXXXL

SEQ ID NO: 35142 - protein, 410 aa, Artificial sequence
  Variant (3)..(3): xaa in position 3 is any amino acid
  Variant (5)..(6): xaa in position 5 to 6 is any amino acid
  Variant (8)..(8): xaa in position 8 is any amino acid
  Variant (11)..(11): xaa in position 11 is any amino acid
  Variant (19)..(19): xaa in position 19 is any amino acid
  Variant (22)..(23): xaa in position 22 to 23 is any amino acid
  Variant (26)..(26): xaa in position 26 is any amino acid
  Variant (30)..(30): xaa in position 30 is any amino acid
  Variant (32)..(38): xaa in position 32 to 38 is any amino acid
  Variant (40)..(40): xaa in position 40 is any amino acid
  Variant (43)..(46): xaa in position 43 to 46 is any amino acid
  Variant (49)..(49): xaa in position 49 is any amino acid
  Variant (51)..(51): xaa in position 51 is any amino acid
  Variant (53)..(53): xaa in position 53 is any amino acid
  Variant (56)..(58): xaa in position 56 to 58 is any amino acid
  Variant (60)..(60): xaa in position 60 is any amino acid
  Variant (62)..(63): xaa in position 62 to 63 is any amino acid
  Variant (65)..(66): xaa in position 65 to 66 is any amino acid
  Variant (68)..(69): xaa in position 68 to 69 is any amino acid
  Variant (79)..(79): xaa in position 79 is any amino acid
  Variant (82)..(82): xaa in position 82 is any amino acid
  Variant (85)..(85): xaa in position 85 is any amino acid
  Variant (88)..(88): xaa in position 88 is any amino acid
  Variant (91)..(91): xaa in position 91 is any amino acid
  Variant (102)..(102): xaa in position 102 is any amino acid
  Variant (111)..(115): xaa in position 111 to 115 is any amino acid
  Variant (121)..(121): xaa in position 121 is any amino acid
  Variant (123)..(123): xaa in position 123 is any amino acid
  Variant (127)..(127): xaa in position 127 is any amino acid
  Variant (133)..(133): xaa in position 133 is any amino acid
  Variant (138)..(138): xaa in position 138 is any amino acid
  Variant (142)..(147): xaa in position 142 to 147 is any amino acid
  Variant (149)..(168): xaa in position 149 to 168 is any amino acid
  Variant (170)..(178): xaa in position 170 to 178 is any amino acid
  Variant (181)..(183): xaa in position 181 to 183 is any amino acid
  Variant (187)..(187): xaa in position 187 is any amino acid
  Variant (189)..(189): xaa in position 189 is any amino acid
  Variant (192)..(193): xaa in position 192 to 193 is any amino acid
  Variant (196)..(207): xaa in position 196 to 207 is any amino acid
  Variant (209)..(209): xaa in position 209 is any amino acid
  Variant (211)..(211): xaa in position 211 is any amino acid
  Variant (220)..(220): xaa in position 220 is any amino acid
  Variant (230)..(237): xaa in position 230 to 237 is any amino acid
  Variant (239)..(240): xaa in position 239 to 240 is any amino acid
  Variant (242)..(247): xaa in position 242 to 247 is any amino acid
  Variant (259)..(261): xaa in position 259 to 261 is any amino acid
  Variant (263)..(264): xaa in position 263 to 264 is any amino acid
  Variant (267)..(269): xaa in position 267 to 269 is any amino acid
  Variant (271)..(271): xaa in position 271 is any amino acid
  Variant (282)..(283): xaa in position 282 to 283 is any amino acid
  Variant (287)..(287): xaa in position 287 is any amino acid
  Variant (298)..(299): xaa in position 298 to 299 is any amino acid
  Variant (304)..(305): xaa in position 304 to 305 is any amino acid
  Variant (307)..(307): xaa in position 307 is any amino acid
  Variant (318)..(318): xaa in position 318 is any amino acid
  Variant (320)..(321): xaa in position 320 to 321 is any amino acid
  Variant (323)..(323): xaa in position 323 is any amino acid
  Variant (325)..(326): xaa in position 325 to 326 is any amino acid
  Variant (331)..(331): xaa in position 331 is any amino acid
  Variant (339)..(339): xaa in position 339 is any amino acid
  Variant (343)..(344): xaa in position 343 to 344 is any amino acid
  Variant (346)..(347): xaa in position 346 to 347 is any amino acid
  Variant (350)..(356): xaa in position 350 to 356 is any amino acid
  Variant (358)..(360): xaa in position 358 to 360 is any amino acid
  Variant (363)..(367): xaa in position 363 to 367 is any amino acid
  Variant (370)..(374): xaa in position 370 to 374 is any amino acid
  Variant (381)..(398): xaa in position 381 to 398 is any amino acid
  Variant (400)..(401): xaa in position 400 to 401 is any amino acid
  Variant (403)..(409): xaa in position 403 to 409 is any amino acid
KIXVXXPXVEXDGDEMTRXIWXXIKXKLIXPXXXXXXXYXDLXXXXRDXTXDXVTXXXAXAXXKXXVXXKCATITPDEXRVXEFXLKXMWXSPNGTIRNILXGTVFREPIXXXXXPRLVPXWXKPIXIGRHAXGDQYXATDXXXXXXGXXXXXXXXXXXXXXXXXXXXVXXXXXXXXXGVXXXMYNXDXSIXXFAXXXXXXXXXXXXPXYXSTKNTILKXYDGRFKDIFXXXXXXXXKXXFXXXXXXYEHRLIDDMVAXXXKXXGGXXXAXKNYDGDVQSDXXAQGXGSLGLMTSVLXXPDGKXXEXEAAHGTVTRHXRXXQXGXXTSTNXIASIFAWXRGLXXRXXLDXXXXXXXFXXXLEXXXXXTVXXXXXMTKDLAXXXXXXXXXXXXXXXXXXTXXFXXXXXXXL

SEQ ID NO: 35143 - protein, 137 aa, Artificial sequence; identical to SEQ ID NO: 6194
  Variant (1)..(1): xaa in position 1 is Lys, Arg or Gln
  Variant (2)..(2): xaa in position 2 is Ile, Lys, Val or Leu
  Variant (3)..(6): xaa in position 3 to 6 is any amino acid
  Variant (7)..(7): xaa in position 7 is Pro, Ser or Thr
  Variant (8)..(8): xaa in position 8 is Ile, Val or Leu
  Variant (9)..(9): xaa in position 9 is Val or Ala
  Variant (10)..(10): xaa in position 10 is Glu or Asp
  Variant (11)..(11): xaa in position 11 is Met, Leu, Ile or Val
  Variant (12)..(12): xaa in position 12 is Asp, Gln or Leu
  Variant (16)..(16): xaa in position 16 is Met or Gln
  Variant (17)..(17): xaa in position 17 is Thr or Ala
  Variant (18)..(18): xaa in position 18 is Arg or Lys
  Variant (19)..(19): xaa in position 19 is Ile or Val
  Variant (20)..(20): xaa in position 20 is Ile, Phe or Met
  Variant (22)..(23): xaa in position 22 to 23 is any amino acid
  Variant (24)..(24): xaa in position 24 is Ile or Val
  Variant (25)..(25): xaa in position 25 is Lys, Arg or Gln
  Variant (26)..(27): xaa in position 26 to 27 is any amino acid
  Variant (28)..(28): xaa in position 28 is Leu or Phe
  Variant (29)..(29): xaa in position 29 is Ile, Val or Leu
  Variant (30)..(30): xaa in position 30 is any amino acid
  Variant (31)..(31): xaa in position 31 is Pro or Thr
  Variant (32)..(32): xaa in position 32 is Tyr, Phe, His or Asn
  Variant (33)..(33): xaa in position 33 is Leu, Val or Met
  Variant (34)..(34): xaa in position 34 is Asp, Glu or Asn
  Variant (35)..(35): xaa in position 35 is Leu, Val, Ile or Met
  Variant (36)..(38): xaa in position 36 to 38 is any amino acid
  Variant (39)..(39): xaa in position 39 is Tyr, Phe, Ser or Thr
  Variant (40)..(40): xaa in position 40 is Tyr or Phe
  Variant (41)..(41): xaa in position 41 is Asp or Ser
  Variant (43)..(43): xaa in position 43 is Gly or Ser
  Variant (44)..(44): xaa in position 44 is Ile, Leu, Val or Met
  Variant (45)..(46): xaa in position 45 to 46 is any amino acid
  Variant (48)..(48): xaa in position 48 is Asp or Asn
  Variant (49)..(49): xaa in position 49 is any amino acid
  Variant (51)..(51): xaa in position 51 is any amino acid
  Variant (53)..(53): xaa in position 53 is Gln, Lys or Arg
  Variant (54)..(54): xaa in position 54 is Val or Ile
  Variant (56)..(56): xaa in position 56 is any amino acid
  Variant (57)..(57): xaa in position 57 is Asp or Glu
  Variant (58)..(58): xaa in position 58 is Ser, Ala or Thr
  Variant (59)..(59): xaa in position 59 is Ala or Ser
  Variant (60)..(60): xaa in position 60 is any amino acid
  Variant (61)..(61): xaa in position 61 is Ala or Glu
  Variant (62)..(62): xaa in position 62 is any amino acid
  Variant (63)..(63): xaa in position 63 is Lys, Leu, Gln or Met
  Variant (64)..(64): xaa in position 64 is Lys, Glu, Gln or Arg
  Variant (65)..(65): xaa in position 65 is Tyr, His or Val
  Variant (66)..(66): xaa in position 66 is any amino acid
  Variant (67)..(67): xaa in position 67 is Val, Met or Ile
  Variant (68)..(68): xaa in position 68 is Gly or Ala
  Variant (69)..(69): xaa in position 69 is Val or Ile
  Variant (77)..(77): xaa in position 77 is Asp or Asn
  Variant (78)..(78): xaa in position 78 is Glu, Ala, Ser or Gln
  Variant (79)..(79): xaa in position 79 is any amino acid
  Variant (81)..(81): xaa in position 81 is Val, Met, Ile or Leu
  Variant (82)..(82): xaa in position 82 is any amino acid
  Variant (84)..(84): xaa in position 84 is Phe or Tyr
  Variant (85)..(85): xaa in position 85 is any amino acid
  Variant (88)..(88): xaa in position 88 is any amino acid
  Variant (91)..(91): xaa in position 91 is Lys, Arg or Leu
  Variant (95)..(95): xaa in position 95 is Gly or Ala
  Variant (97)..(97): xaa in position 97 is Ile or Leu
  Variant (99)..(99): xaa in position 99 is Asn, Ser or Ala
  Variant (100)..(100): xaa in position 100 is Ile, Ala or Tyr
  Variant (101)..(101): xaa in position 101 is Leu or Ile
  Variant (102)..(102): xaa in position 102 is Gly, Asn or Asp
  Variant (104)..(104): xaa in position 104 is Thr or Val
  Variant (105)..(105): xaa in position 105 is Val or Ile
  Variant (108)..(108): xaa in position 108 is any amino acid
  Variant (109)..(109): xaa in position 109 is Pro, Ala or Ser
  Variant (111)..(111): xaa in position 111 is Ile, Val, Leu or Met
  Variant (112)..(112): xaa in position 112 is Cys, Ile, Val or Met
  Variant (113)..(114): xaa in position 113 to 114 is any amino acid
  Variant (115)..(115): xaa in position 115 is Ile, Val or Leu
  Variant (117)..(117): xaa in position 117 is Arg, Lys or Pro
  Variant (118)..(118): xaa in position 118 is Leu, Ile, Ala or Tyr
  Variant (119)..(119): xaa in position 119 is Val, Ile or Leu
  Variant (120)..(121): xaa in position 120 to 121 is any amino acid
  Variant (123)..(124): xaa in position 123 to 124 is any amino acid
  Variant (125)..(125): xaa in position 125 is Pro or Ala
  Variant (127)..(127): xaa in position 127 is Ile, Cys, Val or Thr
  Variant (128)..(128): xaa in position 128 is Ile or Val
  Variant (129)..(129): xaa in position 129 is Gly or Ala
  Variant (133)..(133): xaa in position 133 is Phe, His or Tyr
  Variant (134)..(134): xaa in position 134 is Gly or Ala
  Variant (136)..(136): xaa in position 136 is Gln, Ile or Leu

SEQ ID NO: 35144 - protein, 166 aa, Artificial sequence; identical to SEQ ID NO: 6195
  Variant (1)..(1): xaa in position 1 is Met or Gln
  Variant (2)..(2): xaa in position 2 is Tyr, His or Phe
  Variant (4)..(6): xaa in position 4 to 6 is any amino acid
  Variant (8)..(8): xaa in position 8 is Ile or Val
  Variant (9)..(10): xaa in position 9 to 10 is any amino acid
  Variant (13)..(13): xaa in position 13 is any amino acid
  Variant (14)..(14): xaa in position 14 is Ala or Ser
  Variant (15)..(15): xaa in position 15 is Ser or Cys
  Variant (16)..(16): xaa in position 16 is Phe, Met, Leu or Ile
  Variant (17)..(18): xaa in position 17 to 18 is any amino acid
  Variant (19)..(19): xaa in position 19 is Ala, Gly or Ser
  Variant (20)..(20): xaa in position 20 is Leu, Tyr, Ile or Phe
  Variant (21)..(25): xaa in position 21 to 25 is any amino acid
  Variant (26)..(26): xaa in position 26 is Leu, Val or Ile
  Variant (27)..(27): xaa in position 27 is Tyr, Phe or Trp
  Variant (28)..(28): xaa in position 28 is Leu, Met, Phe or Ser
  Variant (29)..(29): xaa in position 29 is Ser, Thr or Ala
  Variant (32)..(32): xaa in position 32 is Asn, Asp or Ser
  Variant (35)..(35): xaa in position 35 is Leu, Ser or Met
  Variant (37)..(37): xaa in position 37 is any amino acid
  Variant (39)..(39): xaa in position 39 is Asp or His
  Variant (40)..(40): xaa in position 40 is Gly, Ala or His
  Variant (41)..(41): xaa in position 41 is any amino acid
  Variant (43)..(43): xaa in position 43 is Lys or Arg
  Variant (44)..(44): xaa in position 44 is Asp or Ala
  Variant (45)..(45): xaa in position 45 is Ile, Val, Leu or Thr
  Variant (47)..(49): xaa in position 47 to 49 is any amino acid
  Variant (50)..(50): xaa in position 50 is Tyr, Phe, Ala or Val
  Variant (51)..(56): xaa in position 51 to 56 is any amino acid
  Variant (57)..(57): xaa in position 57 is any or no amino acid
  Variant (58)..(58): xaa in position 58 is Phe, Tyr or Leu
  Variant (59)..(61): xaa in position 59 to 61 is any amino acid
  Variant (62)..(62): xaa in position 62 is Gly, Lys, Asn or Ser
  Variant (63)..(63): xaa in position 63 is Ile, Leu or Val
  Variant (64)..(64): xaa in position 64 is any amino acid
  Variant (66)..(66): xaa in position 66 is any amino acid
  Variant (67)..(67): xaa in position 67 is His or Tyr
  Variant (68)..(68): xaa in position 68 is any amino acid
  Variant (73)..(73): xaa in position 73 is Met or Ala
  Variant (74)..(74): xaa in position 74 is Val or Ala
  Variant (76)..(77): xaa in position 76 to 77 is any amino acid
  Variant (78)..(78): xaa in position 78 is Leu, Ile, Met or Val
  Variant (79)..(79): xaa in position 79 is Lys or Arg
  Variant (80)..(80): xaa in position 80 is Ser or Trp
  Variant (81)..(81): xaa in position 81 is any amino acid
  Variant (83)..(83): xaa in position 83 is Gly or Ala
  Variant (84)..(84): xaa in position 84 is Tyr, Phe or Met
  Variant (85)..(85): xaa in position 85 is Val, Ile or Leu
  Variant (86)..(86): xaa in position 86 is Trp, Met, Ile or Leu
  Variant (88)..(88): xaa in position 88 is Cys, Leu, Met or Phe
  Variant (89)..(89): xaa in position 89 is Lys or Met
  Variant (92)..(92): xaa in position 92 is Asp or Glu
  Variant (95)..(95): xaa in position 95 is Val or Ile
  Variant (96)..(96): xaa in position 96 is Gln, Met or Glu
  Variant (99)..(99): xaa in position 99 is any amino acid
  Variant (100)..(100): xaa in position 100 is Val, Leu or Ile
  Variant (102)..(102): xaa in position 102 is Gln, Ser or Thr
  Variant (103)..(103): xaa in position 103 is Gly or Ala
  Variant (104)..(104): xaa in position 104 is Phe or Tyr
  Variant (108)..(108): xaa in position 108 is Gly or Ala
  Variant (109)..(109): xaa in position 109 is Leu or Met
  Variant (111)..(111): xaa in position 111 is Thr or Ser
  Variant (113)..(113): xaa in position 113 is Val, Ile, Thr or Ala
  Variant (115)..(116): xaa in position 115 to 116 is any amino acid
  Variant (117)..(117): xaa in position 117 is Pro, Ser or Ala
  Variant (118)..(118): xaa in position 118 is Asp, Thr or Asn
  Variant (120)..(121): xaa in position 120 to 121 is any amino acid
  Variant (122)..(122): xaa in position 122 is any or no amino acid
  Variant (123)..(123): xaa in position 123 is Glu, Ala, Ile or Val
  Variant (124)..(124): xaa in position 124 is any amino acid
  Variant (127)..(127): xaa in position 127 is Ala or Ser
  Variant (133)..(133): xaa in position 133 is Arg or Lys
  Variant (135)..(135): xaa in position 135 is Tyr or Phe
  Variant (136)..(136): xaa in position 136 is Arg, Tyr or Met
  Variant (137)..(137): xaa in position 137 is any amino acid
  Variant (138)..(138): xaa in position 138 is His, Tyr or Trp
  Variant (139)..(139): xaa in position 139 is Gln or Leu
  Variant (140)..(140): xaa in position 140 is Lys, Gln, Ala or Arg
  Variant (141)..(141): xaa in position 141 is Gly or Asn
  Variant (142)..(143): xaa in position 142 to 143 is any amino acid
  Variant (148)..(148): xaa in position 148 is Ser or Pro
  Variant (149)..(149): xaa in position 149 is Ile or Val
  Variant (151)..(151): xaa in position 151 is Ser or Thr
  Variant (156)..(156): xaa in position 156 is Thr, Ser or Ala
  Variant (157)..(157): xaa in position 157 is any amino acid
  Variant (158)..(158): xaa in position 158 is Gly or Ala
  Variant (159)..(159): xaa in position 159 is Leu or Ile
  Variant (160)..(161): xaa in position 160 to 161 is any amino acid
  Variant (163)..(163): xaa in position 163 is Ala or Gly
  Variant (164)..(164): xaa in position 164 is any amino acid
  Variant (165)..(165): xaa in position 165 is Leu, Phe or Val

SEQ ID NO: 35145 - DNA, 1518 bp, Saccharomyces cerevisiae; identical to SEQ ID NO: 2533
  CDS (1)..(1518)

SEQ ID NO: 35146 - protein, 505 aa, Saccharomyces cerevisiae; identical to SEQ ID NO: 2534

SEQ ID NO: 35147 - DNA, 1548 bp, Mus musculus (house mouse); identical to SEQ ID NO: 2535
  CDS (1)..(1548)

SEQ ID NO: 35148 - protein, 515 aa, Mus musculus (house mouse); identical to SEQ ID NO: 2536

SEQ ID NO: 35149 - DNA, 1593 bp, Fugu rubripes (Japanese pufferfish); identical to SEQ ID NO: 2537
  CDS (1)..(1593)

SEQ ID NO: 35150 - protein, 530 aa, Fugu rubripes (Japanese pufferfish); identical to SEQ ID NO: 2538

SEQ ID NO: 35151 - DNA, 1506 bp, Vibrio cholerae; identical to SEQ ID NO: 2539
  CDS (1)..(1506)

SEQ ID NO: 35152 - protein, 501 aa, Vibrio cholerae; identical to SEQ ID NO: 2540

SEQ ID NO: 35153 - DNA, 1470 bp, Pseudomonas aeruginosa; identical to SEQ ID NO: 2541
  CDS (1)..(1470)

SEQ ID NO: 35154 - protein, 489 aa, Pseudomonas aeruginosa; identical to SEQ ID NO: 2542

SEQ ID NO: 35155 - DNA, 1485 bp, Staphylococcus aureus; identical to SEQ ID NO: 2543
  CDS (1)..(1485)

SEQ ID NO: 35156 - protein, 494 aa, Staphylococcus aureus; identical to SEQ ID NO: 2544

SEQ ID NO: 35157 - DNA, 1488 bp, Streptococcus pneumoniae; identical to SEQ ID NO: 2545
  CDS (1)..(1488)

SEQ ID NO: 35158 - protein, 495 aa, Streptococcus pneumoniae; identical to SEQ ID NO: 2546

SEQ ID NO: 35159 - DNA, 1476 bp, Salmonella enterica subsp. enterica serovar Typhi; identical to SEQ ID NO: 2547
  CDS (1)..(1476)

SEQ ID NO: 35160 - protein, 491 aa, Salmonella enterica subsp. enterica serovar Typhi; identical to SEQ ID NO: 2548

SEQ ID NO: 35161 - DNA, 1476 bp, Agrobacterium tumefaciens; identical to SEQ ID NO: 2549
  CDS (1)..(1476)

SEQ ID NO: 35162 - protein, 491 aa, Agrobacterium tumefaciens; identical to SEQ ID NO: 2550

SEQ ID NO: 35163 - DNA, 1530 bp, Nostoc sp. PCC 7120; identical to SEQ ID NO: 2551
  CDS (1)..(1530)

SEQ ID NO: 35164 - protein, 509 aa, Nostoc sp. PCC 7120; identical to SEQ ID NO: 2552

SEQ ID NO: 35165 - DNA, 1386 bp, Agrobacterium tumefaciens; identical to SEQ ID NO: 2553
  CDS (1)..(1386)

SEQ ID NO: 35166 - protein, 461 aa, Agrobacterium tumefaciens; identical to SEQ ID NO: 2554

SEQ ID NO: 35167 - DNA, 1476 bp, Brucella melitensis; identical to SEQ ID NO: 2555
  CDS (1)..(1476)

SEQ ID NO: 35168 - protein, 491 aa, Brucella melitensis; identical to SEQ ID NO: 2556

SEQ ID NO: 35169 - DNA, 1458 bp, Zymomonas mobilis; identical to SEQ ID NO: 2557
  CDS (1)..(1458)

SEQ ID NO: 35170 - protein, 485 aa, Zymomonas mobilis; identical to SEQ ID NO: 2558

SEQ ID NO: 35171 - DNA, 1470 bp, Bacillus subtilis; identical to SEQ ID NO: 2559
  CDS (1)..(1470)

SEQ ID NO: 35172 - protein, 489 aa, Bacillus subtilis; identical to SEQ ID NO: 2560

SEQ ID NO: 35173 - DNA, 1401 bp, Mycobacterium tuberculosis; identical to SEQ ID NO: 2561
  CDS (1)..(1401)

SEQ ID NO: 35174 - protein, 466 aa, Mycobacterium tuberculosis; identical to SEQ ID NO: 2562

SEQ ID NO: 35175 - DNA, 1545 bp, Mycobacterium tuberculosis; identical to SEQ ID NO: 2563
  CDS (1)..(1545)

SEQ ID NO: 35176 - protein, 514 aa, Mycobacterium tuberculosis; identical to SEQ ID NO: 2564

SEQ ID NO: 35177 - DNA, 1320 bp, Chlamydia trachomatis; identical to SEQ ID NO: 2565
  CDS (1)..(1320)

SEQ ID NO: 35178 - protein, 439 aa, Chlamydia trachomatis; identical to SEQ ID NO: 2566

SEQ ID NO: 35179 - DNA, 1773 bp, Deinococcus radiodurans; identical to SEQ ID NO: 2567
  CDS (1)..(1773)

SEQ ID NO: 35180 - protein, 590 aa, Deinococcus radiodurans; identical to SEQ ID NO: 2568

SEQ ID NO: 35181 - DNA, 1467 bp, Pseudomonas aeruginosa; identical to SEQ ID NO: 2569
  CDS (1)..(1467)

SEQ ID NO: 35182 - protein, 488 aa, Pseudomonas aeruginosa; identical to SEQ ID NO: 2570

SEQ ID NO: 35183 - DNA, 1422 bp, Caulobacter crescentus; identical to SEQ ID NO: 2571
  CDS (1)..(1422)

SEQ ID NO: 35184 - protein, 473 aa, Caulobacter crescentus; identical to SEQ ID NO: 2572

SEQ ID NO: 35185 - DNA, 1437 bp, Borrelia burgdorferi (Lyme disease spirochete); identical to SEQ ID NO: 2573
  CDS (1)..(1437)

SEQ ID NO: 35186 - protein, 478 aa, Borrelia burgdorferi (Lyme disease spirochete); identical to SEQ ID NO: 2574

SEQ ID NO: 35187 - DNA, 1539 bp, Chlamydophila pneumoniae, Chlamydia pneumoniae; identical to SEQ ID NO: 2575
  CDS (1)..(1539)

SEQ ID NO: 35188 - protein, 512 aa, Chlamydophila pneumoniae, Chlamydia pneumoniae; identical to SEQ ID NO: 2576

SEQ ID NO: 35189 - DNA, 1476 bp, Escherichia coli; identical to SEQ ID NO: 2577
  CDS (1)..(1476)

SEQ ID NO: 35190 - protein, 491 aa, Escherichia coli; identical to SEQ ID NO: 2578

SEQ ID NO: 35191 - DNA, 1548 bp, Treponema pallidum subsp. pallidum (syphilis spirochete); identical to SEQ ID NO: 2579
  CDS (1)..(1548)

SEQ ID NO: 35192 - protein, 515 aa, Treponema pallidum subsp. pallidum (syphilis spirochete); identical to SEQ ID NO: 2580

SEQ ID NO: 35193 - DNA, 1476 bp, Buchnera sp; identical to SEQ ID NO: 2581
  CDS (1)..(1476)

SEQ ID NO: 35194 - protein, 491 aa, Buchnera sp; identical to SEQ ID NO: 2582

SEQ ID NO: 35195 - DNA, 1512 bp, Lactococcus lactis subsp. lactis; identical to SEQ ID NO: 2583
  CDS (1)..(1512)

SEQ ID NO: 35196 - protein, 503 aa, Lactococcus lactis subsp. lactis; identical to SEQ ID NO: 2584

SEQ ID NO: 35197 - DNA, 1572 bp, Drosophila melanogaster; identical to SEQ ID NO: 2585
  CDS (1)..(1572)

SEQ ID NO: 35198 - protein, 523 aa, Drosophila melanogaster; identical to SEQ ID NO: 2586

SEQ ID NO: 35199 - DNA, 1575 bp, Synechococcus sp; identical to SEQ ID NO: 2587
  CDS (1)..(1575)

SEQ ID NO: 35200 - protein, 524 aa, Synechococcus sp; identical to SEQ ID NO: 2588

SEQ ID NO: 35201 - DNA, 1485 bp, Haemophilus influenzae; identical to SEQ ID NO: 2589
  CDS (1)..(1485)

SEQ ID NO: 35202 - protein, 494 aa, Haemophilus influenzae; identical to SEQ ID NO: 2590

SEQ ID NO: 35203 - DNA, 1446 bp, Neisseria meningitidis; identical to SEQ ID NO: 2591
  CDS (1)..(1446)

SEQ ID NO: 35204 - protein, 481 aa, Neisseria meningitidis; identical to SEQ ID NO: 2592

SEQ ID NO: 35205 - DNA, 1278 bp, Helicobacter pylori; identical to SEQ ID NO: 2593
  CDS (1)..(1278)

SEQ ID NO: 35206 - protein, 425 aa, Helicobacter pylori; identical to SEQ ID NO: 2594

SEQ ID NO: 35207 - DNA, 1434 bp, Xylella fastidiosa; identical to SEQ ID NO: 2595
  CDS (1)..(1434)

SEQ ID NO: 35208 - protein, 477 aa, Xylella fastidiosa; identical to SEQ ID NO: 2596

SEQ ID NO: 35209 - DNA, 1296 bp, Aquifex aeolicus; identical to SEQ ID NO: 2597
  CDS (1)..(1296)

SEQ ID NO: 35210 - protein, 431 aa, Aquifex aeolicus; identical to SEQ ID NO: 2598

SEQ ID NO: 35211 - DNA, 1491 bp, Thermotoga maritima; identical to SEQ ID NO: 2599
  CDS (1)..(1491)

SEQ ID NO: 35212 - protein, 496 aa, Thermotoga maritima; identical to SEQ ID NO: 2600

SEQ ID NO: 35213 - DNA, 1494 bp, Kluyveromyces marxianus var. lactis, Candida sphaerica; identical to SEQ ID NO: 2601
  CDS (1)..(1494)

SEQ ID NO: 35214 - protein, 497 aa, Kluyveromyces marxianus var. lactis, Candida sphaerica; identical to SEQ ID NO: 2602

SEQ ID NO: 35215 - DNA, 2813 bp, Erwinia chrysanthemi; identical to SEQ ID NO: 2603
  CDS (322)..(1797)

SEQ ID NO: 35216 - protein, 491 aa, Erwinia chrysanthemi; identical to SEQ ID NO: 2604

SEQ ID NO: 35217 - DNA, 3244 bp, Plasmodium falciparum; identical to SEQ ID NO: 2605
  CDS (184)..(2916)

SEQ ID NO: 35218 - protein, 910 aa, Plasmodium falciparum; identical to SEQ ID NO: 2606

SEQ ID NO: 35219 - DNA, 1785 bp, Medicago sativa (alfalfa); identical to SEQ ID NO: 2607
  CDS (38)..(1585)

SEQ ID NO: 35220 - protein, 515 aa, Medicago sativa (alfalfa); identical to SEQ ID NO: 2608

SEQ ID NO: 35221 - DNA, 1689 bp, Solanum tuberosum (potato); identical to SEQ ID NO: 2609
  CDS (46)..(1581)

SEQ ID NO: 35222 - protein, 511 aa, Solanum tuberosum (potato); identical to SEQ ID NO: 2610

SEQ ID NO: 35223 - DNA, 1530 bp, Synechocystis sp; identical to SEQ ID NO: 2611
  CDS (1)..(1530)

SEQ ID NO: 35224 - protein, 509 aa, Synechocystis sp; identical to SEQ ID NO: 2612

SEQ ID NO: 35225 - DNA, 1953 bp, Nicotiana tabacum (common tobacco); identical to SEQ ID NO: 2613
  CDS (43)..(1824)

SEQ ID NO: 35226 - protein, 593 aa, Nicotiana tabacum (common tobacco); identical to SEQ ID NO: 2614

SEQ ID NO: 35227 - DNA, 1869 bp, Nicotiana tabacum (common tobacco); identical to SEQ ID NO: 2615
  CDS (22)..(1788)

SEQ ID NO: 35228 - protein, 588 aa, Nicotiana tabacum (common tobacco); identical to SEQ ID NO: 2616

SEQ ID NO: 35229 - DNA, 2058 bp, Solanum tuberosum (potato); identical to SEQ ID NO: 2617
  CDS (41)..(1774)

SEQ ID NO: 35230 - protein, 577 aa, Solanum tuberosum (potato); identical to SEQ ID NO: 2618

SEQ ID NO: 35231 - DNA, 2049 bp, Spinacia oleracea (spinach); identical to SEQ ID NO: 2619
  CDS (147)..(1871)

SEQ ID NO: 35232 - protein, 574 aa, Spinacia oleracea (spinach); identical to SEQ ID NO: 2620

SEQ ID NO: 35233 - DNA, 2359 bp, Petroselinum crispum (parsley); identical to SEQ ID NO: 2621
  CDS (172)..(1986)

SEQ ID NO: 35234 - protein, 604 aa, Petroselinum crispum (parsley); identical to SEQ ID NO: 2622

SEQ ID NO: 35235 - DNA, 1848 bp, Petroselinum crispum (parsley); identical to SEQ ID NO: 2623
  CDS (41)..(1528)

SEQ ID NO: 35236 - protein, 495 aa, Petroselinum crispum (parsley); identical to SEQ ID NO: 2624

SEQ ID NO: 35237 - DNA, 1957 bp, Petroselinum crispum (parsley); identical to SEQ ID NO: 2625
  CDS (74)..(1678)

SEQ ID NO: 35238 - protein, 534 aa, Petroselinum crispum (parsley); identical to SEQ ID NO: 2626

SEQ ID NO: 35239 - DNA, 1569 bp, Caenorhabditis elegans; identical to SEQ ID NO: 2627
  CDS (1)..(1569)

SEQ ID NO: 35240 - protein, 522 aa, Caenorhabditis elegans; identical to SEQ ID NO: 2628

SEQ ID NO: 35241 - DNA, 1779 bp, Streptomyces coelicolor; identical to SEQ ID NO: 2629
  CDS (1)..(1779)

SEQ ID NO: 35242 - protein, 592 aa, Streptomyces coelicolor; identical to SEQ ID NO: 2630

SEQ ID NO: 35243 - DNA, 1524 bp, Streptomyces coelicolor; identical to SEQ ID NO: 2631
  CDS (1)..(1524)

SEQ ID NO: 35244 - protein, 507 aa, Streptomyces coelicolor; identical to SEQ ID NO: 2632

SEQ ID NO: 35245 - DNA, 1422 bp, Schizosaccharomyces pombe; identical to SEQ ID NO: 2633
  CDS (1)..(1422)

SEQ ID NO: 35246 - protein, 473 aa, Schizosaccharomyces pombe; identical to SEQ ID NO: 2634

SEQ ID NO: 35247 - DNA, 1503 bp, Schizosaccharomyces pombe; identical to SEQ ID NO: 2635
  CDS (1)..(1503)

SEQ ID NO: 35248 - protein, 500 aa, Schizosaccharomyces pombe; identical to SEQ ID NO: 2636

SEQ ID NO: 35249 - DNA, 1428 bp, Schizosaccharomyces pombe; identical to SEQ ID NO: 2637
  CDS (1)..(1428)

SEQ ID NO: 35250 - protein, 475 aa, Schizosaccharomyces pombe; identical to SEQ ID NO: 2638

SEQ ID NO: 35251 - DNA, 1461 bp, Leuconostoc mesenteroides; identical to SEQ ID NO: 2639
  CDS (1)..(1461)

SEQ ID NO: 35252 - protein, 486 aa, Leuconostoc mesenteroides; identical to SEQ ID NO: 2640

SEQ ID NO: 35253 - DNA, 3038 bp, Corynebacterium glutamicum; identical to SEQ ID NO: 2641
  CDS (115)..(1659)

SEQ ID NO: 35254 - protein, 514 aa, Corynebacterium glutamicum; identical to SEQ ID NO: 2642

SEQ ID NO: 35255 - DNA, 1852 bp, Nicotiana tabacum; identical to SEQ ID NO: 2643
  CDS (102)..(1634)

SEQ ID NO: 35256 - protein, 510 aa, Nicotiana tabacum; identical to SEQ ID NO: 2644

SEQ ID NO: 35257 - DNA, 1821 bp, Nicotiana tabacum; identical to SEQ ID NO: 2645
  CDS (88)..(1623)

SEQ ID NO: 35258 - protein, 511 aa, Nicotiana tabacum; identical to SEQ ID NO: 2646

SEQ ID NO: 35259 - DNA, 1808 bp, Chlamydia trachomatis; identical to SEQ ID NO: 2647
  CDS (105)..(1643)

SEQ ID NO: 35260 - protein, 512 aa, Chlamydia trachomatis; identical to SEQ ID NO: 2648

SEQ ID NO: 35261 - DNA, 2750 bp, Plasmodium falciparum; identical to SEQ ID NO: 2649
  CDS (48)..(2258)

SEQ ID NO: 35262 - protein, 736 aa, Plasmodium falciparum; identical to SEQ ID NO: 2650

SEQ ID NO: 35263 - DNA, 1509 bp, Debaryomyces hansenii; identical to SEQ ID NO: 2651
  CDS (1)..(1509)

SEQ ID NO: 35264 - protein, 502 aa, Debaryomyces hansenii; identical to SEQ ID NO: 2652

SEQ ID NO: 35265 - DNA, 1503 bp, Candida glabrata; identical to SEQ ID NO: 2653
  CDS (1)..(1503)

SEQ ID NO: 35266 - protein, 500 aa, Candida glabrata; identical to SEQ ID NO: 2654

SEQ ID NO: 35267 - DNA, 1485 bp, Bacillus thuringiensis serovar konkukian str; identical to SEQ ID NO: 2655
  CDS (1)..(1485)

SEQ ID NO: 35268 - protein, 494 aa, Bacillus thuringiensis serovar konkukian str; identical to SEQ ID NO: 2656

SEQ ID NO: 35269 - DNA, 1554 bp, Oryza sativa; identical to SEQ ID NO: 2657
  CDS (1)..(1554)

SEQ ID NO: 35270 - protein, 517 aa, Oryza sativa; identical to SEQ ID NO: 2658

SEQ ID NO: 35271 - DNA, 1500 bp, Photobacterium profundum; identical to SEQ ID NO: 2659
  CDS (1)..(1500)

SEQ ID NO: 35272 - protein, 499 aa, Photobacterium profundum; identical to SEQ ID NO: 2660

SEQ ID NO: 35273 - DNA, 1551 bp, Parachlamydia sp; identical to SEQ ID NO: 2661
  CDS (1)..(1551)

SEQ ID NO: 35274 - protein, 516 aa, Parachlamydia sp; identical to SEQ ID NO: 2662

SEQ ID NO: 35275 - DNA, 1515 bp, Rhodopseudomonas palustris; identical to SEQ ID NO: 2663
  CDS (1)..(1515)

SEQ ID NO: 35276 - protein, 504 aa, Rhodopseudomonas palustris; identical to SEQ ID NO: 2664

SEQ ID NO: 35277 - DNA, 1650 bp, Corynebacterium diphtheriae; identical to SEQ ID NO: 2665
  CDS (1)..(1650)

SEQ ID NO: 35278 - protein, 549 aa, Corynebacterium diphtheriae; identical to SEQ ID NO: 2666

SEQ ID NO: 35279 - DNA, 1446 bp, uncultured bacterium 581; identical to SEQ ID NO: 2667
  CDS (1)..(1446)

SEQ ID NO: 35280 - protein, 481 aa, uncultured bacterium 581; identical to SEQ ID NO: 2668

SEQ ID NO: 35281 - DNA, 1602 bp, Nonomuraea sp; identical to SEQ ID NO: 2669
  CDS (1)..(1602)

SEQ ID NO: 35282 - protein, 533 aa, Nonomuraea sp; identical to SEQ ID NO: 2670

SEQ ID NO: 35283 - DNA, 1476 bp, Listeria monocytogenes; identical to SEQ ID NO: 2671
  CDS (1)..(1476)

SEQ ID NO: 35284 - protein, 491 aa, Listeria monocytogenes; identical to SEQ ID NO: 2672

SEQ ID NO: 35285 - DNA, 1485 bp, Bacillus cereus; identical to SEQ ID NO: 2673
  CDS (1)..(1485)

SEQ ID NO: 35286 - protein, 494 aa, Bacillus cereus; identical to SEQ ID NO: 2674

SEQ ID NO: 35287 - DNA, 1410 bp, Mycobacterium paratuberculosis; identical to SEQ ID NO: 2675
  CDS (1)..(1410)

SEQ ID NO: 35288 - protein, 469 aa, Mycobacterium paratuberculosis; identical to SEQ ID NO: 2676

SEQ ID NO: 35289 - DNA, 2454 bp, Mycobacterium paratuberculosis; identical to SEQ ID NO: 2677
  CDS (1)..(2454)

SEQ ID NO: 35290 - protein, 817 aa, Mycobacterium paratuberculosis; identical to SEQ ID NO: 2678

SEQ ID NO: 35291 - DNA, 1545 bp, Mycobacterium paratuberculosis; identical to SEQ ID NO: 2679
  CDS (1)..(1545)

SEQ ID NO: 35292 - protein, 514 aa, Mycobacterium paratuberculosis; identical to SEQ ID NO: 2680

SEQ ID NO: 35293 - DNA, 1449 bp, Lactobacillus johnsonii; identical to SEQ ID NO: 2681
  CDS (1)..(1449)

SEQ ID NO: 35294 - protein, 482 aa, Lactobacillus johnsonii; identical to SEQ ID NO: 2682

SEQ ID NO: 35295 - DNA, 1539 bp, Ashbya gossypii; identical to SEQ ID NO: 2683
  CDS (1)..(1539)

SEQ ID NO: 35296 - protein, 512 aa, Ashbya gossypii; identical to SEQ ID NO: 2684

SEQ ID NO: 35297 - DNA, 1734 bp, Oryza sativa; identical to SEQ ID NO: 2685
  CDS (1)..(1734)

SEQ ID NO: 35298 - protein, 577 aa, Oryza sativa; identical to SEQ ID NO: 2686

SEQ ID NO: 35299 - DNA, 1467 bp, Gluconobacter oxydans; identical to SEQ ID NO: 2687
  CDS (1)..(1467)

SEQ ID NO: 35300 - protein, 488 aa, Gluconobacter oxydans; identical to SEQ ID NO: 2688

SEQ ID NO: 35301 - DNA, 1581 bp, Vibrio vulnificus; identical to SEQ ID NO: 2689
  CDS (1)..(1581)

SEQ ID NO: 35302 - protein, 526 aa, Vibrio vulnificus; identical to SEQ ID NO: 2690

SEQ ID NO: 35303 - DNA, 1476 bp, Photorhabdus luminescens; identical to SEQ ID NO: 2691
  CDS (1)..(1476)

SEQ ID NO: 35304 - protein, 491 aa, Photorhabdus luminescens; identical to SEQ ID NO: 2692

SEQ ID NO: 35305 - DNA, 1539 bp, Gloeobacter violaceus; identical to SEQ ID NO: 2693
  CDS (1)..(1539)

SEQ ID NO: 35306 - protein, 512 aa, Gloeobacter violaceus; identical to SEQ ID NO: 2694

SEQ ID NO: 35307 - DNA, 1539 bp, Gloeobacter violaceus; identical to SEQ ID NO: 2695
  CDS (1)..(1539)

SEQ ID NO: 35308 - protein, 512 aa, Gloeobacter violaceus; identical to SEQ ID NO: 2696

SEQ ID NO: 35309 - DNA, 1479 bp, Chromobacterium violaceum; identical to SEQ ID NO: 2697
  CDS (1)..(1479)

SEQ ID NO: 35310 - protein, 492 aa, Chromobacterium violaceum; identical to SEQ ID NO: 2698

SEQ ID NO: 35311 - DNA, 2229 bp, Giardia lamblia ATCC 50803; identical to SEQ ID NO: 2699
  CDS (1)..(2229)

SEQ ID NO: 35312 - protein, 742 aa, Giardia lamblia ATCC 50803; identical to SEQ ID NO: 2700

SEQ ID NO: 35313 - DNA, 2850 bp, Plasmodium yoelii yoelii; identical to SEQ ID NO: 2701
  CDS (1)..(2850)

SEQ ID NO: 35314 - protein, 949 aa, Plasmodium yoelii yoelii; identical to SEQ ID NO: 2702

SEQ ID NO: 35315 - DNA, 1476 bp, Neurospora crassa; identical to SEQ ID NO: 2703
  CDS (1)..(1476)

SEQ ID NO: 35316 - protein, 491 aa, Neurospora crassa; identical to SEQ ID NO: 2704

SEQ ID NO: 35317 - DNA, 1524 bp, Synechococcus sp; identical to SEQ ID NO: 2705
  CDS (1)..(1524)

SEQ ID NO: 35318 - protein, 507 aa, Synechococcus sp; identical to SEQ ID NO: 2706

SEQ ID NO: 35319 - DNA, 1455 bp, Rhodopirellula baltica; identical to SEQ ID NO: 2707
  CDS (1)..(1455)

SEQ ID NO: 35320 - protein, 484 aa, Rhodopirellula baltica; identical to SEQ ID NO: 2708

SEQ ID NO: 35321 - DNA, 1524 bp, Prochlorococcus marinus subsp; identical to SEQ ID NO: 2709
  CDS (1)..(1524)

SEQ ID NO: 35322 - protein, 507 aa, Prochlorococcus marinus subsp; identical to SEQ ID NO: 2710

SEQ ID NO: 35323 - DNA, 1524 bp, Prochlorococcus marinus; identical to SEQ ID NO: 2711
  CDS (1)..(1524)

SEQ ID NO: 35324 - protein, 507 aa, Prochlorococcus marinus; identical to SEQ ID NO: 2712

SEQ ID NO: 35325 - DNA, 1521 bp, Prochlorococcus marinus; identical to SEQ ID NO: 2713
  CDS (1)..(1521)

SEQ ID NO: 35326 - protein, 506 aa, Prochlorococcus marinus; identical to SEQ ID NO: 2714

SEQ ID NO: 35327 - DNA, 1488 bp, Haemophilus ducreyi; identical to SEQ ID NO: 2715
  CDS (1)..(1488)

SEQ ID NO: 35328 - protein, 495 aa, Haemophilus ducreyi; identical to SEQ ID NO: 2716

SEQ ID NO: 35329 - DNA, 1497 bp, Candidatus Blochmannia floridanus; identical to SEQ ID NO: 2717
  CDS (1)..(1497)

SEQ ID NO: 35330 - protein, 498 aa, Candidatus Blochmannia floridanus; identical to SEQ ID NO: 2718

SEQ ID NO: 35331 - DNA, 1768 bp, Oryza sativa; identical to SEQ ID NO: 2719
  CDS (2)..(1768)

SEQ ID NO: 35332 - protein, 588 aa, Oryza sativa; identical to SEQ ID NO: 2720

SEQ ID NO: 35333 - DNA, 1548 bp, Bos indicus; identical to SEQ ID NO: 2721
  CDS (1)..(1548)

SEQ ID NO: 35334 - protein, 515 aa, Bos indicus; identical to SEQ ID NO: 2722

SEQ ID NO: 35335 - DNA, 1536 bp, Chlamydophila caviae; identical to SEQ ID NO: 2723
  CDS (1)..(1536)

SEQ ID NO: 35336 - protein, 511 aa, Chlamydophila caviae; identical to SEQ ID NO: 2724

SEQ ID NO: 35337 - DNA, 1524 bp, Streptomyces avermitilis; identical to SEQ ID NO: 2725
  CDS (1)..(1524)

SEQ ID NO: 35338 - protein, 507 aa, Streptomyces avermitilis; identical to SEQ ID NO: 2726

SEQ ID NO: 35339 - DNA, 1647 bp, Streptomyces avermitilis; identical to SEQ ID NO: 2727
  CDS (1)..(1647)

SEQ ID NO: 35340 - protein, 548 aa, Streptomyces avermitilis; identical to SEQ ID NO: 2728

SEQ ID NO: 35341 - DNA, 1491 bp, Nitrosomonas europaea; identical to SEQ ID NO: 2729
  CDS (1)..(1491)

SEQ ID NO: 35342 - protein, 496 aa, Nitrosomonas europaea; identical to SEQ ID NO: 2730

SEQ ID NO: 35343 - DNA, 1524 bp, Enterococcus faecalis; identical to SEQ ID NO: 2731
  CDS (1)..(1524)

SEQ ID NO: 35344 - protein, 507 aa, Enterococcus faecalis; identical to SEQ ID NO: 2732

SEQ ID NO: 35345 - DNA, 1464 bp, Tropheryma whipplei; identical to SEQ ID NO: 2733
  CDS (1)..(1464)

SEQ ID NO: 35346 - protein, 487 aa, Tropheryma whipplei; identical to SEQ ID NO: 2734

SEQ ID NO: 35347 - DNA, 2145 bp, Leishmania mexicana; identical to SEQ ID NO: 2735
  CDS (298)..(1986)

SEQ ID NO: 35348 - protein, 562 aa, Leishmania mexicana; identical to SEQ ID NO: 2736

SEQ ID NO: 35349 - DNA, 1494 bp, Dictyostelium discoideum; identical to SEQ ID NO: 2737
  CDS (1)..(1494)

SEQ ID NO: 35350 - protein, 497 aa, Dictyostelium discoideum; identical to SEQ ID NO: 2738

SEQ ID NO: 35351 - DNA, 1503 bp, Xylella fastidiosa; identical to SEQ ID NO: 2739
  CDS (1)..(1503)

SEQ ID NO: 35352 - protein, 500 aa, Xylella fastidiosa; identical to SEQ ID NO: 2740

SEQ ID NO: 35353 - DNA, 1506 bp, Vibrio parahaemolyticus; identical to SEQ ID NO: 2741
  CDS (1)..(1506)

SEQ ID NO: 35354 - protein, 501 aa, Vibrio parahaemolyticus; identical to SEQ ID NO: 2742

SEQ ID NO: 35355 - DNA, 1533 bp, Pseudomonas syringae; identical to SEQ ID NO: 2743
  CDS (1)..(1533)

SEQ ID NO: 35356 - protein, 510 aa, Pseudomonas syringae; identical to SEQ ID NO: 2744

SEQ ID NO: 35357 - DNA, 1470 bp, Pseudomonas syringae; identical to SEQ ID NO: 2745
  CDS (1)..(1470)

SEQ ID NO: 35358 - protein, 489 aa, Pseudomonas syringae; identical to SEQ ID NO: 2746

SEQ ID NO: 35359 - DNA, 1458 bp, Pseudomonas putida; identical to SEQ ID NO: 2747
  CDS (1)..(1458)

SEQ ID NO: 35360 - protein, 485 aa, Pseudomonas putida; identical to SEQ ID NO: 2748

SEQ ID NO: 35361 - DNA, 1506 bp, Pseudomonas putida; identical to SEQ ID NO: 2749
  CDS (1)..(1506)

SEQ ID NO: 35362 - protein, 501 aa, Pseudomonas putida; identical to SEQ ID NO: 2750

SEQ ID NO: 35363 - DNA, 1470 bp, Pseudomonas putida; identical to SEQ ID NO: 2751
  CDS (1)..(1470)

SEQ ID NO: 35364 - protein, 489 aa, Pseudomonas putida; identical to SEQ ID NO: 2752

SEQ ID NO: 35365 - DNA, 1485 bp, Lactobacillus plantarum; identical to SEQ ID NO: 2753
  CDS (1)..(1485)

SEQ ID NO: 35366 - protein, 494 aa, Lactobacillus plantarum; identical to SEQ ID NO: 2754

SEQ ID NO: 35367 - DNA, 1440 bp, Clostridium tetani; identical to SEQ ID NO: 2755
  CDS (1)..(1440)

SEQ ID NO: 35368 - protein, 479 aa, Clostridium tetani; identical to SEQ ID NO: 2756

SEQ ID NO: 35369 - DNA, 1512 bp, Bradyrhizobium japonicum; identical to SEQ ID NO: 2757
  CDS (1)..(1512)

SEQ ID NO: 35370 - protein, 503 aa, Bradyrhizobium japonicum; identical to SEQ ID NO: 2758

SEQ ID NO: 35371 - DNA, 1497 bp, Bacteroides thetaiotaomicron; identical to SEQ ID NO: 2759
  CDS (1)..(1497)

SEQ ID NO: 35372 - protein, 498 aa, Bacteroides thetaiotaomicron; identical to SEQ ID NO: 2760

SEQ ID NO: 35373 - DNA, 4583 bp, Mus musculus; identical to SEQ ID NO: 2761
  CDS (119)..(2488)

SEQ ID NO: 35374 - protein, 789 aa, Mus musculus; identical to SEQ ID NO: 2762

SEQ ID NO: 35375 - DNA, 1485 bp, Staphylococcus epidermidis; identical to SEQ ID NO: 2763
  CDS (1)..(1485)

SEQ ID NO: 35376 - protein, 494 aa, Staphylococcus epidermidis; identical to SEQ ID NO: 2764

SEQ ID NO: 35377 - DNA, 1590 bp, Yersinia pestis; identical to SEQ ID NO: 2765
  CDS (1)..(1590)

SEQ ID NO: 35378 - protein, 529 aa, Yersinia pestis; identical to SEQ ID NO: 2766

SEQ ID NO: 35379 - DNA, 1530 bp, Synechococcus elongatus; identical to SEQ ID NO: 2767
  CDS (1)..(1530)

SEQ ID NO: 35380 - protein, 509 aa, Synechococcus elongatus; identical to SEQ ID NO: 2768

SEQ ID NO: 35381 - DNA, 1473 bp, Shewanella oneidensis; identical to SEQ ID NO: 2769
  CDS (1)..(1473)

SEQ ID NO: 35382 - protein, 490 aa, Shewanella oneidensis; identical to SEQ ID NO: 2770

SEQ ID NO: 35383 - DNA, 1476 bp, Oceanobacillus iheyensis; identical to SEQ ID NO: 2771
  CDS (1)..(1476)

SEQ ID NO: 35384 - protein, 491 aa, Oceanobacillus iheyensis; identical to SEQ ID NO: 2772

SEQ ID NO: 35385 - DNA, 1344 bp, Corynebacterium efficiens; identical to SEQ ID NO: 2773
  CDS (1)..(1344)

SEQ ID NO: 35386 - protein, 447 aa, Corynebacterium efficiens; identical to SEQ ID NO: 2774

SEQ ID NO: 35387 - DNA, 1545 bp, Corynebacterium efficiens; identical to SEQ ID NO: 2775
  CDS (1)..(1545)

SEQ ID NO: 35388 - protein, 514 aa, Corynebacterium efficiens; identical to SEQ ID NO: 2776

SEQ ID NO: 35389 - DNA, 1668 bp, Bifidobacterium longum; identical to SEQ ID NO: 2777
  CDS (1)..(1668)

SEQ ID NO: 35390 - protein, 555 aa, Bifidobacterium longum; identical to SEQ ID NO: 2778

SEQ ID NO: 35391 - DNA, 1284 bp, Rhodococcus opacus; identical to SEQ ID NO: 2779
  CDS (1)..(1284)

SEQ ID NO: 35392 - protein, 427 aa, Rhodococcus opacus; identical to SEQ ID NO: 2780

SEQ ID NO: 35393 - DNA, 2879 bp, Leishmania guyanensis; identical to SEQ ID NO: 2781
  CDS (205)..(1893): n means a or g or c or t/u, s means g or c

SEQ ID NO: 35394 - protein, 562 aa, Leishmania guyanensis; identical to SEQ ID NO: 2782

SEQ ID NO: 35395 - DNA, 1689 bp, Leishmania mexicana; identical to SEQ ID NO: 2783
  CDS (1)..(1689): n means a or g or c or t/u, s means g or c

SEQ ID NO: 35396 - protein, 562 aa, Leishmania mexicana; identical to SEQ ID NO: 2784
  Xaa in positions 76-148, 187, 197, 224, 243, 250 and 492-510 is unknown

SEQ ID NO: 35397 - DNA, 2916 bp, Leishmania amazonensis; identical to SEQ ID NO: 2785
  CDS (207)..(1895): n means a or g or c or t/u, s means g or c

SEQ ID NO: 35398 - protein, 562 aa, Leishmania amazonensis; identical to SEQ ID NO: 2786
  Xaa in positions 463 and 481 is unknown

SEQ ID NO: 35399 - DNA, 1440 bp, Chlorobium tepidum; identical to SEQ ID NO: 2787
  CDS (1)..(1440)

SEQ ID NO: 35400 - protein, 479 aa, Chlorobium tepidum; identical to SEQ ID NO: 2788

SEQ ID NO: 35401 - DNA, 2187 bp, Methylobacterium extorquens; identical to SEQ ID NO: 2789
  CDS (640)..(2187)

SEQ ID NO: 35402 - protein, 515 aa, Methylobacterium extorquens; identical to SEQ ID NO: 2790

SEQ ID NO: 35403 - DNA, 1476 bp, Bartonella henselae; identical to SEQ ID NO: 2791
  CDS (1)..(1476)

SEQ ID NO: 35404 - protein, 491 aa, Bartonella henselae; identical to SEQ ID NO: 2792

SEQ ID NO: 35405 - DNA, 2266 bp, Toxoplasma gondii; identical to SEQ ID NO: 2793
  CDS (169)..(1851)

SEQ ID NO: 35406 - protein, 560 aa, Toxoplasma gondii; identical to SEQ ID NO: 2794

SEQ ID NO: 35407 - DNA, 1923 bp, Xanthomonas campestris; identical to SEQ ID NO: 2795
  CDS (1)..(1923)

SEQ ID NO: 35408 - protein, 640 aa, Xanthomonas campestris; identical to SEQ ID NO: 2796

SEQ ID NO: 35409 - DNA, 1431 bp, Xanthomonas campestris; identical to SEQ ID NO: 2797
  CDS (1)..(1431)

SEQ ID NO: 35410 - protein, 476 aa, Xanthomonas campestris; identical to SEQ ID NO: 2798

SEQ ID NO: 35411 - DNA, 1839 bp, Xanthomonas axonopodis; identical to SEQ ID NO: 2799
  CDS (1)..(1839)

SEQ ID NO: 35412 - protein, 612 aa, Xanthomonas axonopodis; identical to SEQ ID NO: 2800

SEQ ID NO: 35413 - DNA, 1431 bp, Xanthomonas axonopodis; identical to SEQ ID NO: 2801
  CDS (1)..(1431)

SEQ ID NO: 35414 - protein, 476 aa, Xanthomonas axonopodis; identical to SEQ ID NO: 2802

SEQ ID NO: 35415 - DNA, 1458 bp, Thermoanaerobacter tengcongensis; identical to SEQ ID NO: 2803
  CDS (1)..(1458)

SEQ ID NO: 35416 - protein, 485 aa, Thermoanaerobacter tengcongensis; identical to SEQ ID NO: 2804

SEQ ID NO: 35417 - DNA, 1762 bp, Oryza sativa; identical to SEQ ID NO: 2805
  CDS (41)..(1558)

SEQ ID NO: 35418 - protein, 505 aa, Oryza sativa; identical to SEQ ID NO: 2806

SEQ ID NO: 35419 - DNA, 1305 bp, Encephalitozoon cuniculi; identical to SEQ ID NO: 2807
  CDS (1)..(1305)

SEQ ID NO: 35420 - protein, 434 aa, Encephalitozoon cuniculi; identical to SEQ ID NO: 2808

SEQ ID NO: 35421 - DNA, 2125 bp, Drosophila melanogaster; identical to SEQ ID NO: 2809
  CDS (158)..(1738)

SEQ ID NO: 35422 - protein, 526 aa, Drosophila melanogaster; identical to SEQ ID NO: 2810

SEQ ID NO: 35423 - DNA, 1470 bp, Ralstonia solanacearum; identical to SEQ ID NO: 2811
  CDS (1)..(1470)

SEQ ID NO: 35424 - protein, 489 aa, Ralstonia solanacearum; identical to SEQ ID NO: 2812

SEQ ID NO: 35425 - DNA, 1521 bp, Enterococcus mundtii; identical to SEQ ID NO: 2813
  CDS (1)..(1521)

SEQ ID NO: 35426 - protein, 506 aa, Enterococcus mundtii; identical to SEQ ID NO: 2814

SEQ ID NO: 35427 - DNA, 2230 bp, Homo sapiens; identical to SEQ ID NO: 2815
  CDS (54)..(1601)

SEQ ID NO: 35428 - protein, 515 aa, Homo sapiens [sequence omitted]

SEQ ID NO: 35429 - DNA, 1470 bp, Rhizobium loti; identical to SEQ ID NO: 2817
  CDS (1)..(1470)

SEQ ID NO: 35430 - protein, 489 aa, Rhizobium loti; identical to SEQ ID NO: 2818

SEQ ID NO: 35431 - DNA, 1428 bp, Rhizobium loti; identical to SEQ ID NO: 2819
  CDS (1)..(1428)

SEQ ID NO: 35432 - protein, 475 aa, Rhizobium loti; identical to SEQ ID NO: 2820

SEQ ID NO: 35433 - DNA, 3584 bp, Plasmodium berghei; identical to SEQ ID NO: 2821
  CDS (370)..(3222)

SEQ ID NO: 35434 - protein, 950 aa, Plasmodium berghei; identical to SEQ ID NO: 2822

SEQ ID NO: 35435 - DNA, 1491 bp, Pasteurella multocida; identical to SEQ ID NO: 2823
  CDS (1)..(1491)

SEQ ID NO: 35436 - protein, 496 aa, Pasteurella multocida; identical to SEQ ID NO: 2824

SEQ ID NO: 35437 - DNA, 1470 bp, Pseudomonas putida; identical to SEQ ID NO: 2825
  CDS (1)..(1470)

SEQ ID NO: 35438 - protein, 489 aa, Pseudomonas putida; identical to SEQ ID NO: 2826

SEQ ID NO: 35439 - DNA, 1566 bp, Trypanosoma brucei; identical to SEQ ID NO: 2827
  CDS (1)..(1566)

SEQ ID NO: 35440 - protein, 521 aa, Trypanosoma brucei; identical to SEQ ID NO: 2828

SEQ ID NO: 35441 - DNA, 1904 bp, Triticum aestivum; identical to SEQ ID NO: 2829
  CDS (153)..(1682)

SEQ ID NO: 35442 - protein, 509 aa, Triticum aestivum; identical to SEQ ID NO: 2830

SEQ ID NO: 35443 - DNA, 2098 bp, Solanum tuberosum; identical to SEQ ID NO: 2831
  CDS (27)..(1775)

SEQ ID NO: 35444 - protein, 582 aa, Solanum tuberosum; identical to SEQ ID NO: 2832

SEQ ID NO: 35445 - DNA, 1924 bp, Dunaliella bioculata; identical to SEQ ID NO: 2833
  CDS (68)..(1840)

SEQ ID NO: 35446 - protein, 590 aa, Dunaliella bioculata; identical to SEQ ID NO: 2834

SEQ ID NO: 35447 - DNA, 1976 bp, Cyanidium caldarium; identical to SEQ ID NO: 2835
  CDS (46)..(1848)

SEQ ID NO: 35448 - protein, 600 aa, Cyanidium caldarium; identical to SEQ ID NO: 2836

SEQ ID NO: 35449 - DNA, 2106 bp, Drosophila melanogaster; identical to SEQ ID NO: 2837
  CDS (28)..(1746)

SEQ ID NO: 35450 - protein, 572 aa, Drosophila melanogaster; identical to SEQ ID NO: 2838

SEQ ID NO: 35451 - DNA, 1777 bp, Mesembryanthemum crystallinum; identical to SEQ ID NO: 2839
  CDS (39)..(1589)

SEQ ID NO: 35452 - protein, 516 aa, Mesembryanthemum crystallinum; identical to SEQ ID NO: 2840

SEQ ID NO: 35453 - DNA, 1542 bp, Mus musculus; identical to SEQ ID NO: 2841
  CDS (1)..(1542)

SEQ ID NO: 35454 - protein, 513 aa, Mus musculus; identical to SEQ ID NO: 2842

SEQ ID NO: 35455 - DNA, 1485 bp, Actinobacillus actinomycetemcomitans; identical to SEQ ID NO: 2843
  CDS (1)..(1485)

SEQ ID NO: 35456 - protein, 494 aa, Actinobacillus actinomycetemcomitans; identical to SEQ ID NO: 2844

SEQ ID NO: 35457 - DNA, 1473 bp, Buchnera aphidicola; identical to SEQ ID NO: 2845
  CDS (1)..(1473)

SEQ ID NO: 35458 - protein, 490 aa, Buchnera aphidicola; identical to SEQ ID NO: 2846

SEQ ID NO: 35459 - DNA, 1473 bp, Buchnera aphidicola; identical to SEQ ID NO: 2847
  CDS (1)..(1473)

SEQ ID NO: 35460 - protein, 490 aa, Buchnera aphidicola; identical to SEQ ID NO: 2848

SEQ ID NO: 35461 - DNA, 2049 bp, Ceratitis capitata; identical to SEQ ID NO: 2849
  CDS (60)..(1640)

SEQ ID NO: 35462 - protein, 526 aa, Ceratitis capitata; identical to SEQ ID NO: 2850

SEQ ID NO: 35463 - DNA, 1524 bp, Chlamydia muridarum; identical to SEQ ID NO: 2851
  CDS (1)..(1524)

SEQ ID NO: 35464 - protein, 507 aa, Chlamydia muridarum; identical to SEQ ID NO: 2852

SEQ ID NO: 35465 - DNA, 2062 bp, Drosophila melanogaster; identical to SEQ ID NO: 2853
  CDS (303)..(1877)

SEQ ID NO: 35466 - protein, 524 aa, Drosophila melanogaster; identical to SEQ ID NO: 2854

SEQ ID NO: 35467 - DNA, 1536 bp, Emericella nidulans; identical to SEQ ID NO: 2855
  CDS (1)..(1536)

SEQ ID NO: 35468 - protein, 511 aa, Emericella nidulans; identical to SEQ ID NO: 2856

SEQ ID NO: 35469 - DNA, 1957 bp, Leuconostoc mesenteroides; identical to SEQ ID NO: 2857
  CDS (206)..(1666)

SEQ ID NO: 35470 - protein, 486 aa, Leuconostoc mesenteroides; identical to SEQ ID NO: 2858

SEQ ID NO: 35471 - DNA, 2055 bp, Macropus robustus; identical to SEQ ID NO: 2859
  CDS (94)..(1641)

SEQ ID NO: 35472 - protein, 515 aa, Macropus robustus; identical to SEQ ID NO: 2860

SEQ ID NO: 35473 - DNA, 1530 bp, Nostoc punctiforme; identical to SEQ ID NO: 2861
  CDS (1)..(1530)

SEQ ID NO: 35474 - protein, 509 aa, Nostoc punctiforme; identical to SEQ ID NO: 2862

SEQ ID NO: 35475 - DNA, 1476 bp, Rhizobium meliloti; identical to SEQ ID NO: 2863
  CDS (1)..(1476)

SEQ ID NO: 35476 - protein, 491 aa, Rhizobium meliloti; identical to SEQ ID NO: 2864

SEQ ID NO: 35477 - DNA, 2853 bp, Homo sapiens; identical to SEQ ID NO: 2865
  CDS (273)..(2648)

SEQ ID NO: 35478 - protein, 791 aa, Homo sapiens; identical to SEQ ID NO: 2866

SEQ ID NO: 35479 - DNA, 1970 bp, Arabidopsis thaliana; identical to SEQ ID NO: 2867
  CDS (60)..(1790)

SEQ ID NO: 35480 - protein, 576 aa, Arabidopsis thaliana; identical to SEQ ID NO: 2868

SEQ ID NO: 35481 - DNA, 2112 bp, Arabidopsis thaliana; identical to SEQ ID NO: 2869
  CDS (142)..(1932)

SEQ ID NO: 35482 - protein, 596 aa, Arabidopsis thaliana; identical to SEQ ID NO: 2870

SEQ ID NO: 35483 - DNA, 2161 bp, Arabidopsis thaliana; identical to SEQ ID NO: 2871
  CDS (90)..(1967)

SEQ ID NO: 35484 - protein, 625 aa, Arabidopsis thaliana; identical to SEQ ID NO: 2872

SEQ ID NO: 35485 - DNA, 1936 bp, Arabidopsis thaliana; identical to SEQ ID NO: 2873
  CDS (136)..(1686)

SEQ ID NO: 35486 - protein, 516 aa, Arabidopsis thaliana; identical to SEQ ID NO: 2874

SEQ ID NO: 35487 - DNA, 1959 bp, Arabidopsis thaliana; identical to SEQ ID NO: 2875
  CDS (194)..(1741)

SEQ ID NO: 35488 - protein, 515 aa, Arabidopsis thaliana [sequence omitted]

SEQ ID NO: 35489 - DNA, 1503 bp, Xenopus laevis; identical to SEQ ID NO: 2877
  CDS (1)..(1503)

SEQ ID NO: 35490 - protein, 500 aa, Xenopus laevis; identical to SEQ ID NO: 2878

SEQ ID NO: 35491 - DNA, 2004 bp, Arabidopsis thaliana; identical to SEQ ID NO: 2879
  CDS (51)..(1850)

SEQ ID NO: 35492 - protein, 599 aa, Arabidopsis thaliana; identical to SEQ ID NO: 2880

SEQ ID NO: 35493 - DNA, 23 bp, Artificial sequence
  (1)..(23): primer
atgagtgaaggccccgtcaaatt

SEQ ID NO: 35494 - DNA, 25 bp, Artificial sequence
  (1)..(25): primer
ctaattatccttcgtatcttctggc

SEQ ID NO: 35495 - protein, 806 aa, Artificial sequence; identical to SEQ ID NO: 18604
  Variant (2)..(3): xaa in position 2 to 3 is any amino acid
  Variant (7)..(9): xaa in position 7 to 9 is any amino acid
  Variant (11)..(12): xaa in position 11 to 12 is any amino acid
  Variant (14)..(17): xaa in position 14 to 17 is any amino acid
  Variant (19)..(23): xaa in position 19 to 23 is any amino acid
  Variant (25)..(32): xaa in position 25 to 32 is any amino acid
  Variant (34)..(35): xaa in position 34 to 35 is any amino acid
  Variant (37)..(81): xaa in position 37 to 81 is any amino acid
  Variant (83)..(95): xaa in position 83 to 95 is any amino acid
  Variant (97)..(225): xaa in position 97 to 225 is any amino acid
  Variant (227)..(230): xaa in position 227 to 230 is any amino acid
  Variant (232)..(258): xaa in position 232 to 258 is any amino acid
  Variant (260)..(262): xaa in position 260 to 262 is any amino acid
  Variant (266)..(266): xaa in position 266 is any amino acid
  Variant (268)..(268): xaa in position 268 is any amino acid
  Variant (270)..(271): xaa in position 270 to 271 is any amino acid
  Variant (273)..(275): xaa in position 273 to 275 is any amino acid
  Variant (277)..(285): xaa in position 277 to 285 is any amino acid
  Variant (287)..(290): xaa in position 287 to 290 is any amino acid
  Variant (300)..(300): xaa in position 300 is any amino acid
  Variant (302)..(302): xaa in position 302 is any amino acid
  Variant (304)..(307): xaa in position 304 to 307 is any amino acid
  Variant (310)..(310): xaa in position 310 is any amino acid
  Variant (312)..(318): xaa in position 312 to 318 is any amino acid
  Variant (321)..(323): xaa in position 321 to 323 is any amino acid
  Variant (325)..(328): xaa in position 325 to 328 is any amino acid
  Variant (330)..(332): xaa in position 330 to 332 is any amino acid
  Variant (334)..(335): xaa in position 334 to 335 is any amino acid
  Variant (337)..(339): xaa in position 337 to 339 is any amino acid
  Variant (341)..(342): xaa in position 341 to 342 is any amino acid
  Variant (344)..(347): xaa in position 344 to 347 is any amino acid
  Variant (349)..(351): xaa in position 349 to 351 is any amino acid
  Variant (354)..(355): xaa in position 354 to 355 is any amino acid
  Variant (359)..(360): xaa in position 359 to 360 is any amino acid
  Variant (362)..(366): xaa in position 362 to 366 is any amino acid
  Variant (370)..(370): xaa in position 370 is any amino acid
  Variant (372)..(382): xaa in position 372 to 382 is any amino acid
  Variant (385)..(385): xaa in position 385 is any amino acid
  Variant (387)..(387): xaa in position 387 is any amino acid
  Variant (389)..(405): xaa in position 389 to 405 is any amino acid
  Variant (409)..(438): xaa in position 409 to 438 is any amino acid
  Variant (440)..(451): xaa in position 440 to 451 is any amino acid
  Variant (453)..(455): xaa in position 453 to 455 is any amino acid
  Variant (457)..(465): xaa in position 457 to 465 is any amino acid
  Variant (467)..(467): xaa in position 467 is any amino acid
  Variant (470)..(470): xaa in position 470 is any amino acid
  Variant (475)..(478): xaa in position 475 to 478 is any amino acid
  Variant (481)..(493): xaa in position 481 to 493 is any amino acid
  Variant (495)..(524): xaa in position 495 to 524 is any amino acid
  Variant (526)..(531): xaa in position 526 to 531 is any amino acid
  Variant (534)..(534): xaa in position 534 is any amino acid
  Variant (536)..(543): xaa in position 536 to 543 is any amino acid
  Variant (545)..(545): xaa in position 545 is any amino acid
  Variant (548)..(588): xaa in position 548 to 588 is any amino acid
  Variant (592)..(592): xaa in position 592 is any amino acid
  Variant (594)..(595): xaa in position 594 to 595 is any amino acid
  Variant (597)..(599): xaa in position 597 to 599 is any amino acid
  Variant (601)..(604): xaa in position 601 to 604 is any amino acid
  Variant (606)..(609): xaa in position 606 to 609 is any amino acid
  Variant (611)..(614): xaa in position 611 to 614 is any amino acid
  Variant (616)..(797): xaa in position 616 to 797 is any amino acid
  Variant (799)..(800): xaa in position 799 to 800 is any amino acid
  Variant (802)..(805): xaa in position 802 to 805 is any amino acid

SEQ ID NO: 35496 - protein, 150 aa, Artificial sequence; identical to SEQ ID NO: 2917
  Variant (1)..(1): xaa in position 1 is Arg or Lys
  Variant (2)..(2): xaa in position 2 is Val, Ile, Leu or Ala
  Variant (3)..(3): xaa in position 3 is Ile, Val, Met or Ala
  Variant (4)..(4): xaa in position 4 is Ile, Val, Leu, Met or Ala
  Variant (8)..(8): xaa in position 8 is Phe, Ile, Leu or Tyr
  Variant (9)..(9): xaa in position 9 is Gly or Ala
  Variant (10)..(10): xaa in position 10 is any amino acid
  Variant (11)..(11): xaa in position 11 is Asp, Ser or Asn
  Variant (12)..(13): xaa in position 12 to 13 is any amino acid
  Variant (14)..(14): xaa in position 14 is Ser, Thr or Asn
  Variant (15)..(15): xaa in position 15 is Ala, Ser, Phe or Tyr
  Variant (16)..(17): xaa in position 16 to 17 is any amino acid
  Variant (18)..(18): xaa in position 18 is Leu, Ile, Val or Phe
  Variant (19)..(21): xaa in position 19 to 21 is any amino acid
  Variant (22)..(22): xaa in position 22 is Leu, Ile or Val
  Variant (23)..(27): xaa in position 23 to 27 is any amino acid
  Variant (28)..(28): xaa in position 28 is Glu, Asp, Pro or Ser
  Variant (29)..(30): xaa in position 29 to 30 is any amino acid
  Variant (31)..(31): xaa in position 31 is Ile, Val, Leu, Thr or Met
  Variant (32)..(32): xaa in position 32 is Tyr, Phe or Leu
  Variant (33)..(33): xaa in position 33 is Arg, His or Leu
  Variant (34)..(34): xaa in position 34 is Ile, Val, Met or Leu
  Variant (37)..(37): xaa in position 37 is Tyr or Phe
  Variant (39)..(39): xaa in position 39 is Gly, Ser or Ala
  Variant (40)..(40): xaa in position 40 is Lys, Arg or Glu
  Variant (41)..(42): xaa in position 41 to 42 is any amino acid
  Variant (43)..(43): xaa in position 43 is Val, Ile, Leu, Ala or Met
  Variant (44)..(44): xaa in position 44 is any amino acid
  Variant (45)..(45): xaa in position 45 is Asn, Gly, Gln or Ala
  Variant (46)..(46): xaa in position 46 is Leu, Ile, Met, Phe or Val
  Variant (47)..(49): xaa in position 47 to 49 is any amino acid
  Variant (50)..(50): xaa in position 50 is Arg, Lys or Glu
  Variant (51)..(51): xaa in position 51 is Phe or Tyr
  Variant (52)..(52): xaa in position 52 is any amino acid
  Variant (54)..(59): xaa in position 54 to 59 is any amino acid
  Variant (60)..(60): xaa in position 60 is any or no amino acid
  Variant (61)..(61): xaa in position 61 is Trp, Met, Asn or Leu
  Variant (62)..(63): xaa in position 62 to 63 is any amino acid
  Variant (64)..(65): xaa in position 64 to 65 is any or no amino acid
  Variant (66)..(66): xaa in position 66 is Ile, Val or Ala
  Variant (67)..(68): xaa in position 67 to 68 is any amino acid
  Variant (69)..(69): xaa in position 69 is Val, Ile, Met or Leu
  Variant (70)..(70): xaa in position 70 is any amino acid
  Variant (71)..(71): xaa in position 71 is Ile, Leu, Val, Phe or Ser
  Variant (72)..(74): xaa in position 72 to 74 is any amino acid
  Variant (76)..(77): xaa in position 76 to 77 is any amino acid
  Variant (78)..(78): xaa in position 78 is Gly, Asp, Val or Ala
  Variant (79)..(81): xaa in position 79 to 81 is any amino acid
  Variant (82)..(82): xaa in position 82 is Arg or Lys
  Variant (83)..(84): xaa in position 83 to 84 is any or no amino acid
  Variant (85)..(85): xaa in position 85 is Tyr or Phe
  Variant (86)..(86): xaa in position 86 is Tyr, Phe or Trp
  Variant (87)..(87): xaa in position 87 is Asp, Glu, Ala or Asn
  Variant (88)..(89): xaa in position 88 to 89 is any amino acid
  Variant (91)..(91): xaa in position 91 is any amino acid
  Variant (92)..(92): xaa in position 92 is any or no amino acid
  Variant (93)..(93): xaa in position 93 is Leu, Ile, Val, Met or Ala
  Variant (94)..(94): xaa in position 94 is Arg, Lys or Leu
  Variant (96)..(96): xaa in position 96 is Met, Val, Ile or Leu
  Variant (97)..(97): xaa in position 97 is Val, Met, Ile, Leu or Phe
  Variant (98)..(98): xaa in position 98 is Gln, Pro or Thr
  Variant (99)..(99): xaa in position 99 is Asn or Ser
  Variant (100)..(100): xaa in position 100 is His, Gln or Pro
  Variant (101)..(102): xaa in position 101 to 102 is any amino acid
  Variant (103)..(103): xaa in position 103 is Gln, Glu, Asn or Leu
  Variant (104)..(104): xaa in position 104 is Leu, Ile, Val, Met or Thr
  Variant (105)..(105): xaa in position 105 is Leu, Met, Val, Ile, Phe or Tyr
  Variant (106)..(106): xaa in position 106 is any amino acid
  Variant (107)..(107): xaa in position 107 is Leu, Met, Ile, Val, Trp or Phe
  Variant (108)..(109): xaa in position 108 to 109 is any amino acid
  Variant (111)..(111): xaa in position 111 is Glu, Asp, Ser or Asn
  Variant (112)..(112): xaa in position 112 is any amino acid
  Variant (114)..(118): xaa in position 114 to 118 is any amino acid
  Variant (119)..(121): xaa in position 119 to 121 is any or no amino acid
  Variant (122)..(122): xaa in position 122 is Ile, Val, Leu, Phe or Met
  Variant (123)..(124): xaa in position 123 to 124 is any amino acid
  Variant (125)..(125): xaa in position 125 is Glu, Lys, Ala, Arg or His
  Variant (126)..(126): xaa in position 126 is Lys or Val
  Variant (127)..(128): xaa in position 127 to 128 is any amino acid
  Variant (129)..(129): xaa in position 129 is Val, Ile, Ala, Leu or Phe
  Variant (130)..(130): xaa in position 130 is Leu, Ile, Val, Phe or Met
  Variant (131)..(140): xaa in position 131 to 140 is any amino acid
  Variant (141)..(145): xaa in position 141 to 145 is any or no amino acid
  Variant (146)..(146): xaa in position 146 is Val, Leu, Ile, Ala or Ser
  Variant (147)..(147): xaa in position 147 is any amino acid
  Variant (148)..(148): xaa in position 148 is Gly or Ala
  Variant (149)..(149): xaa in position 149 is Gln or Arg
  Variant (150)..(150): xaa in position 150 is Tyr or Phe

SEQ ID NO: 35497 - protein, 44 aa, Artificial sequence; identical to SEQ ID NO: 2918
  Variant (1)..(1): xaa in position 1 is Tyr or Leu
  Variant (2)..(2): xaa in position 2 is any amino acid
  Variant (3)..(13): xaa in position 3 to 13 is any or no amino acid
  Variant (15)..(17): xaa in position 15 to 17 is any amino acid
  Variant (19)..(19): xaa in position 19 is Phe or Tyr
  Variant (20)..(25): xaa in position 20 to 25 is any amino acid
  Variant (26)..(26): xaa in position 26 is Ile, Val, Leu or Phe
  Variant (27)..(29): xaa in position 27 to 29 is any amino acid
  Variant (30)..(30): xaa in position 30 is Arg, Asn, Phe or Gln
  Variant (31)..(31): xaa in position 31 is Trp or Phe
  Variant (32)..(32): xaa in position 32 is any amino acid
  Variant (33)..(33): xaa in position 33 is Gly or Asp
  Variant (34)..(34): xaa in position 34 is Val or Thr
  Variant (36)..(36): xaa in position 36 is Phe or Ile
  Variant (37)..(37): xaa in position 37 is any amino acid
  Variant (38)..(38): xaa in position 38 is Leu, Met, Ile, Val or Phe
  Variant (39)..(40): xaa in position 39 to 40 is any amino acid
  Variant (41)..(41): xaa in position 41 is Gly or Ala
  Variant (43)..(43): xaa in position 43 is any amino acid
  Variant (44)..(44): xaa in position 44 is Leu, Met or Val

SEQ ID NO: 35498 - protein, 97 aa, Artificial sequence; identical to SEQ ID NO: 2919
  Variant (1)..(1): xaa in position 1 is Asn, Asp, Gln, Arg or Lys
  Variant (2)..(4): xaa in position 2 to 4 is any amino acid
  Variant (5)..(5): xaa in position 5 is Ile, Leu, Met, Phe or Val
  Variant (6)..(6): xaa in position 6 is any amino acid
  Variant (7)..(7): xaa in position 7 is Ile, Leu, Val, Ala or Ser
  Variant (8)..(8): xaa in position 8 is any amino acid
  Variant (9)..(9): xaa in position 9 is Pro or His
  Variant (10)..(12): xaa in position 10 to 12 is any amino acid
  Variant (13)..(13): xaa in position 13 is Ile, Val, Met, Leu, Phe or Ala
  Variant (14)..(19): xaa in position 14 to 19 is any amino acid
  Variant (20)..(20): xaa in position 20 is Lys, Ser or Arg
  Variant (21)..(29): xaa in position 21 to 29 is any amino acid
  Variant (30)..(35): xaa in position 30 to 35 is any or no amino acid
  Variant (36)..(36): xaa in position 36 is Leu, Ile, Met or Val
  Variant (37)..(44): xaa in position 37 to 44 is any amino acid
  Variant (45)..(64): xaa in position 45 to 64 is any or no amino acid
  Variant (65)..(65): xaa in position 65 is Ala, Gly, Pro or Ser
  Variant (66)..(66): xaa in position 66 is Tyr or Leu
  Variant (67)..(68): xaa in position 67 to 68 is any amino acid
  Variant (69)..(69): xaa in position 69 is Leu, Met or Tyr
  Variant (70)..(70): xaa in position 70 is Leu, Ile, Phe or Met
  Variant (71)..(71): xaa in position 71 is any amino acid
  Variant (72)..(72): xaa in position 72 is Asp, Glu, Ala, Asn or His
  Variant (73)..(75): xaa in position 73 to 75 is any amino acid
  Variant (76)..(76): xaa in position 76 is Gly, Ser or Asp
  Variant (77)..(80): xaa in position 77 to 80 is any amino acid
  Variant (81)..(81): xaa in position 81 is Phe or Tyr
  Variant (82)..(85): xaa in position 82 to 85 is any amino acid
  Variant (86)..(86): xaa in position 86 is any or no amino acid
  Variant (87)..(87): xaa in position 87 is Val, Ile, Leu, Ala or Gln
  Variant (88)..(90): xaa in position 88 to 90 is any amino acid
  Variant (92)..(96): xaa in position 92 to 96 is any amino acid
  Variant (97)..(97): xaa in position 97 is Ile, Val, Leu, Phe or Ala

SEQ ID NO: 35499 - DNA, 2077 bp, Saccharomyces cerevisiae; identical to SEQ ID NO: 3739
  CDS (482)..(1987)

SEQ ID NO: 35500 - protein, 501 aa, Saccharomyces cerevisiae; identical to SEQ ID NO: 3740

SEQ ID NO: 35501 - DNA, 1668 bp, Caenorhabditis elegans; identical to SEQ ID NO: 3749
  CDS (121)..(1668)

SEQ ID NO: 35502 - protein, 515 aa, Caenorhabditis elegans; identical to SEQ ID NO: 15344

SEQ ID NO: 35503 - DNA, 1365 bp, Schizosaccharomyces pombe; identical to SEQ ID NO: 3751
  CDS (1)..(1365)

SEQ ID NO: 35504 - protein, 454 aa, Schizosaccharomyces pombe; identical to SEQ ID NO: 3752

SEQ ID NO: 35505 - DNA, 1521 bp, Debaryomyces hansenii CBS767; identical to SEQ ID NO: 3757
  CDS (1)..(1521)

SEQ ID NO: 35506 - protein, 506 aa, Debaryomyces hansenii CBS767; identical to SEQ ID NO: 3758

SEQ ID NO: 35507 - DNA, 1353 bp, Yarrowia lipolytica CLIB99; identical to SEQ ID NO: 3759
  CDS (1)..(1353)

SEQ ID NO: 35508 - protein, 450 aa, Yarrowia lipolytica CLIB99; identical to SEQ ID NO: 3760

SEQ ID NO: 35509 - DNA, 1380 bp, Kluyveromyces lactis NRRL Y; identical to SEQ ID NO: 3761
  CDS (1)..(1380)

SEQ ID NO: 35510 - protein, 459 aa, Kluyveromyces lactis NRRL Y; identical to SEQ ID NO: 3762

SEQ ID NO: 35511 - DNA, 1431 bp, Candida glabrata CBS138; identical to SEQ ID NO: 3767
  CDS (1)..(1431)

SEQ ID NO: 35512 - protein, 476 aa, Candida glabrata CBS138; identical to SEQ ID NO: 3768

SEQ ID NO: 35513 - DNA, 1965 bp, Oryza sativa; identical to SEQ ID NO: 3773
  CDS (257)..(1726)

SEQ ID NO: 35514 - protein, 489 aa, Oryza sativa; identical to SEQ ID NO: 3774

SEQ ID NO: 35515 - DNA, 1374 bp, Cryptosporidium parvum; identical to SEQ ID NO: 15357
  CDS (1)..(1374)

SEQ ID NO: 35516 - protein, 457 aa, Cryptosporidium parvum; identical to SEQ ID NO: 15358

SEQ ID NO: 35517 - DNA, 1862 bp, Oryza sativa; identical to SEQ ID NO: 15359
  CDS (98)..(1573)

SEQ ID NO: 35518 - protein, 491 aa, Oryza sativa; identical to SEQ ID NO: 15360

SEQ ID NO: 35519 - DNA, 1497 bp, Ashbya gossypii; identical to SEQ ID NO: 3797
  CDS (1)..(1497)

SEQ ID NO: 35520 - protein, 498 aa, Ashbya gossypii; identical to SEQ ID NO: 3798

SEQ ID NO: 35521 - DNA, 1425 bp, Neurospora crassa; identical to SEQ ID NO: 3817
  CDS (1)..(1425)

SEQ ID NO: 35522 - protein, 474 aa, Neurospora crassa; identical to SEQ ID NO: 3818

SEQ ID NO: 35523 - DNA, 1831 bp, Arabidopsis thaliana; identical to SEQ ID NO: 3841
  CDS (116)..(1525)

SEQ ID NO: 35524 - protein, 469 aa, Arabidopsis thaliana; identical to SEQ ID NO: 3842

SEQ ID NO: 35525 - DNA, 1870 bp, Arabidopsis thaliana; identical to SEQ ID NO: 15367
  CDS (207)..(1607)

SEQ ID NO: 35526 - protein, 466 aa, Arabidopsis thaliana; identical to SEQ ID NO: 15368

SEQ ID NO: 35527 - DNA, 1711 bp, Cryptosporidium parvum; identical to SEQ ID NO: 3855
  CDS (290)..(1549)

SEQ ID NO: 35528 - protein, 419 aa, Cryptosporidium parvum; identical to SEQ ID NO: 3856

SEQ ID NO: 35529 - DNA, 1844 bp, Arabidopsis thaliana; identical to SEQ ID NO: 15371
  CDS (61)..(1521)

SEQ ID NO: 35530 - protein, 486 aa, Arabidopsis thaliana; identical to SEQ ID NO: 3858

SEQ ID NO: 35531 - DNA, 3183 bp, Arabidopsis thaliana; identical to SEQ ID NO: 15373
  CDS (1)..(3183)

SEQ ID NO: 35532 - protein, 1060 aa, Arabidopsis thaliana; identical to SEQ ID NO: 15374

SEQ ID NO: 35533 - DNA, 1629 bp, Arabidopsis thaliana; identical to SEQ ID NO: 15375
  CDS (1)..(1629)

SEQ ID NO: 35534 - protein, 542 aa, Arabidopsis thaliana; identical to SEQ ID NO: 15376

SEQ ID NO: 35535 - DNA, 1758 bp, Arabidopsis thaliana; identical to SEQ ID NO: 15377
  CDS (101)..(1552)

SEQ ID NO: 35536 - protein, 483 aa, Arabidopsis thaliana; identical to SEQ ID NO: 3864

SEQ ID NO: 35537 - DNA, 1398 bp, Arabidopsis thaliana; identical to SEQ ID NO: 3865
  CDS (1)..(1398)

SEQ ID NO: 35538 - protein, 465 aa, Arabidopsis thaliana; identical to SEQ ID NO: 3866

SEQ ID NO: 35539 - DNA, 1863 bp, Drosophila melanogaster; identical to SEQ ID NO: 15381
  CDS (77)..(1762)

SEQ ID NO: 35540 - protein, 561 aa, Drosophila melanogaster; identical to SEQ ID NO: 3868

SEQ ID NO: 35541 - DNA, 1847 bp, Homo sapiens; identical to SEQ ID NO: 15383
  CDS (45)..(1691)

SEQ ID NO: 35542 - protein, 548 aa, Homo sapiens; identical to SEQ ID NO: 15384

SEQ ID NO: 35543 - DNA, 23 bp, Artificial sequence
  (1)..(23): primer
atgtcccatcgtatagcaccttc

SEQ ID NO: 35544 - DNA, 27 bp, Artificial sequence
  (1)..(27): primer
tcaatcacaaccaaaatactttgaatc

SEQ ID NO: 35545 - protein, 466 aa, Artificial sequence; identical to SEQ ID NO: 15387
  Variant (2)..(4): xaa in position 2 to 4 is any amino acid
  Variant (5)..(8): xaa in position 5 to 8 is any or no amino acid
  Variant (10)..(12): xaa in position 10 to 12 is any amino acid
  Variant (16)..(38): xaa in position 16 to 38 is any amino acid
  Variant (41)..(57): xaa in position 41 to 57 is any amino acid
  Variant (60)..(60): xaa in position 60 is any amino acid
  Variant (62)..(78): xaa in position 62 to 78 is any amino acid
  Variant (80)..(84): xaa in position 80 to 84 is any amino acid
  Variant (86)..(86): xaa in position 86 is any amino acid
  Variant (88)..(88): xaa in position 88 is any amino acid
  Variant (90)..(110): xaa in position 90 to 110 is any amino acid
  Variant (114)..(124): xaa in position 114 to 124 is any amino acid
  Variant (126)..(134): xaa in position 126 to 134 is any amino acid
  Variant (135)..(163): xaa in position 135 to 163 is any or no amino acid
  Variant (165)..(165): xaa in position 165 is any amino acid
  Variant (167)..(168): xaa in position 167 to 168 is any amino acid
  Variant (170)..(170): xaa in position 170 is any amino acid
  Variant (173)..(174): xaa in position 173 to 174 is any amino acid
  Variant (177)..(180): xaa in position 177 to 180 is any amino acid
  Variant (183)..(189): xaa in position 183 to 189 is any amino acid
  Variant (191)..(194): xaa in position 191 to 194 is any amino acid
  Variant (198)..(214): xaa in position 198 to 214 is any amino acid
  Variant (216)..(219): xaa in position 216 to 219 is any amino acid
  Variant (221)..(222): xaa in position 221 to 222 is any amino acid
  Variant (224)..(234): xaa in position 224 to 234 is any amino acid
  Variant (236)..(293): xaa in position 236 to 293 is any amino acid
  Variant (295)..(297): xaa in position 295 to 297 is any amino acid
  Variant (299)..(341): xaa in position 299 to 341 is any amino acid
  Variant (342)..(361): xaa in position 342 to 361 is any or no amino acid
  Variant (363)..(363): xaa in position 363 is any amino acid
  Variant (365)..(380): xaa in position 365 to 380 is any amino acid
  Variant (382)..(383): xaa in position 382 to 383 is any amino acid
  Variant (385)..(400): xaa in position 385 to 400 is any amino acid
  Variant (401)..(423): xaa in position 401 to 423 is any or no amino acid
  Variant (425)..(451): xaa in position 425 to 451 is any amino acid
  Variant (453)..(455): xaa in position 453 to 455 is any amino acid
  Variant (457)..(465): xaa in position 457 to 465 is any amino acid

SEQ ID NO: 35546 - protein, 528 aa, Artificial sequence; identical to SEQ ID NO: 15388
  Variant (3)..(4): xaa in position 3 to 4 is any amino acid
  Variant (5)..(8): xaa in position 5 to 8 is any or no amino acid
  Variant (10)..(12): xaa in position 10 to 12 is any amino acid
  Variant (17)..(17): xaa in position 17 is any amino acid
  Variant (19)..(21): xaa in position 19 to 21 is any amino acid
  Variant (23)..(31): xaa in position 23 to 31 is any amino acid
  Variant (33)..(36): xaa in position 33 to 36 is any amino acid
  Variant (38)..(38): xaa in position 38 is any amino acid
  Variant (41)..(42): xaa in position 41 to 42 is any amino acid
  Variant (44)..(55): xaa in position 44 to 55 is any amino acid
  Variant (57)..(57): xaa in position 57 is any amino acid
  Variant (60)..(60): xaa in position 60 is any amino acid
  Variant (62)..(62): xaa in position 62 is any amino acid
  Variant (64)..(64): xaa in position 64 is any amino acid
  Variant (66)..(75): xaa in position 66 to 75 is any amino acid
  Variant (77)..(78): xaa in position 77 to 78 is any amino acid
  Variant (80)..(84): xaa in position 80 to 84 is any amino acid
  Variant (86)..(86): xaa in position 86 is any amino acid
  Variant (88)..(88): xaa in position 88 is any amino acid
  Variant (90)..(91): xaa in position 90 to 91 is any amino acid
  Variant (93)..(106): xaa in position 93 to 106 is any amino acid
  Variant (108)..(110): xaa in position 108 to 110 is any amino acid
  Variant (114)..(117): xaa in position 114 to 117 is any amino acid
  Variant (119)..(124): xaa in position 119 to 124 is any amino acid
  Variant (126)..(128): xaa in position 126 to 128 is any amino acid
  Variant (130)..(131): xaa in position 130 to 131 is any amino acid
  Variant (134)..(134): xaa in position 134 is any amino acid
  Variant (135)..(163): xaa in position 135 to 163 is any or no amino acid
  Variant (165)..(165): xaa in position 165 is any amino acid
  Variant (167)..(168): xaa in position 167 to 168 is any amino acid
  Variant (170)..(170): xaa in position 170 is any amino acid
  Variant (173)..(174): xaa in position 173 to 174 is any amino acid
  Variant (177)..(179): xaa in position 177 to 179 is any amino acid
  Variant (183)..(189): xaa in position 183 to 189 is any amino acid
  Variant (191)..(194): xaa in position 191 to 194 is any amino acid
  Variant (198)..(204): xaa in position 198 to 204 is any amino acid
  Variant (206)..(209): xaa in position 206 to 209 is any amino acid
  Variant (212)..(214): xaa in position 212 to 214 is any amino acid
  Variant (216)..(219): xaa in position 216 to 219 is any amino acid
  Variant (221)..(222): xaa in position 221 to 222 is any amino acid
  Variant (224)..(229): xaa in position 224 to 229 is any amino acid
  Variant (231)..(234): xaa in position 231 to 234 is any amino acid
  Variant (236)..(245): xaa in position 236 to 245 is any amino acid
  Variant (247)..(271): xaa in position 247 to 271 is any amino acid
  Variant (273)..(273): xaa in position 273 is any amino acid
  Variant (275)..(279): xaa in position 275 to 279 is any amino acid
  Variant (281)..(290): xaa in position 281 to 290 is any amino acid
  Variant (293)..(293): xaa in position 293 is any amino acid
  Variant (296)..(297): xaa in position 296 to 297 is any amino acid
  Variant (299)..(307): xaa in position 299 to 307 is any amino acid
  Variant (309)..(341): xaa in position 309 to 341 is any amino acid
  Variant (342)..(361): xaa in position 342 to 361 is any or no amino acid
  Variant (363)..(363): xaa in position 363 is any amino acid
  Variant (365)..(370): xaa in position 365 to 370 is any amino acid
  Variant (372)..(379): xaa in position 372 to 379 is any amino acid
  Variant (383)..(383): xaa in position 383 is any amino acid
  Variant (386)..(391): xaa in position 386 to 391 is any amino acid
  Variant (393)..(394): xaa in position 393 to 394 is any amino acid
  Variant (395)..(417): xaa in position 395 to 417 is any or no amino acid
  Variant (419)..(422): xaa in position 419 to 422 is any amino acid
  Variant (425)..(426): xaa in position 425 to 426 is any amino acid
  Variant (428)..(434): xaa in position 428 to 434 is any amino acid
  Variant (436)..(436): xaa in position 436 is any amino acid
  Variant (438)..(438): xaa in position 438 is any amino acid
  Variant (440)..(445): xaa in position 440 to 445 is any amino acid
  Variant (447)..(451): xaa in position 447 to 451 is any amino acid
  Variant (453)..(455): xaa in position 453 to 455 is any amino acid
  Variant (457)..(460): xaa in position 457 to 460 is any amino acid
  Variant (462)..(465): xaa in position 462 to 465 is any amino acid
  Variant (467)..(476): xaa in position 467 to 476 is any amino acid
  Variant (478)..(484): xaa in position 478 to 484 is any amino acid
  Variant (486)..(525): xaa in position 486 to 525 is any amino acid

SEQ ID NO: 35547 - protein, 45 aa, Artificial sequence; identical to SEQ ID NO: 15389
  Variant (1)..(1): xaa in position 1 is Phe, Tyr, Ser or Arg
  Variant (2)..(2): xaa in position 2 is Val, Ile, Ala or Phe
  Variant (4)..(4): xaa in position 4 is Gly or Ala
  Variant (5)..(8): xaa in position 5 to 8 is any or no amino acid
  Variant (9)..(9): xaa in position 9 is Val, Ile or Leu
  Variant (10)..(10): xaa in position 10 is any amino acid
  Variant (12)..(12): xaa in position 12 is any amino acid
  Variant (13)..(13): xaa in position 13 is Ser, Ala or Thr
  Variant (14)..(14): xaa in position 14 is Ala, Gly or Ser
  Variant (18)..(19): xaa in position 18 to 19 is Thr or Ser
  Variant (20)..(20): xaa in position 20 is Val or Leu
  Variant (21)..(21): xaa in position 21 is Cys, Ala or Ser
  Variant (22)..(23): xaa in position 22 to 23 is any amino acid
  Variant (24)..(24): xaa in position 24 is Ile or Leu
  Variant (25)..(25): xaa in position 25 is Ile, Val, Met or Phe
  Variant (26)..(27): xaa in position 26 to 27 is any amino acid
  Variant (28)..(28): xaa in position 28 is Leu or Ile
  Variant (29)..(30): xaa in position 29 to 30 is any amino acid
  Variant (31)..(31): xaa in position 31 is Pro, Gln, His or Lys
  Variant (32)..(32): xaa in position 32 is Trp, Arg or His
  Variant (33)..(33): xaa in position 33 is Val, Thr, Ala or Ile
  Variant (34)..(34): xaa in position 34 is Val or Thr
  Variant (35)..(35): xaa in position 35 is Leu, Val or Ile
  Variant (36)..(36): xaa in position 36 is Ile, Leu or Val
  Variant (37)..(37): xaa in position 37 is Ser, Asn, Glu or Thr
  Variant (38)..(38): xaa in position 38 is any amino acid
  Variant (39)..(39): xaa in position 39 is Asp or Glu
  Variant (40)..(40): xaa in position 40 is Ser, Asn or Cys
  Variant (43)..(44): xaa in position 43 to 44 is any amino acid
  Variant (45)..(45): xaa in position 45 is Leu, Pro or Val

SEQ ID NO: 35548 - protein, 78 aa, Artificial sequence; identical to SEQ ID NO: 15390
  Variant (1)..(1): xaa in position 1 is Tyr, Phe or His
  Variant (2)..(2): xaa in position 2 is Asn or Asp
  Variant (5)..(5): xaa in position 5 is any amino acid
  Variant (7)..(7): xaa in position 7 is any amino acid
  Variant (8)..(8): xaa in position 8 is Ala or Ser
  Variant (9)..(9): xaa in position 9 is any amino acid
  Variant (10)..(10): xaa in position 10 is Asp or Asn
  Variant (11)..(11): xaa in position 11 is any amino acid
  Variant (12)..(12): xaa in position 12 is Glu or Asp
  Variant (13)..(13): xaa in position 13 is any amino acid
  Variant (14)..(14): xaa in position 14 is Leu, Ala or Ile
  Variant (15)..(17): xaa in position 15 to 17 is any amino acid
  Variant (18)..(18): xaa in position 18 is Leu, Met, Val, Ile or Ala
  Variant (19)..(20): xaa in position 19 to 20 is any amino acid
  Variant (21)..(21): xaa in position 21 is Leu or Ile
  Variant (22)..(22): xaa in position 22 is Lys or Arg
  Variant (23)..(23): xaa in position 23 is any amino acid
  Variant (25)..(28): xaa in position 25 to 28 is any amino acid
  Variant (29)..(29): xaa in position 29 is Ile, Val or Met
  Variant (31)..(31): xaa in position 31 is any amino acid
  Variant (33)..(33): xaa in position 33 is Asp, Ser, Cys or Asn
  Variant (35)..(36): xaa in position 35 to 36 is any amino acid
  Variant (37)..(37): xaa in position 37 is His or Tyr
  Variant (38)..(38): xaa in position 38 is any amino acid
  Variant (39)..(39): xaa in position 39 is Arg, Ser or Asn
  Variant (40)..(44): xaa in position 40 to 44 is any amino acid
  Variant (45)..(46): xaa in position 45 to 46 is any or no amino acid
  Variant (47)..(47): xaa in position 47 is Val, Ile, Met or Leu
  Variant (48)..(48): xaa in position 48 is Tyr, Asn, Ser or Phe
  Variant (49)..(49): xaa in position 49 is Gly, Pro, Ala or Ser
  Variant (50)..(50): xaa in position 50 is any amino acid
  Variant (51)..(51): xaa in position 51 is Asp, Ser, Asn or His
  Variant (52)..(52): xaa in position 52 is Val or Ile
  Variant (53)..(53): xaa in position 53 is Ile, Val or Leu
  Variant (54)..(54): xaa in position 54 is Ile or Val
  Variant (55)..(55): xaa in position 55 is Leu, Phe, Ile or Val
  Variant (59)..(59): xaa in position 59 is Leu, Tyr, Phe or Met
  Variant (60)..(60): xaa in position 60 is any amino acid
  Variant (61)..(61): xaa in position 61 is Leu or Phe
  Variant (62)..(62): xaa in position 62 is any amino acid
  Variant (63)..(63): xaa in position 63 is Asp, His or Ser
  Variant (64)..(65): xaa in position 64 to 65 is any amino acid
  Variant (66)..(66): xaa in position 66 is any or no amino acid
  Variant (67)..(67): xaa in position 67 is Val, Leu or Ile
  Variant (68)..(69): xaa in position 68 to 69 is any amino acid
  Variant (71)..(71): xaa in position 71 is Met, Leu or Ile
  Variant (72)..(72): xaa in position 72 is Asp or Asn
  Variant (73)..(73): xaa in position 73 is Met, Leu, Ile or Val
  Variant (74)..(74): xaa in position 74 is Lys or Ser
  Variant (75)..(75): xaa in position 75 is Ile or Val
  Variant (76)..(76): xaa in position 76 is Phe or Tyr
  Variant (77)..(77): xaa in position 77 is Val, Cys or Leu
  Variant (78)..(78): xaa in position 78 is Asp, Cys or Glu

SEQ ID NO: 35549 - protein, 72 aa, Artificial sequence; identical to SEQ ID NO: 15391
  Variant (2)..(2): xaa in position 2 is any amino acid
  Variant (4)..(4): xaa in position 4 is Ile, Val, Thr or Leu
  Variant (5)..(5): xaa in position 5 is Arg or Cys
  Variant (7)..(7): xaa in position 7 is Ala, Ser, Val or Thr
  Variant (10)..(10): xaa in position 10 is Ile or Leu
  Variant (11)..(11): xaa in position 11 is any amino acid
  Variant (14)..(16): xaa in position 14 to 16 is any amino acid
  Variant (17)..(17): xaa in position 17 is Arg, Lys or Asn
  Variant (20)..(20): xaa in position 20 is Asp, Gln, Asn or Glu
  Variant (21)..(21): xaa in position 21 is Ile, Leu, Val or Met
  Variant (22)..(23): xaa in position 22 to 23 is any amino acid
  Variant (24)..(24): xaa in position 24 is Val, Ile, Cys or Ala
  Variant (25)..(25): xaa in position 25 is Leu, Ile or Met
  Variant (26)..(26): xaa in position 26 is any amino acid
  Variant (28)..(28): xaa in position 28 is Tyr or Trp
  Variant (29)..(31): xaa in position 29 to 31 is any amino acid
  Variant (35)..(35): xaa in position 35 is any amino acid
  Variant (36)..(36): xaa in position 36 is Phe, Ala or Tyr
  Variant (37)..(38): xaa in position 37 to 38 is any amino acid
  Variant (39)..(39): xaa in position 39 is Phe or Tyr
  Variant (40)..(40): xaa in position 40 is Val or Ile
  Variant (41)..(41): xaa in position 41 is any amino acid
  Variant (42)..(42): xaa in position 42 is Pro or Arg
  Variant (43)..(46): xaa in position 43 to 46 is any amino acid
  Variant (47)..(47): xaa in position 47 is Ala or Thr
  Variant (48)..(48): xaa in position 48 is Asp or Asn
  Variant (49)..(49): xaa in position 49 is Ile, Ala, Val or Leu
  Variant (50)..(50): xaa in position 50 is Ile, Val or Leu
  Variant (51)..(51): xaa in position 51 is Ile, Val or Phe
  Variant (53)..(53): xaa in position 53 is Arg, Ser or His
  Variant (54)..(54): xaa in position 54 is Gly, Met or Tyr
  Variant (55)..(55): xaa in position 55 is any amino acid
  Variant (56)..(56): xaa in position 56 is any or no amino acid
  Variant (58)..(58): xaa in position 58 is any amino acid
  Variant (59)..(59): xaa in position 59 is Val, Ile, Thr or Leu
  Variant (61)..(61): xaa in position 61 is Ile, Val, Thr or Met
  Variant (62)..(62): xaa in position 62 is any amino acid
  Variant (63)..(63): xaa in position 63 is Leu or Met
  Variant (64)..(64): xaa in position 64 is Ile, Val, Leu or Met
  Variant (65)..(65): xaa in position 65 is any amino acid
  Variant (66)..(66): xaa in position 66 is Gln, Asn or Lys
  Variant (67)..(67): xaa in position 67 is His, Phe or Asn
  Variant (68)..(68): xaa in position 68 is Ile, Val or Leu
  Variant (69)..(71): xaa in position 69 to 71 is any amino acid

SEQ ID NO: 35550 - protein, 42 aa, Artificial sequence; identical to SEQ ID NO: 15392
  Variant (1)..(1): xaa in position 1 is Leu, Ile or Val
  Variant (2)..(3): xaa in position 2 to 3 is any amino acid
  Variant (4)..(4): xaa in position 4 is Leu, Ile or Val
  Variant (5)..(6): xaa in position 5 to 6 is any amino acid
  Variant (7)..(7): xaa in position 7 is Thr, Asn or Ser
  Variant (8)..(8): xaa in position 8 is any amino acid
  Variant (9)..(9): xaa in position 9 is Gln, His or Glu
  Variant (10)..(12): xaa in position 10 to 12 is any amino acid
  Variant (13)..(13): xaa in position 13 is Met, Leu or Ile
  Variant (14)..(14): xaa in position 14 is any amino acid
  Variant (15)..(15): xaa in position 15 is Thr or Ser
  Variant (16)..(16): xaa in position 16 is any amino acid
  Variant (17)..(17): xaa in position 17 is Ile, Leu or Val
  Variant (18)..(25): xaa in position 18 to 25 is any amino acid
  Variant (26)..(26): xaa in position 26 is Asp, Glu or Asn
  Variant (27)..(27): xaa in position 27 is Phe, Trp, Leu or His
  Variant (28)..(28): xaa in position 28 is any amino acid
  Variant (30)..(30): xaa in position 30 is Tyr, Phe, Trp or Gln
  Variant (31)..(32): xaa in position 31 to 32 is any amino acid
  Variant (34)..(34): xaa in position 34 is Leu, Ile or Phe
  Variant (35)..(35): xaa in position 35 is any amino acid
  Variant (36)..(36): xaa in position 36 is Arg, Thr or Ile
  Variant (37)..(37): xaa in position 37 is Leu, Ile or Met
  Variant (38)..(38): xaa in position 38 is Val, Leu or Ile
  Variant (39)..(39): xaa in position 39 is Val, Ile, Met or Leu
  Variant (40)..(41): xaa in position 40 to 41 is any amino acid
  Variant (42)..(42): xaa in position 42 is Ala, Gly, Cys or Thr

SEQ ID NO: 35551 - protein, 29 aa, Artificial sequence
  Variant (1)..(1): xaa in position 1 is Gly or Ala
  Variant (2)..(2): xaa in position 2 is Val, Ile or Leu
  Variant (3)..(3): xaa in position 3 is any amino acid
  Variant (4)..(4): xaa in position 4 is Ile, Val or Thr
  Variant (5)..(5): xaa in position 5 is Ile, Leu, Val or Met
  Variant (7)..(7): xaa in position 7 is Ser, Ala or Gly
  Variant (9)..(10): xaa in position 9 to 10 is any amino acid
  Variant (11)..(11): xaa in position 11 is Met, Phe or Leu
  Variant (12)..(12): xaa in position 12 is Glu, Met or Asp
  Variant (13)..(13): xaa in position 13 is any amino acid
  Variant (14)..(14): xaa in position 14 is Ala, Ser or Gly
  Variant (15)..(15): xaa in position 15 is Leu, Val or Ile
  Variant (16)..(19): xaa in position 16 to 19 is any amino acid
  Variant (20)..(20): xaa in position 20 is Lys, Pro or Asn
  Variant (21)..(24): xaa in position 21 to 24 is any amino acid
  Variant (26)..(26): xaa in position 26 is Lys, Thr or Arg
  Variant (27)..(27): xaa in position 27 is Ile, Leu or Val
  Variant (29)..(29): xaa in position 29 is Ile, Leu or Val
XXXXXRXGXXXXXXXXXXXXXXXXGXXLX

SEQ ID NO: 35552 - protein, 49 aa, Artificial sequence; identical to SEQ ID NO: 15394
  Variant (1)..(1): xaa in position 1 is Leu or Ile
  Variant (2)..(2): xaa in position 2 is His, Ile, Tyr or Val
  Variant (3)..(5): xaa in position 3 to 5 is any amino acid
  Variant (6)..(6): xaa in position 6 is Leu, Ile or Phe
  Variant (8)..(9): xaa in position 8 to 9 is any amino acid
  Variant (10)..(10): xaa in position 10 is Ile or Leu
  Variant (11)..(14): xaa in position 11 to 14 is any amino acid
  Variant (15)..(17): xaa in position 15 to 17 is any or no amino acid
  Variant (18)..(18): xaa in position 18 is Val or Ile
  Variant (19)..(19): xaa in position 19 is Leu, Phe, Ile or Val
  Variant (20)..(20): xaa in position 20 is Leu or Ile
  Variant (21)..(21): xaa in position 21 is Leu, Met, Phe or Cys
  Variant (22)..(22): xaa in position 22 is Asp, Ala or Glu
  Variant (23)..(24): xaa in position 23 to 24 is any amino acid
  Variant (25)..(25): xaa in position 25 is Leu, Ile, Val or Met
  Variant (26)..(26): xaa in position 26 is any amino acid
  Variant (27)..(27): xaa in position 27 is any or no amino acid
  Variant (28)..(28): xaa in position 28 is Thr, Ser, Asn or Ala
  Variant (29)..(29): xaa in position 29 is Gly or His
  Variant (30)..(31): xaa in position 30 to 31 is any amino acid
  Variant (32)..(32): xaa in position 32 is Ala, Val, Met or Ile
  Variant (33)..(34): xaa in position 33 to 34 is any amino acid
  Variant (36)..(36): xaa in position 36 is Ile, Val or Thr
  Variant (37)..(37): xaa in position 37 is any amino acid
  Variant (38)..(38): xaa in position 38 is Val, Leu, Tyr or Ile
  Variant (40)..(40): xaa in position 40 is Leu, Ile, Val or Thr
  Variant (41)..(43): xaa in position 41 to 43 is any amino acid
  Variant (44)..(44): xaa in position 44 is Val or Ile
  Variant (45)..(48): xaa in position 45 to 48 is any amino acid

SEQ ID NO: 35553 - DNA, 2376 bp, Saccharomyces cerevisiae
  CDS (1)..(2376)
atggtagcgacatcttcaaagaggacgttggatccgaaggaggaacatttgcctgctgacaaaacatccactaattcaagcaacactataatatctgagttggcaacacaagagaaatccagctctagtggtactacactaaaattaatagctcttaatatcaagtccatatcagatgaagatgtgggatatatccaaaatgttgaaagactgtctttaaggaaaaatcacttaacatccttaccagcgagtttcaagaggttatcaaggctgcaatatctggatttgcataataacaattttaaagaaatcccatatattttgacacaatgccctcaattagagatcttggatctgtcctccaatgagattgaagcattgccagatgaaatatcatcgttttggcaagataatattcgtgtattatcattgaaagacaacaacgttactagcatacgtaatttgaaatcgatcacaaaattaaacaagctgagcatcttggatttagaggataataaaatacccaaagaagagcttgaccaagtacagagttatactccatttcatacgggcatccccaaagaagaatattgggcaattgcgatatcacgatatctaaaagatcatcctaacctacctactccagaacctaaaatatctagagcagcgaaaagaatgggattcataaatacgaacttgtctaatggagcaatgaatgaaaacaatataatttcacttgccccaagtgcaaatacaactataagtgcatctactgcaatggtctcatctaatcaaacctctgcaacatctttcagtggtacagtcaatgcagaatcagaacaaagtggggcagtgaatggtacggaactatacaatcacaccaaatataatgactacttcaagaggttgtcgattttaccagaagagtcaatgagtaacgggcatcaaaaaatatcgcatgcagagttggttgtttcctgtcggaagctcctatttagttttacagaatgccaacaagctatcagaaaaatcgcctctttctgtaaagagaaggccgtagcggttaatgtagtatcattattatactctgtcagatcacatactgataatctggtggaggtcttgcagcaaacagagaacgaagacgaatcgcatgatcaggcgttaatcaagctgtgcctcactatcatcacaaattttaaacaaattataacattgttgagaaaaaattttgagatttttttcaaagaagacgatctatgcttcataaggatgttttatatgacattaatgtgtgcttatatggaaatgtataatgcatggtcttttatcaaagaagatgatcaagtgtccggttctgcaagtaaggcacccaagaaacattctttttcgaggcacgagacatcgtccagtagtatcacaagcggtggaggacccgcagcaagtacgaccagtacacattgtagcggaaacataaaattactgccgaaaacaaggagcacaagaacaccatctgcatctgcattgctttcaaatagtaatattctgacgggtgataccactgctgttcctcttttatcaccaaatctaaatggtgcacacacccatggtccaattttgggacaccaaaatgcaataagcaatggaagttctcaaacgaacatgaatgaagtaaaaactactagcgatactattccaaggcaacagctgcttcagcacaataaatccatcagcgattcgaaaaaagagtcacaggcgcatgaacctaaacagcatccggttatgacttcttcaataattaacgcatcaaatagtaataacgtctcgaatgttaatataaccccaccaccgatgaatggtggtggtgccgcgaacagtagtgctaatgtagtggagacaaatattgacattcaactgtatcaaacgttgtccacagtagttaaaatggtgagcgttgtatataaccagttaacttcagagatatccaagatagccattgctagcaccatgggaaagcaaattttgacggactcgctagcacctaaaattcgtgatttgacggaaacatgtcgtcaagcgatggatttatccaaacaattgaatgaaaggttaaatgtattaataccgaacgattcaaattcagagaagtatctgacatctttggagaagctgaaaacgtgggagataatgaattcgttcttaaaagtaataatatcaattctggctaatactaaaatcgtaatgagcgacgtgcctaatttgaatgagctgagacctaacctagccaacttggcgaagattaccaaggatgtcactgtgatattggacttgagttcatacaaggctgtatcagtaagcgccaactctccggagtaa

SEQ ID NO: 35554 - protein, 791 aa, Saccharomyces cerevisiae
MVATSSKRTLDPKEEHLPADKTSTNSSNTIISELATQEKSSSSGTTLKLIALNIKSISDEDVGYIQNVERLSLRKNHLTSLPASFKRLSRLQYLDLHNNNFKEIPYILTQCPQLEILDLSSNEIEALPDEISSFWQDNIRVLSLKDNNVTSIRNLKSITKLNKLSILDLEDNKIPKEELDQVQSYTPFHTGIPKEEYWAIAISRYLKDHPNLPTPEPKISRAAKRMGFINTNLSNGAMNENNIISLAPSANTTISASTAMVSSNQTSATSFSGTVNAESEQSGAVNGTELYNHTKYNDYFKRLSILPEESMSNGHQKISHAELVVSCRKLLFSFTECQQAIRKIASFCKEKAVAVNVVSLLYSVRSHTDNLVEVLQQTENEDESHDQALIKLCLTIITNFKQIITLLRKNFEIFFKEDDLCFIRMFYMTLMCAYMEMYNAWSFIKEDDQVSGSASKAPKKHSFSRHETSSSSITSGGGPAASTTSTHCSGNIKLLPKTRSTRTPSASALLSNSNILTGDTTAVPLLSPNLNGAHTHGPILGHQNAISNGSSQTNMNEVKTTSDTIPRQQLLQHNKSISDSKKESQAHEPKQHPVMTSSIINASNSNNVSNVNITPPPMNGGGAANSSANVVETNIDIQLYQTLSTVVKMVSVVYNQLTSEISKIAIASTMGKQILTDSLAPKIRDLTETCRQAMDLSKQLNERLNVLIPNDSNSEKYLTSLEKLKTWEIMNSFLKVIISILANTKIVMSDVPNLNELRPNLANLAKITKDVTVILDLSSYKAVSVSANSPE

SEQ ID NO: 35555 - DNA, 717 bp, Danio rerio
  CDS (1)..(717)
atggggaacagtgcgctcaaagctcatttggaaacatctcagaagactggagtctttcagctgaccggaaagggtttgacagagttcccagaggacctgcagaagctcacagcaaacctgcggacagtcgatctgtccaacaacaagatcgaggagcttccagcgttcataggaagcttccagcatctcaagagttttaccataagctgcaataaactgaccagtctaccaaatgacattggcaagctcaagaagctggaaacccttattttaaatggaaaccagctaaaacagcttccttcttcaattggtcaactcaagtccttgcgcacactgagcctgtccggcaaccagttcaaagagtttcccagtggcttgggcacccttcgccagcttgatgttctggatctttccaaaaatcagatccgagtggttcctgcagaggtggccgaactgcaagccattgaaatcaacctcaatcagaatcagatttcaagcgtgactcaagaggtgtctcgcacacccagactgaaagtcttgcggctagaggagaactgtctggagctctcctctatccccctctccatcctcacagactcccaggtgtccctgctgtctgtcgagggcaatttgtttgaggtcaaaaagatgcgtgacctggaaggatacgataaatatatggagcgtttcactgcaaccaagaagaaatttgcgtga

SEQ ID NO: 35556 - protein, 238 aa, Danio rerio
MGNSALKAHLETSQKTGVFQLTGKGLTEFPEDLQKLTANLRTVDLSNNKIEELPAFIGSFQHLKSFTISCNKLTSLPNDIGKLKKLETLILNGNQLKQLPSSIGQLKSLRTLSLSGNQFKEFPSGLGTLRQLDVLDLSKNQIRVVPAEVAELQAIEINLNQNQISSVTQEVSRTPRLKVLRLEENCLELSSIPLSILTDSQVSLLSVEGNLFEVKKMRDLEGYDKYMERFTATKKKFA

SEQ ID NO: 35557 - DNA, 1506 bp, Caenorhabditis elegans
  CDS (1)..(1506)
atgggaattgattcctacaatccaacagtgcgtgcacgccttgcaaatgcttctaaaacgcgagtcctgagcctgaaggagtctgccctgcaccgtattcctgatgacgtgaaagatctaacaatgttgaagcatctggatatgagtattaattatctgactcaacttcccccgtttattgggtcaatgtctcatcttaagaatttaaatttgtccagaaatcaactagaatctcttcctttggagatcaactccctggcgtgtcttgaagttttaaatgtctcacaaaacaaactgacagagcttcccgatctgtcacagtgtgtctcattaaagacagtagaggcgatagaaaaccaattcatcatcttcccagctggtgtgtgcaaatgtccaaatctcgaaacatgcttgttaactgaaaatcggatcgagaaacttccagacgaaattcattcgctacgggcaattagcgtgatcctcaacaaaaaccggcttctctctctcaacaccgctaatttgcttcgctgtgaacgcttgcgtgcagtaaacgtggacgataaccaactaaatcgcgacgaaattgaacaattccttgtgaatgcgccacgagaaattcgtatttcatttgaaagaaatgtttcgcaaatgcatacaactgatttgcaggtttgttcgggttcaatttttatttttatctatactacatgccttactgaaatgggaaacgattcatctaaaacaaaatcaattggtgataatgcacggaagattattggaaaatccggtccatcgacatcaacggtcaataagcatctcgaaatggcaagcaaaagtcggattcttcagctaaaaggaactgggctcaagaaagttcctgacgaaatcgaaccattagctgatgttctccgcaacttggaactcagtgaaaacaaaattcgagaaattcctatctttattggtcaattttctcaactcaagcaacttcatttggctaataactgtcttgaatttctacctgatgaacttggatcgatgaaaaagctggagattttgaatttggcgggaaacaagctgaaagcgttgcccgacacaattgtcggttgcaccgatttgaaaaccatcgacttatcatccaacgttttcaccgtttttcctgtagcagtgattggctgtttgcaattggatatactcaatttaaatggaaaccaaattgaatctctccctgacgatatatccaatttgaaagttatcgagttaagtctgaatcaaaatcgactgagctccttaaatccatcaaatcttgccaaaactacacgactgaggactcttcgtctcgatgaaaactgtttggagaagtcggagttcactcgcgatttactagaatcttcaacaatttccgtgatgtcatacgacggaaatcgattccaattgaaagattttcaagatttaccaggatatgatgcttatcaagaacgtttcactgctactaaacgtaaaatctaa

SEQ ID NO: 35558 - protein, 501 aa, Caenorhabditis elegans
MGIDSYNPTVRARLANASKTRVLSLKESALHRIPDDVKDLTMLKHLDMSINYLTQLPPFIGSMSHLKNLNLSRNQLESLPLEINSLACLEVLNVSQNKLTELPDLSQCVSLKTVEAIENQFIIFPAGVCKCPNLETCLLTENRIEKLPDEIHSLRAISVILNKNRLLSLNTANLLRCERLRAVNVDDNQLNRDEIEQFLVNAPREIRISFERNVSQMHTTDLQVCSGSIFIFIYTTCLTEMGNDSSKTKSIGDNARKIIGKSGPSTSTVNKHLEMASKSRILQLKGTGLKKVPDEIEPLADVLRNLELSENKIREIPIFIGQFSQLKQLHLANNCLEFLPDELGSMKKLEILNLAGNKLKALPDTIVGCTDLKTIDLSSNVFTVFPVAVIGCLQLDILNLNGNQIESLPDDISNLKVIELSLNQNRLSSLNPSNLAKTTRLRTLRLDENCLEKSEFTRDLLESSTISVMSYDGNRFQLKDFQDLPGYDAYQERFTATKRKI

SEQ ID NO: 35559 - DNA, 684 bp, Caenorhabditis elegans
  CDS (1)..(684)
atggcaagcaaaagtcggattcttcagctaaaaggaactgggctcaagaaagttcctgacgaaatcgaaccattagctgatgttctccgcaacttggaactcagtgaaaacaaaattcgagaaattcctatctttattggtcaattttctcaactcaagcaacttcatttggctaataactgtcttgaatttctacctgatgaacttggatcgatgaaaaagctggagattttgaatttggcgggaaacaagctgaaagcgttgcccgacacaattgtcggttgcaccgatttgaaaaccatcgacttatcatccaacgttttcaccgtttttcctgtagcagtgattggctgtttgcaattggatatactcaatttaaatggaaaccaaattgaatctctccctgacgatatatccaatttgaaagttatcgagttaagtctgaatcaaaatcgactgagctccttaaatccatcaaatcttgccaaaactacacgactgaggactcttcgtctcgatgaaaactgtttggagaagtcggagttcactcgcgatttactagaatcttcaacaatttccgtgatgtcatacgacggaaatcgattccaattgaaagattttcaagatttaccaggatatgatgcttatcaagaacgtttcactgctactaaacgtaaaatctaa

SEQ ID NO: 35560 - protein, 227 aa, Caenorhabditis elegans
MASKSRILQLKGTGLKKVPDEIEPLADVLRNLELSENKIREIPIFIGQFSQLKQLHLANNCLEFLPDELGSMKKLEILNLAGNKLKALPDTIVGCTDLKTIDLSSNVFTVFPVAVIGCLQLDILNLNGNQIESLPDDISNLKVIELSLNQNRLSSLNPSNLAKTTRLRTLRLDENCLEKSEFTRDLLESSTISVMSYDGNRFQLKDFQDLPGYDAYQERFTATKRKI

SEQ ID NO: 35561 - DNA, 720 bp, Homo sapiens
  CDS (1)..(720)
atgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaattttgcgtga

SEQ ID NO: 35562 - protein, 239 aa, Homo sapiens
MGNSALRAHVETAQKTGVFQLKDRGLTEFPADLQKLTSNLRTIDLSNNKIESLPPLLIGKFTLLKSLSLNNNKLTVLPDEICNLKKLETLSLNNNHLRELPSTFGQLSALKTLSLSGNQLGALPPQLCSLRHLDVMDLSKNQIRSIPDSVGELQVIELNLNQNQISQISVKISCCPRLKILRLEENCLELSMLPQSILSDSQICLLAVEGNLFEIKKLRELEGYDKYMERFTATKKNFA

SEQ ID NO: 35563 - DNA, 1272 bp, Leptospira interrogans serovar Lai str. 56601
  CDS (1)..(1272): transl_table=11
atgaattatagatttacaaacatcctaaaggttataattttcttttgttttattttcgaaatacaatcagaagaaatacaaaaaccttataaaaatttagcaaaggctcttcaaaatccagcagacgttcggaacttagatttgagtttccaagggttgaagacgttgccaaacaaaataggacaacttaagaatttacaaaaattggatttaggcggaaacgaacctacgattttgtctaaagaaatctggcagttaaaagatctgcaaaaattgaatttgaacaataacaaacttacggttctccctaaggaaatcggacaattacaaaacttgcaagaattaagtttgcatagcaatgagctcgtaaatcttccgaaagagattggacagtttaagaatttgcaaaaactaaatttggacaataataaacttacggttctccctaaggaaatcggacaattacaaaacttgcaagaattgagtttacttagtaacaaactcataagtcttcccacagaaattgaacaacttaaaagtctgaagaatctagatttgaatcacaatgaattaactactgtttcgaaagaagttatgctacttgaaactttagaaaatttagatctaagatccaacaaactgaaaacaattcctaaagagataagacaacttaaaagtttgaaagtgttgatgttaactggcaatcaacttacttctttgccgaaagaaatcgaacaactccaaaatctaaaaacattaaatttgggagaaaatcgttttcaaatacttcccgtagaaattttagaacttaagaatttactggaattgaatttgtattataaccaacttgtagagtttccgaaggaagttggacaacttaaaagtttaaagtatttgagtttgtatcacaatcaaattacaactcttccggtagaagttacacaattgccggatttgcaagagctgcatttgtctgggaataaaattacgattcttccaaaagagattctacaacttaaaaatttagaatggctgtcattgagtaacaataaactcaatgcgcttccgaaagaaatcggacagttgaaaaaattacaaaggttggaattaggaaacaatcagcttacgacccttccgaaagaaatagaacaacttaaaaatttacaaagattagaattagattccaatcccatttctccaaaagaaaaagaaagaatccgaaaacttcttcctaaatgtgaaatcgattttgaaggagggggaggagaatag

SEQ ID NO: 35564 - protein, 423 aa, Leptospira interrogans serovar Lai str. 56601
MNYRFTNILKVIIFFCFIFEIQSEEIQKPYKNLAKALQNPADVRNLDLSFQGLKTLPNKIGQLKNLQKLDLGGNEPTILSKEIWQLKDLQKLNLNNNKLTVLPKEIGQLQNLQELSLHSNELVNLPKEIGQFKNLQKLNLDNNKLTVLPKEIGQLQNLQELSLLSNKLISLPTEIEQLKSLKNLDLNHNELTTVSKEVMLLETLENLDLRSNKLKTIPKEIRQLKSLKVLMLTGNQLTSLPKEIEQLQNLKTLNLGENRFQILPVEILELKNLLELNLYYNQLVEFPKEVGQLKSLKYLSLYHNQITTLPVEVTQLPDLQELHLSGNKITILPKEILQLKNLEWLSLSNNKLNALPKEIGQLKKLQRLELGNNQLTTLPKEIEQLKNLQRLELDSNPISPKEKERIRKLLPKCEIDFEGGGGE

SEQ ID NO: 35565 - DNA, 1497 bp, Leptospira interrogans serovar Lai str. 56601
  CDS (1)..(1497): transl_table=11
atgaacttccgcataacgttaatttacttacaaaaaataacaattggtcttttgcttctcattactctttcttgcgagattcaagcagaagaagtagaaccaggaacttatagggatttaacaaaagcgctccaaaatcctttggatgttcgagttttgaatttgagtggagaaaaactcacagctcttcccaaagaaatcggacagctgaagaatttacaagagttgaatttaaaatggaacctactcacagttcttccaaaggaaattggacaactggagaatttacaggaattagatttacgtgataaccaactcgcaacttttcctgccgtaatagtagagttacagaagttagaaagtttggatttatctgagaaccgactcataatacttcctaacgaaataggacggctacagaatttacaagatttgggtttgtataaaaacaaacttactacttttccaaaggaaatagggcagttacagaatttacaaaagttatggttatctgagaaccgactcacagcacttcctaaggaaattggtcaattgaagaatttacaaacattggatttgcaggataaccaattcacgatacttccaaaagaaataggacaattacagaatttacaaacattgaatttgagcgataaccaactcgcaactcttcctgtcgaaatcggacaactacagaatttacaagagttgtatttgcggaataaccgactcacagtttttccaaaggaaataggacaactacagaatttgcaaatgttatgttcacctgaaaaccgtctcacagcacttcctaaagaaatggggcagctacagaatttacaaacattgaatttggtgaataaccgactcacagtttttcctaaggaaatcggacaactacagaatctgcaagatttggaattgctaatgaatcctctttccttaaaagaaagaaaaagaattcaaaagttgtttccagatagtaatcttgatttgagagaagtagcagagaacggtgtttaccgcaatttaaatctggctcaggaagaacctttaaaagtttttgaattgagtcttgaatacaaagatttttctcaatcgtttccaaaagtaattttgaaattccgaaatttacggggtttaaatttatacgactgcggattttcaactcttccgaaagaaatcagccgacttaaaaatttaaagtatttagccttaggcttaaatggtcttaaaaatattccttctgaaatcggccaactgaagaatttagaagctttgaatttagaagcaaacgaattggaaagacttcccaaagaaattgggcaactgcggaatttacagaagttaagtttacatcaaaatacattgaaaatatttcccgccgaaatcgaacaactgaaaaaattgcaaaagttagatttgagcgttaatcaattcacgacttttcctaaggaaatcggaaaattagaaaatttacaaacattgaatttataa

SEQ ID NO: 35566 - protein, 498 aa, Leptospira interrogans serovar Lai str. 56601
MNFRITLIYLQKITIGLLLLITLSCEIQAEEVEPGTYRDLTKALQNPLDVRVLNLSGEKLTALPKEIGQLKNLQELNLKWNLLTVLPKEIGQLENLQELDLRDNQLATFPAVIVELQKLESLDLSENRLIILPNEIGRLQNLQDLGLYKNKLTTFPKEIGQLQNLQKLWLSENRLTALPKEIGQLKNLQTLDLQDNQFTILPKEIGQLQNLQTLNLSDNQLATLPVEIGQLQNLQELYLRNNRLTVFPKEIGQLQNLQMLCSPENRLTALPKEMGQLQNLQTLNLVNNRLTVFPKEIGQLQNLQDLELLMNPLSLKERKRIQKLFPDSNLDLREVAENGVYRNLNLAQEEPLKVFELSLEYKDFSQSFPKVILKFRNLRGLNLYDCGFSTLPKEISRLKNLKYLALGLNGLKNIPSEIGQLKNLEALNLEANELERLPKEIGQLRNLQKLSLHQNTLKIFPAEIEQLKKLQKLDLSVNQFTTFPKEIGKLENLQTLNL

SEQ ID NO: 35567 - DNA, 1287 bp, Leptospira interrogans serovar Lai str. 56601
  CDS (1)..(1287): transl_table=11
atgaacttccgcataacgttgatttacttacaaaagattacaattggtcttttgtttctcattactctttcttgcgagattcaagcagacgaagtaaaaccaggaacttatatggatttaacaaaagcgctccaaaatcctttaaatgttcgagttttggatttgagtggacaaaatttcacaacacttcctaaggaaattgaacaactgaagaacttgcaaaagttgtatttatttgataaccgactcaaaactcttcctaaggaaatcggacaattgaaaaatttgcaagagttgaatttgagtagtaaccaactcacgatacttcctaaagaaatcggaaaactggaaaatttacaaagattggatttatatgataacagactcacgattcttcctatcgaaatcggaaaattacaaaatttgcaaacgttatatttaagtagtaaccagctgacaactcttcctagggaaagcggaaaactggagaatttgcaagagttgaatttaagtgataatcaactcacaactcttccacaagaaattggacaactacagaatttacaaacgttgaatttgaagagtaatcaacttacaactctttttaaagaaatagaacaattgaagaatttacaaacgttgaatttgagcgataaccaactcacaactcttccaattgaaatcggaaaactacaaaatttgcatacgttgaatttgagcgataaccaactcacaactcttccaattgaaatcggaaaactacaaaatttgcatacgttgaatttgagcgataaccaactcacaactcttccaattgaaatcggaaaactacaaaatttgcatacgttgaatttgagtggtaatcaacttacaacgctttcaattgaaatcggaaaactacagaacttacaagacttgaatttgcatagtaatcaactcacaaccctttctaaagaaattgaacagctaaaaaatttacaaacgttgagtttgagttataaccgactcgtaattcttcctaaggaaatcggacaactacagaatctgcaagagttgaatttatggaataaccaactcacagctcttcctatcgaaattggacaactacaaaatttacaaacgttgagtttgtataaaaacagactcatgacttttccgaaagaaattggacaattgaaaaacttgcaaacgttgtatttggggggtcataatcaattttcatctgaagaaaaagaaagaattcgaaaactgctaccgaattgcaaaatttactttggagataattag

SEQ ID NO: 35568 - protein, 428 aa, Leptospira interrogans serovar Lai str. 56601
MNFRITLIYLQKITIGLLFLITLSCEIQADEVKPGTYMDLTKALQNPLNVRVLDLSGQNFTTLPKEIEQLKNLQKLYLFDNRLKTLPKEIGQLKNLQELNLSSNQLTILPKEIGKLENLQRLDLYDNRLTILPIEIGKLQNLQTLYLSSNQLTTLPRESGKLENLQELNLSDNQLTTLPQEIGQLQNLQTLNLKSNQLTTLFKEIEQLKNLQTLNLSDNQLTTLPIEIGKLQNLHTLNLSDNQLTTLPIEIGKLQNLHTLNLSDNQLTTLPIEIGKLQNLHTLNLSGNQLTTLSIEIGKLQNLQDLNLHSNQLTTLSKEIEQLKNLQTLSLSYNRLVILPKEIGQLQNLQELNLWNNQLTALPIEIGQLQNLQTLSLYKNRLMTFPKEIGQLKNLQTLYLGGHNQFSSEEKERIRKLLPNCKIYFGDN

SEQ ID NO: 35569 - DNA, 870 bp, Leptospira interrogans serovar Lai str. 56601
  CDS (1)..(870): transl_table=11
atgacgtgctccaatctctacaaaatggattttacccttcgattcagaataaaatcctgcggagaatccacgatgaaatttcgcataacgttgatttacttacaaaaaataacaatcttccttttatttctcatttatttatcttgcgagattcaagcagaagcaccagaagacgaaccaggaacatatagggatttaacagaagcgctccaaaattctttggatgttcgaattttgattttgagtgaacaaaaacttacaactcttcctaagaaaattgaacaactaaagaatttacaaatgttggatttatgttataaccaatttaaaacagttcctaaagaaattgaacaactaaagaatttacaaatgttggatttatgttataaccaatttaaaacagttcctaagaaaattgggcaactaaagaatttgcaagtattgaatttgagtagtaaccagctcacaactcttccaaaggaaatcggaaaactggaaaatttgcaagtattgaatttgagtagtaaccagctcataacttttccaaaagaaatcggaaaactggaaaatttgcaagtattgaatttgggttctaaccgactcaaaacccttcctaaaggaattgagcaattgaaaaacttgcaaacgttgtatttgaattataaccaacttacgactcttcctcgtgagatcggtcgattacaaagtctaactaaattacatttgcagcataatcaaatagcgacactcccggacgaaatcatacaacttcaaaatttacggaaacttactttgtatgaaaatccgattccgccgcaagagctggacaaaatacgaaagcttcttccaaattgtgagattcgattttga

SEQ ID NO: 35570 - protein, 289 aa, Leptospira interrogans serovar Lai str. 56601
MTCSNLYKMDFTLRFRIKSCGESTMKFRITLIYLQKITIFLLFLIYLSCEIQAEAPEDEPGTYRDLTEALQNSLDVRILILSEQKLTTLPKKIEQLKNLQMLDLCYNQFKTVPKEIEQLKNLQMLDLCYNQFKTVPKKIGQLKNLQVLNLSSNQLTTLPKEIGKLENLQVLNLSSNQLITFPKEIGKLENLQVLNLGSNRLKTLPKGIEQLKNLQTLYLNYNQLTTLPREIGRLQSLTKLHLQHNQIATLPDEIIQLQNLRKLTLYENPIPPQELDKIRKLLPNCEIRF

SEQ ID NO: 35571 - DNA, 1281 bp, Leptospira interrogans serovar Lai str. 56601
  CDS (1)..(1281): transl_table=11
atgaatttccaatccataaacattcgtttaaataaaagactcatgattcttttgattctgatctgtttttcctgcaaactacaagcccaatctaacgaagtgcaaacatattatcgtaatataacagaggttcttaaaaatccacagaatgttcgaattctgaatttgagcggtagcaaactcacaacccttccgggagaaatcggaaaactgcaaaatttacaactgttgaatttagatgataaccaacttatagctcttccgaaagaaattggaaaacttcaaaatttacaacaattgcatttgagtaagaaccaactcatggcgcttccagaagaaatcggacaacttcagaatttacaaaagttgaaattgtatgaaaaccagcttacggccattcccaaagagattggacaactacaaaatttacaagagctgaatttggcacataaccaactcgcaactctaccagaagacatcgaacaattacaaagattacaaacattgtatttgggtcataaccaatttaactctattctcaaagagattggacaattacaaaatttagaatcattaggtttggatcataatcaacttaacgtccttcccaaagaaattggacaacttcgaaatttagaatcattaggtttggatcataaccaacttaacgtccttcccaaagaaattggacaacttcaaaatttacaaatattacatttgcgtaataaccaactcacaactcttcccaaagaaatcgggcagcttcagaatttacaaaagttacttttaaataaaaacaaactcacaactcttcccaaagaaattggtcagcttcagaatttacaaaagttgaaattgtatgaaaaccaacttacaacccttccgaaagagattggacaactacaaaatttacaagagttggatttagatggtaaccaactcacaactctaccagaaaacatcggacaattacagaggttacaaacgttgtatttgggtaataatcaacttaacttccttccaaataaagtagaacaactacaaaatttagaatcattagatctggagcataaccaacttaacgcccttcccaaagaaattggaaaattgcaaaagttgcaaaccctgaatttgaaatataatcaacttgcgactcttcccgaggagatcaaacaactaaagaacttaaaaaagttgtatttgcataacaacccacttccatcggaaaaaatagaaagaattcgaaaattacttccccaatgtaatatttattttgaatga

SEQ ID NO: 35572 - protein, 426 aa, Leptospira interrogans serovar Lai str. 56601
MNFQSINIRLNKRLMILLILICFSCKLQAQSNEVQTYYRNITEVLKNPQNVRILNLSGSKLTTLPGEIGKLQNLQLLNLDDNQLIALPKEIGKLQNLQQLHLSKNQLMALPEEIGQLQNLQKLKLYENQLTAIPKEIGQLQNLQELNLAHNQLATLPEDIEQLQRLQTLYLGHNQFNSILKEIGQLQNLESLGLDHNQLNVLPKEIGQLRNLESLGLDHNQLNVLPKEIGQLQNLQILHLRNNQLTTLPKEIGQLQNLQKLLLNKNKLTTLPKEIGQLQNLQKLKLYENQLTTLPKEIGQLQNLQELDLDGNQLTTLPENIGQLQRLQTLYLGNNQLNFLPNKVEQLQNLESLDLEHNQLNALPKEIGKLQKLQTLNLKYNQLATLPEEIKQLKNLKKLYLHNNPLPSEKIERIRKLLPQCNIYFE

SEQ ID NO: 35573 - DNA, 1227 bp, Leptospira interrogans serovar Lai str. 56601
  CDS (1)..(1227): transl_table=11
atgaaaccgaatttaatacgacaacgctgttttcaaaaagtggaaatcctttttttaatatttgtatgttcccttacgcaattccatgcggaagaaaatcacacaacgaaagaaggtctttatacaaatttaaccgaggctcttaaaaatccgaatgaggttcggattttagatttaagtagaagcaaactcaagattcttccgaaagaaatcgggcaactgcaaaatttacaaatcctgaattcagaaaataatcaactcacgacccttcccaaagaaatcggaaaattgcagaacttgcaagagttacatctgcagaataaccaactaacaacccttccagaagaaatagggcagttacagaatttaaaagtattacatttgaacaataatcaactcactactcttccagaagaaatcggaaaactacaaaatctacaagagttgaatttatttgttaatcgacttaacatccttccaaaggaaatcggacgactacaaaatttacaagagttatatttgtctcttaatcggcttacaatccttccagaagaaattggacaattagagagtttacgaaagttgagtttgggtggtaagaataagccattcacgattcttccaaaagaaatcacgcagcttcagaatttacaagagttgcatttgaaatttaaccggctcacggtccttcccaaagaaattggacaacttcaaaatttgcggatattagatttgtatcaaaaccgactcacgattcttccgaaagaaattggacaactcaaaaatttactagtattggatttgtctggtaaccaacttacaattcttccgaaagaaatcacacaacttcagaatttacaagaattgaatttggaatacaatcgattcgaagcttttccaaaagaaatcacacagtttcagaatttacaagtgttggatttgtatcaaaaccgactcacgactcttccaaaagaaattggacaattgcagaatttacaaaagttgcatttgagtagaaaccaacttacgactcttccgaaagagattggacgattgcaaaagttagaatcattgggtttggatcataatcaacttgcgactcttcccgaggagatcaaacaactaaagaacttaaaaaagttgtatttgcataacaacccacttctatcggaaaaaatagaaagaattcgaaaattacttccccaatgtattatttattttgaatga

SEQ ID NO: 35574 - protein, 408 aa, Leptospira interrogans serovar Lai str. 56601
MKPNLIRQRCFQKVEILFLIFVCSLTQFHAEENHTTKEGLYTNLTEALKNPNEVRILDLSRSKLKILPKEIGQLQNLQILNSENNQLTTLPKEIGKLQNLQELHLQNNQLTTLPEEIGQLQNLKVLHLNNNQLTTLPEEIGKLQNLQELNLFVNRLNILPKEIGRLQNLQELYLSLNRLTILPEEIGQLESLRKLSLGGKNKPFTILPKEITQLQNLQELHLKFNRLTVLPKEIGQLQNLRILDLYQNRLTILPKEIGQLKNLLVLDLSGNQLTILPKEITQLQNLQELNLEYNRFEAFPKEITQFQNLQVLDLYQNRLTTLPKEIGQLQNLQKLHLSRNQLTTLPKEIGRLQKLESLGLDHNQLATLPEEIKQLKNLKKLYLHNNPLLSEKIERIRKLLPQCIIYFE

SEQ ID NO: 35575 - DNA, 1134 bp, Leptospira interrogans serovar Lai str. 56601
  CDS (1)..(1134): transl_table=11
atgaacttccgcataacgttaattcacttacaaaaaattacaattggtcttttgtttctcattcatctttcttacgagattcaagcagaagaaccaggaacttatagagatttaacaaaagcgctccaaaatcctttggaggttcgagttttggatttgagtcgtcaagaactcaaaacccttcctatagaaatcggaaaattgaagaatctgcaaaggttgtatttacattataaccaacttacagttcttccacaagaaatagaacaactgaaaaatttacaattgttgtatttgcgttctaaccgactcactactcttcctaacgaaatcgagcaattgaagaacttgcaagttttggatttgggttctaaccaacttacaattcttccacaagaaatagaacagctgaaaaatttacaattgttgtatttgcattctaaccgactcactactctttctaaagacattgaacaactacagaatttgaaatcgttggatttgagtaataaccaacttacaactcttcctaacgaaatcgagcaattgaaaaacttgaaatcgttgtatttgagtgagaaccaattcgcaacttttcctaaagaaattggacaactacagaatttaaaagtgttgtttttgaataataaccaaatcacaatacttcccaacgaaatcgcaaaactaaaaaagctacaatacttatatttaagcgacaatcaactcataacccttccgaaagaaatagagcaattgaagaacttgcaaacgttggatttgagttataaccaacttacaatacttcctaaggaagtcggacaattagaaaatttgcaaacgttggatttgcgtaataaccaactcaaaactcttccgaaagaaatagagcaattgaagaacttacaaacgttgtttttgaataataaccaactcacaatacttccacaagaaatcggaaaactgaagaatttgttatggttgagtttggtttataaccaactcactactcttcctaacgaaatcgagcaattgaagaacttacaaacattgtatttaaacaacaaccaattctcatcccaagaaaaaaaaagaattcgaaaacttcttccaaagtgccaaatttcctttgaataa

SEQ ID NO: 35576 - protein, 377 aa, Leptospira interrogans serovar Lai str. 56601
MNFRITLIHLQKITIGLLFLIHLSYEIQAEEPGTYRDLTKALQNPLEVRVLDLSRQELKTLPIEIGKLKNLQRLYLHYNQLTVLPQEIEQLKNLQLLYLRSNRLTTLPNEIEQLKNLQVLDLGSNQLTILPQEIEQLKNLQLLYLHSNRLTTLSKDIEQLQNLKSLDLSNNQLTTLPNEIEQLKNLKSLYLSENQFATFPKEIGQLQNLKVLFLNNNQITILPNEIAKLKKLQYLYLSDNQLITLPKEIEQLKNLQTLDLSYNQLTILPKEVGQLENLQTLDLRNNQLKTLPKEIEQLKNLQTLFLNNNQLTILPQEIGKLKNLLWLSLVYNQLTTLPNEIEQLKNLQTLYLNNNQFSSQEKKRIRKLLPKCQISFE

SEQ ID NO: 35577 - DNA, 936 bp, Leptospira interrogans serovar Lai str. 56601
  CDS (1)..(936): transl_table=11
atgaactttcgcataactttgaattacttacaaaaaataacaattggtcttttgtttctcatgcatctttcttgcgagattcaagcagaggaatttgaacaacaagaaacttatacggatttaacaaaagcgctccaaaatcctttgaaggttcgaaccttggatttgagtgctaaccgattcaaaactcttcctaaggaaatcggaaaattgaaaaatttacaagagttgaatttgaataagaaccaactcacaactcttccacaagaaattggacaattgaagaatttgaaatcgttgaatttgagttataaccaaatcaaaactattccgaaagaaattgaaaaactacaaaagttgcaatcgttgggtttggataataaccaacttacaactcttccacaagaaattggacaactacagaacttgcaatcgttggatttgagtactaaccgactcacaactcttccacaagaaattggacatctacagaatttgcaagatttgtatttggtttctaaccaactcacaattcttcctaacgaaatcggacaattaaagaacttgcaaacgttgaatttgcgtaataaccgactcactactctttctaaagaaattgagcaactacagaatttgaaatcgttggatttgcgttctaaccaacttactacttttcctaaggaaatcgagcaattgaagaatttgcaagttttggatttgggttctaaccaactcactactcttccagagggaatcggacaattgaagaacttgcaaacattggatttggattctaaccaacttacaactcttccacaagaaatcggacaactacagaatttgcaagaattgtttttaaacaacaatcaactctcatcccaagaaaaaaaaagaattcgaaaacttcttccaaagtgccaaatttactttgactaa

SEQ ID NO: 35578 - protein, 311 aa, Leptospira interrogans serovar Lai str. 56601
MNFRITLNYLQKITIGLLFLMHLSCEIQAEEFEQQETYTDLTKALQNPLKVRTLDLSANRFKTLPKEIGKLKNLQELNLNKNQLTTLPQEIGQLKNLKSLNLSYNQIKTIPKEIEKLQKLQSLGLDNNQLTTLPQEIGQLQNLQSLDLSTNRLTTLPQEIGHLQNLQDLYLVSNQLTILPNEIGQLKNLQTLNLRNNRLTTLSKEIEQLQNLKSLDLRSNQLTTFPKEIEQLKNLQVLDLGSNQLTTLPEGIGQLKNLQTLDLDSNQLTTLPQEIGQLQNLQELFLNNNQLSSQEKKRIRKLLPKCQIYFD

SEQ ID NO: 35579 - DNA, 990 bp, Leptospira interrogans serovar Lai str. 56601
  CDS (1)..(990): transl_table=11
atgaattttcgcataactttgaattacttacaaaaaataataattggtctttttctttcttgcaagattcaaacggaaaaagaagaaccaggaacttattgggatttaacaaaagctctccaaaatcctttggatgttcgaattttgaatttgagtgaacaaaaactcacaactcttcctaaggaaatcgggcaactaaagaatctacaagagttgaatttgggtaataaccaaattacaatacttcctaaggagattggacaattacagaatttgcaattgttgggtttatattacaaccaacttacaattcttcctaaggaaatcgagcaattgaagaacttgcaagcattatatttgggtaataaccaaattacaatacttcctaaggagattagacaactacagaatttgaaagtgttgtttttgagtaataaccaacttacaactcttcctaaggaaatcgagcaattgaagaacttgcaaactttgtatttgggtaataaccgacttacaacttttccgaaagaaatcgaacaattgaagaatttgcaattgttgtatttatatgataaccaactcacagttcttccacaagaaataaaacaactgaaaaatttacaattgttggatttaagttataaccaactcaaaactcttcctaaggaaatcgagcaattgaagaacttgcaagagttgaatttgggttataaccaactcacagttcttcctaaggaaatcgagcaattgaagaacttgcaaacattatatttgggttataaccaactcactactcttccgaaagaaattggacaactacagaatttgaaagtgttgtttttgaataataaccaactcactactcttccgaaagaaatcggacaactgaagaacttgcaagaattgtatttaaacaacaatcaactctcaatcgaagaaaaagaaagaatccaaaagcttattccaaagtgccaaatttcctttgaataa

SEQ ID NO: 35580 - protein, 329 aa, Leptospira interrogans serovar Lai str. 56601
MNFRITLNYLQKIIIGLFLSCKIQTEKEEPGTYWDLTKALQNPLDVRILNLSEQKLTTLPKEIGQLKNLQELNLGNNQITILPKEIGQLQNLQLLGLYYNQLTILPKEIEQLKNLQALYLGNNQITILPKEIRQLQNLKVLFLSNNQLTTLPKEIEQLKNLQTLYLGNNRLTTFPKEIEQLKNLQLLYLYDNQLTVLPQEIKQLKNLQLLDLSYNQLKTLPKEIEQLKNLQELNLGYNQLTVLPKEIEQLKNLQTLYLGYNQLTTLPKEIGQLQNLKVLFLNNNQLTTLPKEIGQLKNLQELYLNNNQLSIEEKERIQKLIPKCQISFE

SEQ ID NO: 35581 - DNA, 1458 bp, Caenorhabditis elegans
  CDS (1)..(1458)
atgggaattgattcctacaatccaacagtgcgtgcacgccttgcaaatgcttctaaaacgcgagtcctgagcctgaaggagtctgccctgcaccgtattcctgatgacgtgaaagatctaacaatgttgaagcatctggatatgagtattaattatctgactcaacttcccccgtttattgggtcaatgtctcatcttaagaatttaaatttgtccagaaatcaactagaatctcttcctttggagatcaactccctggcgtgtcttgaagttttaaatgtctcacaaaacaaactgacagagcttcccgatctgtcacagtgtgtctcattaaagacagtagaggcgatagaaaaccaattcatcatcttcccagctggtgtgtgcaaatgtccaaatctcgaaacatgcttgttaactgaaaatcggatcgagaaacttccagacgaaattcattcgctacgggcaattagcgtgatcctcaacaaaaaccggcttctctctctcaacaccgctaatttgcttcgctgtgaacgcttgcgtgcagtaaacgtggacgataaccaactaaatcgcgacgaaattgaacaattccttgtgaatgcgccacgagaaattcgtatttcatttgaaagaaatgtttcgcaaatgcatacaactgatttgcaggaaatgggaaacgattcatctaaaacaaaatcaattggtgataatgcacggaagattattggaaaatccggtccatcgacatcaacggtcaataagcatctcgaaatggcaagcaaaagtcggattcttcagctaaaaggaactgggctcaagaaagttcctgacgaaatcgaaccattagctgatgttctccgcaacttggaactcagtgaaaacaaaattcgagaaattcctatctttattggtcaattttctcaactcaagcaacttcatttggctaataactgtcttgaatttctacctgatgaacttggatcgatgaaaaagctggagattttgaatttggcgggaaacaagctgaaagcgttgcccgacacaattgtcggttgcaccgatttgaaaaccatcgacttatcatccaacgttttcaccgtttttcctgtagcagtgattggctgtttgcaattggatatactcaatttaaatggaaaccaaattgaatctctccctgacgatatatccaatttgaaagttatcgagttaagtctgaatcaaaatcgactgagctccttaaatccatcaaatcttgccaaaactacacgactgaggactcttcgtctcgatgaaaactgtttggagaagtcggagttcactcgcgatttactagaatcttcaacaatttccgtgatgtcatacgacggaaatcgattccaattgaaagattttcaagatttaccaggatatgatgcttatcaagaacgtttcactgctactaaacgtaaaatctaa

SEQ ID NO: 35582 - protein, 485 aa, Caenorhabditis elegans
MGIDSYNPTVRARLANASKTRVLSLKESALHRIPDDVKDLTMLKHLDMSINYLTQLPPFIGSMSHLKNLNLSRNQLESLPLEINSLACLEVLNVSQNKLTELPDLSQCVSLKTVEAIENQFIIFPAGVCKCPNLETCLLTENRIEKLPDEIHSLRAISVILNKNRLLSLNTANLLRCERLRAVNVDDNQLNRDEIEQFLVNAPREIRISFERNVSQMHTTDLQEMGNDSSKTKSIGDNARKIIGKSGPSTSTVNKHLEMASKSRILQLKGTGLKKVPDEIEPLADVLRNLELSENKIREIPIFIGQFSQLKQLHLANNCLEFLPDELGSMKKLEILNLAGNKLKALPDTIVGCTDLKTIDLSSNVFTVFPVAVIGCLQLDILNLNGNQIESLPDDISNLKVIELSLNQNRLSSLNPSNLAKTTRLRTLRLDENCLEKSEFTRDLLESSTISVMSYDGNRFQLKDFQDLPGYDAYQERFTATKRKI

SEQ ID NO: 35583 - DNA, 2160 bp, Eremothecium gossypii
  CDS (1)..(2160)
atggaagtgcaaggggatccgcacacaggaggtgcgatggcgacgatggctcccatgacgcagaagctgacgtatctgattacgaaggagctgtcgcagaaggagtctccgacgattaagctcatagaactgaacatttccagccttccagaagaggcggtggagctgctgcacacggtggaacggctgtcgctgcagcggaaccaactgacaacgctaccgacgagcttccgcaacctgacgaagctgcgttacctcgacctacacgggaacaggcttgcggagatccccgcgatcctgctgcagtgcccgcacctggagattgtggacttgtcctcgaacgagatttcggcgctgccgcaggagtattcgccgctgtggtgcagcaacgtgaaggtgctatcgctgaagaacaaccgcgtgcgatcgctgcgggacctctacgcaacaataacgcagctgaaggctctgacgattttggagatagacggcaataagattccgaaggaggagcttgatcacgtgacgtctcatgtgccaactaagtcgctgcctcctgaggagtactggctgatggcgctgcgtaagtacatgcaggactttccacagggtatgcctgctgcaggtgcaaagactgcgcgtgcggcgaagcggatgggcttcatcggtgctgaagagtcaggatctgcgatgcactcggcgccggcgcaggactcggatttgatctcgcactccaagtacaacgactactttaaacgactgtcggtccttcccgaggaaaccagtagttccacccatgccagtgcgtcctccgaaacacgggtgtctcatgaggatcttgtggtaggatgccggaagctgcttttctcgttcaccgagtgccaacaaaatatccgtaaaatcacctccctctgcgcagacaaatcggttgctgtaaatatggtttccttgctatacacagtccgctcgcatatcgataatttggtggaggtgctagaacaggccgaagataccccggataccaatgtccacgatcagctccttgtgaacctttgcgttggaataatatcagtattcaagcaaatcatttcattacttcggaaaaactttgatgcattcttccgagcaaacgacgtctgcttcacacgaatgttttacatgacactgttatgttcctataccgaaatgtgcaatgtgtggaacctggtggtcccagagaatattaagaggaagaggccggttgttactccacggcagcgctctttcagtgtccaaacacaccattctttcaaacacctgccacccaggcagcgctcgaatacactccagcgtgggacgccttcctcttctgcactgcagccactgcagccacctttgattaaccagttgccactcaattcaccgcccagttccaaaaatactacaccactatccaacttatcgactccccctcccccaactaatattccttcatcgttgactggatcaaccatcttggatccgagagcagatgcttcgccaaggaccatgagatcagactcgcagatacattcgcctaatataaaacgtccacaggactcacaactatctgcggaacaaagtaaccaacatgcgggtccatcgggggaaatgaatatcgatacacagctataccatacccttagaacagttattgggatggtaaacgtggtttatgcacaattgacgcaagccattcagaagactgctattgcaagtacaacagatgatcatccaggtataactcccgctattgctgctaagattaaagatctcacggaaacttgcttccagtccatggaactgtccaaggttttgaaatcgcgcctgtctctgatcacttctacggagtcggagcagtacaataccaacgcagagaagctcaatacatgggaggatatcaatgcttttttgaaatctattattgcaattttagccaacaccaaactaattatgaaggatctacctgtgctgaacgaagtgcggcctaatttagcatctctggccaagattaccaaagatgtgaccgttatcctggacatgagctcatacagaacggtgtcccgcatccacgcagcctgcccagcagccttctgcacacggacccggttcacaattgcagacgccacaagaaggtactga

SEQ ID NO: 35584 - protein, 719 aa, Eremothecium gossypii
MEVQGDPHTGGAMATMAPMTQKLTYLITKELSQKESPTIKLIELNISSLPEEAVELLHTVERLSLQRNQLTTLPTSFRNLTKLRYLDLHGNRLAEIPAILLQCPHLEIVDLSSNEISALPQEYSPLWCSNVKVLSLKNNRVRSLRDLYATITQLKALTILEIDGNKIPKEELDHVTSHVPTKSLPPEEYWLMALRKYMQDFPQGMPAAGAKTARAAKRMGFIGAEESGSAMHSAPAQDSDLISHSKYNDYFKRLSVLPEETSSSTHASASSETRVSHEDLVVGCRKLLFSFTECQQNIRKITSLCADKSVAVNMVSLLYTVRSHIDNLVEVLEQAEDTPDTNVHDQLLVNLCVGIISVFKQIISLLRKNFDAFFRANDVCFTRMFYMTLLCSYTEMCNVWNLVVPENIKRKRPVVTPRQRSFSVQTHHSFKHLPPRQRSNTLQRGTPSSSALQPLQPPLINQLPLNSPPSSKNTTPLSNLSTPPPPTNIPSSLTGSTILDPRADASPRTMRSDSQIHSPNIKRPQDSQLSAEQSNQHAGPSGEMNIDTQLYHTLRTVIGMVNVVYAQLTQAIQKTAIASTTDDHPGITPAIAAKIKDLTETCFQSMELSKVLKSRLSLITSTESEQYNTNAEKLNTWEDINAFLKSIIAILANTKLIMKDLPVLNEVRPNLASLAKITKDVTVILDMSSYRTVSRIHAACPAAFCTRTRFTIADATRRY

SEQ ID NO: 35585 - DNA, 3123 bp, Magnaporthe grisea 70-15
  CDS (1)..(3123)
atggatcgaacaggcgataggccagccctcagtctctccaacggtggcagagggctacccgagaatcctgcccagggtcgaaggaacatgacgaacggtggcgccaatggcggcggctcgctcaacagtctgcctccaatgcccaccgccatccccgccaacgttcgcagcatgtcttccacctcgtcttcgactctctccgcgaatcctcccgtttccgccggtcaggtcataggcatggcgcgtcgagccatggccgaagccctcaaggagcacgagtctcaggcagcagaggccagcggggtcagcaacgagttgaagcccggtgtcaccattgacttgagtcgcaaaaacatacaggagcttccggaagagattgttgacgtgatcaaacacgaacttgagcgactagcactttctcataacaaaatatcgtcgttccccgcccgttggtccgaatgctcctccttgcgctacctaaacgttcggaacaatgagcttcgggagttccccctaccgctgtgccatctcaaaagcctcgagattctcgatctggggcgtaacaagatccgatcgctcccccctgaaatcgtcaaattgacttcgttgaaggtctttgcagttcaaaagaaccgtatcgaagagttgcccatttgcctggcggacatgggctcactgcaaatgattaagctggaaggcaatcctattcgatttccacctcccgaagttctgcaggtgcaggcagcaagtcctcccaacgaggggcatttgaaagaaagtgaagtcacagagttaacggtcacggcccacatcaaaaagttcatgaagcagagagctttggagctcaccagtagcagatcggactctgagatgggcatggacgaatcgaacgaaggcatggaaaccccaagagttccgatcaaacgcgttgtcagtgggagatttcccgtaagggtcaatggtgccggcttgccagacctcagatcacctgcttttgcgcggcccggaccacccccgatccctacgcgctcccactaccgcgggctatctcaacagaacactgctccaaggaagcctggggttatgcccttgaccatcggcaatgtcaatgagcgcatgcgaagcaactcggaaactttatcacaaacccctcgagcagataggcctggcgaacgttctcggcggatgggcgtcgtctcacaaaaagcccagcagctcggaacacttgacgagactcaagctaataaccggttttcgcactaccgtggcctcagtcacggctcggcgatgcaagggaatggccaaatgcttaatggcaagatgcccgtcagccctgccgaatctatactccagcggccgatatacgtgcgtcgattgtccattttgcccgaaagaaggcgcgagtccaagtttgtcgatccggtgctagaggccgctaagggcgttctctactccattttccagatccatcccatgatccagatgctcatgggattgacgagcgacgggctagctaagcgctccagtcttgagatcgtcttttacaataccaactctcatgtggaggagctcgagcaggaaattcaacgtcacgaggctgatgaggacggagcatcccaatttgaaaatgagaacgtgatgcgcgcgtgcatcaccttggtgaacgcttacgtgcacgtttgctcactgcttgcgagcaatgtcgaccttttcatagacaacggtgacccgcgatatattcgaaccttgatgatgcagctctacaatagcatcacagagctacgagtgacgacatcgcacgtgctgccggaagagggacaccgtagagccgccagccgcacggctatgaactctggaaccatccgcccacgttcgcgcgaaaacaccgccaccccgacggcagagaggccaaacggaatcccccggagtgtggcccgcggcaacttgacccataacccgagcaacctcagggttactactgacgttccgctttccagcattccgtacgtcaacgggactggtcgcacggccaccatttcctcagccacgccccggtcgggggagtcgtttgtctccacgggcagccgtggtctgtcgggcgacttcaccgaggaggatcgcatctttgaaaacatattcttggccctgcagaagtcaaccgatctggtagtgcggctgttgccagcgttcaaccaccaatataccaacggtctgcaagcggctatacagcaccgcaacactcgagagtcgcagatgtggaagtcattgatatctaagtgctcaatgacgatccaacagaccgagaagctcaagacgcgtctttcgctgatcaagctgaaagagcccgggatcaggactcagggctctttctggaatgacgtacgtgactttgtggactcttgggcggagtttggcagcaaagtcagggaggtcgaaaaaccactatcgctaccggccgacacgaggatgcgcttacgaccattccagaagagtatccaggaggcatcaagtcttatactacgctcgccgtggggctactggcttcggccgggcctggcaacgtcgcaccaaaccggtaatggaggcggcatttttagcccaggcggtgccgtggagtctcacaattctacgggtttgaacggtgaccgacagtatcagcaaaacgggcaatacggaaacccaagccacaaccatctccatcacaacccccacatacagcttccaatgacacctcagagcgctgcattgggtcctgcggcccaagctacagtgccggcaaccccacagagcggttctttcgctgcagcgctgaccggcaacgtatttgagcgggcggatgcactcatgtctcagggtggcccgtcatctatacactcgcactctcgccacggaaccttcacttcctctacgtcaggttcttccggcggaatgagtggtagcttcaattcgattagcagcactctatcatcagcgactagctacaacgatgacaggatgggaggtcactcggcttcttcatcttcgtccgtcataagcccgggcggcctaggaggcggccctggaccaatggcctctgccttcccgttccgcatgcaaaatggcggtgggagggtggcgttgtag

SEQ ID NO: 35586 - protein, 1040 aa, Magnaporthe grisea 70-15
MDRTGDRPALSLSNGGRGLPENPAQGRRNMTNGGANGGGSLNSLPPMPTAIPANVRSMSSTSSSTLSANPPVSAGQVIGMARRAMAEALKEHESQAAEASGVSNELKPGVTIDLSRKNIQELPEEIVDVIKHELERLALSHNKISSFPARWSECSSLRYLNVRNNELREFPLPLCHLKSLEILDLGRNKIRSLPPEIVKLTSLKVFAVQKNRIEELPICLADMGSLQMIKLEGNPIRFPPPEVLQVQAASPPNEGHLKESEVTELTVTAHIKKFMKQRALELTSSRSDSEMGMDESNEGMETPRVPIKRVVSGRFPVRVNGAGLPDLRSPAFARPGPPPIPTRSHYRGLSQQNTAPRKPGVMPLTIGNVNERMRSNSETLSQTPRADRPGERSRRMGVVSQKAQQLGTLDETQANNRFSHYRGLSHGSAMQGNGQMLNGKMPVSPAESILQRPIYVRRLSILPERRRESKFVDPVLEAAKGVLYSIFQIHPMIQMLMGLTSDGLAKRSSLEIVFYNTNSHVEELEQEIQRHEADEDGASQFENENVMRACITLVNAYVHVCSLLASNVDLFIDNGDPRYIRTLMMQLYNSITELRVTTSHVLPEEGHRRAASRTAMNSGTIRPRSRENTATPTAERPNGIPRSVARGNLTHNPSNLRVTTDVPLSSIPYVNGTGRTATISSATPRSGESFVSTGSRGLSGDFTEEDRIFENIFLALQKSTDLVVRLLPAFNHQYTNGLQAAIQHRNTRESQMWKSLISKCSMTIQQTEKLKTRLSLIKLKEPGIRTQGSFWNDVRDFVDSWAEFGSKVREVEKPLSLPADTRMRLRPFQKSIQEASSLILRSPWGYWLRPGLATSHQTGNGGGIFSPGGAVESHNSTGLNGDRQYQQNGQYGNPSHNHLHHNPHIQLPMTPQSAALGPAAQATVPATPQSGSFAAALTGNVFERADALMSQGGPSSIHSHSRHGTFTSSTSGSSGGMSGSFNSISSTLSSATSYNDDRMGGHSASSSSSVISPGGLGGGPGPMASAFPFRMQNGGGRVAL

SEQ ID NO: 35587 - DNA, 2940 bp, Gibberella zeae PH-1
  CDS (1)..(2940)
atggagcggccagaccgactcgccggttcgtccgtcggttctacatcgcaggcttcaattccgcgaagcttgcccgaaaaccatacatctggacgccgtccagttccaaactcagctgccacatccaacggccctccgccacctcctcctatcccaagcctacgcagcgtcccgtccagttcatctctctcaaccgttggcatgtcggcagcccaggttatcaacctcgcgcgcgaggccatgcaaaatgcaatcgaaagcgaaagtcaagccgccgaagctggtgctgttagcacagggctccgaaccggagtcactattgacctgagtcgtaaaggcatccagaaacttccagatgaagtcgtcgacattgtgaaaggcgaactggaacggtccgcttccaagaactcgtcctcaaacacacgacccgacgccgatacttatactgtctccagactagcattgtctcataaccaactgacaagcttgcctgctcgcttttccgaatgcacatcactgcgatacctcaacatccggggtaaccagatcaaggaattccctatgcctttgtgtgaactgaaatctctagaaatcctcgacctcggccggaactcacttcgaattcttccagcagatattgcaagactctcttcattgaaagtgctatctatacccaaaaaccaaatacgagagttgcccctatgcattgccgacatgggatcattacaagttatcaaatttgaaggaaaccctatcagctttccgccacgagatgcaattcaagtacaagcagcgagccctccacacgaaggtattcaaaaagacaacgaagtgacggaggtggcggtcactttgcagatcaagcgatacctgaagcaatatactattaatggccggtccgaatctgacaatacgggagatgaatcgagcgaaggtgcagaaaccccccggtttcctctgaagagagtggctagtgggcgctttcctgtcaaggtccagggtgccgatttgcctgatatccgttctcccaacattggatcacgagcacccccgataccgtcaaggtctcattaccgggggctttcccaacaaaacaccgcttttcgacgacctggtgttatgcctctaacaatcggcaatgtcaatgagcgtgttcgcagcaactctgaaagcctactccgggcagagagatcagatggccgcagcaggcgcatgggaatagtctcaagaaagccttctgacctcggcacgcttgatgagatgcaggtcaacaaccgctttagccactatcgtggtttgagtcacggttctgccatgcaggggaatcaagcaacaactaagagtccagcaacacccacagaaccctacctcgcacgcccgatatacgtgagacgtctttcaatccttcctgaacgacgaagagagtcaaagatatttgacccagtaatcgaaactgccaagggcattctgtactcggtcttccagattcatcccatgatccaggcgttaatgggcctgacaagtgacggctcagccaagcgatccagtcttgaaatcgtgttttacaacaccaactcgcatgttgaggaattggagcaggagctacagaaacacgaaaacgcgttgggcgagcctctcgatcattctcaacgagaaaacgaaaacgtgcacagggcatgccagactctggtcagcgcgtatggccatgtctgcacacttttggccgataacatcggcacattcgtggattttggagatgcccgatatattcgaagtctcctgatgtccctatacaacagtatcatggaactgcgcgtcactttgtcatctgtcagtgctgccgatgttcgtcgacgaggcgggcccaaaggtggttcaactggcgagcgcactgccagaccacatgcacgagaaccatctgcaactcctaccctcagcaggtcgaatggagcccgcaaccgcaacggcaccttggttcaccacccggttaacctccgtgttagtactgacgtgccggtgcctactcccctttctgcaacatatctcaatggcaatgggcgcactgctactcttgcttcggccactccccgatcaggagaatctttctcctcaattggtagccgcggaatgtcatccgagtttacagaagaggatcgacagtttgagcggattttcctggctctgcaaagatctactgatctcgttatgggcacgctgcccaacttcaacgcccagctggctggtggcttacgaaatgccatgtaccagcggactcctgaaagtgttcttcagcactggaaacagttgattgccatgtgtggtcaggttatccagcagaccgagattctcaaaaacagattgtccatgatcaaactgaaggagccaggcgttcggacgcaggcaaatttctggagtctctgcagtaacttcagtcactcgtgggcggacatgatttctcagatcaagtatggacctaacagtgtgccgcttccccccgatactcgggcacgcttgaggccgattcaacagagcatcaaggagacaagcaacatcatctataaatcgccctggcactatctattccacccttctggcgctatgaacggacaggcataccctcgcggcatgtctcccacgtcagttcccatcacaccacagagtgccgctttgggccctgcaatgcaagcaacagttcctactacgccctcgaacagctcctttgcggcagcattccatgggaatgttttcgaccgagcagacgctctcatggccaacccaggtatctccatgggtcgcaacggtgcttttggcaagggtcacatgggcttcagctcgctatcttctctatcttccatgtcgtctgatgaaggaatacttcccactcacggaccactcggcccagtacctcttcgtcttaatggaggcaaagtcgccttttag

SEQ ID NO: 35588 - protein, 979 aa, Gibberella zeae PH-1
MERPDRLAGSSVGSTSQASIPRSLPENHTSGRRPVPNSAATSNGPPPPPPIPSLRSVPSSSSLSTVGMSAAQVINLAREAMQNAIESESQAAEAGAVSTGLRTGVTIDLSRKGIQKLPDEVVDIVKGELERSASKNSSSNTRPDADTYTVSRLALSHNQLTSLPARFSECTSLRYLNIRGNQIKEFPMPLCELKSLEILDLGRNSLRILPADIARLSSLKVLSIPKNQIRELPLCIADMGSLQVIKFEGNPISFPPRDAIQVQAASPPHEGIQKDNEVTEVAVTLQIKRYLKQYTINGRSESDNTGDESSEGAETPRFPLKRVASGRFPVKVQGADLPDIRSPNIGSRAPPIPSRSHYRGLSQQNTAFRRPGVMPLTIGNVNERVRSNSESLLRAERSDGRSRRMGIVSRKPSDLGTLDEMQVNNRFSHYRGLSHGSAMQGNQATTKSPATPTEPYLARPIYVRRLSILPERRRESKIFDPVIETAKGILYSVFQIHPMIQALMGLTSDGSAKRSSLEIVFYNTNSHVEELEQELQKHENALGEPLDHSQRENENVHRACQTLVSAYGHVCTLLADNIGTFVDFGDARYIRSLLMSLYNSIMELRVTLSSVSAADVRRRGGPKGGSTGERTARPHAREPSATPTLSRSNGARNRNGTLVHHPVNLRVSTDVPVPTPLSATYLNGNGRTATLASATPRSGESFSSIGSRGMSSEFTEEDRQFERIFLALQRSTDLVMGTLPNFNAQLAGGLRNAMYQRTPESVLQHWKQLIAMCGQVIQQTEILKNRLSMIKLKEPGVRTQANFWSLCSNFSHSWADMISQIKYGPNSVPLPPDTRARLRPIQQSIKETSNIIYKSPWHYLFHPSGAMNGQAYPRGMSPTSVPITPQSAALGPAMQATVPTTPSNSSFAAAFHGNVFDRADALMANPGISMGRNGAFGKGHMGFSSLSSLSSMSSDEGILPTHGPLGPVPLRLNGGKVAF

SEQ ID NO: 35589 - DNA, 2943 bp, Aspergillus nidulans FGSC A4
  CDS (1)..(2943)
atgatttctactttggttcgaccggaggatagtctaagaatgcctcgctcatatcgagacactgaagaggaagacgcgaaccgacacagtcccgagccagcggcgccgttatcctcgtcatcctcgaccaccgacgggtcgaataagagcgaagatgaagccacgttggtgaacgggtctaccggcgataccagcagcaggccgacaaagtcgcgtgaatcgcttacgccggaggagacaatccaacttgcgcgccgagcagtagagaacgggatccaggaaacgaaacggtctttggcaggaagcgaagcggtcggtgatgtggtcaagccgaagctgaccattgatttgggccactcaaatatcagtcgtataccggagccggttgtggatattatcaaggatgaagttgaacggctctcgttatggaacaatcaactggtccatattccttaccgattcgcagagtgctctcatcttcgatatctcaacgtcagatctaacaactttcgtgaatttcctagaggagtgattaaactgccattactggagattttggatttgagccgcaacaaaattagccagcttccggaggaaataaagaaattaacatctctccgagttctgtcggtgatgcaaaaccgccttgacgatttaccacttggtgtgtcggatatgaacaagcttcagatcctcaaagtagctggaaatccactgcggtacccgctccgcaaagtaatagaaacatctgaggccgagattacctcctcaatgatgagcgataacgaaaaagaagttgctttaacggctgagcttaaaaggtatcttaaggcgcggcaacctattaattctaatgattttgaatcaaacaacgaaagtgatggcatcttggacactccaaaacccgtcaaacggggagtgagcagtcgcttcccagtgattccaagcacaggcgacggcgctgaccctaaatcgccgtcattatcacggccacctcccatcccacttaaatcacattatcgcattgcttctggacatggcggtgctctgcaaatcctccagcgtcccggtcccatacctggggctaatgagcggaatcgaagtaatagcgagggtatcattcaagcctcttttgcaacacggtccaagcgcatgggggtcatcagtcgaaagaacacagacttgggcacactggacgaaatgcggccataccgcaatagtcacctccgtggtctcagttatggatctattcttcggacaaggccatctatcagcaactcatctagtccgagcagcccaagagagcgcaggcggcccagagatggatttgtgaatcggatgtcgagtctaccagagcacaagggcgagcgggaaactgaaagccccataatcgaaagcgccaagggaattctttttgccctctttcaagtccagtctcatgtctatgcccttataaatgtcatcaagcgtgatgattaccggcgaaatagtctcgaaattgtcttttacaacgcttccactcatgtggaccgactaaatgaggcgcttgaaaatgcagaaaactcacgagcagatgatgcggagccaatgcgagcctcctacgaggctgtcaagagggaatgcgagacgtgtatcatggcgtactctcacgtcggaacccagttacgcaacagccttgacagaatcgttgccaatggcgattcgcgctacattcgctcgctgatgcttatgatatttggtagcgtggttgagctccgcaacgcatgtgcatgcttggaggtacctgttggaaaccgaccgagacctactggaaggccaccagtacctgagatcagcagagaatctgcggattcagatagataccactgcacaacagtcaccccaacgcggggaagagaaccgtccttctccactcgccggctccgtagcgatacaacaatcttgcatccacaaactaatatgcatgggcccctgccagcctctgccacatttcagtccgccgttagctctccaggcttcgctcccactccatacagctatggagcgaggagtcggtcgagcagcaggtcgaatcatgtcaacacatccgtaccctcgtcccttgctactcctcggtcaggcgagtctttccctccgatgcctacttcggtgatacctaaaataaaccccttgaccggcttggacgaaatagaagaggaacggatctttgagaagattttctaccaacttaccgctgcttacaccgctgctctccaagcgctacctgttgcccgccgtcattttgcgaggaacctggaggtcgcggaacagaatcgggaattcgaagatatccagatgctatggaacaacctcattcaccgctgccgggtttgtctggaagtatcagaagccctcgggcttcgtttgtctaatatgaaagtgaaggaaccagggggtggaatgcggaaccaacgagagttctggcaactatgcaaagcctttatgcagtcttttgtcgaactggtgactgacatgcgcgaagtacggagcatgcacttactcccatctgaagtaatcgtgattcttcggcctgtgcagaaggccagcagggaagcaggtcgcttgatcgaggcttctccatggtcatatcttgcagacatggctcccgggaacggccccccggccatatacggaccacccttgccgtcccaaacttcacatcagcagcagcagcatcaccatcaccatcaacaacatcaccctcagctcaacacaagcatgtcaccttctgttgcgcttcccgcaaccccccttagcgctgctctgggcccagcggcgcaagcaacaataccttcgacacctgcaagtgcctacagcgataagttcttcgagggtgacgtctttcaacgagccgactccttgctttcaatgccaaatcaggcgccattcttctcgcgacggtga

SEQ ID NO: 35590 - protein, 980 aa, Aspergillus nidulans FGSC A4
MISTLVRPEDSLRMPRSYRDTEEEDANRHSPEPAAPLSSSSSTTDGSNKSEDEATLVNGSTGDTSSRPTKSRESLTPEETIQLARRAVENGIQETKRSLAGSEAVGDVVKPKLTIDLGHSNISRIPEPVVDIIKDEVERLSLWNNQLVHIPYRFAECSHLRYLNVRSNNFREFPRGVIKLPLLEILDLSRNKISQLPEEIKKLTSLRVLSVMQNRLDDLPLGVSDMNKLQILKVAGNPLRYPLRKVIETSEAEITSSMMSDNEKEVALTAELKRYLKARQPINSNDFESNNESDGILDTPKPVKRGVSSRFPVIPSTGDGADPKSPSLSRPPPIPLKSHYRIASGHGGALQILQRPGPIPGANERNRSNSEGIIQASFATRSKRMGVISRKNTDLGTLDEMRPYRNSHLRGLSYGSILRTRPSISNSSSPSSPRERRRPRDGFVNRMSSLPEHKGERETESPIIESAKGILFALFQVQSHVYALINVIKRDDYRRNSLEIVFYNASTHVDRLNEALENAENSRADDAEPMRASYEAVKRECETCIMAYSHVGTQLRNSLDRIVANGDSRYIRSLMLMIFGSVVELRNACACLEVPVGNRPRPTGRPPVPEISRESADSDRYHCTTVTPTRGREPSFSTRRLRSDTTILHPQTNMHGPLPASATFQSAVSSPGFAPTPYSYGARSRSSSRSNHVNTSVPSSLATPRSGESFPPMPTSVIPKINPLTGLDEIEEERIFEKIFYQLTAAYTAALQALPVARRHFARNLEVAEQNREFEDIQMLWNNLIHRCRVCLEVSEALGLRLSNMKVKEPGGGMRNQREFWQLCKAFMQSFVELVTDMREVRSMHLLPSEVIVILRPVQKASREAGRLIEASPWSYLADMAPGNGPPAIYGPPLPSQTSHQQQQHHHHHQQHHPQLNTSMSPSVALPATPLSAALGPAAQATIPSTPASAYSDKFFEGDVFQRADSLLSMPNQAPFFSRR

SEQ ID NO: 35591 - DNA, 2607 bp, Candida glabrata CBS138
  CDS (1)..(2607)
atgccactagcaaatgaaaaatacaatgacgatagttcaaaggggtctcaagctatgaatgagttaagtatagatgaaatgagagaagtaatagatcatgagttaacacaacaggaatcaaaaaatagctccactgttaaacttataggactgaaccttaaaacaataccaccggaagatattaaactacttgcaaatgcagaaagactctcactaaggaaaaacaacataacatacttaccagaaaactttagtgagttaaaaaacctgcgctacctcgatctgcatagtaatgggcttcgagagatcccggttgaacttctgaattgccagaagttggaaattttggatatatcatccaataaaatctctcagcttccagaggaatttccaagcgtattctctactagattaaaggttatatctctgaagaacaacagacttacctcaatttggaaactatctcctattcttcaactaaatcatataaaagttctagaaattgaaggaaaccctataccgaaagaagaacttgatcaagtactatcttatgttccaaatcaacaaaacttacctaaagatgagtattgggcaattgccattcctcgctttcttaacaatcacccaaaaatgaaagtacagtcgctagagtcaaaattgagtagagcggcaaagcggatggggtttgttaataccataccagtaactgatgaacaattgaatgattctagcatctcatctgccactatatcagaacatatcaataatgttactattgccaaagagaatttcacagatacgaatatgaatacacctaatgttctgtcttcaaatgacctctacaaccatactaaatacaacgattatttcaaaagactatcaattcttccagaagaggttaaccaggaacagcataaagtatcacacactgatttggttgttgcttgtcgcaaattattgtttagttttacagagtgtcaacaggcaatacgaaagatcacttcactttgtaaagaaaagtccattgctgtgaatgtggtatctcttctatattcggttagatcacacattgataatcttgtggaaattttagaacagtctgacaatcaagaaatctcgaacgaccaacctttgatcacactttgtatgactatcatctcaatatttaaacaaattattgcgctgttacagaaaaattttaaagctttttttgaggaagatgatttatgtttcataagaatgtttttcatgtcactagtgtgttcatatactgaaatgtacaatgcatggagctttattacaccacaggagacacttttactacataagaaaagtgccagtaacaatagcaataaaattcaacctgagagtgatggtcatccggctataataagaagtaaaagcgaagcgaacagtaggacagaccatgtcggattaagcagaaaaccaacgctaactaatgtttcaaaaccagatattgctggagtacgattgtcaaatgaagaaaaaactagatatcatgatgccgtatctgatcaagaaagctcagtagaacacaatgaatcaggcattccaaaagtagccaggtcaagaagtaataccatacaaggtagaggaacaggtagtcttttgaatgttaatggatctaagtctaatataataacatctcctaatggtgttagtcagttacgaactcaaggacaactacctactcatgcagttgctactacaaacagtactcaagagcaaggttcttcggacaaacataaaatgaatatttctaatttagctaagacagcagataatagaggtggtaatttcaagaatccacctgatgagaaacagattaacaatgaacttcaaaatggaaatgtgtctcttacagcaccaaaactaaagcaagtacagcaacccccattaactgagaagggtggaatctcaacaccgactggaacggatgtagatattgatcagcaacttcacgaaacattgggaacagtagttaagatggtgacaatggtgtataatcaacttacatctgaaatatctaaagttgctttggctagttcaacaggacatcaggtattgaccgatacactagctaccaaaataaaagatttaacagatacctgtaggcaattattgcaattatcacaggtactaggtgaaaggttacggcttctgactggtgatggaataactgctgaaaagtattcaacgacctctgaaaagctaaaaacatgggaaagtatcaatgccttcctcaaagcaattatttcaattcttgccaatgcaaagactttaatggctgatttgccaagtctaaatgaagtaaggccacaacttgcttcgttagccaagataaccaaagatgttacggtgattttagatttgagttcatataaagcagtttctgttgcagcagcaaatcaagaagctctacagcataacaataacaactctgaaacaaaatctggagattccaaatcgccagtaaacgaatcggctataagtggtgatcacagtcatacagacatcgccaatgttccactgtttacaccacaggctgctagtgcttatatgagggatccattcgaccaacagtaa

SEQ ID NO: 35592 - protein, 868 aa, Candida glabrata CBS138
MPLANEKYNDDSSKGSQAMNELSIDEMREVIDHELTQQESKNSSTVKLIGLNLKTIPPEDIKLLANAERLSLRKNNITYLPENFSELKNLRYLDLHSNGLREIPVELLNCQKLEILDISSNKISQLPEEFPSVFSTRLKVISLKNNRLTSIWKLSPILQLNHIKVLEIEGNPIPKEELDQVLSYVPNQQNLPKDEYWAIAIPRFLNNHPKMKVQSLESKLSRAAKRMGFVNTIPVTDEQLNDSSISSATISEHINNVTIAKENFTDTNMNTPNVLSSNDLYNHTKYNDYFKRLSILPEEVNQEQHKVSHTDLVVACRKLLFSFTECQQAIRKITSLCKEKSIAVNVVSLLYSVRSHIDNLVEILEQSDNQEISNDQPLITLCMTIISIFKQIIALLQKNFKAFFEEDDLCFIRMFFMSLVCSYTEMYNAWSFITPQETLLLHKKSASNNSNKIQPESDGHPAIIRSKSEANSRTDHVGLSRKPTLTNVSKPDIAGVRLSNEEKTRYHDAVSDQESSVEHNESGIPKVARSRSNTIQGRGTGSLLNVNGSKSNIITSPNGVSQLRTQGQLPTHAVATTNSTQEQGSSDKHKMNISNLAKTADNRGGNFKNPPDEKQINNELQNGNVSLTAPKLKQVQQPPLTEKGGISTPTGTDVDIDQQLHETLGTVVKMVTMVYNQLTSEISKVALASSTGHQVLTDTLATKIKDLTDTCRQLLQLSQVLGERLRLLTGDGITAEKYSTTSEKLKTWESINAFLKAIISILANAKTLMADLPSLNEVRPQLASLAKITKDVTVILDLSSYKAVSVAAANQEALQHNNNNSETKSGDSKSPVNESAISGDHSHTDIANVPLFTPQAASAYMRDPFDQQ

SEQ ID NO: 35593 - DNA, 2379 bp, Kluyveromyces lactis NRRL Y-1140
  CDS (1)..(2379)
atggataaccatacggaattactgacatcactcaggcaaggtcaaaatggaaatcccccgatgcaccctgttaataaagagatttatcagaaggataacacagcagtttcattagctgatcttggtttgtcttcaataacagatgatgctgttgagctgcttcaactagttgagaacctttctttgcaccagaataacttaacacagcttcccggatcctttaaaaagttgacaaatcttcgaaccatcgatctttctgataacagattcaatgatattcctccatcgttaatgcaatgccttcgattagaaaaaataaatctttctaacaacaacatatggcagctacctcaagaatttccagagacatggtgtgataaccttgttacactctcattgaggaacaacaatctaacatccatcaagacactatttcctataatatcccagttaaagaatctacgagtccttgaactagatgggaataattttccaaatgatgttatcgagaaggttctacaaggttttactagttccaagtgctctgcggaagaatactgggttatagccttaagaaaattcttcagtgacaataccgtttcacaaacaccggcagttacaactctggatccacaacaaaagatagcaagggctgcgaaacgaatgggctttattggaaattcacatgattcggaagacaatgagaataatctcacgtctccccagagcgatcttgatctttactctcattcaaaattcaacgaatacttcaaaagattatctgttctgccagaggaacccaatttgcaagaggtagaagaggaaacagatgaacagaattataaagaattactacagacacatcatgaaaagaaaagaaaatctatggaaaatgttgtgctagcttgcaggaaacttttgttcactttcactgagtgtcagcaaaacattaggaagataacatcgctatgttctgaaaagaccatttcggttaatgttgtgtcacagctttacagtctcaagtctcatattgataatttagttgaagtcttggaacaatttgaaaataatagtcaacaaaatgatccttcaataacgcaaagtcagttccttcatcatgatgttttgatacgactatgtttgaccatactttctatattcaaaaagatttttgttcaacttcgaaagaacttcactgcattttttggcaataacgacgtgttttttttaagggtgttctacatgaacatattatgttcgtatactgaaatattcaacgcctggaaactacttgttttggataaccaggaaatgatgaaaaagaaaaagctagccagaacgcattcagttcattctatgaacatggctcagtaccaaaagtatttaaacagcaggcaaaaatcgtcttctgctattaatcgatcttcttctctgagtggcgtctcttcccaacagtctgcaattaatgtcaacacaccaggtataaatggtccttatgcgaatcaaaatggccaacaggttaccccgccaattaatccaacatctttcacgactacaccgatatctgaagtttcaacaacaccgcctatactagattcttcaccgaaaccacctcgcagtctaaattacagtgagcaatcaactgcctccacagtcacacaaggtgccgcacccaccgatacctccaatatcccctcacaagcacttgcagataaggatatagacctgcagctataccatacgttgaatacagttattgatatggttaacgttgtatattcacaattgacgcaggcaataacaaagtcagcaatagctagtactacctccgatcagctttcaataactcctacggttgctgcaaaaacaaaagaattgacagatacttgcttccaatccatggagttatcgaaagtgttaaaaaaacgactaaatgtgatttccaatagtgatattgacacatatttggttactaaagaaaagctcaaaacttgggaagatataaatgcatttttgaagtcaatcatagctattctagccaacacaaaggaaatcatgagtgatctgccgactttgaatgacgtgaggcctaatctagcctctttagctaaaattacaaaggatgttactgttatactcgatctaagctcttacaaaagtgcttccattaccaatcagcagtcatcctcaaacccttcatatgttggtgcaagttctgttgatgcgccatcacaacagcaaaatcacacaacgaatcaaggatcaccggcaggtcagcatggagataccacggatcatacagcttcgaatataataacaccattatctacgccttcgctggtgacttctcacaatgtgaatccatttgatcaactgtga

SEQ ID NO: 35594 - protein, 792 aa, Kluyveromyces lactis NRRL Y-1140
MDNHTELLTSLRQGQNGNPPMHPVNKEIYQKDNTAVSLADLGLSSITDDAVELLQLVENLSLHQNNLTQLPGSFKKLTNLRTIDLSDNRFNDIPPSLMQCLRLEKINLSNNNIWQLPQEFPETWCDNLVTLSLRNNNLTSIKTLFPIISQLKNLRVLELDGNNFPNDVIEKVLQGFTSSKCSAEEYWVIALRKFFSDNTVSQTPAVTTLDPQQKIARAAKRMGFIGNSHDSEDNENNLTSPQSDLDLYSHSKFNEYFKRLSVLPEEPNLQEVEEETDEQNYKELLQTHHEKKRKSMENVVLACRKLLFTFTECQQNIRKITSLCSEKTISVNVVSQLYSLKSHIDNLVEVLEQFENNSQQNDPSITQSQFLHHDVLIRLCLTILSIFKKIFVQLRKNFTAFFGNNDVFFLRVFYMNILCSYTEIFNAWKLLVLDNQEMMKKKKLARTHSVHSMNMAQYQKYLNSRQKSSSAINRSSSLSGVSSQQSAINVNTPGINGPYANQNGQQVTPPINPTSFTTTPISEVSTTPPILDSSPKPPRSLNYSEQSTASTVTQGAAPTDTSNIPSQALADKDIDLQLYHTLNTVIDMVNVVYSQLTQAITKSAIASTTSDQLSITPTVAAKTKELTDTCFQSMELSKVLKKRLNVISNSDIDTYLVTKEKLKTWEDINAFLKSIIAILANTKEIMSDLPTLNDVRPNLASLAKITKDVTVILDLSSYKSASITNQQSSSNPSYVGASSVDAPSQQQNHTTNQGSPAGQHGDTTDHTASNIITPLSTPSLVTSHNVNPFDQL

SEQ ID NO: 35595 - DNA, 2301 bp, Yarrowia lipolytica CLIB99
  CDS (1)..(2301)
atgtcgacgataccaacaggaattcgtctacaattttttcccattgtctatccgtactcgctctcctatttcttgccatgttccatcctgtatcgtgcactgcatatgaccgctccttacaaggttgcagctgcaaatattctacccctccaaccgttcatggccttttgcggcacattttcggggccgccgcacgtagaaacgaattgggccacattccaaagaggtacaaaaccacataagccagggaaaaacataaataccagtgccacgtacgccctaggagtccaccagacccccacatccacacatccacacatggcatcatcatccctcttctcccagctgcaggagaactctatcgggtccgccaatatacgaccgttctacctgttctcaccaacctcgatggacttgattcaagacgtgcaacgcaaggtggaggaggctggaggagatgaagagcgcggcgtggagctcaatcatatgggactgacggaggtgagtgatggcgtggcagagctgctgttgcgggtccgcaagctgtctctcacgggcaatatgctcacagacctacctccgctcatgggccatatgacgcaattgcggtacttggatctgagtaacaatgctctacacaacgtccctgcggttgtgactcggctgacgacgctcgaaatcctcgatgtctcctacaaccaggtggaggctttcccggagggcatgctgcggctcaccaatctcatggtcttgtcgttttcacacaacaagctgcgccatgtgccatcgttcatcgcggacatggcagaactgcggctcatggagattgatggcaacccgttcgtggacccccctcctccatgtgtcgacccacaagccgagggagtgctagattgggttgaagaagtcaaggagtggctgaggagtaaacgaatacaaccacctccacagcagcagttgccacagcagcagttgccacagatacagacacagacaccacaacaagtgccaccaacaccaacaccaacacaagcacaagctccgtcagtgcacaccacgcctccagtgacacccctcgaagatgaccccatttcgtcccgacaggccaaacgaatgggcgtcattgtcaaaaaataccgatccaccacgtcacatgctcgtggggcgtcacatgactcagccattggagatcccgtccaaggtcaaggctcgtccacgggagcctacttcaagcggctgtccacgcttcccgaggaacgcaaaaacaacacgatcgaggcgtgtcgaaaaatcctctttgccttttctgagatcctgccagccatcaaaacatacagcggcttttgcaaagatagaaaactggtggcgaaagcggccaatctacatggcacgtgccagcaacaacaggaggcactactggcggcactggagagatatgaagagacggtacaggacgctacagtggaatctgccgtcgtggaaagggcggggctctgcgtgggctctctgcggcgcattctggcgctgttgcattccaacattgccttgtttgcatcggcagacattcggtacacgcgcctgatgcttctgtcgacatttggatccttatccgaagtccataacgcgtggcataccctgtttccgcctaatgagcccgacaagttcagcaccgtgtctcccgcagaccgagcgctgtacgagaagctcatcagtgcgaccaactgcgctcaaaacgtgctgggacagctgacggagttcatctccaagagcgcagctgcgtctgcacacgctggaggcaccatttcgcctcacgtgaccatcctggtgaaggagctcacgtccacgtgtgtggcaggagcagacgcgactcgccaagtacgtcagcggcttgaccgagtggccagaggcgatttcccgccgcgacagcagttcctggacacgacatcgtacttcctcaaggtggtgattgccatgttggccgctacaagacaggccatggacgatctaccgattctgggcaatgcgtctgcagctctgggaaccctgaccaagttgactaaggagattgccatttcgctggaatacaagcccaaggataacggcggaggtgctggaatgggaatgggtggcattggaggtcttcctactgctacagggtctacatttgcgcccccaacaatgcctgctgtgattcctcagttctcacctgcggcgagcgggcaaaccactccgctagtggctgccttgggtcctgcagccagtgttgttgagggctttttcgatcatcaccaggttgaatag

SEQ ID NO: 35596 - protein, 766 aa, Yarrowia lipolytica CLIB99
MSTIPTGIRLQFFPIVYPYSLSYFLPCSILYRALHMTAPYKVAAANILPLQPFMAFCGTFSGPPHVETNWATFQRGTKPHKPGKNINTSATYALGVHQTPTSTHPHMASSSLFSQLQENSIGSANIRPFYLFSPTSMDLIQDVQRKVEEAGGDEERGVELNHMGLTEVSDGVAELLLRVRKLSLTGNMLTDLPPLMGHMTQLRYLDLSNNALHNVPAVVTRLTTLEILDVSYNQVEAFPEGMLRLTNLMVLSFSHNKLRHVPSFIADMAELRLMEIDGNPFVDPPPPCVDPQAEGVLDWVEEVKEWLRSKRIQPPPQQQLPQQQLPQIQTQTPQQVPPTPTPTQAQAPSVHTTPPVTPLEDDPISSRQAKRMGVIVKKYRSTTSHARGASHDSAIGDPVQGQGSSTGAYFKRLSTLPEERKNNTIEACRKILFAFSEILPAIKTYSGFCKDRKLVAKAANLHGTCQQQQEALLAALERYEETVQDATVESAVVERAGLCVGSLRRILALLHSNIALFASADIRYTRLMLLSTFGSLSEVHNAWHTLFPPNEPDKFSTVSPADRALYEKLISATNCAQNVLGQLTEFISKSAAASAHAGGTISPHVTILVKELTSTCVAGADATRQVRQRLDRVARGDFPPRQQFLDTTSYFLKVVIAMLAATRQAMDDLPILGNASAALGTLTKLTKEIAISLEYKPKDNGGGAGMGMGGIGGLPTATGSTFAPPTMPAVIPQFSPAASGQTTPLVAALGPAASVVEGFFDHHQVE

SEQ ID NO: 35597 - DNA, 2466 bp, Candida albicans SC5314
  CDS (1)..(2466): transl_table=12
atgagtagatctcaaatagttgcgttattgaaggagcaacttgataccattaaacagaagaaatcaatcaaactaaactccttaccatctaccaccaaaccgtcagaattgatagatacaatatatgagtttttaactagttttgatccgtctttggagttagagaaattggcaatacaaaacagccaactcattgaactaccatcaaacttccacaaaattgcatcgtctataaagtatttggatttacaccagaattcaatttcgtatattcctcaagattttttttatgggtttgatagtttggagatcttggatttagcatccaatgacttggagttcttgcctgactcgttgtcttctgttaccacgttgaaggtaatttctatcaaagataacagtttcaagtacatatcgccacagcttggagaattaccaaatttgaacttaatcgaagtgtcagggaatccatcactacttccttcgaacgacataattcgagcattccagcaacaaaaacctgatctagattgggtgggagagttgaagaattatttggtcgccaatagaatgctcattaatctgaaaattcaagaggccatggaaaagtcgtcgcaaaaacgacaacaagtaccaaaagattcgacaccagaaacgtctcaaaccacgagtgatccagtaatagcgagaagtaaatccggatctatatcgacctcgttttcatcaaaggcatcacggagaatggggttgattatcaagaaatcagacgaaaacagtgacggatcctccaaagaagatgccaataatagtttaatctctggggctgtaccggatcatgtaaccacagaaggcattcctcatgttgactcaccaacagacatctccttccagttgccaaagtcgccacctacatctacaccaggaacaaccacaccgtcaacacaagctgcacctgctacgacatctactaataagaaccttggcgtgacactgacatcatcggcacgaggacgttcaaacacttttaaagagatcgatcggatgcttgaaaaaagcgaaagtgtcgatactgaacgtaaatctaatgcttatttcaaacgtttgtccaccttgcaagaacttcctggtgatgagttatcggagtattctcaacccaaaaaacccgcagcagagggcaaacaagcttctggaaatgtgtcaaaatctaataacaccgctgccagcgaaaattccccagccaaacctcaacagcaaagtaaattgcacaccaatccagtcattattagagtatctcgtaaaatccttttttcatttagtgaactacattcatccattcgtagattcacttcgttttgctcagataaaaaagtcacgatgaaaatggtgtcatacctttatagcacaaaatctaacattgattctttagtggagaatcttgaaatcatggaagaatccggcgacaattcagaacaaatagtgcaagctttacacaattgcataggctcgttcaaatcgattatgaagcttctccatgagaatatccagtcttttgttggaaatatagaggtttgctttataagaatggtctatttatctgtgtttggatcgttgaatgaactacaaaatgcttacttgttgttgtgtcctaaagcaagtgcaaagtcttcttcaactgaaatgaaacagaagctttccatcaatactactacggatgcagatgaaaagttgtacagtacaattgaactggctactagcagcacacagacaatattttccgagttgaataaaacaatcaataaaggtgcaacagctagtgccaacggaggggtagttcacccaacagtcgcttccaagataaaagaactagccaaggtgtgtgcagcatcactagacattataaaaagactcaatacaaagctaataactatcagaaataatccatcggtcaccacgaaaaagttgtttgctgaggatattaatcaatttatcaaaactgttgtccagactttagctgcagttaaggcaatagttaaagatatacctattctcgacgacattcgtgcatcaatgtccaatttgacaaagactgcaaaggaggtgacatactttttagaggtttcgtcgtacaaatcattgcttccggactcttcgtccactggtgtctctcaacaaccacaattgatctcagtccctagtgtatcaaacttgtttacaccagtagctgcacatgcaccttccttacccactagcggaggacaagcagctagcaatggaccaaccccaatacgcaatccttcaacaaattcctccataactacgacaacattagtgcttcctccattaaacttacaagaaagtgctccgttgactgctccggtacaatcttctggtcaaatgtttgcaaaacacggacttaatccatttgatgggttgattatggcaagaaataatgataatcaaggttag

SEQ ID NO: 35598 - protein, 821 aa, Candida albicans SC5314
MSRSQIVALLKEQLDTIKQKKSIKLNSLPSTTKPSELIDTIYEFLTSFDPSLELEKLAIQNSQLIELPSNFHKIASSIKYLDLHQNSISYIPQDFFYGFDSLEILDLASNDLEFLPDSLSSVTTLKVISIKDNSFKYISPQLGELPNLNLIEVSGNPSLLPSNDIIRAFQQQKPDLDWVGELKNYLVANRMLINSKIQEAMEKSSQKRQQVPKDSTPETSQTTSDPVIARSKSGSISTSFSSKASRRMGLIIKKSDENSDGSSKEDANNSLISGAVPDHVTTEGIPHVDSPTDISFQLPKSPPTSTPGTTTPSTQAAPATTSTNKNLGVTSTSSARGRSNTFKEIDRMLEKSESVDTERKSNAYFKRLSTLQELPGDELSEYSQPKKPAAEGKQASGNVSKSNNTAASENSPAKPQQQSKLHTNPVIIRVSRKILFSFSELHSSIRRFTSFCSDKKVTMKMVSYLYSTKSNIDSLVENLEIMEESGDNSEQIVQALHNCIGSFKSIMKLLHENIQSFVGNIEVCFIRMVYLSVFGSLNELQNAYLLLCPKASAKSSSTEMKQKLSINTTTDADEKLYSTIESATSSTQTIFSELNKTINKGATASANGGVVHPTVASKIKELAKVCAASLDIIKRLNTKLITIRNNPSVTTKKLFAEDINQFIKTVVQTLAAVKAIVKDIPILDDIRASMSNLTKTAKEVTYFLEVSSYKSLLPDSSSTGVSQQPQLISVPSVSNLFTPVAAHAPSLPTSGGQAASNGPTPIRNPSTNSSITTTTLVLPPLNLQESAPLTAPVQSSGQMFAKHGLNPFDGLIMARNNDNQG

SEQ ID NO: 35599 - DNA, 1137 bp, Leptospira interrogans serovar Copenhageni str. Fiocruz L1-130
  CDS (1)..(1137): transl_table=11
atgaactttcgcataactttgacttacttacaaagaataataattagtcttttatttctcattcatctttcttgcgagattcaagcatgcgaagaaccaggaatttatagagatttaacaaaagcgttccaaaatcctttggatgttcgagttttgattttgagtgaacaaaaactcaaggttcttcctgagaaaattggacaacttaaaaacttgcaaatgttggatttgagtgataaccaactcataatacttcctaaagaaattagacaactgaagaacttgcaagaattgtttttgaattataaccaacttacaacttttcctaaggaaatcgagcaattgaaaagcttgcacaagttgtatttgagcaataaccaactcactattcttcctgtcgaaattggacaactacagaatcttcaagaattgaatttatggaataatcaacttaaaaccatttctaaggaaatcgagcaattgaagaacttgcaaaagttgtatttggataataaccaactcacagctctttctaaggaaatcggaaaactacagaatttgaaatcgttgtttttgagtaataaccaacttacaacttttcctaaggaaatcggaaaactacagaatttgcaagaattgtatttgagtaataaccaacttacaacttttcctaaagaaatcggaaaactacaaaagttgcaatggttgggtttgggtgataaccaactcacaacaattcctaacgaaatcggaaaactacaaaagttgcaagagttgaatttagatgttaaccaactcacaacaattcctaaggaaattgggcaattacagaatttacaagtgttgtttttgagttataaccaatttaaaacaattcctgtggaattcggacaactaaagaatttaaaaatgttgagtttagatgctaaccaactcacagcacttcctaaagaaatcggaaaattgaagaatttaaaaatgttgaatttagatgctaaccaactcacaacaattcctaaggaaattggacaattacagaacttgcaaactttgtatttacgaaacaaccaattctcaatcgaagaaaaagaaaggattcgaaagcttcttccaaagtgccaaatttactttgaataa

SEQ ID NO: 35600 - protein, 378 aa, Leptospira interrogans serovar Copenhageni str. Fiocruz L1-130
MNFRITLTYLQRIIISLLFLIHLSCEIQACEEPGIYRDLTKAFQNPLDVRVLILSEQKLKVLPEKIGQLKNLQMLDLSDNQLIILPKEIRQLKNLQELFLNYNQLTTFPKEIEQLKSLHKLYLSNNQLTILPVEIGQLQNLQELNLWNNQLKTISKEIEQLKNLQKLYLDNNQLTALSKEIGKLQNLKSLFLSNNQLTTFPKEIGKLQNLQELYLSNNQLTTFPKEIGKLQKLQWLGLGDNQLTTIPNEIGKLQKLQELNLDVNQLTTIPKEIGQLQNLQVLFLSYNQFKTIPVEFGQLKNLKMLSLDANQLTALPKEIGKLKNLKMLNLDANQLTTIPKEIGQLQNLQTLYLRNNQFSIEEKERIRKLLPKCQIYFE

SEQ ID NO: 35601 - DNA, 1209 bp, Leptospira interrogans serovar Copenhageni str. Fiocruz L1-130
  CDS (1)..(1209): transl_table=11
ttgaaaaatttacaagagttgaatttgaataagaaccaactcacaattcttcctaaggaaattgggcaattgaagaacttgcgaaagttgaatttgagtgctaaccaaatcaaaactattccgaaagaaattgaaaaactacaaaagttgcaatcgttgtatttgcctaataaccaacttacaactcttccacaagaaattggacaactacaaaagttgcaatggttgtatttgcctaagaaccaactcacaactcttccacaagaaattggacaattgaagaatttgaaatcgttgaatttgagttataaccaaatcaaaactattccgaaagaaattgaaaaactacaaaagttgcaatcgttgggtttggataataaccaacttacaactcttccacaagaaattggacaactacagaacttgcaatcgttggatttgagtactaaccgacttacaactcttccacaagaaattggacaactacagaacttgcaatcgttggatttgagtactaaccgactcacaactcttccacaagaaattggacatctacagaatttgcaagaattgtatttggtttctaaccaactcacaattcttcctaacgaaatcggacaattaaagaacttgcaaacgttgaatttgcgtaataaccgactcactactctttctaaagaaattgagcaactacagaatttgaaatcgttggatttgcgttctaaccaacttactatttttcctaaggaaatcggacaattgaagaatttgcaagttttggatttgggttctaaccaactcactactcttccagagggaatcggacaattgaagaacttgcaaacattggatttggattctaaccaacttacaactcttccacaagaaataaaacaactgaaaaatttacaattgttggatttaagttataaccaactcaaaactcttcctaaggaaatcgagcaattgaagaacttgcaaacattatatttgggttataaccaactcacagttcttccaaaagaaattggacaactacagaatttgaaagtgttgtttttgaataataaccaactcactactcttccgaaagaaatcggacaactgaagaacttgcaagaattgtatttaaacaacaatcaactctcaatcgaagaaaaagaaaggattcgaaagcttcttccaaagtgccaaatttactttgaataa

SEQ ID NO: 35602 - protein, 402 aa, Leptospira interrogans serovar Copenhageni str. Fiocruz L1-130
MKNLQELNLNKNQLTILPKEIGQLKNLRKLNLSANQIKTIPKEIEKLQKLQSLYLPNNQLTTLPQEIGQLQKLQWLYLPKNQLTTLPQEIGQLKNLKSLNLSYNQIKTIPKEIEKLQKLQSLGLDNNQLTTLPQEIGQLQNLQSLDLSTNRLTTLPQEIGQLQNLQSLDLSTNRLTTLPQEIGHLQNLQELYLVSNQLTILPNEIGQLKNLQTLNLRNNRLTTLSKEIEQLQNLKSLDLRSNQLTIFPKEIGQLKNLQVLDLGSNQLTTLPEGIGQLKNLQTLDLDSNQLTTLPQEIKQLKNLQLLDLSYNQLKTLPKEIEQLKNLQTLYLGYNQLTVLPKEIGQLQNLKVLFLNNNQLTTLPKEIGQLKNLQELYLNNNQLSIEEKERIRKLLPKCQIYFE

SEQ ID NO: 35603 - DNA, 1566 bp, Leptospira interrogans serovar Copenhageni str. Fiocruz L1-130
  CDS (1)..(1566): transl_table=11
atgaacttccgcataactttgaattacttacaaaaaataacaattggtcttttatttctcattaatttatcttgcaagattcaagcagaagaagtagaaccagaagcttatcaagatttaacaaaagccctccaaaatcctttggatgttcgagttttgattttgagtgaacaaaaactcacaactcttccgaaagaaattaaacaactacagaacttgaaattgttggatttgggtcataatcagcttacagctcttccgaaagaaatcggacaactacggaatttacaagagttggatttgagttttaactcacttacaactctccccaaagaagtcgggcaattggagaatttacaacggttaaatttgaattcccaaaaactcacgacccttccgaaagaaatcggacaactacggaatttacaagagttggatttgagttttaactcacttacaactctccccaaagaagtcgggcaattggagaatttacaacggttaaatttgaattcccaaaaactcacgacccttccgaaagaaatcggacaactacggaatttacaagagttggatttgagttttaactcacttacaactctccccaaagaagtcgggcaattggagaatttacaacggttaaatttgaattcccaaaaactcacgacccttccgaaagaaatcggacaactacggaatttacaagagttggatttgagttttaactcacttacaactctccccaaagaagtcgggcaattggagaatttacaacggttggatttgcatcaaaaccgactcgcaactcttcctatggaaatcggacagttaaaaaatttacaagagttagatttgaatagcaacaaactcacaacccttccgaaagaaataagacaactacgaaatttacaagagttagatttgcatcgaaaccaactcacaactctcccaaaagaaatcggacaactacagaatttaaagaccttgaatttgattgttacccagctaacaacccttcccaaagaaataggggagcttcagaatttaaagaccttgaatttgcttgataaccaacttacaactcttcccaaagaaataggggagcttcagaatttagagatcttggttttgcgtgaaaaccggatcacagctcttccgaaagaaatcggacaactacagaatttacaacggttggatttgcatcaaaaccaactcacaactctcccgaaagaaatcggacagctacagaatttacaagagctctgtttagatgagaatcaactcacgactcttccgaaagaaatcgagcaattacaaaacttacgagtcttggatttggataataaccaactcacgactcttccgaaagaaatcggacaattacagaacttgcaagagctctgtttggatgagaatcaactcacaacttttcctaaggaaatcaggcaactgaaaaatttacaagagttgcatttgtatttgaatcctctctcatccaaagaaaaaaaaaggattcgaagattacttccaaaatgtgaaattcattttgaagaatatcatatatag

SEQ ID NO: 35604 - protein, 521 aa, Leptospira interrogans serovar Copenhageni str. Fiocruz L1-130
MNFRITLNYLQKITIGLLFLINLSCKIQAEEVEPEAYQDLTKALQNPLDVRVLILSEQKLTTLPKEIKQLQNLKLLDLGHNQLTALPKEIGQLRNLQELDLSFNSLTTLPKEVGQLENLQRLNLNSQKLTTLPKEIGQLRNLQELDLSFNSLTTLPKEVGQLENLQRLNLNSQKLTTLPKEIGQLRNLQELDLSFNSLTTLPKEVGQLENLQRLNLNSQKLTTLPKEIGQLRNLQELDLSFNSLTTLPKEVGQLENLQRLDLHQNRLATLPMEIGQLKNLQELDLNSNKLTTLPKEIRQLRNLQELDLHRNQLTTLPKEIGQLQNLKTLNLIVTQLTTLPKEIGELQNLKTLNLLDNQLTTLPKEIGELQNLEILVLRENRITALPKEIGQLQNLQRLDLHQNQLTTLPKEIGQLQNLQELCLDENQLTTLPKEIEQLQNLRVLDLDNNQLTTLPKEIGQLQNLQELCLDENQLTTFPKEIRQLKNLQELHLYLNPLSSKEKKRIRRLLPKCEIHFEEYHI

SEQ ID NO: 35605 - DNA, 1134 bp, Leptospira interrogans serovar Copenhageni str. Fiocruz L1-130
  CDS (1)..(1134): transl_table=11
atgaacttccgcataacgttaattcacttacaaaaaattacaattggtcttttgtttctcattcatctttcttacgagattcaagcagaagaaccaggaacttatagagatttaacaaaagcgctccaaaatcctttggaggttcgagttttggatttgagtcgtcaagaactcaaaacccttcctatagaaatcggaaaattgaagaatctgcaaaggttgtatttacattataaccaacttacagttcttccacaagaaatagaacaactgaaaaatttacaattgttgtatttgcgttctaaccgactcactactcttcctaaggaaatcgagcaattgaagaacttgcaagttttggatttgggttctaaccaacttacagttcttccacaagaaatagaacagctgaaaaatttacaattgttgtatttgcattctaaccgactcactactctttctaaagacattgaacaactacagaatttgaaatcgttagatttgagtaataaccaacttacaactcttcctaacgaaatcgagcaattgaaaaacttgaaatcgttgtatttgagtgagaaccaattcgcaacttttcctaaagaaattggacaactacagaatttaaaagtgttgtttttgaataataaccaaatcacaatacttcccaacgaaatcgcaaaactaaaaaagctacaatacttatatttaagcgacaatcaactcataacccttccgaaagaaatagagcaattgaagaacttgcaaacgttggatttgagttataaccaacttacaatacttcctaaggaagtcggacaattagaaaatttgcaaacgttggatttgcgtaataaccaactcaaaactcttccgaaagaaatagagcaattgaagaacttacaaacgttgtttttgagtaataaccaactcacaatacttccacaagaaatcggaaaactgaagaatttgttatggttgagtttggtttataaccaactcactactcttcctaacgaaatcgagcaattgaagaacttacaaacattgtatttaaacaacaaccaattctcatcccaagaaaaaaaaagaattcgaaaacttcttccaaagtgccaaatttactttgactaa

SEQ ID NO: 35606 - protein, 377 aa, Leptospira interrogans serovar Copenhageni str. Fiocruz L1-130
MNFRITLIHLQKITIGLLFLIHLSYEIQAEEPGTYRDLTKALQNPLEVRVLDLSRQELKTLPIEIGKLKNLQRLYLHYNQLTVLPQEIEQLKNLQLLYLRSNRLTTLPKEIEQLKNLQVLDLGSNQLTVLPQEIEQLKNLQLLYLHSNRLTTLSKDIEQLQNLKSLDLSNNQLTTLPNEIEQLKNLKSLYLSENQFATFPKEIGQLQNLKVLFLNNNQITILPNEIAKLKKLQYLYLSDNQLITLPKEIEQLKNLQTLDLSYNQLTILPKEVGQLENLQTLDLRNNQLKTLPKEIEQLKNLQTLFLSNNQLTILPQEIGKLKNLLWLSLVYNQLTTLPNEIEQLKNLQTLYLNNNQFSSQEKKRIRKLLPKCQIYFD

SEQ ID NO: 35607 - DNA, 1281 bp, Leptospira interrogans serovar Copenhageni str. Fiocruz L1-130
  CDS (1)..(1281): transl_table=11
atgaatttccaatccataaacattcgtttaaataaaagactcatgattcttttgattctgatctgtttttcctgcaaactacaagcccaatctaacgaagcgcaaacatattatcgtaatataacagaggctcttaaaaatccacagaatgttcgaattctgaatttgagcggtagcaaactcacaacccttccgggagaaatcggaaaactgcaaaatttacaactgttgaatttagatgataaccaacttatagctcttccgaaagaaattggaaaacttcaaaatttacaacaattgcatttgagtaagaaccaactcatggcgcttccagaagaaatcggacaacttcagaatttacaaaagttgaaattgtatgaaaaccagcttacggccattcccaaagagattggacaactacaaaatttacaagagctgaatttggcacataaccaactcgcaactctaccagaagacatcgaacaattacaaagattacaaacattgtatttgggtcataaccaatttaactccattctcaaagagattggacaattacaaaatttagaatcattaggtttggatcataatcaacttaacgtccttcccaaagaaattggacaacttcgaaatttagaatcattaggtttggatcataaccaacttaacgtccttcccaaagaaattggacaacttcaaaatttacaaatattacatttgcgtaataaccaactcacaactcttcccaaagaaatcgggcagcttcagaatttacaaaagttacttttaaataaaaacaaactcacaactcttcccaaagaaattggtcagcttcagaatttacaaaagttgaaattgtatgaaaaccaacttacaacccttccgaaagagattggacaactacaaaatttacaagagttggatttagatggtaaccaactcacaactctaccagaaaacatcggacaattacagaggttacaaacgttgtatttgggtaataatcaacttaacttccttccaaaagaaattggacaacttcgaaatttagaatcattagatctggagcataaccaacttaacgcccttcccaaagaaattggaaaattgcagaagttgcaaaccctgaatttgaaatataatcaacttgcgactcttcccgaggagatcaaacaactaaagaacttaaaaaagttgtatttgcataacaatccacttccatcggaaaaaatagcaagaattcgaaaattacttccccaatgtattatttattttgaatga

SEQ ID NO: 35608 - protein, 426 aa, Leptospira interrogans serovar Copenhageni str. Fiocruz L1-130
MNFQSINIRLNKRLMILLILICFSCKLQAQSNEAQTYYRNITEALKNPQNVRILNLSGSKLTTLPGEIGKLQNLQLLNLDDNQLIALPKEIGKLQNLQQLHLSKNQLMALPEEIGQLQNLQKLKLYENQLTAIPKEIGQLQNLQELNLAHNQLATLPEDIEQLQRLQTLYLGHNQFNSILKEIGQLQNLESLGLDHNQLNVLPKEIGQLRNLESLGLDHNQLNVLPKEIGQLQNLQILHLRNNQLTTLPKEIGQLQNLQKLLLNKNKLTTLPKEIGQLQNLQKLKLYENQLTTLPKEIGQLQNLQELDLDGNQLTTLPENIGQLQRLQTLYLGNNQLNFLPKEIGQLRNLESLDLEHNQLNALPKEIGKLQKLQTLNLKYNQLATLPEEIKQLKNLKKLYLHNNPLPSEKIARIRKLLPQCIIYFE

SEQ ID NO: 35609 - DNA, 1719 bp, Leptospira interrogans serovar Copenhageni str. Fiocruz L1-130
  CDS (1)..(1719): transl_table=11
atgaactttcgcataacgttgatttacttacaaaagattacaattggtcttttgtttctcattactctttcttgcgagattcaagcagacgaagtaaaaccaggaacttatatggatttaacaaaagcgctccaaaatcctttaaatgttcgagttttggatttgagtggacaaaatttcacaacacttcctaaggaaattgaacaattaaagaatttacaggaattagatttacgtgataaccaactcgcaacttttcctgccgtaatagtagagctacagaagttagaaagtttggatttatctgagaaccggcttgtaatgcttcctaatgaaatagggcggttacaaaatttacaagagttgggtttgtataaaaacaaacttactacttttccaaaggaaatagggcagttacagaatttacaaaagttatggttatctgagaaccgactcacagcacttcctaaggaaattggtcaattgaagaatttacaaacattggatttgcagaataaccaattcacgatacttccaaaagaaataggacaattacagaatttacaaacattgaatttgcaggataaccaactcgcaactcttcctgtcgaaatcggacaactacagaatttacaagagttgtatttgcggaataaccgactcacagttcttccaaaggaaataggacaactacagaatttgcaaacgttatgttcacctgaaaaccgtctcacagcacttcctaaagaaatggggcagctaaaaaatttacaaacattgaatttggtgaataaccgactcacagttcttcctaaggaaatcggacaactacagaatctgcaagatttggaattgctaatgaatcccctttcattaaaagaaagaaaaagaattcaaaagttgtttccagatagtaatcttgatttgagagaagtagcagaggacggtgtttatcgcaatttaaatttggctcaggaagaacctttaaaagtttttgacttgaggcttcaatacaaaaatttttctcaattgtttccaaaagtaattttgaaatttcgaaatttacgagagttgtatttatacgattgtggattttcaactcttccgaaagaaattagccgacttaaaaatttaaagtatttagccttaggcttaaatggtcttaaaaatattccttctgaaatcggccaactgaagaatttagaagctttgaatttagaagcaaacgaattggaaagacttcctaaagaaattgggcaactgcggaatttacagaggttaagtttacatcaaaatacattgaaaatatttcccgccgaaatcgaacaactgaaaaaattgcaaaagttagatttgagcgttaatcaattcacgacttttcctaaggaaatcggaaaattagaaaatttacaaacattgaatttgcagcgtaaccaacttacaaaccttactgccgaaatcggacaactacaaaatttacaagagttggatttaaatgataatcaatttacagttcttcctaaggaaattggaaaactgaaaaaattacaaacattggatttacggaataaccaactcacaacccttcctaccgaaatcggacaactacaaaatttacaatggttgtatttacagaataatcaactttcactcaaagaacaagaaaggattcgaaagttacttccactaaaatgtaaaataatttttgaagtttattag

SEQ ID NO: 35610 - protein, 572 aa, Leptospira interrogans serovar Copenhageni str. Fiocruz L1-130
MNFRITLIYLQKITIGLLFLITLSCEIQADEVKPGTYMDLTKALQNPLNVRVLDLSGQNFTTLPKEIEQLKNLQELDLRDNQLATFPAVIVELQKLESLDLSENRLVMLPNEIGRLQNLQELGLYKNKLTTFPKEIGQLQNLQKLWLSENRLTALPKEIGQLKNLQTLDLQNNQFTILPKEIGQLQNLQTLNLQDNQLATLPVEIGQLQNLQELYLRNNRLTVLPKEIGQLQNLQTLCSPENRLTALPKEMGQLKNLQTLNLVNNRLTVLPKEIGQLQNLQDLELLMNPLSLKERKRIQKLFPDSNLDLREVAEDGVYRNLNLAQEEPLKVFDLRLQYKNFSQLFPKVILKFRNLRELYLYDCGFSTLPKEISRLKNLKYLALGLNGLKNIPSEIGQLKNLEALNLEANELERLPKEIGQLRNLQRLSLHQNTLKIFPAEIEQLKKLQKLDLSVNQFTTFPKEIGKLENLQTLNLQRNQLTNLTAEIGQLQNLQELDLNDNQFTVLPKEIGKLKKLQTLDLRNNQLTTLPTEIGQLQNLQWLYLQNNQLSLKEQERIRKLLPLKCKIIFEVY

SEQ ID NO: 35611 - DNA, 1272 bp, Leptospira interrogans serovar Copenhageni str. Fiocruz L1-130
  CDS (1)..(1272): transl_table=11
atgaattatagatttacaaacatcctaaaggttataattttcttttgttttattttcgaaatacaatcagaagaaatacaaaaaccttataaaaatttagcaaaggctcttcaaaatccagcagacgttcggaacttagatttgagtttccaagggttgaagacgttgccaaataaaataggacaacttaagaatttacaaaaattggatttaggcggaaacgaacctacgattttgtctaaagaaatctggcagttaaaagatctgcaaaaattgaatttgaacaataacaaacttacggttctccctaaggaaatcggacaattacaaaacttgcaagaattaagtttgcatagcaatgagctcgtaaatcttccgaaagaaattggacagtttaagaatttgcaaaaactaaatttggacaataataaacttacggttctccctaaggaaatcggacaattacaaaacttgcaagaattgagtttacttagtaacaaactcataagtcttcccacagaaattgaacaacttaaaagtctgaagaatctagatttgaatcacaatgaatttactactgtttcgaaagaagttatgctacttgaaactttagaaaatttagatctaagatccaacaaactgaaaacaattcctaaagagataagacaacttaaaagtttgaaagtgttgatgttaactggcaatcaacttacctctttgccgaaagaaatcgaacaactccaaaatctaaaaacattaaatttgggagaaaatcgttttcaaatatttcccgtagaaattttagaacttaagaatttactggaattgaatttgtattataaccaacttgtagagtttccgaaggaagttggacaacttaaaagtttaaagtatttgagtttgtatcacaatcaaattacaactcttccggtagaagttacacaattgccggatttgcaagagctgcatttgtctgggaataaaattacgattcttccaaaagagattctacaacttaaaaatttagaatggctgtcattgagtaacaataaactcaatgcgcttccgaaagaaatcggacagttgaaaaaattacaaaggttggaattaggaaacaatcagcttacgacccttccgaaagaaatagaacaacttaaaaatttacaaagattagaattagattccaatcccatttctccaaaagaaaaagaaagaatccgaaaacttcttcctaaatgtgaaatcgattttgaaggagggggaggagaatag

SEQ ID NO: 35612 - protein, 423 aa, Leptospira interrogans serovar Copenhageni str. Fiocruz L1-130
MNYRFTNILKVIIFFCFIFEIQSEEIQKPYKNLAKALQNPADVRNLDLSFQGLKTLPNKIGQLKNLQKLDLGGNEPTILSKEIWQLKDLQKLNLNNNKLTVLPKEIGQLQNLQELSLHSNELVNLPKEIGQFKNLQKLNLDNNKLTVLPKEIGQLQNLQELSLLSNKLISLPTEIEQLKSLKNLDLNHNEFTTVSKEVMLLETLENLDLRSNKLKTIPKEIRQLKSLKVLMLTGNQLTSLPKEIEQLQNLKTLNLGENRFQIFPVEILELKNLLELNLYYNQLVEFPKEVGQLKSLKYLSLYHNQITTLPVEVTQLPDLQELHLSGNKITILPKEILQLKNLEWLSLSNNKLNALPKEIGQLKKLQRLELGNNQLTTLPKEIEQLKNLQRLELDSNPISPKEKERIRKLLPKCEIDFEGGGGE

SEQ ID NO: 35613 - DNA, 819 bp, Leptospira interrogans serovar Copenhageni str. Fiocruz L1-130
  CDS (1)..(819): transl_table=11
atgaagtgccactttatatttgttagcattggattgatcttgtctttgtactgtagtctgaaaatgacaaaaacgtatcataatttgcaggatgctcttgataaccctttggacgttttaattcttgagatgagtatgaatacgcgtataagtatgggtttgcatgaactcgaatctcttccaagggtaattgggttatttcaaaatttagaaaaattgaatttagatggtaatcaacttacgtctcttccgaaagaaattggacaacttcaaaagttacgtgtattaaacttggctggtaatcaatttacgtcccttccaaaagaaataggacaacttcaaaatttagaaagattggatttagatggtaatcaatttacgtctcttccgaaagaaattggacaacttcaaaatttacgtgtattaaacttggctggtaatcaacttacgtcccttccaaaagaaataggacaacttcaaaatttagaaagattggatttagctggtaatcaatttacgtcccttccaaaagaaataggacaacttcaaaagttagaagcattgaatttagatcataatcgatttacaatttttccgaaagaaattaggcagcaacagagcctaaaatggttgcgtttgagtggggaccaactcaagacccttcccaaagaaattctattacttcaaaatttacaagtgctgcggttgtattcgaactctttttcattaaaagaaaaacagaaaattcaagagctacttcctaactgtgaaatcgattttgaaagtgaaggtaaaagcgaatcttctttgactgaatga

SEQ ID NO: 35614 - protein, 272 aa, Leptospira interrogans serovar Copenhageni str. Fiocruz L1-130
MKCHFIFVSIGLILSLYCSLKMTKTYHNLQDALDNPLDVLILEMSMNTRISMGLHELESLPRVIGLFQNLEKLNLDGNQLTSLPKEIGQLQKLRVLNLAGNQFTSLPKEIGQLQNLERLDLDGNQFTSLPKEIGQLQNLRVLNLAGNQLTSLPKEIGQLQNLERLDLAGNQFTSLPKEIGQLQKLEALNLDHNRFTIFPKEIRQQQSLKWLRLSGDQLKTLPKEILLLQNLQVLRLYSNSFSLKEKQKIQELLPNCEIDFESEGKSESSLTE

SEQ ID NO: 35615 - DNA, 1320 bp, Caenorhabditis briggsae
  CDS (1)..(1320)
atgggtgttgattcatataatccaactgtgcgtgcacgcctcacaaatgcaccgaaaacacgggttctgaacttgaaggaatctgctctccatcgagttcctgataatctcagtttgctaccctgtctagaagtgctgaaagtttcacaaaacaaactcacagatcttcccgatctttcaaagtgtgttctattgaaaactgtggaagcaagtgaaaatcatttcactgctttcccattgggtgtttgtcattctcctagtctcgaaacatgcatattcacagacaaccgaattgaaagttttcctgacgaaattcattcactgcgggcaatcagcttgatcctcaacaaaaaccggcttctctcactcaacaccgttaatttgctgcgctgtgaacgattgcgcgctgtgaacgttgacgataaccaactgaatcacgatgaaatcgagcaattcgttgctaacgctccacgagaaattcgaatttcgttcgatggaaatgtggctccaaaacatacggctgatttgcaggaaatgggcaatgactcctcgaaatcaaagtccgtcaccagcaatgcccgcaaactcattggtcagtcgggtccttccacatcaactgttaataaacaccttgagatggcaagcaaaagtcgagttctacaactgaagggaactggactgaagaaaattcctgatgaagtagagcagttagcaggagtattgcggaacttggagttgagcgagaacaaaatccgcgagataccggttttcatcggactgttctcacaattaaaacaacttcatttatccaataactgcctagaaagtttaccagatgaaattggttcaatgaaaaaactagaaattttgaaccttggaggtaacaaaatcaagaacctaccagatacgatagctggatgtacggacttgcgaacgattgatgtctcctctaactctttttcggagtttcctatttctattattgcctgtttgcaacttgatatactaaacttgaatgaaaatcaaattgaaacacttcctgatgacgtatcaaaattgcaagtcattgaactcagtctcagccagaatcgtctaaaaactttgaattcatcgaacctctcaaaatctcatcgacttcgcactctccgagtggatggaaactgtctagaaaaaactgagtttgctcgtgatcttctcgaatcttctactgtgtccgttatcacttatgatgggaaccgtttccagttgaaagatttccaagacttgcccggatatgatgcttatcaagaacgattcaccgctactaaaagaaagatttaa

SEQ ID NO: 35616 - protein, 439 aa, Caenorhabditis briggsae
MGVDSYNPTVRARLTNAPKTRVLNLKESALHRVPDNLSLLPCLEVLKVSQNKLTDLPDLSKCVLLKTVEASENHFTAFPLGVCHSPSLETCIFTDNRIESFPDEIHSLRAISLILNKNRLLSLNTVNLLRCERLRAVNVDDNQLNHDEIEQFVANAPREIRISFDGNVAPKHTADLQEMGNDSSKSKSVTSNARKLIGQSGPSTSTVNKHLEMASKSRVLQLKGTGLKKIPDEVEQLAGVLRNLELSENKIREIPVFIGLFSQLKQLHLSNNCLESLPDEIGSMKKLEILNLGGNKIKNLPDTIAGCTDLRTIDVSSNSFSEFPISIIACLQLDILNLNENQIETLPDDVSKLQVIELSLSQNRLKTLNSSNLSKSHRLRTLRVDGNCLEKTEFARDLLESSTVSVITYDGNRFQLKDFQDLPGYDAYQERFTATKRKI

SEQ ID NO: 35617 - DNA, 720 bp, Homo sapiens
  CDS (1)..(720)
atgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacagcaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaagtttgcgtga

SEQ ID NO: 35618 - protein, 239 aa, Homo sapiens
MGNSALRAHVETAQKTGVFQLKDRGLTEFPADLQKLTSNLRTIDLSNNKIESLPPLLIGKFTLLKSLSLNSNKLTVLPDEICNLKKLETLSLNNNHLRELPSTFGQLSALKTLSLSGNQLGALPPQLCSLRHLDVMDLSKNQIRSIPDSVGELQVIELNLNQNQISQISVKISCCPRLKILRLEENCLELSMLPQSILSDSQICLLAVEGNLFEIKKLRELEGYDKYMERFTATKKKFA

SEQ ID NO: 35619 - DNA, 720 bp, Homo sapiens
  CDS (1)..(720)
atgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaagtttgcgtga

SEQ ID NO: 35620 - protein, 239 aa, Homo sapiens
MGNSALRAHVETAQKTGVFQLKDRGLTEFPADLQKLTSNLRTIDLSNNKIESLPPLLIGKFTLLKSLSLNNNKLTVLPDEICNLKKLETLSLNNNHLRELPSTFGQLSALKTLSLSGNQLGALPPQLCSLRHLDVMDLSKNQIRSIPDSVGELQVIELNLNQNQISQISVKISCCPRLKILRLEENCLELSMLPQSILSDSQICLLAVEGNLFEIKKLRELEGYDKYMERFTATKKKFA

SEQ ID NO: 35621 - DNA, 24 bp, Artificial sequence
  (1)..(24): primer
atggtagcgacatcttcaaagagg

SEQ ID NO: 35622 - DNA, 23 bp, Artificial sequence
  (1)..(23): primer
ttactccggagagttggcgctta

SEQ ID NO: 35623 - protein, 380 aa, Artificial sequence
  Variant (2)..(9): xaa in position 2 to 9 is any amino acid
  Variant (10)..(11): xaa in position 10 to 11 is any or no amino acid
  Variant (13)..(13): xaa in position 13 is any amino acid
  Variant (15)..(18): xaa in position 15 to 18 is any amino acid
  Variant (20)..(21): xaa in position 20 to 21 is any amino acid
  Variant (24)..(24): xaa in position 24 is any amino acid
  Variant (27)..(28): xaa in position 27 to 28 is any amino acid
  Variant (30)..(31): xaa in position 30 to 31 is any amino acid
  Variant (32)..(33): xaa in position 32 to 33 is any or no amino acid
  Variant (35)..(36): xaa in position 35 to 36 is any amino acid
  Variant (38)..(38): xaa in position 38 is any amino acid
  Variant (40)..(41): xaa in position 40 to 41 is any amino acid
  Variant (43)..(45): xaa in position 43 to 45 is any or no amino acid
  Variant (47)..(52): xaa in position 47 to 52 is any amino acid
  Variant (53)..(53): xaa in position 53 is any or no amino acid
  Variant (55)..(59): xaa in position 55 to 59 is any amino acid
  Variant (61)..(62): xaa in position 61 to 62 is any amino acid
  Variant (64)..(64): xaa in position 64 is any amino acid
  Variant (66)..(67): xaa in position 66 to 67 is any amino acid
  Variant (69)..(75): xaa in position 69 to 75 is any amino acid
  Variant (76)..(90): xaa in position 76 to 90 is any or no amino acid
  Variant (93)..(94): xaa in position 93 to 94 is any amino acid
  Variant (96)..(97): xaa in position 96 to 97 is any amino acid
  Variant (99)..(105): xaa in position 99 to 105 is any amino acid
  Variant (106)..(128): xaa in position 106 to 128 is any or no amino acid
  Variant (130)..(137): xaa in position 130 to 137 is any amino acid
  Variant (139)..(143): xaa in position 139 to 143 is any amino acid
  Variant (145)..(151): xaa in position 145 to 151 is any amino acid
  Variant (153)..(166): xaa in position 153 to 166 is any amino acid
  Variant (167)..(214): xaa in position 167 to 214 is any or no amino acid
  Variant (216)..(217): xaa in position 216 to 217 is any amino acid
  Variant (219)..(219): xaa in position 219 is any amino acid
  Variant (221)..(221): xaa in position 221 is any amino acid
  Variant (222)..(222): xaa in position 222 is any or no amino acid
  Variant (224)..(228): xaa in position 224 to 228 is any amino acid
  Variant (229)..(265): xaa in position 229 to 265 is any or no amino acid
  Variant (267)..(268): xaa in position 267 to 268 is any amino acid
  Variant (270)..(271): xaa in position 270 to 271 is any amino acid
  Variant (273)..(274): xaa in position 273 to 274 is any amino acid
  Variant (276)..(296): xaa in position 276 to 296 is any amino acid
  Variant (297)..(311): xaa in position 297 to 311 is any or no amino acid
  Variant (313)..(314): xaa in position 313 to 314 is any amino acid
  Variant (316)..(337): xaa in position 316 to 337 is any amino acid
  Variant (338)..(364): xaa in position 338 to 364 is any or no amino acid
  Variant (366)..(378): xaa in position 366 to 378 is any amino acid
  Variant (379)..(379): xaa in position 379 is any or no amino acid
IXXXXXXXXXXLXLXXXXLXXLPXEIXXLXXXXLXXLXLXXNXXXLXXXXXXXIXXXXXLXXLXLXXNXXXXXXXXXXXXXXXXXXXXXXEIXXLXXLXXXXXXXXXXXXXXXXXXXXXXXXXXXXXXNXXXXXXXXIXXXXXLXXXXXXXNXXXXXXXXXXXXXXXXXXXXXXXXXXXXXXXXXXXXXXXXXXXXXXXXXXXXXXXXXXXXXXLXXLXLXXNXXXXXXXXXXXXXXXXXXXXXXXXXXXXXXXXXXXXXXXXXXPXXIXXLXXLXXXXXXXXXXXXXXXXXXXXXXXXXXXXXXXXXXXXLXXLXXXXXXXXXXXXXXXXXXXXXXXXXXXXXXXXXXXXXXXXXXXXXXXXXLXXXXXXXXXXXXXXI

SEQ ID NO: 35624 - protein, 46 aa, Artificial sequence
  Variant (2)..(4): xaa in position 2 to 4 is any or no amino acid
  Variant (6)..(13): xaa in position 6 to 13 is any amino acid
  Variant (14)..(14): xaa in position 14 is any or no amino acid
  Variant (16)..(17): xaa in position 16 to 17 is any amino acid
  Variant (18)..(18): xaa in position 18 is Phe, Ile, Leu or Val
  Variant (19)..(19): xaa in position 19 is any amino acid
  Variant (20)..(20): xaa in position 20 is Ile, Leu or Val
  Variant (21)..(22): xaa in position 21 to 22 is any amino acid
  Variant (24)..(24): xaa in position 24 is any amino acid
  Variant (25)..(25): xaa in position 25 is Phe, Ile or Leu
  Variant (26)..(27): xaa in position 26 to 27 is any amino acid
  Variant (28)..(28): xaa in position 28 is Phe, Ile, Leu or Val
  Variant (29)..(29): xaa in position 29 is Pro or Ser
  Variant (30)..(31): xaa in position 30 to 31 is any amino acid
  Variant (32)..(32): xaa in position 32 is Ile, Leu or Val
  Variant (33)..(37): xaa in position 33 to 37 is any amino acid
  Variant (39)..(45): xaa in position 39 to 45 is any amino acid
  Variant (46)..(46): xaa in position 46 is Asn or Ser
LXXXPXXXXXXXXXLXXXXXXXNXXXXXXXXXXXXXXLXXXXXXXX

SEQ ID NO: 35625 - DNA, 1392 bp, Escherichia coli K12; identical to SEQ ID NO: 28298
  CDS (1)..(1392): transl_table=11

SEQ ID NO: 35626 - protein, 463 aa, Escherichia coli K12; identical to SEQ ID NO: 28299

SEQ ID NO: 35627 - DNA, 1428 bp, Aquifex aeolicus VF5; identical to SEQ ID NO: 28300
  CDS (1)..(1428): transl_table=11

SEQ ID NO: 35628 - protein, 475 aa, Aquifex aeolicus VF5; identical to SEQ ID NO: 28301

SEQ ID NO: 35629 - DNA, 1212 bp, Pseudomonas aeruginosa PAO1; identical to SEQ ID NO: 28302
  CDS (1)..(1212): transl_table=11

SEQ ID NO: 35630 - protein, 403 aa, Pseudomonas aeruginosa PAO1; identical to SEQ ID NO: 28303

SEQ ID NO: 35631 - DNA, 1407 bp, Pseudomonas aeruginosa PAO1; identical to SEQ ID NO: 28304
  CDS (1)..(1407): transl_table=11

SEQ ID NO: 35632 - protein, 468 aa, Pseudomonas aeruginosa PAO1; identical to SEQ ID NO: 28305

SEQ ID NO: 35633 - DNA, 1296 bp, Pseudomonas aeruginosa PAO1; identical to SEQ ID NO: 28306
  CDS (1)..(1296): transl_table=11

SEQ ID NO: 35634 - protein, 431 aa, Pseudomonas aeruginosa PAO1; identical to SEQ ID NO: 28307

SEQ ID NO: 35635 - DNA, 1554 bp, Mycobacterium leprae TN; identical to SEQ ID NO: 28308
  CDS (1)..(1554): transl_table=11

SEQ ID NO: 35636 - protein, 517 aa, Mycobacterium leprae TN; identical to SEQ ID NO: 28309

SEQ ID NO: 35637 - DNA, 1389 bp, Escherichia coli O157:H7; identical to SEQ ID NO: 28310
  CDS (1)..(1389): transl_table=11

SEQ ID NO: 35638 - protein, 462 aa, Escherichia coli O157:H7; identical to SEQ ID NO: 28311

SEQ ID NO: 35639 - DNA, 1410 bp, Mycobacterium tuberculosis CDC1551; identical to SEQ ID NO: 28312
  CDS (1)..(1410): transl_table=11

SEQ ID NO: 35640 - protein, 469 aa, Mycobacterium tuberculosis CDC1551; identical to SEQ ID NO: 28313

SEQ ID NO: 35641 - DNA, 1392 bp, Mycobacterium tuberculosis CDC1551; identical to SEQ ID NO: 28314
  CDS (1)..(1392): transl_table=11

SEQ ID NO: 35642 - protein, 463 aa, Mycobacterium tuberculosis CDC1551; identical to SEQ ID NO: 28315

SEQ ID NO: 35643 - DNA, 1188 bp, Mycobacterium tuberculosis CDC1551; identical to SEQ ID NO: 28316
  CDS (1)..(1188): transl_table=11

SEQ ID NO: 35644 - protein, 395 aa, Mycobacterium tuberculosis CDC1551; identical to SEQ ID NO: 28317

SEQ ID NO: 35645 - DNA, 1548 bp, Mycobacterium tuberculosis CDC1551; identical to SEQ ID NO: 28318
  CDS (1)..(1548): transl_table=11

SEQ ID NO: 35646 - protein, 515 aa, Mycobacterium tuberculosis CDC1551; identical to SEQ ID NO: 28319

SEQ ID NO: 35647 - DNA, 1170 bp, Staphylococcus aureus subsp. aureus Mu50; identical to SEQ ID NO: 28320
  CDS (1)..(1170): transl_table=11

SEQ ID NO: 35648 - protein, 389 aa, Staphylococcus aureus subsp. aureus Mu50; identical to SEQ ID NO: 28321

SEQ ID NO: 35649 - DNA, 1422 bp, Caulobacter crescentus CB15; identical to SEQ ID NO: 28322
  CDS (1)..(1422): transl_table=11

SEQ ID NO: 35650 - protein, 473 aa, Caulobacter crescentus CB15; identical to SEQ ID NO: 28323

SEQ ID NO: 35651 - DNA, 1275 bp, Sinorhizobium meliloti 1021; identical to SEQ ID NO: 28324
  CDS (1)..(1275): transl_table=11

SEQ ID NO: 35652 - protein, 424 aa, Sinorhizobium meliloti 1021; identical to SEQ ID NO: 28325

SEQ ID NO: 35653 - DNA, 1398 bp, Salmonella typhimurium LT2; identical to SEQ ID NO: 28326
  CDS (1)..(1398): transl_table=11

SEQ ID NO: 35654 - protein, 465 aa, Salmonella typhimurium LT2; identical to SEQ ID NO: 28327

SEQ ID NO: 35655 - DNA, 1314 bp, Ralstonia solanacearum GMI1000; identical to SEQ ID NO: 28328
  CDS (1)..(1314): transl_table=11

SEQ ID NO: 35656 - protein, 437 aa, Ralstonia solanacearum GMI1000; identical to SEQ ID NO: 28329

SEQ ID NO: 35657 - DNA, 1386 bp, Ralstonia solanacearum GMI1000; identical to SEQ ID NO: 28330
  CDS (1)..(1386): transl_table=11

SEQ ID NO: 35658 - protein, 461 aa, Ralstonia solanacearum GMI1000; identical to SEQ ID NO: 28331

SEQ ID NO: 35659 - DNA, 2856 bp, Brucella melitensis 16M; identical to SEQ ID NO: 28332
  CDS (1)..(2856): transl_table=11

SEQ ID NO: 35660 - protein, 951 aa, Brucella melitensis 16M; identical to SEQ ID NO: 28333

SEQ ID NO: 35661 - DNA, 1293 bp, Clostridium perfringens str. 13; identical to SEQ ID NO: 28334
  CDS (1)..(1293): transl_table=11

SEQ ID NO: 35662 - protein, 430 aa, Clostridium perfringens str. 13; identical to SEQ ID NO: 28335

SEQ ID NO: 35663 - DNA, 1338 bp, Corynebacterium glutamicum ATCC 13032; identical to SEQ ID NO: 28336
  CDS (1)..(1338): transl_table=11

SEQ ID NO: 35664 - protein, 445 aa, Corynebacterium glutamicum ATCC 13032; identical to SEQ ID NO: 28337

SEQ ID NO: 35665 - DNA, 1239 bp, Streptomyces coelicolor A3(2); identical to SEQ ID NO: 28338
  CDS (1)..(1239): transl_table=11

SEQ ID NO: 35666 - protein, 412 aa, Streptomyces coelicolor A3(2); identical to SEQ ID NO: 28339

SEQ ID NO: 35667 - DNA, 1359 bp, Streptomyces coelicolor A3(2); identical to SEQ ID NO: 28340
  CDS (1)..(1359): transl_table=11

SEQ ID NO: 35668 - protein, 452 aa, Streptomyces coelicolor A3(2); identical to SEQ ID NO: 28341

SEQ ID NO: 35669 - DNA, 1236 bp, Xanthomonas campestris pv. campestris str. ATCC 33913; identical to SEQ ID NO: 28342
  CDS (1)..(1236): transl_table=11

SEQ ID NO: 35670 - protein, 411 aa, Xanthomonas campestris pv. campestris str. ATCC 33913; identical to SEQ ID NO: 28343

SEQ ID NO: 35671 - DNA, 2688 bp, Brucella suis 1330; identical to SEQ ID NO: 28344
  CDS (1)..(2688): transl_table=11

SEQ ID NO: 35672 - protein, 895 aa, Brucella suis 1330; identical to SEQ ID NO: 28345

SEQ ID NO: 35673 - DNA, 1389 bp, Shigella flexneri 2a str. 301; identical to SEQ ID NO: 28346
  CDS (1)..(1389): transl_table=11

SEQ ID NO: 35674 - protein, 462 aa, Shigella flexneri 2a str. 301; identical to SEQ ID NO: 28347

SEQ ID NO: 35675 - DNA, 1434 bp, Corynebacterium efficiens YS-314; identical to SEQ ID NO: 28348
  CDS (1)..(1434): transl_table=11

SEQ ID NO: 35676 - protein, 477 aa, Corynebacterium efficiens YS-314; identical to SEQ ID NO: 28349

SEQ ID NO: 35677 - DNA, 1302 bp, Corynebacterium efficiens YS-314; identical to SEQ ID NO: 28350
  CDS (1)..(1302): transl_table=11

SEQ ID NO: 35678 - protein, 433 aa, Corynebacterium efficiens YS-314; identical to SEQ ID NO: 28351

SEQ ID NO: 35679 - DNA, 1236 bp, Pseudomonas putida KT2440; identical to SEQ ID NO: 28352
  CDS (1)..(1236): transl_table=11

SEQ ID NO: 35680 - protein, 411 aa, Pseudomonas putida KT2440; identical to SEQ ID NO: 28353

SEQ ID NO: 35681 - DNA, 1164 bp, Staphylococcus epidermidis ATCC 12228; identical to SEQ ID NO: 28354
  CDS (1)..(1164): transl_table=11

SEQ ID NO: 35682 - protein, 387 aa, Staphylococcus epidermidis ATCC 12228; identical to SEQ ID NO: 28355

SEQ ID NO: 35683 - DNA, 1380 bp, Bradyrhizobium japonicum USDA 110; identical to SEQ ID NO: 28356
  CDS (1)..(1380): transl_table=11

SEQ ID NO: 35684 - protein, 459 aa, Bradyrhizobium japonicum USDA 110; identical to SEQ ID NO: 28357

SEQ ID NO: 35685 - DNA, 1191 bp, Lactobacillus plantarum WCFS1; identical to SEQ ID NO: 28358
  CDS (1)..(1191): transl_table=11

SEQ ID NO: 35686 - protein, 396 aa, Lactobacillus plantarum WCFS1; identical to SEQ ID NO: 28359

SEQ ID NO: 35687 - DNA, 1212 bp, Pseudomonas syringae pv. tomato str. DC3000; identical to SEQ ID NO: 28360
  CDS (1)..(1212): transl_table=11

SEQ ID NO: 35688 - protein, 403 aa, Pseudomonas syringae pv. tomato str. DC3000; identical to SEQ ID NO: 28361

SEQ ID NO: 35689 - DNA, 1389 bp, Salmonella enterica subsp. enterica serovar Typhi Ty2; identical to SEQ ID NO: 28362
  CDS (1)..(1389): transl_table=11

SEQ ID NO: 35690 - protein, 462 aa, Salmonella enterica subsp. enterica serovar Typhi Ty2; identical to SEQ ID NO: 28363

SEQ ID NO: 35691 - DNA, 1392 bp, Streptomyces avermitilis MA-4680; identical to SEQ ID NO: 28364
  CDS (1)..(1392): transl_table=11

SEQ ID NO: 35692 - protein, 463 aa, Streptomyces avermitilis MA-4680; identical to SEQ ID NO: 28365

SEQ ID NO: 35693 - DNA, 1170 bp, Bacillus cereus ATCC 14579; identical to SEQ ID NO: 28366
  CDS (1)..(1170): transl_table=11

SEQ ID NO: 35694 - protein, 389 aa, Bacillus cereus ATCC 14579; identical to SEQ ID NO: 28367

SEQ ID NO: 35695 - DNA, 1389 bp, Shigella flexneri 2a str. 2457T; identical to SEQ ID NO: 28368
  CDS (1)..(1389): transl_table=11

SEQ ID NO: 35696 - protein, 462 aa, Shigella flexneri 2a str. 2457T; identical to SEQ ID NO: 28369

SEQ ID NO: 35697 - DNA, 1203 bp, Chromobacterium violaceum ATCC 12472; identical to SEQ ID NO: 28370
  CDS (1)..(1203): transl_table=11

SEQ ID NO: 35698 - protein, 400 aa, Chromobacterium violaceum ATCC 12472; identical to SEQ ID NO: 28371

SEQ ID NO: 35699 - DNA, 1380 bp, Chromobacterium violaceum ATCC 12472; identical to SEQ ID NO: 28372
  CDS (1)..(1380): transl_table=11

SEQ ID NO: 35700 - protein, 459 aa, Chromobacterium violaceum ATCC 12472; identical to SEQ ID NO: 28373

SEQ ID NO: 35701 - DNA, 1284 bp, Chromobacterium violaceum ATCC 12472; identical to SEQ ID NO: 28374
  CDS (1)..(1284): transl_table=11

SEQ ID NO: 35702 - protein, 427 aa, Chromobacterium violaceum ATCC 12472; identical to SEQ ID NO: 28375

SEQ ID NO: 35703 - DNA, 1380 bp, Chromobacterium violaceum ATCC 12472; identical to SEQ ID NO: 28376
  CDS (1)..(1380): transl_table=11

SEQ ID NO: 35704 - protein, 459 aa, Chromobacterium violaceum ATCC 12472; identical to SEQ ID NO: 28377

SEQ ID NO: 35705 - DNA, 1332 bp, Corynebacterium diphtheriae NCTC 13129; identical to SEQ ID NO: 28378
  CDS (1)..(1332): transl_table=11

SEQ ID NO: 35706 - protein, 443 aa, Corynebacterium diphtheriae NCTC 13129; identical to SEQ ID NO: 28379

SEQ ID NO: 35707 - DNA, 1299 bp, Corynebacterium diphtheriae NCTC 13129; identical to SEQ ID NO: 28380
  CDS (1)..(1299): transl_table=11

SEQ ID NO: 35708 - protein, 432 aa, Corynebacterium diphtheriae NCTC 13129; identical to SEQ ID NO: 28381

SEQ ID NO: 35709 - DNA, 1281 bp, Cupriavidus necator; identical to SEQ ID NO: 28382
  CDS (1)..(1281): transl_table=11

SEQ ID NO: 35710 - protein, 426 aa, Cupriavidus necator; identical to SEQ ID NO: 28383

SEQ ID NO: 35711 - DNA, 1395 bp, Cupriavidus necator; identical to SEQ ID NO: 28384
  CDS (1)..(1395): transl_table=11

SEQ ID NO: 35712 - protein, 464 aa, Cupriavidus necator; identical to SEQ ID NO: 28385

SEQ ID NO: 35713 - DNA, 1458 bp, Mycobacterium avium subsp. paratuberculosis K-10; identical to SEQ ID NO: 28386
  CDS (1)..(1458): transl_table=11

SEQ ID NO: 35714 - protein, 485 aa, Mycobacterium avium subsp. paratuberculosis K-10; identical to SEQ ID NO: 28387

SEQ ID NO: 35715 - DNA, 1392 bp, Mycobacterium avium subsp. paratuberculosis K-10; identical to SEQ ID NO: 28388
  CDS (1)..(1392): transl_table=11

SEQ ID NO: 35716 - protein, 463 aa, Mycobacterium avium subsp. paratuberculosis K-10; identical to SEQ ID NO: 28389

SEQ ID NO: 35717 - DNA, 1392 bp, Mycobacterium avium subsp. paratuberculosis K-10; identical to SEQ ID NO: 28390
  CDS (1)..(1392): transl_table=11

SEQ ID NO: 35718 - protein, 463 aa, Mycobacterium avium subsp. paratuberculosis K-10; identical to SEQ ID NO: 28391

SEQ ID NO: 35719 - DNA, 1170 bp, Bacillus anthracis str. Sterne; identical to SEQ ID NO: 28392
  CDS (1)..(1170): transl_table=11

SEQ ID NO: 35720 - protein, 389 aa, Bacillus anthracis str. Sterne; identical to SEQ ID NO: 28393

SEQ ID NO: 35721 - DNA, 1170 bp, Bacillus thuringiensis serovar konkukian str. 97-27; identical to SEQ ID NO: 28394
  CDS (1)..(1170): transl_table=11

SEQ ID NO: 35722 - protein, 389 aa, Bacillus thuringiensis serovar konkukian str. 97-27; identical to SEQ ID NO: 28395

SEQ ID NO: 35723 - DNA, 1170 bp, Staphylococcus aureus subsp. aureus MRSA252; identical to SEQ ID NO: 28396
  CDS (1)..(1170): transl_table=11

SEQ ID NO: 35724 - protein, 389 aa, Staphylococcus aureus subsp. aureus MRSA252; identical to SEQ ID NO: 28397

SEQ ID NO: 35725 - DNA, 1170 bp, Staphylococcus aureus subsp. aureus MSSA476; identical to SEQ ID NO: 28398
  CDS (1)..(1170): transl_table=11

SEQ ID NO: 35726 - protein, 389 aa, Staphylococcus aureus subsp. aureus MSSA476; identical to SEQ ID NO: 28399

SEQ ID NO: 35727 - DNA, 1389 bp, Erwinia carotovora subsp. atroseptica SCRI1043; identical to SEQ ID NO: 28400
  CDS (1)..(1389): transl_table=11

SEQ ID NO: 35728 - protein, 462 aa, Erwinia carotovora subsp. atroseptica SCRI1043; identical to SEQ ID NO: 28401

SEQ ID NO: 35729 - DNA, 1317 bp, Propionibacterium acnes KPA171202; identical to SEQ ID NO: 28402
  CDS (1)..(1317): transl_table=11

SEQ ID NO: 35730 - protein, 438 aa, Propionibacterium acnes KPA171202; identical to SEQ ID NO: 28403

SEQ ID NO: 35731 - DNA, 1206 bp, Bacillus licheniformis ATCC 14580; identical to SEQ ID NO: 28404
  CDS (1)..(1206): transl_table=11

SEQ ID NO: 35732 - protein, 401 aa, Bacillus licheniformis ATCC 14580; identical to SEQ ID NO: 28405

SEQ ID NO: 35733 - DNA, 1185 bp, Bacillus licheniformis ATCC 14580; identical to SEQ ID NO: 28406
  CDS (1)..(1185): transl_table=11

SEQ ID NO: 35734 - protein, 394 aa, Bacillus licheniformis ATCC 14580; identical to SEQ ID NO: 28407

SEQ ID NO: 35735 - DNA, 1230 bp, Burkholderia mallei ATCC 23344; identical to SEQ ID NO: 28408
  CDS (1)..(1230): transl_table=11

SEQ ID NO: 35736 - protein, 409 aa, Burkholderia mallei ATCC 23344; identical to SEQ ID NO: 28409

SEQ ID NO: 35737 - DNA, 1404 bp, Burkholderia mallei ATCC 23344; identical to SEQ ID NO: 28410
  CDS (1)..(1404): transl_table=11

SEQ ID NO: 35738 - protein, 467 aa, Burkholderia mallei ATCC 23344; identical to SEQ ID NO: 28411

SEQ ID NO: 35739 - DNA, 1281 bp, Burkholderia pseudomallei K96243; identical to SEQ ID NO: 28412
  CDS (1)..(1281): transl_table=11

SEQ ID NO: 35740 - protein, 426 aa, Burkholderia pseudomallei K96243; identical to SEQ ID NO: 28413

SEQ ID NO: 35741 - DNA, 1386 bp, Burkholderia pseudomallei K96243; identical to SEQ ID NO: 28414
  CDS (1)..(1386): transl_table=11

SEQ ID NO: 35742 - protein, 461 aa, Burkholderia pseudomallei K96243; identical to SEQ ID NO: 28415

SEQ ID NO: 35743 - DNA, 1458 bp, Burkholderia pseudomallei K96243; identical to SEQ ID NO: 28416
  CDS (1)..(1458): transl_table=11

SEQ ID NO: 35744 - protein, 485 aa, Burkholderia pseudomallei K96243; identical to SEQ ID NO: 28417

SEQ ID NO: 35745 - DNA, 1275 bp, Burkholderia pseudomallei K96243; identical to SEQ ID NO: 28418
  CDS (1)..(1275): transl_table=11

SEQ ID NO: 35746 - protein, 424 aa, Burkholderia pseudomallei K96243; identical to SEQ ID NO: 28419

SEQ ID NO: 35747 - DNA, 1275 bp, Methylococcus capsulatus str. Bath; identical to SEQ ID NO: 28420
  CDS (1)..(1275): transl_table=11

SEQ ID NO: 35748 - protein, 424 aa, Methylococcus capsulatus str. Bath; identical to SEQ ID NO: 28421

SEQ ID NO: 35749 - DNA, 1470 bp, Nocardia farcinica IFM 10152; identical to SEQ ID NO: 28422
  CDS (1)..(1470): transl_table=11

SEQ ID NO: 35750 - protein, 489 aa, Nocardia farcinica IFM 10152; identical to SEQ ID NO: 28423

SEQ ID NO: 35751 - DNA, 1485 bp, Nocardia farcinica IFM 10152; identical to SEQ ID NO: 28424
  CDS (1)..(1485): transl_table=11

SEQ ID NO: 35752 - protein, 494 aa, Nocardia farcinica IFM 10152; identical to SEQ ID NO: 28425

SEQ ID NO: 35753 - DNA, 1323 bp, Haloarcula marismortui ATCC 43049; identical to SEQ ID NO: 28426
  CDS (1)..(1323): transl_table=11

SEQ ID NO: 35754 - protein, 440 aa, Haloarcula marismortui ATCC 43049; identical to SEQ ID NO: 28427

SEQ ID NO: 35755 - DNA, 1200 bp, Geobacillus kaustophilus HTA426; identical to SEQ ID NO: 28428
  CDS (1)..(1200): transl_table=11

SEQ ID NO: 35756 - protein, 399 aa, Geobacillus kaustophilus HTA426; identical to SEQ ID NO: 28429

SEQ ID NO: 35757 - DNA, 1203 bp, Geobacillus kaustophilus HTA426; identical to SEQ ID NO: 28430
  CDS (1)..(1203): transl_table=11

SEQ ID NO: 35758 - protein, 400 aa, Geobacillus kaustophilus HTA426; identical to SEQ ID NO: 28431

SEQ ID NO: 35759 - DNA, 1389 bp, Salmonella enterica subsp. enterica serovar Paratyphi A str. ATCC; identical to SEQ ID NO: 28432
  CDS (1)..(1389): transl_table=11

SEQ ID NO: 35760 - protein, 462 aa, Salmonella enterica subsp. enterica serovar Paratyphi A str. ATCC; identical to SEQ ID NO: 28433

SEQ ID NO: 35761 - DNA, 1332 bp, Idiomarina loihiensis L2TR; identical to SEQ ID NO: 28434
  CDS (1)..(1332): transl_table=11

SEQ ID NO: 35762 - protein, 443 aa, Idiomarina loihiensis L2TR; identical to SEQ ID NO: 28435

SEQ ID NO: 35763 - DNA, 1692 bp, Azoarcus sp. EbN1; identical to SEQ ID NO: 28436
  CDS (1)..(1692): transl_table=11

SEQ ID NO: 35764 - protein, 563 aa, Azoarcus sp. EbN1; identical to SEQ ID NO: 28437

SEQ ID NO: 35765 - DNA, 1377 bp, Azoarcus sp. EbN1; identical to SEQ ID NO: 28438
  CDS (1)..(1377): transl_table=11

SEQ ID NO: 35766 - protein, 458 aa, Azoarcus sp. EbN1; identical to SEQ ID NO: 28439

SEQ ID NO: 35767 - DNA, 1509 bp, Bacillus clausii KSM-K16; identical to SEQ ID NO: 28440
  CDS (1)..(1509): transl_table=11

SEQ ID NO: 35768 - protein, 502 aa, Bacillus clausii KSM-K16; identical to SEQ ID NO: 28441

SEQ ID NO: 35769 - DNA, 1206 bp, Bacillus clausii KSM-K16; identical to SEQ ID NO: 28442
  CDS (1)..(1206): transl_table=11

SEQ ID NO: 35770 - protein, 401 aa, Bacillus clausii KSM-K16; identical to SEQ ID NO: 28443

SEQ ID NO: 35771 - DNA, 1164 bp, Staphylococcus epidermidis RP62A; identical to SEQ ID NO: 28444
  CDS (1)..(1164): transl_table=11

SEQ ID NO: 35772 - protein, 387 aa, Staphylococcus epidermidis RP62A; identical to SEQ ID NO: 28445

SEQ ID NO: 35773 - DNA, 1389 bp, Salmonella enterica subsp. enterica serovar Choleraesuis str; identical to SEQ ID NO: 28446
  CDS (1)..(1389): transl_table=11

SEQ ID NO: 35774 - protein, 462 aa, Salmonella enterica subsp. enterica serovar Choleraesuis str; identical to SEQ ID NO: 28447

SEQ ID NO: 35775 - DNA, 1212 bp, Pseudomonas syringae pv. syringae B728a; identical to SEQ ID NO: 28448
  CDS (1)..(1212): transl_table=11

SEQ ID NO: 35776 - protein, 403 aa, Pseudomonas syringae pv. syringae B728a; identical to SEQ ID NO: 28449

SEQ ID NO: 35777 - DNA, 1158 bp, Staphylococcus haemolyticus JCSC1435; identical to SEQ ID NO: 28450
  CDS (1)..(1158): transl_table=11

SEQ ID NO: 35778 - protein, 385 aa, Staphylococcus haemolyticus JCSC1435; identical to SEQ ID NO: 28451

SEQ ID NO: 35779 - DNA, 1380 bp, Psychrobacter arcticum 273-4; identical to SEQ ID NO: 28452
  CDS (1)..(1380): transl_table=11

SEQ ID NO: 35780 - protein, 459 aa, Psychrobacter arcticum 273-4; identical to SEQ ID NO: 28453

SEQ ID NO: 35781 - DNA, 1212 bp, Pseudomonas syringae pv. phaseolicola 1448A; identical to SEQ ID NO: 28454
  CDS (1)..(1212): transl_table=11

SEQ ID NO: 35782 - protein, 403 aa, Pseudomonas syringae pv. phaseolicola 1448A; identical to SEQ ID NO: 28455

SEQ ID NO: 35783 - DNA, 1215 bp, Dechloromonas aromatica RCB; identical to SEQ ID NO: 28456
  CDS (1)..(1215): transl_table=11

SEQ ID NO: 35784 - protein, 404 aa, Dechloromonas aromatica RCB; identical to SEQ ID NO: 28457

SEQ ID NO: 35785 - DNA, 1290 bp, Ralstonia eutropha JMP134; identical to SEQ ID NO: 28458
  CDS (1)..(1290): transl_table=11

SEQ ID NO: 35786 - protein, 429 aa, Ralstonia eutropha JMP134; identical to SEQ ID NO: 28459

SEQ ID NO: 35787 - DNA, 1386 bp, Ralstonia eutropha JMP134; identical to SEQ ID NO: 28460
  CDS (1)..(1386): transl_table=11

SEQ ID NO: 35788 - protein, 461 aa, Ralstonia eutropha JMP134; identical to SEQ ID NO: 28461

SEQ ID NO: 35789 - DNA, 1362 bp, Shigella sonnei Ss046; identical to SEQ ID NO: 28462
  CDS (1)..(1362): transl_table=11

SEQ ID NO: 35790 - protein, 453 aa, Shigella sonnei Ss046; identical to SEQ ID NO: 28463

SEQ ID NO: 35791 - DNA, 1269 bp, Thiobacillus denitrificans ATCC 25259; identical to SEQ ID NO: 28464
  CDS (1)..(1269): transl_table=11

SEQ ID NO: 35792 - protein, 422 aa, Thiobacillus denitrificans ATCC 25259; identical to SEQ ID NO: 28465

SEQ ID NO: 35793 - DNA, 1677 bp, Thiobacillus denitrificans ATCC 25259; identical to SEQ ID NO: 28466
  CDS (1)..(1677): transl_table=11

SEQ ID NO: 35794 - protein, 558 aa, Thiobacillus denitrificans ATCC 25259; identical to SEQ ID NO: 28467

SEQ ID NO: 35795 - DNA, 1263 bp, Magnetospirillum magnetotacticum MS-1; identical to SEQ ID NO: 28468
  CDS (1)..(1263)

SEQ ID NO: 35796 - protein, 420 aa, Magnetospirillum magnetotacticum MS-1; identical to SEQ ID NO: 28469

SEQ ID NO: 35797 - DNA, 1407 bp, Pseudomonas aeruginosa UCBPP-PA14; identical to SEQ ID NO: 28470
  CDS (1)..(1407)

SEQ ID NO: 35798 - protein, 468 aa, Pseudomonas aeruginosa UCBPP-PA14; identical to SEQ ID NO: 28471

SEQ ID NO: 35799 - DNA, 1326 bp, Burkholderia cepacia R18194; identical to SEQ ID NO: 28472
  CDS (1)..(1326)

SEQ ID NO: 35800 - protein, 441 aa, Burkholderia cepacia R18194; identical to SEQ ID NO: 28473

SEQ ID NO: 35801 - DNA, 1326 bp, Burkholderia cenocepacia AU 1054; identical to SEQ ID NO: 28474
  CDS (1)..(1326): transl_table=11

SEQ ID NO: 35802 - protein, 441 aa, Burkholderia cenocepacia AU 1054; identical to SEQ ID NO: 28475

SEQ ID NO: 35803 - DNA, 1407 bp, Burkholderia pseudomallei S13; identical to SEQ ID NO: 28476
  CDS (1)..(1407)

SEQ ID NO: 35804 - protein, 468 aa, Burkholderia pseudomallei S13; identical to SEQ ID NO: 28477

SEQ ID NO: 35805 - DNA, 1212 bp, Polaromonas sp. JS666; identical to SEQ ID NO: 28478
  CDS (1)..(1212): transl_table=11

SEQ ID NO: 35806 - protein, 403 aa, Polaromonas sp. JS666; identical to SEQ ID NO: 28479

SEQ ID NO: 35807 - DNA, 1320 bp, Geobacter metallireducens GS-15; identical to SEQ ID NO: 28480
  CDS (1)..(1320): transl_table=11

SEQ ID NO: 35808 - protein, 439 aa, Geobacter metallireducens GS-15; identical to SEQ ID NO: 28481

SEQ ID NO: 35809 - DNA, 1230 bp, Nitrobacter hamburgensis X14; identical to SEQ ID NO: 28482
  CDS (1)..(1230): transl_table=11

SEQ ID NO: 35810 - protein, 409 aa, Nitrobacter hamburgensis X14; identical to SEQ ID NO: 28483

SEQ ID NO: 35811 - DNA, 1209 bp, Paracoccus denitrificans PD1222; identical to SEQ ID NO: 28484
  CDS (1)..(1209): transl_table=11

SEQ ID NO: 35812 - protein, 402 aa, Paracoccus denitrificans PD1222; identical to SEQ ID NO: 28485

SEQ ID NO: 35813 - DNA, 1401 bp, Pseudomonas aeruginosa; identical to SEQ ID NO: 28486
  CDS (1)..(1401): transl_table=11

SEQ ID NO: 35814 - protein, 466 aa, Pseudomonas aeruginosa; identical to SEQ ID NO: 28487

SEQ ID NO: 35815 - DNA, 1416 bp, Mycobacterium fortuitum; identical to SEQ ID NO: 28488
  CDS (1)..(1416): transl_table=11

SEQ ID NO: 35816 - protein, 471 aa, Mycobacterium fortuitum; identical to SEQ ID NO: 28489

SEQ ID NO: 35817 - DNA, 1527 bp, Populus tremula x Populus tremuloides; identical to SEQ ID NO: 28490
  CDS (1)..(1527)

SEQ ID NO: 35818 - protein, 508 aa, Populus tremula x Populus tremuloides; identical to SEQ ID NO: 28491

SEQ ID NO: 35819 - DNA, 1602 bp, Pseudomonas sp; identical to SEQ ID NO: 28492
  CDS (1)..(1602): transl_table=11

SEQ ID NO: 35820 - protein, 533 aa, Pseudomonas sp; identical to SEQ ID NO: 28493

SEQ ID NO: 35821 - DNA, 1302 bp, Halomonas maura; identical to SEQ ID NO: 28494
  CDS (1)..(1302): transl_table=11

SEQ ID NO: 35822 - protein, 433 aa, Halomonas maura; identical to SEQ ID NO: 28495

SEQ ID NO: 35823 - DNA, 1254 bp, Rhizobium sp; identical to SEQ ID NO: 28496
  CDS (1)..(1254): transl_table=11

SEQ ID NO: 35824 - protein, 417 aa, Rhizobium sp; identical to SEQ ID NO: 28497

SEQ ID NO: 35825 - DNA, 1311 bp, Halobacterium mediterranei; identical to SEQ ID NO: 28498
  CDS (1)..(1311): transl_table=11

SEQ ID NO: 35826 - protein, 436 aa, Halobacterium mediterranei; identical to SEQ ID NO: 28499

SEQ ID NO: 35827 - DNA, 1650 bp, Physcomitrella patens; identical to SEQ ID NO: 28500
  CDS (1)..(1650)

SEQ ID NO: 35828 - protein, 549 aa, Physcomitrella patens; identical to SEQ ID NO: 28501

SEQ ID NO: 35829 - DNA, 1353 bp, Corynebacterium glutamicum; identical to SEQ ID NO: 28502
  CDS (1)..(1353): transl_table=11

SEQ ID NO: 35830 - protein, 450 aa, Corynebacterium glutamicum; identical to SEQ ID NO: 28503

SEQ ID NO: 35831 - DNA, 1284 bp, Paracoccus halodenitrificans; identical to SEQ ID NO: 28504
  CDS (1)..(1284): transl_table=11

SEQ ID NO: 35832 - protein, 427 aa, Paracoccus halodenitrificans; identical to SEQ ID NO: 28505

SEQ ID NO: 35833 - DNA, 1593 bp, Paracoccus halodenitrificans; identical to SEQ ID NO: 28506
  CDS (1)..(1593): transl_table=11

SEQ ID NO: 35834 - protein, 530 aa, Paracoccus halodenitrificans; identical to SEQ ID NO: 28507

SEQ ID NO: 35835 - DNA, 2718 bp, Paracoccus pantotrophus; identical to SEQ ID NO: 28508
  CDS (1)..(2718): transl_table=11

SEQ ID NO: 35836 - protein, 905 aa, Paracoccus pantotrophus; identical to SEQ ID NO: 28509

SEQ ID NO: 35837 - DNA, 1266 bp, Pseudomonas fluorescens; identical to SEQ ID NO: 28510
  CDS (1)..(1266): transl_table=11

SEQ ID NO: 35838 - protein, 421 aa, Pseudomonas fluorescens; identical to SEQ ID NO: 28511

SEQ ID NO: 35839 - DNA, 1332 bp, Thermus thermophilus; identical to SEQ ID NO: 28512
  CDS (1)..(1332): transl_table=11

SEQ ID NO: 35840 - protein, 443 aa, Thermus thermophilus; identical to SEQ ID NO: 28513

SEQ ID NO: 35841 - DNA, 1308 bp, Thermus thermophilus; identical to SEQ ID NO: 28514
  CDS (1)..(1308): transl_table=11

SEQ ID NO: 35842 - protein, 435 aa, Thermus thermophilus; identical to SEQ ID NO: 28515

SEQ ID NO: 35843 - DNA, 1449 bp, Cylindrotheca fusiformis; identical to SEQ ID NO: 28516
  CDS (1)..(1449)

SEQ ID NO: 35844 - protein, 482 aa, Cylindrotheca fusiformis; identical to SEQ ID NO: 28517

SEQ ID NO: 35845 - DNA, 1449 bp, Cylindrotheca fusiformis; identical to SEQ ID NO: 28518
  CDS (1)..(1449)

SEQ ID NO: 35846 - protein, 482 aa, Cylindrotheca fusiformis; identical to SEQ ID NO: 28519

SEQ ID NO: 35847 - DNA, 1449 bp, Cylindrotheca fusiformis; identical to SEQ ID NO: 28520
  CDS (1)..(1449)

SEQ ID NO: 35848 - protein, 482 aa, Cylindrotheca fusiformis; identical to SEQ ID NO: 28521

SEQ ID NO: 35849 - DNA, 1212 bp, Pseudomonas aeruginosa; identical to SEQ ID NO: 28522
  CDS (1)..(1212): transl_table=11

SEQ ID NO: 35850 - protein, 403 aa, Pseudomonas aeruginosa; identical to SEQ ID NO: 28523

SEQ ID NO: 35851 - DNA, 1389 bp, Escherichia coli; identical to SEQ ID NO: 28524
  CDS (1)..(1389): transl_table=11

SEQ ID NO: 35852 - protein, 462 aa, Escherichia coli; identical to SEQ ID NO: 28525

SEQ ID NO: 35853 - DNA, 1389 bp, Salmonella typhimurium; identical to SEQ ID NO: 28526
  CDS (1)..(1389): transl_table=11

SEQ ID NO: 35854 - protein, 462 aa, Salmonella typhimurium; identical to SEQ ID NO: 28527

SEQ ID NO: 35855 - DNA, 1266 bp, Bacillus subtilis; identical to SEQ ID NO: 28528
  CDS (1)..(1266): transl_table=11

SEQ ID NO: 35856 - protein, 421 aa, Bacillus subtilis; identical to SEQ ID NO: 28529

SEQ ID NO: 35857 - DNA, 21 bp, Artificial sequence
  (1)..(21): primer
atgagtcactcatccgccccc

SEQ ID NO: 35858 - DNA, 27 bp, Artificial sequence
  (1)..(27): primer
ttattttttagaatgccgaccatatac

SEQ ID NO: 35859 - protein, 512 aa, Artificial sequence; identical to SEQ ID NO: 28532
  Variant (2)..(9): xaa in position 2 to 9 is any amino acid
  Variant (11)..(11): xaa in position 11 is any amino acid
  Variant (13)..(13): xaa in position 13 is any amino acid
  Variant (16)..(16): xaa in position 16 is any amino acid
  Variant (18)..(22): xaa in position 18 to 22 is any amino acid
  Variant (23)..(24): xaa in position 23 to 24 is any or no amino acid
  Variant (26)..(38): xaa in position 26 to 38 is any amino acid
  Variant (39)..(49): xaa in position 39 to 49 is any or no amino acid
  Variant (51)..(51): xaa in position 51 is any amino acid
  Variant (53)..(54): xaa in position 53 to 54 is any amino acid
  Variant (55)..(55): xaa in position 55 is any or no amino acid
  Variant (57)..(57): xaa in position 57 is any amino acid
  Variant (60)..(60): xaa in position 60 is any amino acid
  Variant (64)..(72): xaa in position 64 to 72 is any amino acid
  Variant (74)..(74): xaa in position 74 is any amino acid
  Variant (76)..(86): xaa in position 76 to 86 is any amino acid
  Variant (88)..(101): xaa in position 88 to 101 is any amino acid
  Variant (102)..(110): xaa in position 102 to 110 is any or no amino acid
  Variant (112)..(112): xaa in position 112 is any amino acid
  Variant (113)..(113): xaa in position 113 is any or no amino acid
  Variant (115)..(117): xaa in position 115 to 117 is any amino acid
  Variant (119)..(119): xaa in position 119 is any amino acid
  Variant (123)..(123): xaa in position 123 is any amino acid
  Variant (126)..(127): xaa in position 126 to 127 is any amino acid
  Variant (129)..(133): xaa in position 129 to 133 is any amino acid
  Variant (137)..(140): xaa in position 137 to 140 is any amino acid
  Variant (142)..(142): xaa in position 142 is any amino acid
  Variant (144)..(144): xaa in position 144 is any amino acid
  Variant (147)..(147): xaa in position 147 is any amino acid
  Variant (150)..(150): xaa in position 150 is any amino acid
  Variant (151)..(151): xaa in position 151 is any or no amino acid
  Variant (153)..(153): xaa in position 153 is any amino acid
  Variant (155)..(156): xaa in position 155 to 156 is any amino acid
  Variant (158)..(162): xaa in position 158 to 162 is any amino acid
  Variant (164)..(164): xaa in position 164 is any or no amino acid
  Variant (166)..(181): xaa in position 166 to 181 is any amino acid
  Variant (182)..(210): xaa in position 182 to 210 is any or no amino acid
  Variant (212)..(212): xaa in position 212 is any amino acid
  Variant (214)..(215): xaa in position 214 to 215 is any amino acid
  Variant (217)..(243): xaa in position 217 to 243 is any amino acid
  Variant (244)..(314): xaa in position 244 to 314 is any or no amino acid
  Variant (316)..(320): xaa in position 316 to 320 is any amino acid
  Variant (322)..(324): xaa in position 322 to 324 is any amino acid
  Variant (327)..(327): xaa in position 327 is any amino acid
  Variant (331)..(342): xaa in position 331 to 342 is any amino acid
  Variant (344)..(357): xaa in position 344 to 357 is any amino acid
  Variant (358)..(377): xaa in position 358 to 377 is any or no amino acid
  Variant (379)..(381): xaa in position 379 to 381 is any amino acid
  Variant (383)..(384): xaa in position 383 to 384 is any amino acid
  Variant (387)..(387): xaa in position 387 is any amino acid
  Variant (392)..(392): xaa in position 392 is any amino acid
  Variant (395)..(432): xaa in position 395 to 432 is any amino acid
  Variant (433)..(455): xaa in position 433 to 455 is any or no amino acid
  Variant (457)..(457): xaa in position 457 is any amino acid
  Variant (459)..(459): xaa in position 459 is any amino acid
  Variant (462)..(462): xaa in position 462 is any amino acid
  Variant (464)..(465): xaa in position 464 to 465 is any amino acid
  Variant (467)..(469): xaa in position 467 to 469 is any amino acid
  Variant (471)..(474): xaa in position 471 to 474 is any amino acid
  Variant (475)..(497): xaa in position 475 to 497 is any or no amino acid
  Variant (499)..(501): xaa in position 499 to 501 is any amino acid
  Variant (503)..(507): xaa in position 503 to 507 is any amino acid
  Variant (510)..(510): xaa in position 510 is any amino acid

SEQ ID NO: 35860 - protein, 19 aa, Artificial sequence
  Variant (2)..(10): xaa in position 2 to 10 is any amino acid
  Variant (11)..(11): xaa in position 11 is any or no amino acid
  Variant (13)..(13): xaa in position 13 is any amino acid
  Variant (14)..(14): xaa in position 14 is Ala, Ile or Val
  Variant (16)..(16): xaa in position 16 is any amino acid
  Variant (17)..(17): xaa in position 17 is Ile, Leu, Met or Val
  Variant (18)..(18): xaa in position 18 is any amino acid
  Variant (19)..(19): xaa in position 19 is Ala, Gly or Ser
LXXXXXXXXXXFXXWXXXX

SEQ ID NO: 35861 - protein, 45 aa, Artificial sequence; identical to SEQ ID NO: 28534
  Variant (2)..(3): xaa in position 2 to 3 is any amino acid
  Variant (4)..(4): xaa in position 4 is any or no amino acid
  Variant (6)..(6): xaa in position 6 is Ala, Gly or Thr
  Variant (7)..(7): xaa in position 7 is any amino acid
  Variant (9)..(9): xaa in position 9 is Ala, Gly or Ser
  Variant (10)..(12): xaa in position 10 to 12 is any amino acid
  Variant (13)..(13): xaa in position 13 is Ala, Gly, Pro, Ser or Thr
  Variant (14)..(15): xaa in position 14 to 15 is any amino acid
  Variant (16)..(16): xaa in position 16 is Ala, Gly, Asn, Pro or Ser
  Variant (17)..(18): xaa in position 17 to 18 is any amino acid
  Variant (19)..(19): xaa in position 19 is Phe, His or Tyr
  Variant (20)..(24): xaa in position 20 to 24 is any amino acid
  Variant (26)..(26): xaa in position 26 is any amino acid
  Variant (27)..(27): xaa in position 27 is Ala, Ser or Val
  Variant (28)..(28): xaa in position 28 is any amino acid
  Variant (30)..(31): xaa in position 30 to 31 is any amino acid
  Variant (32)..(33): xaa in position 32 to 33 is any or no amino acid
  Variant (35)..(38): xaa in position 35 to 38 is any amino acid
  Variant (39)..(39): xaa in position 39 is Ala, Gly or Val
  Variant (40)..(44): xaa in position 40 to 44 is any amino acid
  Variant (45)..(45): xaa in position 45 is Phe, Ile, Leu or Val

SEQ ID NO: 35862 - protein, 24 aa, Artificial sequence
  Variant (2)..(3): xaa in position 2 to 3 is any amino acid
  Variant (4)..(4): xaa in position 4 is any or no amino acid
  Variant (6)..(6): xaa in position 6 is any or no amino acid
  Variant (8)..(8): xaa in position 8 is Ala, Gly or Ser
  Variant (9)..(9): xaa in position 9 is Phe or Tyr
  Variant (10)..(10): xaa in position 10 is Ala, Ile or Val
  Variant (11)..(11): xaa in position 11 is Ala or Gly
  Variant (12)..(12): xaa in position 12 is any amino acid
  Variant (13)..(13): xaa in position 13 is Ala, Gly, Ser or Thr
  Variant (14)..(15): xaa in position 14 to 15 is any amino acid
  Variant (16)..(16): xaa in position 16 is Phe, Leu, Met or Val
  Variant (17)..(17): xaa in position 17 is Ala, Gly, Pro, Ser or Thr
  Variant (18)..(23): xaa in position 18 to 23 is any amino acid
  Variant (24)..(24): xaa in position 24 is Phe or Tyr
YXXXFXGXXXXXXXXXXXXXXXXX

SEQ ID NO: 35863 - protein, 33 aa, Artificial sequence; identical to SEQ ID NO: 28536
  Variant (2)..(19): xaa in position 2 to 19 is any amino acid
  Variant (20)..(22): xaa in position 20 to 22 is any or no amino acid
  Variant (24)..(24): xaa in position 24 is Phe, Ile, Leu, Met or Val
  Variant (25)..(25): xaa in position 25 is any amino acid
  Variant (26)..(26): xaa in position 26 is Ala, Gly or Ser
  Variant (27)..(28): xaa in position 27 to 28 is any amino acid
  Variant (30)..(30): xaa in position 30 is Ala, Cys, Gly, Asn, Ser or Thr
  Variant (31)..(31): xaa in position 31 is any amino acid
  Variant (33)..(33): xaa in position 33 is Ala, Gly, Pro or Ser

SEQ ID NO: 35864 - DNA, 1818 bp, Escherichia coli; identical to SEQ ID NO: 13510
  CDS (1)..(1818)

SEQ ID NO: 35865 - protein, 605 aa, Escherichia coli; identical to SEQ ID NO: 13511

SEQ ID NO: 35866 - DNA, 1665 bp, Mesorhizobium loti MAFF303099; identical to SEQ ID NO: 13512
  CDS (1)..(1665): transl_table=11

SEQ ID NO: 35867 - protein, 554 aa, Mesorhizobium loti MAFF303099; identical to SEQ ID NO: 13513

SEQ ID NO: 35868 - DNA, 1635 bp, Mesorhizobium loti MAFF303099; identical to SEQ ID NO: 13514
  CDS (1)..(1635): transl_table=11

SEQ ID NO: 35869 - protein, 544 aa, Mesorhizobium loti MAFF303099; identical to SEQ ID NO: 13515

SEQ ID NO: 35870 - DNA, 1851 bp, Thermoplasma volcanium GSS1; identical to SEQ ID NO: 13516
  CDS (1)..(1851): transl_table=11

SEQ ID NO: 35871 - protein, 616 aa, Thermoplasma volcanium GSS1; identical to SEQ ID NO: 13517

SEQ ID NO: 35872 - DNA, 1422 bp, Thermotoga maritima MSB8; identical to SEQ ID NO: 13518
  CDS (1)..(1422): transl_table=11

SEQ ID NO: 35873 - protein, 473 aa, Thermotoga maritima MSB8; identical to SEQ ID NO: 13519

SEQ ID NO: 35874 - DNA, 1671 bp, Thermotoga maritima MSB8; identical to SEQ ID NO: 13520
  CDS (1)..(1671): transl_table=11

SEQ ID NO: 35875 - protein, 556 aa, Thermotoga maritima MSB8; identical to SEQ ID NO: 13521

SEQ ID NO: 35876 - DNA, 1737 bp, Bacillus halodurans C-125; identical to SEQ ID NO: 13522
  CDS (1)..(1737): transl_table=11

SEQ ID NO: 35877 - protein, 578 aa, Bacillus halodurans C-125; identical to SEQ ID NO: 13523

SEQ ID NO: 35878 - DNA, 1704 bp, Streptococcus pyogenes M1 GAS; identical to SEQ ID NO: 13524
  CDS (1)..(1704): transl_table=11

SEQ ID NO: 35879 - protein, 567 aa, Streptococcus pyogenes M1 GAS; identical to SEQ ID NO: 13525

SEQ ID NO: 35880 - DNA, 1614 bp, Streptococcus pyogenes M1 GAS; identical to SEQ ID NO: 13526
  CDS (1)..(1614): transl_table=11

SEQ ID NO: 35881 - protein, 537 aa, Streptococcus pyogenes M1 GAS; identical to SEQ ID NO: 13527

SEQ ID NO: 35882 - DNA, 1974 bp, Deinococcus radiodurans R1; identical to SEQ ID NO: 13528
  CDS (1)..(1974): transl_table=11

SEQ ID NO: 35883 - protein, 657 aa, Deinococcus radiodurans R1; identical to SEQ ID NO: 13529

SEQ ID NO: 35884 - DNA, 1497 bp, Deinococcus radiodurans R1; identical to SEQ ID NO: 13530
  CDS (1)..(1497): transl_table=11

SEQ ID NO: 35885 - protein, 498 aa, Deinococcus radiodurans R1; identical to SEQ ID NO: 13531

SEQ ID NO: 35886 - DNA, 1695 bp, Deinococcus radiodurans R1; identical to SEQ ID NO: 13532
  CDS (1)..(1695): transl_table=11

SEQ ID NO: 35887 - protein, 564 aa, Deinococcus radiodurans R1; identical to SEQ ID NO: 13533

SEQ ID NO: 35888 - DNA, 1452 bp, Deinococcus radiodurans R1; identical to SEQ ID NO: 13534
  CDS (1)..(1452): transl_table=11

SEQ ID NO: 35889 - protein, 483 aa, Deinococcus radiodurans R1; identical to SEQ ID NO: 13535

SEQ ID NO: 35890 - DNA, 1659 bp, Deinococcus radiodurans R1; identical to SEQ ID NO: 13536
  CDS (1)..(1659): transl_table=11

SEQ ID NO: 35891 - protein, 552 aa, Deinococcus radiodurans R1; identical to SEQ ID NO: 13537

SEQ ID NO: 35892 - DNA, 1824 bp, Mycoplasma pulmonis UAB CTIP; identical to SEQ ID NO: 13538
  CDS (1)..(1824): transl_table=4

SEQ ID NO: 35893 - protein, 607 aa, Mycoplasma pulmonis UAB CTIP; identical to SEQ ID NO: 13539

SEQ ID NO: 35894 - DNA, 1806 bp, Mycobacterium tuberculosis CDC1551; identical to SEQ ID NO: 13540
  CDS (1)..(1806): transl_table=11

SEQ ID NO: 35895 - protein, 601 aa, Mycobacterium tuberculosis CDC1551; identical to SEQ ID NO: 13541

SEQ ID NO: 35896 - DNA, 1641 bp, Mycobacterium tuberculosis CDC1551; identical to SEQ ID NO: 13542
  CDS (1)..(1641): transl_table=11

SEQ ID NO: 35897 - protein, 546 aa, Mycobacterium tuberculosis CDC1551; identical to SEQ ID NO: 13543

SEQ ID NO: 35898 - DNA, 1356 bp, Clostridium acetobutylicum ATCC 824; identical to SEQ ID NO: 13544
  CDS (1)..(1356): transl_table=11

SEQ ID NO: 35899 - protein, 451 aa, Clostridium acetobutylicum ATCC 824; identical to SEQ ID NO: 13545

SEQ ID NO: 35900 - DNA, 1785 bp, Agrobacterium tumefaciens str. C58; identical to SEQ ID NO: 13546
  CDS (1)..(1785): transl_table=11

SEQ ID NO: 35901 - protein, 594 aa, Agrobacterium tumefaciens str. C58; identical to SEQ ID NO: 13547

SEQ ID NO: 35902 - DNA, 1608 bp, Streptococcus pneumoniae R6; identical to SEQ ID NO: 13548
  CDS (1)..(1608): transl_table=11

SEQ ID NO: 35903 - protein, 535 aa, Streptococcus pneumoniae R6; identical to SEQ ID NO: 13549

SEQ ID NO: 35904 - DNA, 1764 bp, Streptococcus pneumoniae R6; identical to SEQ ID NO: 13550
  CDS (1)..(1764): transl_table=11

SEQ ID NO: 35905 - protein, 587 aa, Streptococcus pneumoniae R6; identical to SEQ ID NO: 13551

SEQ ID NO: 35906 - DNA, 1851 bp, Thermoplasma acidophilum DSM 1728; identical to SEQ ID NO: 13552
  CDS (1)..(1851): transl_table=11

SEQ ID NO: 35907 - protein, 616 aa, Thermoplasma acidophilum DSM 1728; identical to SEQ ID NO: 13553

SEQ ID NO: 35908 - DNA, 1527 bp, Synechocystis sp. PCC 6803; identical to SEQ ID NO: 13554
  CDS (1)..(1527): transl_table=11

SEQ ID NO: 35909 - protein, 508 aa, Synechocystis sp. PCC 6803; identical to SEQ ID NO: 13555

SEQ ID NO: 35910 - DNA, 1818 bp, Salmonella typhimurium LT2; identical to SEQ ID NO: 13556
  CDS (1)..(1818): transl_table=11

SEQ ID NO: 35911 - protein, 605 aa, Salmonella typhimurium LT2; identical to SEQ ID NO: 13557

SEQ ID NO: 35912 - DNA, 1662 bp, Listeria monocytogenes EGD-e; identical to SEQ ID NO: 13558
  CDS (1)..(1662): transl_table=11

SEQ ID NO: 35913 - protein, 553 aa, Listeria monocytogenes EGD-e; identical to SEQ ID NO: 13559

SEQ ID NO: 35914 - DNA, 1776 bp, Listeria monocytogenes EGD-e; identical to SEQ ID NO: 13560
  CDS (1)..(1776): transl_table=11

SEQ ID NO: 35915 - protein, 591 aa, Listeria monocytogenes EGD-e; identical to SEQ ID NO: 13561

SEQ ID NO: 35916 - DNA, 1467 bp, Nostoc sp. PCC 7120; identical to SEQ ID NO: 13562
  CDS (1)..(1467): transl_table=11

SEQ ID NO: 35917 - protein, 488 aa, Nostoc sp. PCC 7120; identical to SEQ ID NO: 13563

SEQ ID NO: 35918 - DNA, 3483 bp, Ralstonia solanacearum GMI1000; identical to SEQ ID NO: 13564
  CDS (1)..(3483): transl_table=11

SEQ ID NO: 35919 - protein, 1160 aa, Ralstonia solanacearum GMI1000; identical to SEQ ID NO: 13565

SEQ ID NO: 35920 - DNA, 1821 bp, Clostridium perfringens str. 13; identical to SEQ ID NO: 13566
  CDS (1)..(1821): transl_table=11

SEQ ID NO: 35921 - protein, 606 aa, Clostridium perfringens str. 13; identical to SEQ ID NO: 13567

SEQ ID NO: 35922 - DNA, 1665 bp, Clostridium perfringens str. 13; identical to SEQ ID NO: 13568
  CDS (1)..(1665): transl_table=11

SEQ ID NO: 35923 - protein, 554 aa, Clostridium perfringens str. 13; identical to SEQ ID NO: 13569

SEQ ID NO: 35924 - DNA, 1833 bp, Clostridium perfringens str. 13; identical to SEQ ID NO: 13570
  CDS (1)..(1833): transl_table=11

SEQ ID NO: 35925 - protein, 610 aa, Clostridium perfringens str. 13; identical to SEQ ID NO: 13571

SEQ ID NO: 35926 - DNA, 1938 bp, Pyrococcus furiosus DSM 3638; identical to SEQ ID NO: 13572
  CDS (1)..(1938): transl_table=11

SEQ ID NO: 35927 - protein, 645 aa, Pyrococcus furiosus DSM 3638; identical to SEQ ID NO: 13573

SEQ ID NO: 35928 - DNA, 1614 bp, Streptococcus pyogenes MGAS8232; identical to SEQ ID NO: 13574
  CDS (1)..(1614): transl_table=11

SEQ ID NO: 35929 - protein, 537 aa, Streptococcus pyogenes MGAS8232; identical to SEQ ID NO: 13575

SEQ ID NO: 35930 - DNA, 1725 bp, Thermoanaerobacter tengcongensis MB4; identical to SEQ ID NO: 13576
  CDS (1)..(1725): transl_table=11

SEQ ID NO: 35931 - protein, 574 aa, Thermoanaerobacter tengcongensis MB4; identical to SEQ ID NO: 13577

SEQ ID NO: 35932 - DNA, 1575 bp, Thermoanaerobacter tengcongensis MB4; identical to SEQ ID NO: 13578
  CDS (1)..(1575): transl_table=11

SEQ ID NO: 35933 - protein, 524 aa, Thermoanaerobacter tengcongensis MB4; identical to SEQ ID NO: 13579

SEQ ID NO: 35934 - DNA, 1719 bp, Streptomyces coelicolor A3(2); identical to SEQ ID NO: 13580
  CDS (1)..(1719)

SEQ ID NO: 35935 - protein, 572 aa, Streptomyces coelicolor A3(2); identical to SEQ ID NO: 13581

SEQ ID NO: 35936 - DNA, 3351 bp, Xanthomonas campestris pv. campestris str. ATCC 33913; identical to SEQ ID NO: 13582
  CDS (1)..(3351): transl_table=11

SEQ ID NO: 35937 - protein, 1116 aa, Xanthomonas campestris pv. campestris str. ATCC 33913; identical to SEQ ID NO: 13583

SEQ ID NO: 35938 - DNA, 1617 bp, Xanthomonas campestris pv. campestris str. ATCC 33913; identical to SEQ ID NO: 13584
  CDS (1)..(1617): transl_table=11

SEQ ID NO: 35939 - protein, 538 aa, Xanthomonas campestris pv. campestris str. ATCC 33913; identical to SEQ ID NO: 13585

SEQ ID NO: 35940 - DNA, 1617 bp, Xanthomonas axonopodis pv. citri str. 306; identical to SEQ ID NO: 13586
  CDS (1)..(1617): transl_table=11

SEQ ID NO: 35941 - protein, 538 aa, Xanthomonas axonopodis pv. citri str. 306; identical to SEQ ID NO: 13587

SEQ ID NO: 35942 - DNA, 3327 bp, Chlorobium tepidum TLS; identical to SEQ ID NO: 13588
  CDS (1)..(3327): transl_table=11

SEQ ID NO: 35943 - protein, 1108 aa, Chlorobium tepidum TLS; identical to SEQ ID NO: 13589

SEQ ID NO: 35944 - DNA, 1668 bp, Yersinia pestis KIM; identical to SEQ ID NO: 13590
  CDS (1)..(1668): transl_table=11

SEQ ID NO: 35945 - protein, 555 aa, Yersinia pestis KIM; identical to SEQ ID NO: 13591

SEQ ID NO: 35946 - DNA, 1830 bp, Yersinia pestis KIM; identical to SEQ ID NO: 13592
  CDS (1)..(1830): transl_table=11

SEQ ID NO: 35947 - protein, 609 aa, Yersinia pestis KIM; identical to SEQ ID NO: 13593

SEQ ID NO: 35948 - DNA, 1608 bp, Streptococcus agalactiae 2603V/R; identical to SEQ ID NO: 13594
  CDS (1)..(1608): transl_table=11

SEQ ID NO: 35949 - protein, 535 aa, Streptococcus agalactiae 2603V/R; identical to SEQ ID NO: 13595

SEQ ID NO: 35950 - DNA, 1497 bp, Oceanobacillus iheyensis HTE831; identical to SEQ ID NO: 13596
  CDS (1)..(1497): transl_table=11

SEQ ID NO: 35951 - protein, 498 aa, Oceanobacillus iheyensis HTE831; identical to SEQ ID NO: 13597

SEQ ID NO: 35952 - DNA, 1752 bp, Oceanobacillus iheyensis HTE831; identical to SEQ ID NO: 13598
  CDS (1)..(1752): transl_table=11

SEQ ID NO: 35953 - protein, 583 aa, Oceanobacillus iheyensis HTE831; identical to SEQ ID NO: 13599

SEQ ID NO: 35954 - DNA, 1398 bp, Bifidobacterium longum NCC2705; identical to SEQ ID NO: 13600
  CDS (1)..(1398): transl_table=11

SEQ ID NO: 35955 - protein, 465 aa, Bifidobacterium longum NCC2705; identical to SEQ ID NO: 13601

SEQ ID NO: 35956 - DNA, 1818 bp, Shigella flexneri 2a str. 301; identical to SEQ ID NO: 13602
  CDS (1)..(1818): transl_table=11

SEQ ID NO: 35957 - protein, 605 aa, Shigella flexneri 2a str. 301; identical to SEQ ID NO: 13603

SEQ ID NO: 35958 - DNA, 1746 bp, Leptospira interrogans serovar Lai str. 56601; identical to SEQ ID NO: 13604
  CDS (1)..(1746): transl_table=11

SEQ ID NO: 35959 - protein, 581 aa, Leptospira interrogans serovar Lai str. 56601; identical to SEQ ID NO: 13605

SEQ ID NO: 35960 - DNA, 1839 bp, Corynebacterium efficiens YS-314; identical to SEQ ID NO: 13606
  CDS (1)..(1839): transl_table=11

SEQ ID NO: 35961 - protein, 612 aa, Corynebacterium efficiens YS-314; identical to SEQ ID NO: 13607

SEQ ID NO: 35962 - DNA, 1839 bp, Vibrio vulnificus CMCP6; identical to SEQ ID NO: 13608
  CDS (1)..(1839): transl_table=11

SEQ ID NO: 35963 - protein, 612 aa, Vibrio vulnificus CMCP6; identical to SEQ ID NO: 13609

SEQ ID NO: 35964 - DNA, 2064 bp, Vibrio vulnificus CMCP6; identical to SEQ ID NO: 13610
  CDS (1)..(2064): transl_table=11

SEQ ID NO: 35965 - protein, 687 aa, Vibrio vulnificus CMCP6; identical to SEQ ID NO: 13611

SEQ ID NO: 35966 - DNA, 1464 bp, Bradyrhizobium japonicum USDA 110; identical to SEQ ID NO: 13612
  CDS (1)..(1464)

SEQ ID NO: 35967 - protein, 487 aa, Bradyrhizobium japonicum USDA 110; identical to SEQ ID NO: 13613

SEQ ID NO: 35968 - DNA, 1698 bp, Bradyrhizobium japonicum USDA 110; identical to SEQ ID NO: 13614
  CDS (1)..(1698)

SEQ ID NO: 35969 - protein, 565 aa, Bradyrhizobium japonicum USDA 110; identical to SEQ ID NO: 13615

SEQ ID NO: 35970 - DNA, 1626 bp, Lactobacillus plantarum WCFS1; identical to SEQ ID NO: 13616
  CDS (1)..(1626): transl_table=11

SEQ ID NO: 35971 - protein, 541 aa, Lactobacillus plantarum WCFS1; identical to SEQ ID NO: 13617

SEQ ID NO: 35972 - DNA, 1827 bp, Vibrio parahaemolyticus RIMD 2210633; identical to SEQ ID NO: 13618
  CDS (1)..(1827): transl_table=11

SEQ ID NO: 35973 - protein, 608 aa, Vibrio parahaemolyticus RIMD 2210633; identical to SEQ ID NO: 13619

SEQ ID NO: 35974 - DNA, 1818 bp, Salmonella enterica subsp. enterica serovar Typhi Ty2; identical to SEQ ID NO: 13620
  CDS (1)..(1818): transl_table=11

SEQ ID NO: 35975 - protein, 605 aa, Salmonella enterica subsp. enterica serovar Typhi Ty2; identical to SEQ ID NO: 13621

SEQ ID NO: 35976 - DNA, 2079 bp, Bacteroides thetaiotaomicron VPI-5482; identical to SEQ ID NO: 13622
  CDS (1)..(2079): transl_table=11

SEQ ID NO: 35977 - protein, 692 aa, Bacteroides thetaiotaomicron VPI-5482; identical to SEQ ID NO: 13623

SEQ ID NO: 35978 - DNA, 1854 bp, Bacteroides thetaiotaomicron VPI-5482; identical to SEQ ID NO: 13624
  CDS (1)..(1854): transl_table=11

SEQ ID NO: 35979 - protein, 617 aa, Bacteroides thetaiotaomicron VPI-5482; identical to SEQ ID NO: 13625

SEQ ID NO: 35980 - DNA, 1767 bp, Enterococcus faecalis V583; identical to SEQ ID NO: 13626
  CDS (1)..(1767): transl_table=11

SEQ ID NO: 35981 - protein, 588 aa, Enterococcus faecalis V583; identical to SEQ ID NO: 13627

SEQ ID NO: 35982 - DNA, 1614 bp, Enterococcus faecalis V583; identical to SEQ ID NO: 13628
  CDS (1)..(1614): transl_table=11

SEQ ID NO: 35983 - protein, 537 aa, Enterococcus faecalis V583; identical to SEQ ID NO: 13629

SEQ ID NO: 35984 - DNA, 1674 bp, Enterococcus faecalis V583; identical to SEQ ID NO: 13630
  CDS (1)..(1674): transl_table=11

SEQ ID NO: 35985 - protein, 557 aa, Enterococcus faecalis V583; identical to SEQ ID NO: 13631

SEQ ID NO: 35986 - DNA, 1719 bp, Streptomyces avermitilis MA-4680; identical to SEQ ID NO: 13632
  CDS (1)..(1719)

SEQ ID NO: 35987 - protein, 572 aa, Streptomyces avermitilis MA-4680; identical to SEQ ID NO: 13633

SEQ ID NO: 35988 - DNA, 1752 bp, Streptomyces avermitilis MA-4680; identical to SEQ ID NO: 13634
  CDS (1)..(1752)

SEQ ID NO: 35989 - protein, 583 aa, Streptomyces avermitilis MA-4680; identical to SEQ ID NO: 13635

SEQ ID NO: 35990 - DNA, 1665 bp, Bacillus anthracis str. Ames; identical to SEQ ID NO: 13636
  CDS (1)..(1665): transl_table=11

SEQ ID NO: 35991 - protein, 554 aa, Bacillus anthracis str. Ames; identical to SEQ ID NO: 13637

SEQ ID NO: 35992 - DNA, 1761 bp, Bacillus anthracis str. Ames; identical to SEQ ID NO: 13638
  CDS (1)..(1761): transl_table=11

SEQ ID NO: 35993 - protein, 586 aa, Bacillus anthracis str. Ames; identical to SEQ ID NO: 13639

SEQ ID NO: 35994 - DNA, 1641 bp, Mycobacterium bovis AF2122/97; identical to SEQ ID NO: 13640
  CDS (1)..(1641): transl_table=11

SEQ ID NO: 35995 - protein, 546 aa, Mycobacterium bovis AF2122/97; identical to SEQ ID NO: 13641

SEQ ID NO: 35996 - DNA, 1761 bp, Rhodopirellula baltica SH 1; identical to SEQ ID NO: 13642
  CDS (1)..(1761): transl_table=11

SEQ ID NO: 35997 - protein, 586 aa, Rhodopirellula baltica SH 1; identical to SEQ ID NO: 13643

SEQ ID NO: 35998 - DNA, 3342 bp, Bordetella pertussis Tohama I; identical to SEQ ID NO: 13644
  CDS (1)..(3342): transl_table=11

SEQ ID NO: 35999 - protein, 1113 aa, Bordetella pertussis Tohama I; identical to SEQ ID NO: 13645

SEQ ID NO: 36000 - DNA, 3342 bp, Bordetella bronchiseptica RB50; identical to SEQ ID NO: 13646
  CDS (1)..(3342)

SEQ ID NO: 36001 - protein, 1113 aa, Bordetella bronchiseptica RB50; identical to SEQ ID NO: 13647

SEQ ID NO: 36002 - DNA, 1452 bp, Prochlorococcus marinus str. MIT 9313; identical to SEQ ID NO: 13648
  CDS (1)..(1452): transl_table=11

SEQ ID NO: 36003 - protein, 483 aa, Prochlorococcus marinus str. MIT 9313; identical to SEQ ID NO: 13649

SEQ ID NO: 36004 - DNA, 1407 bp, Synechococcus sp. WH 8102; identical to SEQ ID NO: 13650
  CDS (1)..(1407): transl_table=11

SEQ ID NO: 36005 - protein, 468 aa, Synechococcus sp. WH 8102; identical to SEQ ID NO: 13651

SEQ ID NO: 36006 - DNA, 1662 bp, Synechococcus sp. WH 8102; identical to SEQ ID NO: 13652
  CDS (1)..(1662): transl_table=11

SEQ ID NO: 36007 - protein, 553 aa, Synechococcus sp. WH 8102; identical to SEQ ID NO: 13653

SEQ ID NO: 36008 - DNA, 1863 bp, Gloeobacter violaceus PCC 7421; identical to SEQ ID NO: 13654
  CDS (1)..(1863): transl_table=11

SEQ ID NO: 36009 - protein, 620 aa, Gloeobacter violaceus PCC 7421; identical to SEQ ID NO: 13655

SEQ ID NO: 36010 - DNA, 1443 bp, Gloeobacter violaceus PCC 7421; identical to SEQ ID NO: 13656
  CDS (1)..(1443): transl_table=11

SEQ ID NO: 36011 - protein, 480 aa, Gloeobacter violaceus PCC 7421; identical to SEQ ID NO: 13657

SEQ ID NO: 36012 - DNA, 1635 bp, Vibrio vulnificus YJ016; identical to SEQ ID NO: 13658
  CDS (1)..(1635): transl_table=11

SEQ ID NO: 36013 - protein, 544 aa, Vibrio vulnificus YJ016; identical to SEQ ID NO: 13659

SEQ ID NO: 36014 - DNA, 3303 bp, Rhodopseudomonas palustris CGA009; identical to SEQ ID NO: 13660
  CDS (1)..(3303): transl_table=11

SEQ ID NO: 36015 - protein, 1100 aa, Rhodopseudomonas palustris CGA009; identical to SEQ ID NO: 13661

SEQ ID NO: 36016 - DNA, 1617 bp, Rhodopseudomonas palustris CGA009; identical to SEQ ID NO: 13662
  CDS (1)..(1617): transl_table=11

SEQ ID NO: 36017 - protein, 538 aa, Rhodopseudomonas palustris CGA009; identical to SEQ ID NO: 13663

SEQ ID NO: 36018 - DNA, 3336 bp, Geobacter sulfurreducens PCA; identical to SEQ ID NO: 13664
  CDS (1)..(3336): transl_table=11

SEQ ID NO: 36019 - protein, 1111 aa, Geobacter sulfurreducens PCA; identical to SEQ ID NO: 13665

SEQ ID NO: 36020 - DNA, 1335 bp, Mycobacterium avium subsp. paratuberculosis str. k10; identical to SEQ ID NO: 13666
  CDS (1)..(1335): transl_table=11

SEQ ID NO: 36021 - protein, 444 aa, Mycobacterium avium subsp. paratuberculosis str. k10; identical to SEQ ID NO: 13667

SEQ ID NO: 36022 - DNA, 1773 bp, Mycobacterium avium subsp. paratuberculosis str. k10; identical to SEQ ID NO: 13668
  CDS (1)..(1773): transl_table=11

SEQ ID NO: 36023 - protein, 590 aa, Mycobacterium avium subsp. paratuberculosis str. k10; identical to SEQ ID NO: 13669

SEQ ID NO: 36024 - DNA, 1725 bp, Lactobacillus johnsonii NCC 533; identical to SEQ ID NO: 13670
  CDS (1)..(1725): transl_table=11

SEQ ID NO: 36025 - protein, 574 aa, Lactobacillus johnsonii NCC 533; identical to SEQ ID NO: 13671

SEQ ID NO: 36026 - DNA, 1668 bp, Lactobacillus johnsonii NCC 533; identical to SEQ ID NO: 13672
  CDS (1)..(1668): transl_table=11

SEQ ID NO: 36027 - protein, 555 aa, Lactobacillus johnsonii NCC 533; identical to SEQ ID NO: 13673

SEQ ID NO: 36028 - DNA, 1665 bp, Bacillus cereus ATCC 10987; identical to SEQ ID NO: 13674
  CDS (1)..(1665): transl_table=11

SEQ ID NO: 36029 - protein, 554 aa, Bacillus cereus ATCC 10987; identical to SEQ ID NO: 13675

SEQ ID NO: 36030 - DNA, 1710 bp, Anopheles gambiae str. PEST; identical to SEQ ID NO: 13676
  CDS (1)..(1710)

SEQ ID NO: 36031 - protein, 569 aa, Anopheles gambiae str. PEST; identical to SEQ ID NO: 13677

SEQ ID NO: 36032 - DNA, 1800 bp, Anopheles gambiae str. PEST; identical to SEQ ID NO: 13678
  CDS (1)..(1800)

SEQ ID NO: 36033 - protein, 599 aa, Anopheles gambiae str. PEST; identical to SEQ ID NO: 13679

SEQ ID NO: 36034 - DNA, 1509 bp, Anopheles gambiae str. PEST; identical to SEQ ID NO: 13680
  CDS (1)..(1509)

SEQ ID NO: 36035 - protein, 502 aa, Anopheles gambiae str. PEST; identical to SEQ ID NO: 13681

SEQ ID NO: 36036 - DNA, 1716 bp, Gibberella zeae PH-1; identical to SEQ ID NO: 13682
  CDS (1)..(1716)

SEQ ID NO: 36037 - protein, 571 aa, Gibberella zeae PH-1; identical to SEQ ID NO: 13683

SEQ ID NO: 36038 - DNA, 1635 bp, Leptospira interrogans serovar Copenhageni str. Fiocruz L1-130; identical to SEQ ID NO: 13684
  CDS (1)..(1635): transl_table=11

SEQ ID NO: 36039 - protein, 544 aa, Leptospira interrogans serovar Copenhageni str. Fiocruz L1-130; identical to SEQ ID NO: 13685

SEQ ID NO: 36040 - DNA, 1251 bp, Thermus thermophilus HB27; identical to SEQ ID NO: 13686
  CDS (1)..(1251): transl_table=11

SEQ ID NO: 36041 - protein, 416 aa, Thermus thermophilus HB27 [sequence omitted]

SEQ ID NO: 36042 - DNA, 1662 bp, Listeria monocytogenes str. 4b F2365; identical to SEQ ID NO: 13688
  CDS (1)..(1662): transl_table=11

SEQ ID NO: 36043 - protein, 553 aa, Listeria monocytogenes str. 4b F2365; identical to SEQ ID NO: 13689

SEQ ID NO: 36044 - DNA, 1533 bp, Listeria monocytogenes str. 4b F2365; identical to SEQ ID NO: 13690
  CDS (1)..(1533): transl_table=11

SEQ ID NO: 36045 - protein, 510 aa, Listeria monocytogenes str. 4b F2365; identical to SEQ ID NO: 13691

SEQ ID NO: 36046 - DNA, 1761 bp, Bacillus thuringiensis serovar konkukian str. 97-27; identical to SEQ ID NO: 13692
  CDS (1)..(1761): transl_table=11

SEQ ID NO: 36047 - protein, 586 aa, Bacillus thuringiensis serovar konkukian str. 97-27; identical to SEQ ID NO: 13693

SEQ ID NO: 36048 - DNA, 1710 bp, Leifsonia xyli subsp. xyli str. CTCB07; identical to SEQ ID NO: 13694
  CDS (1)..(1710): transl_table=11

SEQ ID NO: 36049 - protein, 569 aa, Leifsonia xyli subsp. xyli str. CTCB07; identical to SEQ ID NO: 13695

SEQ ID NO: 36050 - DNA, 1683 bp, Bacillus licheniformis ATCC 14580; identical to SEQ ID NO: 13696
  CDS (1)..(1683): transl_table=11

SEQ ID NO: 36051 - protein, 560 aa, Bacillus licheniformis ATCC 14580; identical to SEQ ID NO: 13697

SEQ ID NO: 36052 - DNA, 1764 bp, Bacillus licheniformis ATCC 14580; identical to SEQ ID NO: 13698
  CDS (1)..(1764): transl_table=11

SEQ ID NO: 36053 - protein, 587 aa, Bacillus licheniformis ATCC 14580; identical to SEQ ID NO: 13699

SEQ ID NO: 36054 - DNA, 1620 bp, Methylococcus capsulatus str. Bath; identical to SEQ ID NO: 13700
  CDS (1)..(1620): transl_table=11

SEQ ID NO: 36055 - protein, 539 aa, Methylococcus capsulatus str. Bath; identical to SEQ ID NO: 13701

SEQ ID NO: 36056 - DNA, 1866 bp, Photobacterium profundum SS9; identical to SEQ ID NO: 13702
  CDS (1)..(1866): transl_table=11

SEQ ID NO: 36057 - protein, 621 aa, Photobacterium profundum SS9; identical to SEQ ID NO: 13703

SEQ ID NO: 36058 - DNA, 1656 bp, Thermus thermophilus HB8; identical to SEQ ID NO: 13704
  CDS (1)..(1656): transl_table=11

SEQ ID NO: 36059 - protein, 551 aa, Thermus thermophilus HB8; identical to SEQ ID NO: 13705

SEQ ID NO: 36060 - DNA, 1767 bp, Geobacillus kaustophilus HTA426; identical to SEQ ID NO: 13706
  CDS (1)..(1767): transl_table=11

SEQ ID NO: 36061 - protein, 588 aa, Geobacillus kaustophilus HTA426; identical to SEQ ID NO: 13707

SEQ ID NO: 36062 - DNA, 1542 bp, Geobacillus kaustophilus HTA426; identical to SEQ ID NO: 13708
  CDS (1)..(1542): transl_table=11

SEQ ID NO: 36063 - protein, 513 aa, Geobacillus kaustophilus HTA426; identical to SEQ ID NO: 13709

SEQ ID NO: 36064 - DNA, 4983 bp, Geobacillus kaustophilus HTA426; identical to SEQ ID NO: 13710
  CDS (1)..(4983): transl_table=11

SEQ ID NO: 36065 - protein, 1660 aa, Geobacillus kaustophilus HTA426; identical to SEQ ID NO: 13711

SEQ ID NO: 36066 - DNA, 1689 bp, Azoarcus sp. EbN1; identical to SEQ ID NO: 13712
  CDS (1)..(1689): transl_table=11

SEQ ID NO: 36067 - protein, 562 aa, Azoarcus sp. EbN1; identical to SEQ ID NO: 13713

SEQ ID NO: 36068 - DNA, 1770 bp, Bacillus clausii KSM-K16; identical to SEQ ID NO: 13714
  CDS (1)..(1770): transl_table=11

SEQ ID NO: 36069 - protein, 589 aa, Bacillus clausii KSM-K16; identical to SEQ ID NO: 13715

SEQ ID NO: 36070 - DNA, 2298 bp, Thermococcus kodakarensis KOD1; identical to SEQ ID NO: 13716
  CDS (1)..(2298): transl_table=11

SEQ ID NO: 36071 - protein, 765 aa, Thermococcus kodakarensis KOD1; identical to SEQ ID NO: 13717

SEQ ID NO: 36072 - DNA, 2724 bp, Xanthomonas oryzae pv. oryzae KACC10331; identical to SEQ ID NO: 13718
  CDS (1)..(2724): transl_table=11

SEQ ID NO: 36073 - protein, 907 aa, Xanthomonas oryzae pv. oryzae KACC10331; identical to SEQ ID NO: 13719

SEQ ID NO: 36074 - DNA, 1260 bp, Vibrio fischeri ES114; identical to SEQ ID NO: 13720
  CDS (1)..(1260): transl_table=11

SEQ ID NO: 36075 - protein, 419 aa, Vibrio fischeri ES114; identical to SEQ ID NO: 13721

SEQ ID NO: 36076 - DNA, 1815 bp, Corynebacterium glutamicum ATCC 13032; identical to SEQ ID NO: 13722
  CDS (1)..(1815): transl_table=11

SEQ ID NO: 36077 - protein, 604 aa, Corynebacterium glutamicum ATCC 13032; identical to SEQ ID NO: 13723

SEQ ID NO: 36078 - DNA, 3327 bp, Pseudomonas syringae pv. syringae B728a; identical to SEQ ID NO: 13724
  CDS (1)..(3327)

SEQ ID NO: 36079 - protein, 1108 aa, Pseudomonas syringae pv. syringae B728a; identical to SEQ ID NO: 13725

SEQ ID NO: 36080 - DNA, 1659 bp, Lactobacillus gasseri; identical to SEQ ID NO: 13726
  CDS (1)..(1659)

SEQ ID NO: 36081 - protein, 552 aa, Lactobacillus gasseri; identical to SEQ ID NO: 13727

SEQ ID NO: 36082 - DNA, 1467 bp, Nostoc punctiforme PCC 73102; identical to SEQ ID NO: 13728
  CDS (1)..(1467)

SEQ ID NO: 36083 - protein, 488 aa, Nostoc punctiforme PCC 73102; identical to SEQ ID NO: 13729

SEQ ID NO: 36084 - DNA, 1674 bp, Nostoc punctiforme PCC 73102; identical to SEQ ID NO: 13730
  CDS (1)..(1674)

SEQ ID NO: 36085 - protein, 557 aa, Nostoc punctiforme PCC 73102; identical to SEQ ID NO: 13731

SEQ ID NO: 36086 - DNA, 1266 bp, Bifidobacterium longum DJO10A; identical to SEQ ID NO: 13732
  CDS (1)..(1266)

SEQ ID NO: 36087 - protein, 421 aa, Bifidobacterium longum DJO10A; identical to SEQ ID NO: 13733

SEQ ID NO: 36088 - DNA, 3333 bp, Desulfovibrio desulfuricans G20; identical to SEQ ID NO: 13734
  CDS (1)..(3333)

SEQ ID NO: 36089 - protein, 1110 aa, Desulfovibrio desulfuricans G20; identical to SEQ ID NO: 13735

SEQ ID NO: 36090 - DNA, 1467 bp, Anabaena variabilis ATCC 29413; identical to SEQ ID NO: 13736
  CDS (1)..(1467)

SEQ ID NO: 36091 - protein, 488 aa, Anabaena variabilis ATCC 29413; identical to SEQ ID NO: 13737

SEQ ID NO: 36092 - DNA, 3366 bp, Ralstonia eutropha JMP134; identical to SEQ ID NO: 13738
  CDS (1)..(3366)

SEQ ID NO: 36093 - protein, 1121 aa, Ralstonia eutropha JMP134; identical to SEQ ID NO: 13739

SEQ ID NO: 36094 - DNA, 2586 bp, Rhodobacter sphaeroides 2.4.1; identical to SEQ ID NO: 13740
  CDS (1)..(2586)

SEQ ID NO: 36095 - protein, 861 aa, Rhodobacter sphaeroides 2.4.1; identical to SEQ ID NO: 13741

SEQ ID NO: 36096 - DNA, 3417 bp, Burkholderia cepacia R18194; identical to SEQ ID NO: 13742
  CDS (1)..(3417)

SEQ ID NO: 36097 - protein, 1138 aa, Burkholderia cepacia R18194; identical to SEQ ID NO: 13743

SEQ ID NO: 36098 - DNA, 1776 bp, Listeria monocytogenes str. 4b H7858; identical to SEQ ID NO: 13744
  CDS (1)..(1776): transl_table=11

SEQ ID NO: 36099 - protein, 591 aa, Listeria monocytogenes str. 4b H7858; identical to SEQ ID NO: 13745

SEQ ID NO: 36100 - DNA, 1533 bp, Listeria monocytogenes str. 1/2a F6854; identical to SEQ ID NO: 13746
  CDS (1)..(1533): transl_table=11

SEQ ID NO: 36101 - protein, 510 aa, Listeria monocytogenes str. 1/2a F6854; identical to SEQ ID NO: 13747

SEQ ID NO: 36102 - DNA, 1662 bp, Listeria monocytogenes str. 1/2a F6854; identical to SEQ ID NO: 13748
  CDS (1)..(1662): transl_table=11

SEQ ID NO: 36103 - protein, 553 aa, Listeria monocytogenes str. 1/2a F6854; identical to SEQ ID NO: 13749

SEQ ID NO: 36104 - DNA, 3342 bp, Pseudomonas fluorescens PfO-1; identical to SEQ ID NO: 13750
  CDS (1)..(3342)

SEQ ID NO: 36105 - protein, 1113 aa, Pseudomonas fluorescens PfO-1; identical to SEQ ID NO: 13751

SEQ ID NO: 36106 - DNA, 1629 bp, Rhodospirillum rubrum; identical to SEQ ID NO: 13752
  CDS (1)..(1629)

SEQ ID NO: 36107 - protein, 542 aa, Rhodospirillum rubrum; identical to SEQ ID NO: 13753

SEQ ID NO: 36108 - DNA, 3303 bp, Rhodospirillum rubrum; identical to SEQ ID NO: 13754
  CDS (1)..(3303)

SEQ ID NO: 36109 - protein, 1100 aa, Rhodospirillum rubrum; identical to SEQ ID NO: 13755

SEQ ID NO: 36110 - DNA, 3465 bp, Burkholderia fungorum LB400; identical to SEQ ID NO: 13756
  CDS (1)..(3465)

SEQ ID NO: 36111 - protein, 1154 aa, Burkholderia fungorum LB400; identical to SEQ ID NO: 13757

SEQ ID NO: 36112 - DNA, 1821 bp, Thermobifida fusca; identical to SEQ ID NO: 13758
  CDS (1)..(1821)

SEQ ID NO: 36113 - protein, 606 aa, Thermobifida fusca; identical to SEQ ID NO: 13759

SEQ ID NO: 36114 - DNA, 1563 bp, Microbulbifer degradans 2-40; identical to SEQ ID NO: 13760
  CDS (1)..(1563)

SEQ ID NO: 36115 - protein, 520 aa, Microbulbifer degradans 2-40; identical to SEQ ID NO: 13761

SEQ ID NO: 36116 - DNA, 1671 bp, Oenococcus oeni PSU-1; identical to SEQ ID NO: 13762
  CDS (1)..(1671)

SEQ ID NO: 36117 - protein, 556 aa, Oenococcus oeni PSU-1; identical to SEQ ID NO: 13763

SEQ ID NO: 36118 - DNA, 1482 bp, Trichodesmium erythraeum IMS101; identical to SEQ ID NO: 13764
  CDS (1)..(1482)

SEQ ID NO: 36119 - protein, 493 aa, Trichodesmium erythraeum IMS101; identical to SEQ ID NO: 13765

SEQ ID NO: 36120 - DNA, 3288 bp, Thiobacillus denitrificans ATCC 25259; identical to SEQ ID NO: 13766
  CDS (1)..(3288)

SEQ ID NO: 36121 - protein, 1095 aa, Thiobacillus denitrificans ATCC 25259; identical to SEQ ID NO: 13767

SEQ ID NO: 36122 - DNA, 1815 bp, Chloroflexus aurantiacus; identical to SEQ ID NO: 13768
  CDS (1)..(1815)

SEQ ID NO: 36123 - protein, 604 aa, Chloroflexus aurantiacus; identical to SEQ ID NO: 13769

SEQ ID NO: 36124 - DNA, 4140 bp, Chloroflexus aurantiacus; identical to SEQ ID NO: 13770
  CDS (1)..(4140)

SEQ ID NO: 36125 - protein, 1379 aa, Chloroflexus aurantiacus; identical to SEQ ID NO: 13771

SEQ ID NO: 36126 - DNA, 3363 bp, Chloroflexus aurantiacus; identical to SEQ ID NO: 13772
  CDS (1)..(3363)

SEQ ID NO: 36127 - protein, 1120 aa, Chloroflexus aurantiacus; identical to SEQ ID NO: 13773

SEQ ID NO: 36128 - DNA, 1803 bp, Lactococcus lactis subsp. cremoris SK11; identical to SEQ ID NO: 13774
  CDS (1)..(1803)

SEQ ID NO: 36129 - protein, 600 aa, Lactococcus lactis subsp. cremoris SK11; identical to SEQ ID NO: 13775

SEQ ID NO: 36130 - DNA, 1755 bp, Lactococcus lactis subsp. cremoris SK11; identical to SEQ ID NO: 13776
  CDS (1)..(1755)

SEQ ID NO: 36131 - protein, 584 aa, Lactococcus lactis subsp. cremoris SK11; identical to SEQ ID NO: 13777

SEQ ID NO: 36132 - DNA, 1695 bp, Lactobacillus casei ATCC 334; identical to SEQ ID NO: 13778
  CDS (1)..(1695)

SEQ ID NO: 36133 - protein, 564 aa, Lactobacillus casei ATCC 334; identical to SEQ ID NO: 13779

SEQ ID NO: 36134 - DNA, 1779 bp, Lactobacillus casei ATCC 334; identical to SEQ ID NO: 13780
  CDS (1)..(1779)

SEQ ID NO: 36135 - protein, 592 aa, Lactobacillus casei ATCC 334; identical to SEQ ID NO: 13781

SEQ ID NO: 36136 - DNA, 1668 bp, Lactobacillus casei ATCC 334; identical to SEQ ID NO: 13782
  CDS (1)..(1668)

SEQ ID NO: 36137 - protein, 555 aa, Lactobacillus casei ATCC 334; identical to SEQ ID NO: 13783

SEQ ID NO: 36138 - DNA, 570 bp, Lactobacillus delbrueckii subsp. bulgaricus ATCC BAA-365; identical to SEQ ID NO: 13784
  CDS (1)..(570)

SEQ ID NO: 36139 - protein, 189 aa, Lactobacillus delbrueckii subsp. bulgaricus ATCC BAA-365; identical to SEQ ID NO: 13785

SEQ ID NO: 36140 - DNA, 1827 bp, Deinococcus geothermalis DSM 11300; identical to SEQ ID NO: 13786
  CDS (1)..(1827): transl_table=11

SEQ ID NO: 36141 - protein, 608 aa, Deinococcus geothermalis DSM 11300; identical to SEQ ID NO: 13787

SEQ ID NO: 36142 - DNA, 1491 bp, Deinococcus geothermalis DSM 11300; identical to SEQ ID NO: 13788
  CDS (1)..(1491): transl_table=11

SEQ ID NO: 36143 - protein, 496 aa, Deinococcus geothermalis DSM 11300; identical to SEQ ID NO: 13789

SEQ ID NO: 36144 - DNA, 2097 bp, Deinococcus geothermalis DSM 11300; identical to SEQ ID NO: 13790
  CDS (1)..(2097): transl_table=11

SEQ ID NO: 36145 - protein, 698 aa, Deinococcus geothermalis DSM 11300; identical to SEQ ID NO: 13791

SEQ ID NO: 36146 - DNA, 1662 bp, Anaeromyxobacter dehalogenans 2CP-C; identical to SEQ ID NO: 13792
  CDS (1)..(1662): transl_table=11

SEQ ID NO: 36147 - protein, 553 aa, Anaeromyxobacter dehalogenans 2CP-C; identical to SEQ ID NO: 13793

SEQ ID NO: 36148 - DNA, 1638 bp, Anaeromyxobacter dehalogenans 2CP-C; identical to SEQ ID NO: 13794
  CDS (1)..(1638): transl_table=11

SEQ ID NO: 36149 - protein, 545 aa, Anaeromyxobacter dehalogenans 2CP-C; identical to SEQ ID NO: 13795

SEQ ID NO: 36150 - DNA, 1602 bp, Anaeromyxobacter dehalogenans 2CP-C; identical to SEQ ID NO: 13796
  CDS (1)..(1602): transl_table=11

SEQ ID NO: 36151 - protein, 533 aa, Anaeromyxobacter dehalogenans 2CP-C; identical to SEQ ID NO: 13797

SEQ ID NO: 36152 - DNA, 1188 bp, Streptococcus pneumoniae TIGR4; identical to SEQ ID NO: 13798
  CDS (1)..(1188)

SEQ ID NO: 36153 - protein, 395 aa, Streptococcus pneumoniae TIGR4; identical to SEQ ID NO: 13799

SEQ ID NO: 36154 - DNA, 1407 bp, Arthrobacter sp. FB24; identical to SEQ ID NO: 13800
  CDS (1)..(1407): transl_table=11

SEQ ID NO: 36155 - protein, 468 aa, Arthrobacter sp. FB24; identical to SEQ ID NO: 13801

SEQ ID NO: 36156 - DNA, 1968 bp, Arthrobacter sp. FB24; identical to SEQ ID NO: 13802
  CDS (1)..(1968): transl_table=11

SEQ ID NO: 36157 - protein, 655 aa, Arthrobacter sp. FB24; identical to SEQ ID NO: 13803

SEQ ID NO: 36158 - DNA, 1797 bp, Arthrobacter sp. FB24; identical to SEQ ID NO: 13804
  CDS (1)..(1797): transl_table=11

SEQ ID NO: 36159 - protein, 598 aa, Arthrobacter sp. FB24; identical to SEQ ID NO: 13805

SEQ ID NO: 36160 - DNA, 3327 bp, Azotobacter vinelandii AvOP; identical to SEQ ID NO: 13806
  CDS (1)..(3327): transl_table=11

SEQ ID NO: 36161 - protein, 1108 aa, Azotobacter vinelandii AvOP; identical to SEQ ID NO: 13807

SEQ ID NO: 36162 - DNA, 3414 bp, Burkholderia vietnamiensis G4; identical to SEQ ID NO: 13808
  CDS (1)..(3414): transl_table=11

SEQ ID NO: 36163 - protein, 1137 aa, Burkholderia vietnamiensis G4; identical to SEQ ID NO: 13809

SEQ ID NO: 36164 - DNA, 3414 bp, Burkholderia cenocepacia HI2424; identical to SEQ ID NO: 13810
  CDS (1)..(3414): transl_table=11

SEQ ID NO: 36165 - protein, 1137 aa, Burkholderia cenocepacia HI2424; identical to SEQ ID NO: 13811

SEQ ID NO: 36166 - DNA, 1614 bp, Chromohalobacter salexigens DSM 3043; identical to SEQ ID NO: 13812
  CDS (1)..(1614): transl_table=11

SEQ ID NO: 36167 - protein, 537 aa, Chromohalobacter salexigens DSM 3043; identical to SEQ ID NO: 13813

SEQ ID NO: 36168 - DNA, 3396 bp, Burkholderia pseudomallei S13; identical to SEQ ID NO: 13814
  CDS (1)..(3396)

SEQ ID NO: 36169 - protein, 1131 aa, Burkholderia pseudomallei S13; identical to SEQ ID NO: 13815

SEQ ID NO: 36170 - DNA, 1728 bp, Clostridium thermocellum ATCC 27405; identical to SEQ ID NO: 13816
  CDS (1)..(1728): transl_table=11

SEQ ID NO: 36171 - protein, 575 aa, Clostridium thermocellum ATCC 27405; identical to SEQ ID NO: 13817

SEQ ID NO: 36172 - DNA, 1461 bp, Crocosphaera watsonii WH 8501; identical to SEQ ID NO: 13818
  CDS (1)..(1461): transl_table=11

SEQ ID NO: 36173 - protein, 486 aa, Crocosphaera watsonii WH 8501; identical to SEQ ID NO: 13819

SEQ ID NO: 36174 - DNA, 3318 bp, Chlorobium phaeobacteroides BS1; identical to SEQ ID NO: 13820
  CDS (1)..(3318): transl_table=11

SEQ ID NO: 36175 - protein, 1105 aa, Chlorobium phaeobacteroides BS1; identical to SEQ ID NO: 13821

SEQ ID NO: 36176 - DNA, 3339 bp, Geobacter metallireducens GS-15; identical to SEQ ID NO: 13822
  CDS (1)..(3339): transl_table=11

SEQ ID NO: 36177 - protein, 1112 aa, Geobacter metallireducens GS-15; identical to SEQ ID NO: 13823

SEQ ID NO: 36178 - DNA, 1785 bp, Exiguobacterium sp. 255-15; identical to SEQ ID NO: 13824
  CDS (1)..(1785): transl_table=11

SEQ ID NO: 36179 - protein, 594 aa, Exiguobacterium sp. 255-15; identical to SEQ ID NO: 13825

SEQ ID NO: 36180 - DNA, 1674 bp, Exiguobacterium sp. 255-15; identical to SEQ ID NO: 13826
  CDS (1)..(1674): transl_table=11

SEQ ID NO: 36181 - protein, 557 aa, Exiguobacterium sp. 255-15; identical to SEQ ID NO: 13827

SEQ ID NO: 36182 - DNA, 1611 bp, Exiguobacterium sp. 255-15; identical to SEQ ID NO: 13828
  CDS (1)..(1611): transl_table=11

SEQ ID NO: 36183 - protein, 536 aa, Exiguobacterium sp. 255-15; identical to SEQ ID NO: 13829

SEQ ID NO: 36184 - DNA, 1788 bp, Exiguobacterium sp. 255-15; identical to SEQ ID NO: 13830
  CDS (1)..(1788): transl_table=11

SEQ ID NO: 36185 - protein, 595 aa, Exiguobacterium sp. 255-15; identical to SEQ ID NO: 13831

SEQ ID NO: 36186 - DNA, 1803 bp, Frankia sp. CcI3; identical to SEQ ID NO: 13832
  CDS (1)..(1803): transl_table=11

SEQ ID NO: 36187 - protein, 600 aa, Frankia sp. CcI3; identical to SEQ ID NO: 13833

SEQ ID NO: 36188 - DNA, 3582 bp, Desulfitobacterium hafniense DCB-2; identical to SEQ ID NO: 13834
  CDS (1)..(3582): transl_table=11

SEQ ID NO: 36189 - protein, 1193 aa, Desulfitobacterium hafniense DCB-2; identical to SEQ ID NO: 13835

SEQ ID NO: 36190 - DNA, 1719 bp, Frankia sp. EAN1pec; identical to SEQ ID NO: 13836
  CDS (1)..(1719): transl_table=11

SEQ ID NO: 36191 - protein, 572 aa, Frankia sp. EAN1pec; identical to SEQ ID NO: 13837

SEQ ID NO: 36192 - DNA, 1761 bp, Moorella thermoacetica ATCC 39073; identical to SEQ ID NO: 13838
  CDS (1)..(1761): transl_table=11

SEQ ID NO: 36193 - protein, 586 aa, Moorella thermoacetica ATCC 39073; identical to SEQ ID NO: 13839

SEQ ID NO: 36194 - DNA, 1623 bp, Shewanella baltica OS155; identical to SEQ ID NO: 13840
  CDS (1)..(1623): transl_table=11

SEQ ID NO: 36195 - protein, 540 aa, Shewanella baltica OS155; identical to SEQ ID NO: 13841

SEQ ID NO: 36196 - DNA, 1635 bp, Shewanella amazonensis SB2B; identical to SEQ ID NO: 13842
  CDS (1)..(1635): transl_table=11

SEQ ID NO: 36197 - protein, 544 aa, Shewanella amazonensis SB2B; identical to SEQ ID NO: 13843

SEQ ID NO: 36198 - DNA, 3297 bp, Pelodictyon phaeoclathratiforme BU-1; identical to SEQ ID NO: 13844
  CDS (1)..(3297): transl_table=11

SEQ ID NO: 36199 - protein, 1098 aa, Pelodictyon phaeoclathratiforme BU-1; identical to SEQ ID NO: 13845

SEQ ID NO: 36200 - DNA, 3414 bp, Prosthecochloris aestuarii DSM 271; identical to SEQ ID NO: 13846
  CDS (1)..(3414): transl_table=11

SEQ ID NO: 36201 - protein, 1137 aa, Prosthecochloris aestuarii DSM 271; identical to SEQ ID NO: 13847

SEQ ID NO: 36202 - DNA, 1593 bp, Rubrobacter xylanophilus DSM 9941; identical to SEQ ID NO: 13848
  CDS (1)..(1593): transl_table=11

SEQ ID NO: 36203 - protein, 530 aa, Rubrobacter xylanophilus DSM 9941; identical to SEQ ID NO: 13849

SEQ ID NO: 36204 - DNA, 5328 bp, Rubrobacter xylanophilus DSM 9941; identical to SEQ ID NO: 13850
  CDS (1)..(5328): transl_table=11

SEQ ID NO: 36205 - protein, 1775 aa, Rubrobacter xylanophilus DSM 9941; identical to SEQ ID NO: 13851

SEQ ID NO: 36206 - DNA, 1755 bp, Mesorhizobium sp. BNC1; identical to SEQ ID NO: 13852
  CDS (1)..(1755): transl_table=11

SEQ ID NO: 36207 - protein, 584 aa, Mesorhizobium sp. BNC1; identical to SEQ ID NO: 13853

SEQ ID NO: 36208 - DNA, 3348 bp, Mesorhizobium sp. BNC1; identical to SEQ ID NO: 13854
  CDS (1)..(3348): transl_table=11

SEQ ID NO: 36209 - protein, 1115 aa, Mesorhizobium sp. BNC1; identical to SEQ ID NO: 13855

SEQ ID NO: 36210 - DNA, 1653 bp, Silicibacter sp. TM1040; identical to SEQ ID NO: 13856
  CDS (1)..(1653): transl_table=11

SEQ ID NO: 36211 - protein, 550 aa, Silicibacter sp. TM1040; identical to SEQ ID NO: 13857

SEQ ID NO: 36212 - DNA, 3267 bp, Nitrobacter hamburgensis X14; identical to SEQ ID NO: 13858
  CDS (1)..(3267): transl_table=11

SEQ ID NO: 36213 - protein, 1088 aa, Nitrobacter hamburgensis X14; identical to SEQ ID NO: 13859

SEQ ID NO: 36214 - DNA, 1926 bp, Shewanella denitrificans OS-217; identical to SEQ ID NO: 13860
  CDS (1)..(1926): transl_table=11

SEQ ID NO: 36215 - protein, 641 aa, Shewanella denitrificans OS-217; identical to SEQ ID NO: 13861

SEQ ID NO: 36216 - DNA, 1419 bp, Thermotoga neapolitana; identical to SEQ ID NO: 13862
  CDS (1)..(1419): transl_table=11

SEQ ID NO: 36217 - protein, 472 aa, Thermotoga neapolitana; identical to SEQ ID NO: 13863

SEQ ID NO: 36218 - DNA, 1701 bp, Bacteroides thetaiotaomicron; identical to SEQ ID NO: 13864
  CDS (1)..(1701): transl_table=11

SEQ ID NO: 36219 - protein, 566 aa, Bacteroides thetaiotaomicron; identical to SEQ ID NO: 13865

SEQ ID NO: 36220 - DNA, 3906 bp, Alicyclobacillus acidocaldarius; identical to SEQ ID NO: 13866
  CDS (1)..(3906): transl_table=11

SEQ ID NO: 36221 - protein, 1301 aa, Alicyclobacillus acidocaldarius; identical to SEQ ID NO: 13867

SEQ ID NO: 36222 - DNA, 1797 bp, Klebsiella oxytoca; identical to SEQ ID NO: 13868
  CDS (1)..(1797): transl_table=11

SEQ ID NO: 36223 - protein, 598 aa, Klebsiella oxytoca; identical to SEQ ID NO: 13869

SEQ ID NO: 36224 - DNA, 1581 bp, Bacillus sp; identical to SEQ ID NO: 13870
  CDS (1)..(1581): transl_table=11

SEQ ID NO: 36225 - protein, 526 aa, Bacillus sp; identical to SEQ ID NO: 13871

SEQ ID NO: 36226 - DNA, 1761 bp, Anoxybacillus flavithermus; identical to SEQ ID NO: 13872
  CDS (1)..(1761): transl_table=11

SEQ ID NO: 36227 - protein, 586 aa, Anoxybacillus flavithermus; identical to SEQ ID NO: 13873

SEQ ID NO: 36228 - DNA, 1749 bp, Thermoactinomyces thalpophilus; identical to SEQ ID NO: 13874
  CDS (1)..(1749): transl_table=11

SEQ ID NO: 36229 - protein, 582 aa, Thermoactinomyces thalpophilus; identical to SEQ ID NO: 13875

SEQ ID NO: 36230 - DNA, 1332 bp, Anaerobranca gottschalkii; identical to SEQ ID NO: 13876
  CDS (1)..(1332): transl_table=11

SEQ ID NO: 36231 - protein, 443 aa, Anaerobranca gottschalkii; identical to SEQ ID NO: 13877

SEQ ID NO: 36232 - DNA, 1740 bp, Aedes albopictus; identical to SEQ ID NO: 13878
  CDS (1)..(1740)

SEQ ID NO: 36233 - protein, 579 aa, Aedes albopictus; identical to SEQ ID NO: 13879

SEQ ID NO: 36234 - DNA, 1170 bp, Aeromonas hydrophila; identical to SEQ ID NO: 13880
  CDS (1)..(1170): n means a or g or c or t/u, s means g or c

SEQ ID NO: 36235 - protein, 389 aa, Aeromonas hydrophila; identical to SEQ ID NO: 13881
  Xaa in position 289 is unknown

SEQ ID NO: 36236 - DNA, 1449 bp, Thermoactinomyces vulgaris; identical to SEQ ID NO: 13882
  CDS (1)..(1449): transl_table=11

SEQ ID NO: 36237 - protein, 482 aa, Thermoactinomyces vulgaris; identical to SEQ ID NO: 13883

SEQ ID NO: 36238 - DNA, 1581 bp, Xanthomonas campestris; identical to SEQ ID NO: 13884
  CDS (1)..(1581): transl_table=11

SEQ ID NO: 36239 - protein, 526 aa, Xanthomonas campestris; identical to SEQ ID NO: 13885

SEQ ID NO: 36240 - DNA, 3309 bp, Rhodobacter sphaeroides f; identical to SEQ ID NO: 13886
  CDS (1)..(3309): transl_table=11

SEQ ID NO: 36241 - protein, 1102 aa, Rhodobacter sphaeroides f; identical to SEQ ID NO: 13887

SEQ ID NO: 36242 - DNA, 1548 bp, Ostreococcus tauri; identical to SEQ ID NO: 13888
  CDS (1)..(1548)

SEQ ID NO: 36243 - protein, 515 aa, Ostreococcus tauri; identical to SEQ ID NO: 13889

SEQ ID NO: 36244 - DNA, 1554 bp, uncultured bacterium; identical to SEQ ID NO: 13890
  CDS (1)..(1554)

SEQ ID NO: 36245 - protein, 517 aa, uncultured bacterium; identical to SEQ ID NO: 13891

SEQ ID NO: 36246 - DNA, 2628 bp, Chlamydomonas reinhardtii; identical to SEQ ID NO: 13892
  CDS (1)..(2628)

SEQ ID NO: 36247 - protein, 875 aa, Chlamydomonas reinhardtii; identical to SEQ ID NO: 13893

SEQ ID NO: 36248 - DNA, 1962 bp, Paenibacillus sp; identical to SEQ ID NO: 13894
  CDS (1)..(1962): transl_table=11

SEQ ID NO: 36249 - protein, 653 aa, Paenibacillus sp; identical to SEQ ID NO: 13895

SEQ ID NO: 36250 - DNA, 1548 bp, Halothermothrix orenii; identical to SEQ ID NO: 13896
  CDS (1)..(1548): transl_table=11

SEQ ID NO: 36251 - protein, 515 aa, Halothermothrix orenii; identical to SEQ ID NO: 13897

SEQ ID NO: 36252 - DNA, 1533 bp, Paenibacillus sp; identical to SEQ ID NO: 13898
  CDS (1)..(1533): transl_table=11

SEQ ID NO: 36253 - protein, 510 aa, Paenibacillus sp; identical to SEQ ID NO: 13899

SEQ ID NO: 36254 - DNA, 1767 bp, Bacillus stearothermophilus; identical to SEQ ID NO: 13900
  CDS (1)..(1767): transl_table=11

SEQ ID NO: 36255 - protein, 588 aa, Bacillus stearothermophilus; identical to SEQ ID NO: 13901

SEQ ID NO: 36256 - DNA, 6057 bp, Bacillus stearothermophilus; identical to SEQ ID NO: 13902
  CDS (1)..(6057): transl_table=11

SEQ ID NO: 36257 - protein, 2018 aa, Bacillus stearothermophilus; identical to SEQ ID NO: 13903

SEQ ID NO: 36258 - DNA, 1983 bp, Thermococcus sp; identical to SEQ ID NO: 13904
  CDS (1)..(1983): transl_table=11

SEQ ID NO: 36259 - protein, 660 aa, Thermococcus sp; identical to SEQ ID NO: 13905

SEQ ID NO: 36260 - DNA, 2181 bp, Thermococcus sp; identical to SEQ ID NO: 13906
  CDS (1)..(2181)

SEQ ID NO: 36261 - protein, 726 aa, Thermococcus sp; identical to SEQ ID NO: 13907

SEQ ID NO: 36262 - DNA, 2220 bp, Thermococcus sp; identical to SEQ ID NO: 13908
  CDS (1)..(2220): transl_table=11

SEQ ID NO: 36263 - protein, 739 aa, Thermococcus sp; identical to SEQ ID NO: 13909

SEQ ID NO: 36264 - DNA, 1737 bp, Alicyclobacillus acidocaldarius; identical to SEQ ID NO: 13910
  CDS (1)..(1737): transl_table=11

SEQ ID NO: 36265 - protein, 578 aa, Alicyclobacillus acidocaldarius; identical to SEQ ID NO: 13911

SEQ ID NO: 36266 - DNA, 1548 bp, Paenibacillus polymyxa; identical to SEQ ID NO: 13912
  CDS (1)..(1548): transl_table=11

SEQ ID NO: 36267 - protein, 515 aa, Paenibacillus polymyxa; identical to SEQ ID NO: 13913

SEQ ID NO: 36268 - DNA, 1689 bp, Dictyoglomus thermophilum; identical to SEQ ID NO: 13914
  CDS (1)..(1689): transl_table=11

SEQ ID NO: 36269 - protein, 562 aa, Dictyoglomus thermophilum; identical to SEQ ID NO: 13915

SEQ ID NO: 36270 - DNA, 1497 bp, Dictyoglomus thermophilum; identical to SEQ ID NO: 13916
  CDS (1)..(1497): transl_table=11

SEQ ID NO: 36271 - protein, 498 aa, Dictyoglomus thermophilum; identical to SEQ ID NO: 13917

SEQ ID NO: 36272 - DNA, 1242 bp, Triticum aestivum; identical to SEQ ID NO: 13918
  CDS (1)..(1242)

SEQ ID NO: 36273 - protein, 413 aa, Triticum aestivum; identical to SEQ ID NO: 13919

SEQ ID NO: 36274 - DNA, 1761 bp, Bacillus acidopullulyticus; identical to SEQ ID NO: 13920
  CDS (1)..(1761): transl_table=11

SEQ ID NO: 36275 - protein, 586 aa, Bacillus acidopullulyticus; identical to SEQ ID NO: 13921

SEQ ID NO: 36276 - DNA, 1563 bp, Bacillus megaterium; identical to SEQ ID NO: 13922
  CDS (1)..(1563): transl_table=11

SEQ ID NO: 36277 - protein, 520 aa, Bacillus megaterium; identical to SEQ ID NO: 13923

SEQ ID NO: 36278 - DNA, 4428 bp, Thermoanaerobacter thermohydrosulfuricus; identical to SEQ ID NO: 13924
  CDS (1)..(4428): transl_table=11

SEQ ID NO: 36279 - protein, 1475 aa, Thermoanaerobacter thermohydrosulfuricus; identical to SEQ ID NO: 13925

SEQ ID NO: 36280 - DNA, 1776 bp, Bacillus sphaericus; identical to SEQ ID NO: 13926
  CDS (1)..(1776): transl_table=11

SEQ ID NO: 36281 - protein, 591 aa, Bacillus sphaericus; identical to SEQ ID NO: 13927

SEQ ID NO: 36282 - DNA, 1725 bp, Thermoanaerobacter ethanolicus; identical to SEQ ID NO: 13928
  CDS (1)..(1725): transl_table=11

SEQ ID NO: 36283 - protein, 574 aa, Thermoanaerobacter ethanolicus; identical to SEQ ID NO: 13929

SEQ ID NO: 36284 - DNA, 1761 bp, Drosophila virilis; identical to SEQ ID NO: 13930
  CDS (1)..(1761)

SEQ ID NO: 36285 - protein, 586 aa, Drosophila virilis; identical to SEQ ID NO: 13931

SEQ ID NO: 36286 - DNA, 1329 bp, Thermotoga neapolitana; identical to SEQ ID NO: 13932
  CDS (1)..(1329): transl_table=11

SEQ ID NO: 36287 - protein, 442 aa, Thermotoga neapolitana; identical to SEQ ID NO: 13933

SEQ ID NO: 36288 - DNA, 2001 bp, Thermoactinomyces vulgaris; identical to SEQ ID NO: 13934
  CDS (1)..(2001): transl_table=11

SEQ ID NO: 36289 - protein, 666 aa, Thermoactinomyces vulgaris; identical to SEQ ID NO: 13935

SEQ ID NO: 36290 - DNA, 1758 bp, Thermoactinomyces vulgaris; identical to SEQ ID NO: 13936
  CDS (1)..(1758): transl_table=11

SEQ ID NO: 36291 - protein, 585 aa, Thermoactinomyces vulgaris; identical to SEQ ID NO: 13937

SEQ ID NO: 36292 - DNA, 24 bp, Artificial sequence
  (1)..(24): primer
atgatgttaaatgcatggcacctg

SEQ ID NO: 36293 - DNA, 24 bp, Artificial sequence
  (1)..(24): primer
ttagttcatccataccgtagccga

SEQ ID NO: 36294 - protein, 917 aa, Artificial sequence; identical to SEQ ID NO: 13940
  Variant (2)..(2): xaa in position 2 is any amino acid
  Variant (6)..(6): xaa in position 6 is any amino acid
  Variant (15)..(16): xaa in position 15 to 16 is any amino acid
  Variant (18)..(18): xaa in position 18 is any amino acid
  Variant (22)..(22): xaa in position 22 is any amino acid
  Variant (25)..(25): xaa in position 25 is any amino acid
  Variant (26)..(85): xaa in position 26 to 85 is any or no amino acid
  Variant (89)..(89): xaa in position 89 is any amino acid
  Variant (93)..(93): xaa in position 93 is any amino acid
  Variant (99)..(99): xaa in position 99 is any amino acid
  Variant (101)..(108): xaa in position 101 to 108 is any or no amino acid
  Variant (112)..(112): xaa in position 112 is any amino acid
  Variant (117)..(117): xaa in position 117 is any amino acid
  Variant (121)..(121): xaa in position 121 is any amino acid
  Variant (124)..(125): xaa in position 124 to 125 is any amino acid
  Variant (126)..(152): xaa in position 126 to 152 is any or no amino acid
  Variant (158)..(158): xaa in position 158 is any amino acid
  Variant (161)..(162): xaa in position 161 to 162 is any amino acid
  Variant (166)..(166): xaa in position 166 is any amino acid
  Variant (171)..(171): xaa in position 171 is any amino acid
  Variant (174)..(175): xaa in position 174 to 175 is any amino acid
  Variant (178)..(179): xaa in position 178 to 179 is any amino acid
  Variant (182)..(182): xaa in position 182 is any amino acid
  Variant (186)..(189): xaa in position 186 to 189 is any or no amino acid
  Variant (195)..(195): xaa in position 195 is any amino acid
  Variant (197)..(197): xaa in position 197 is any amino acid
  Variant (203)..(203): xaa in position 203 is any amino acid
  Variant (205)..(205): xaa in position 205 is any amino acid
  Variant (208)..(208): xaa in position 208 is any amino acid
  Variant (211)..(214): xaa in position 211 to 214 is any amino acid
  Variant (215)..(256): xaa in position 215 to 256 is any or no amino acid
  Variant (258)..(258): xaa in position 258 is any or no amino acid
  Variant (266)..(266): xaa in position 266 is any or no amino acid
  Variant (268)..(269): xaa in position 268 to 269 is any amino acid
  Variant (270)..(394): xaa in position 270 to 394 is any or no amino acid
  Variant (397)..(399): xaa in position 397 to 399 is any or no amino acid
  Variant (401)..(402): xaa in position 401 to 402 is any amino acid
  Variant (403)..(404): xaa in position 403 to 404 is any or no amino acid
  Variant (413)..(413): xaa in position 413 is any amino acid
  Variant (415)..(417): xaa in position 415 to 417 is any amino acid
  Variant (420)..(420): xaa in position 420 is any amino acid
  Variant (421)..(426): xaa in position 421 to 426 is any or no amino acid
  Variant (433)..(433): xaa in position 433 is any amino acid
  Variant (434)..(434): xaa in position 434 is any or no amino acid
  Variant (436)..(441): xaa in position 436 to 441 is any or no amino acid
  Variant (449)..(449): xaa in position 449 is any amino acid
  Variant (451)..(452): xaa in position 451 to 452 is any amino acid
  Variant (454)..(458): xaa in position 454 to 458 is any amino acid
  Variant (459)..(487): xaa in position 459 to 487 is any or no amino acid
  Variant (489)..(490): xaa in position 489 to 490 is any amino acid
  Variant (492)..(495): xaa in position 492 to 495 is any amino acid
  Variant (498)..(498): xaa in position 498 is any amino acid
  Variant (504)..(509): xaa in position 504 to 509 is any amino acid
  Variant (510)..(529): xaa in position 510 to 529 is any or no amino acid
  Variant (532)..(534): xaa in position 532 to 534 is any amino acid
  Variant (535)..(538): xaa in position 535 to 538 is any or no amino acid
  Variant (540)..(544): xaa in position 540 to 544 is any amino acid
  Variant (547)..(554): xaa in position 547 to 554 is any amino acid
  Variant (555)..(592): xaa in position 555 to 592 is any or no amino acid
  Variant (594)..(607): xaa in position 594 to 607 is any amino acid
  Variant (608)..(611): xaa in position 608 to 611 is any or no amino acid
  Variant (613)..(613): xaa in position 613 is any amino acid
  Variant (617)..(618): xaa in position 617 to 618 is any amino acid
  Variant (620)..(620): xaa in position 620 is any amino acid
  Variant (623)..(623): xaa in position 623 is any amino acid
  Variant (625)..(627): xaa in position 625 to 627 is any amino acid
  Variant (628)..(667): xaa in position 628 to 667 is any or no amino acid
  Variant (672)..(674): xaa in position 672 to 674 is any amino acid
  Variant (684)..(684): xaa in position 684 is any amino acid
  Variant (694)..(697): xaa in position 694 to 697 is any amino acid
  Variant (698)..(737): xaa in position 698 to 737 is any or no amino acid
  Variant (739)..(739): xaa in position 739 is any amino acid
  Variant (740)..(740): xaa in position 740 is any or no amino acid
  Variant (742)..(742): xaa in position 742 is any or no amino acid
  Variant (745)..(745): xaa in position 745 is any or no amino acid
  Variant (747)..(750): xaa in position 747 to 750 is any amino acid
  Variant (752)..(797): xaa in position 752 to 797 is any or no amino acid
  Variant (801)..(801): xaa in position 801 is any amino acid
  Variant (803)..(803): xaa in position 803 is any amino acid
  Variant (805)..(805): xaa in position 805 is any amino acid
  Variant (808)..(808): xaa in position 808 is any amino acid
  Variant (812)..(814): xaa in position 812 to 814 is any amino acid
  Variant (817)..(817): xaa in position 817 is any amino acid
  Variant (818)..(818): xaa in position 818 is any or no amino acid
  Variant (820)..(827): xaa in position 820 to 827 is any amino acid
  Variant (828)..(840): xaa in position 828 to 840 is any or no amino acid
  Variant (845)..(845): xaa in position 845 is any amino acid
  Variant (847)..(850): xaa in position 847 to 850 is any amino acid
  Variant (852)..(852): xaa in position 852 is any amino acid
  Variant (857)..(857): xaa in position 857 is any amino acid
  Variant (859)..(864): xaa in position 859 to 864 is any amino acid
  Variant (865)..(886): xaa in position 865 to 886 is any or no amino acid
  Variant (888)..(898): xaa in position 888 to 898 is any amino acid
  Variant (899)..(909): xaa in position 899 to 909 is any or no amino acid
  Variant (911)..(915): xaa in position 911 to 915 is any amino acid
  Variant (916)..(916): xaa in position 916 is any or no amino acid

SEQ ID NO: 36295 - protein, 8 aa, Artificial sequence
  Variant (2)..(2): xaa in position 2 is Glu or Gln
  Variant (3)..(3): xaa in position 3 is Ile, Leu or Val
  Variant (4)..(7): xaa in position 4 to 7 is any amino acid
YXXXXXXF

SEQ ID NO: 36296 - protein, 72 aa, Artificial sequence; identical to SEQ ID NO: 13942
  Variant (2)..(12): xaa in position 2 to 12 is any amino acid
  Variant (14)..(16): xaa in position 14 to 16 is any amino acid
  Variant (17)..(17): xaa in position 17 is Phe, Ile, Leu, Met or Val
  Variant (18)..(18): xaa in position 18 is Trp or Tyr
  Variant (19)..(19): xaa in position 19 is Phe, Ile, Leu, Met or Val
  Variant (20)..(20): xaa in position 20 is any amino acid
  Variant (22)..(30): xaa in position 22 to 30 is any amino acid
  Variant (31)..(31): xaa in position 31 is any or no amino acid
  Variant (33)..(35): xaa in position 33 to 35 is any amino acid
  Variant (36)..(36): xaa in position 36 is Asp, Glu, Asn or Thr
  Variant (37)..(39): xaa in position 37 to 39 is any amino acid
  Variant (40)..(40): xaa in position 40 is Phe, Ile, Leu or Val
  Variant (41)..(44): xaa in position 41 to 44 is any amino acid
  Variant (46)..(52): xaa in position 46 to 52 is any amino acid
  Variant (53)..(53): xaa in position 53 is Phe, Leu, Met or Val
  Variant (54)..(61): xaa in position 54 to 61 is any amino acid
  Variant (62)..(62): xaa in position 62 is Phe, Ile, Leu, Met or Val
  Variant (63)..(63): xaa in position 63 is any amino acid
  Variant (64)..(64): xaa in position 64 is Ile, Leu or Val
  Variant (65)..(66): xaa in position 65 to 66 is any amino acid
  Variant (67)..(67): xaa in position 67 is Asp or Glu
  Variant (68)..(71): xaa in position 68 to 71 is any amino acid

SEQ ID NO: 36297 - protein, 14 aa, Artificial sequence
  Variant (2)..(6): xaa in position 2 to 6 is any amino acid
  Variant (7)..(8): xaa in position 7 to 8 is any or no amino acid
  Variant (10)..(10): xaa in position 10 is Ala or Gly
  Variant (11)..(11): xaa in position 11 is any amino acid
  Variant (13)..(13): xaa in position 13 is Phe, Ile, Leu, Met or Val
WXXXXXXXDXXRXD

SEQ ID NO: 36298 - protein, 12 aa, Artificial sequence
  Variant (2)..(2): xaa in position 2 is any amino acid
  Variant (3)..(3): xaa in position 3 is Ala, Ile, Pro or Val
  Variant (4)..(5): xaa in position 4 to 5 is any amino acid
  Variant (7)..(7): xaa in position 7 is any amino acid
  Variant (9)..(9): xaa in position 9 is Asp, Glu, Gly, Asn, Gln, Ser or Thr
  Variant (11)..(11): xaa in position 11 is any amino acid
GXXXXYXGXEXG

SEQ ID NO: 36299 - DNA, 456 bp, Escherichia coli K12; identical to SEQ ID NO: 19503
  CDS (1)..(456): transl_table=11

SEQ ID NO: 36300 - protein, 151 aa, Escherichia coli K12; identical to SEQ ID NO: 19504

SEQ ID NO: 36301 - DNA, 444 bp, Escherichia coli; identical to SEQ ID NO: 19505
  CDS (1)..(444): transl_table=11

SEQ ID NO: 36302 - protein, 147 aa, Escherichia coli; identical to SEQ ID NO: 19506

SEQ ID NO: 36303 - DNA, 465 bp, Mesorhizobium loti MAFF303099; identical to SEQ ID NO: 19507
  CDS (1)..(465): transl_table=11

SEQ ID NO: 36304 - protein, 154 aa, Mesorhizobium loti MAFF303099; identical to SEQ ID NO: 19508

SEQ ID NO: 36305 - DNA, 423 bp, Thermotoga maritima MSB8; identical to SEQ ID NO: 19509
  CDS (1)..(423): transl_table=11

SEQ ID NO: 36306 - protein, 140 aa, Thermotoga maritima MSB8; identical to SEQ ID NO: 19510

SEQ ID NO: 36307 - DNA, 570 bp, Vibrio cholerae O1 biovar eltor str. N16961; identical to SEQ ID NO: 19511
  CDS (1)..(570): transl_table=11

SEQ ID NO: 36308 - protein, 189 aa, Vibrio cholerae O1 biovar eltor str. N16961; identical to SEQ ID NO: 19512

SEQ ID NO: 36309 - DNA, 450 bp, Pasteurella multocida subsp. multocida str. Pm70; identical to SEQ ID NO: 19513
  CDS (1)..(450): transl_table=11

SEQ ID NO: 36310 - protein, 149 aa, Pasteurella multocida subsp. multocida str. Pm70; identical to SEQ ID NO: 19514

SEQ ID NO: 36311 - DNA, 453 bp, Pseudomonas aeruginosa PAO1; identical to SEQ ID NO: 19515
  CDS (1)..(453): transl_table=11

SEQ ID NO: 36312 - protein, 150 aa, Pseudomonas aeruginosa PAO1; identical to SEQ ID NO: 19516

SEQ ID NO: 36313 - DNA, 480 bp, Deinococcus radiodurans R1; identical to SEQ ID NO: 19517
  CDS (1)..(480): transl_table=11

SEQ ID NO: 36314 - protein, 159 aa, Deinococcus radiodurans R1; identical to SEQ ID NO: 19518

SEQ ID NO: 36315 - DNA, 435 bp, Xylella fastidiosa 9a5c; identical to SEQ ID NO: 19519
  CDS (1)..(435): transl_table=11

SEQ ID NO: 36316 - protein, 144 aa, Xylella fastidiosa 9a5c; identical to SEQ ID NO: 19520

SEQ ID NO: 36317 - DNA, 456 bp, Sinorhizobium meliloti 1021; identical to SEQ ID NO: 19521
  CDS (1)..(456): transl_table=11

SEQ ID NO: 36318 - protein, 151 aa, Sinorhizobium meliloti 1021; identical to SEQ ID NO: 19522

SEQ ID NO: 36319 - DNA, 465 bp, Caulobacter crescentus CB15; identical to SEQ ID NO: 19523
  CDS (1)..(465): transl_table=11

SEQ ID NO: 36320 - protein, 154 aa, Caulobacter crescentus CB15; identical to SEQ ID NO: 19524

SEQ ID NO: 36321 - DNA, 465 bp, Agrobacterium tumefaciens str. C58; identical to SEQ ID NO: 19525
  CDS (1)..(465): transl_table=11

SEQ ID NO: 36322 - protein, 154 aa, Agrobacterium tumefaciens str. C58; identical to SEQ ID NO: 19526

SEQ ID NO: 36323 - DNA, 417 bp, Xanthomonas axonopodis pv. citri str. 306; identical to SEQ ID NO: 19527
  CDS (1)..(417): transl_table=11

SEQ ID NO: 36324 - protein, 138 aa, Xanthomonas axonopodis pv. citri str. 306; identical to SEQ ID NO: 19528

SEQ ID NO: 36325 - DNA, 468 bp, Brucella suis 1330; identical to SEQ ID NO: 19529
  CDS (1)..(468): transl_table=11

SEQ ID NO: 36326 - protein, 155 aa, Brucella suis 1330; identical to SEQ ID NO: 19530

SEQ ID NO: 36327 - DNA, 432 bp, Pseudomonas putida KT2440; identical to SEQ ID NO: 19531
  CDS (1)..(432): transl_table=11

SEQ ID NO: 36328 - protein, 143 aa, Pseudomonas putida KT2440; identical to SEQ ID NO: 19532

SEQ ID NO: 36329 - DNA, 453 bp, Vibrio vulnificus CMCP6; identical to SEQ ID NO: 19533
  CDS (1)..(453): transl_table=11

SEQ ID NO: 36330 - protein, 150 aa, Vibrio vulnificus CMCP6; identical to SEQ ID NO: 19534

SEQ ID NO: 36331 - DNA, 444 bp, Bradyrhizobium japonicum USDA 110; identical to SEQ ID NO: 19535
  CDS (1)..(444): transl_table=11

SEQ ID NO: 36332 - protein, 147 aa, Bradyrhizobium japonicum USDA 110; identical to SEQ ID NO: 19536

SEQ ID NO: 36333 - DNA, 435 bp, Xylella fastidiosa Temecula1; identical to SEQ ID NO: 19537
  CDS (1)..(435): transl_table=11

SEQ ID NO: 36334 - protein, 144 aa, Xylella fastidiosa Temecula1; identical to SEQ ID NO: 19538

SEQ ID NO: 36335 - DNA, 462 bp, Vibrio parahaemolyticus RIMD 2210633; identical to SEQ ID NO: 19539
  CDS (1)..(462): transl_table=11

SEQ ID NO: 36336 - protein, 153 aa, Vibrio parahaemolyticus RIMD 2210633; identical to SEQ ID NO: 19540

SEQ ID NO: 36337 - DNA, 429 bp, Bacillus cereus ATCC 14579; identical to SEQ ID NO: 19541
  CDS (1)..(429): transl_table=11

SEQ ID NO: 36338 - protein, 142 aa, Bacillus cereus ATCC 14579; identical to SEQ ID NO: 19542

SEQ ID NO: 36339 - DNA, 444 bp, Prochlorococcus marinus str. MIT 9313; identical to SEQ ID NO: 19543
  CDS (1)..(444): transl_table=11

SEQ ID NO: 36340 - protein, 147 aa, Prochlorococcus marinus str. MIT 9313; identical to SEQ ID NO: 19544

SEQ ID NO: 36341 - DNA, 456 bp, Photorhabdus luminescens subsp. laumondii TTO1; identical to SEQ ID NO: 19545
  CDS (1)..(456): transl_table=11

SEQ ID NO: 36342 - protein, 151 aa, Photorhabdus luminescens subsp. laumondii TTO1; identical to SEQ ID NO: 19546

SEQ ID NO: 36343 - DNA, 459 bp, Vibrio vulnificus YJ016; identical to SEQ ID NO: 19547
  CDS (1)..(459): transl_table=11

SEQ ID NO: 36344 - protein, 152 aa, Vibrio vulnificus YJ016; identical to SEQ ID NO: 19548

SEQ ID NO: 36345 - DNA, 450 bp, Rhodopseudomonas palustris CGA009; identical to SEQ ID NO: 19549
  CDS (1)..(450): transl_table=11

SEQ ID NO: 36346 - protein, 149 aa, Rhodopseudomonas palustris CGA009; identical to SEQ ID NO: 19550

SEQ ID NO: 36347 - DNA, 429 bp, Bacillus cereus ATCC 10987; identical to SEQ ID NO: 19551
  CDS (1)..(429): transl_table=11

SEQ ID NO: 36348 - protein, 142 aa, Bacillus cereus ATCC 10987; identical to SEQ ID NO: 19552

SEQ ID NO: 36349 - DNA, 429 bp, Bacillus anthracis str. Sterne; identical to SEQ ID NO: 19553
  CDS (1)..(429): transl_table=11

SEQ ID NO: 36350 - protein, 142 aa, Bacillus anthracis str. Sterne; identical to SEQ ID NO: 19554

SEQ ID NO: 36351 - DNA, 429 bp, Bacillus thuringiensis serovar konkukian str. 97-27; identical to SEQ ID NO: 19555
  CDS (1)..(429): transl_table=11

SEQ ID NO: 36352 - protein, 142 aa, Bacillus thuringiensis serovar konkukian str. 97-27; identical to SEQ ID NO: 19556

SEQ ID NO: 36353 - DNA, 471 bp, Acinetobacter sp. ADP1; identical to SEQ ID NO: 19557
  CDS (1)..(471): transl_table=11

SEQ ID NO: 36354 - protein, 156 aa, Acinetobacter sp. ADP1; identical to SEQ ID NO: 19558

SEQ ID NO: 36355 - DNA, 456 bp, Erwinia carotovora subsp. atroseptica SCRI1043; identical to SEQ ID NO: 19559
  CDS (1)..(456): transl_table=11

SEQ ID NO: 36356 - protein, 151 aa, Erwinia carotovora subsp. atroseptica SCRI1043; identical to SEQ ID NO: 19560

SEQ ID NO: 36357 - DNA, 468 bp, Propionibacterium acnes KPA171202; identical to SEQ ID NO: 19561
  CDS (1)..(468): transl_table=11

SEQ ID NO: 36358 - protein, 155 aa, Propionibacterium acnes KPA171202; identical to SEQ ID NO: 19562

SEQ ID NO: 36359 - DNA, 492 bp, Desulfotalea psychrophila LSv54; identical to SEQ ID NO: 19563
  CDS (1)..(492): transl_table=11

SEQ ID NO: 36360 - protein, 163 aa, Desulfotalea psychrophila LSv54; identical to SEQ ID NO: 19564

SEQ ID NO: 36361 - DNA, 462 bp, Desulfotalea psychrophila LSv54; identical to SEQ ID NO: 19565
  CDS (1)..(462): transl_table=11

SEQ ID NO: 36362 - protein, 153 aa, Desulfotalea psychrophila LSv54; identical to SEQ ID NO: 19566

SEQ ID NO: 36363 - DNA, 450 bp, Yersinia pseudotuberculosis IP 32953; identical to SEQ ID NO: 19567
  CDS (1)..(450): transl_table=11

SEQ ID NO: 36364 - protein, 149 aa, Yersinia pseudotuberculosis IP 32953; identical to SEQ ID NO: 19568

SEQ ID NO: 36365 - DNA, 429 bp, Bacillus cereus E33L; identical to SEQ ID NO: 19569
  CDS (1)..(429): transl_table=11

SEQ ID NO: 36366 - protein, 142 aa, Bacillus cereus E33L; identical to SEQ ID NO: 19570

SEQ ID NO: 36367 - DNA, 453 bp, Mannheimia succiniciproducens MBEL55E; identical to SEQ ID NO: 19571
  CDS (1)..(453): transl_table=11

SEQ ID NO: 36368 - protein, 150 aa, Mannheimia succiniciproducens MBEL55E; identical to SEQ ID NO: 19572

SEQ ID NO: 36369 - DNA, 444 bp, Methylococcus capsulatus str. Bath; identical to SEQ ID NO: 19573
  CDS (1)..(444): transl_table=11

SEQ ID NO: 36370 - protein, 147 aa, Methylococcus capsulatus str. Bath; identical to SEQ ID NO: 19574

SEQ ID NO: 36371 - DNA, 459 bp, Photobacterium profundum SS9; identical to SEQ ID NO: 19575
  CDS (1)..(459): transl_table=11

SEQ ID NO: 36372 - protein, 152 aa, Photobacterium profundum SS9; identical to SEQ ID NO: 19576

SEQ ID NO: 36373 - DNA, 453 bp, Salmonella enterica subsp. enterica serovar Paratyphi A str. ATCC; identical to SEQ ID NO: 19577
  CDS (1)..(453): transl_table=11

SEQ ID NO: 36374 - protein, 150 aa, Salmonella enterica subsp. enterica serovar Paratyphi A str. ATCC; identical to SEQ ID NO: 19578

SEQ ID NO: 36375 - DNA, 579 bp, Xanthomonas oryzae pv. oryzae KACC10331; identical to SEQ ID NO: 19579
  CDS (1)..(579): transl_table=11

SEQ ID NO: 36376 - protein, 192 aa, Xanthomonas oryzae pv. oryzae KACC10331; identical to SEQ ID NO: 19580

SEQ ID NO: 36377 - DNA, 453 bp, Vibrio fischeri ES114; identical to SEQ ID NO: 19581
  CDS (1)..(453): transl_table=11

SEQ ID NO: 36378 - protein, 150 aa, Vibrio fischeri ES114; identical to SEQ ID NO: 19582

SEQ ID NO: 36379 - DNA, 453 bp, Salmonella enterica subsp. enterica serovar Choleraesuis str; identical to SEQ ID NO: 19583
  CDS (1)..(453): transl_table=11

SEQ ID NO: 36380 - protein, 150 aa, Salmonella enterica subsp. enterica serovar Choleraesuis str; identical to SEQ ID NO: 19584

SEQ ID NO: 36381 - DNA, 468 bp, Brucella abortus biovar 1 str. 9-941; identical to SEQ ID NO: 19585
  CDS (1)..(468): transl_table=11

SEQ ID NO: 36382 - protein, 155 aa, Brucella abortus biovar 1 str. 9-941; identical to SEQ ID NO: 19586

SEQ ID NO: 36383 - DNA, 435 bp, Xanthomonas campestris pv. campestris str. 8004; identical to SEQ ID NO: 19587
  CDS (1)..(435): transl_table=11

SEQ ID NO: 36384 - protein, 144 aa, Xanthomonas campestris pv. campestris str. 8004; identical to SEQ ID NO: 19588

SEQ ID NO: 36385 - DNA, 450 bp, Pseudomonas fluorescens Pf-5; identical to SEQ ID NO: 19589
  CDS (1)..(450): transl_table=11

SEQ ID NO: 36386 - protein, 149 aa, Pseudomonas fluorescens Pf-5; identical to SEQ ID NO: 19590

SEQ ID NO: 36387 - DNA, 498 bp, Psychrobacter arcticum 273-4; identical to SEQ ID NO: 19591
  CDS (1)..(498): transl_table=11

SEQ ID NO: 36388 - protein, 165 aa, Psychrobacter arcticum 273-4; identical to SEQ ID NO: 19592

SEQ ID NO: 36389 - DNA, 441 bp, Dechloromonas aromatica RCB; identical to SEQ ID NO: 19593
  CDS (1)..(441): transl_table=11

SEQ ID NO: 36390 - protein, 146 aa, Dechloromonas aromatica RCB; identical to SEQ ID NO: 19594

SEQ ID NO: 36391 - DNA, 444 bp, Haemophilus somnus 129PT; identical to SEQ ID NO: 19595
  CDS (1)..(444)

SEQ ID NO: 36392 - protein, 147 aa, Haemophilus somnus 129PT; identical to SEQ ID NO: 19596

SEQ ID NO: 36393 - DNA, 444 bp, Haemophilus somnus 2336; identical to SEQ ID NO: 19597
  CDS (1)..(444)

SEQ ID NO: 36394 - protein, 147 aa, Haemophilus somnus 2336; identical to SEQ ID NO: 19598

SEQ ID NO: 36395 - DNA, 453 bp, Pseudomonas aeruginosa UCBPP-PA14; identical to SEQ ID NO: 19599
  CDS (1)..(453)

SEQ ID NO: 36396 - protein, 150 aa, Pseudomonas aeruginosa UCBPP-PA14; identical to SEQ ID NO: 19600

SEQ ID NO: 36397 - DNA, 495 bp, Psychrobacter sp. 273-4; identical to SEQ ID NO: 19601
  CDS (1)..(495)

SEQ ID NO: 36398 - protein, 164 aa, Psychrobacter sp. 273-4; identical to SEQ ID NO: 19602

SEQ ID NO: 36399 - DNA, 471 bp, Erythrobacter litoralis HTCC2594; identical to SEQ ID NO: 19603
  CDS (1)..(471): transl_table=11

SEQ ID NO: 36400 - protein, 156 aa, Erythrobacter litoralis HTCC2594; identical to SEQ ID NO: 19604

SEQ ID NO: 36401 - DNA, 447 bp, Sphingopyxis alaskensis RB2256; identical to SEQ ID NO: 19605
  CDS (1)..(447): transl_table=11

SEQ ID NO: 36402 - protein, 148 aa, Sphingopyxis alaskensis RB2256; identical to SEQ ID NO: 19606

SEQ ID NO: 36403 - DNA, 447 bp, Magnetococcus sp. MC-1; identical to SEQ ID NO: 19607
  CDS (1)..(447): transl_table=11

SEQ ID NO: 36404 - protein, 148 aa, Magnetococcus sp. MC-1; identical to SEQ ID NO: 19608

SEQ ID NO: 36405 - DNA, 462 bp, Mesorhizobium sp. BNC1; identical to SEQ ID NO: 19609
  CDS (1)..(462): transl_table=11

SEQ ID NO: 36406 - protein, 153 aa, Mesorhizobium sp. BNC1; identical to SEQ ID NO: 19610

SEQ ID NO: 36407 - DNA, 417 bp, Xylella fastidiosa Dixon; identical to SEQ ID NO: 19611
  CDS (1)..(417): transl_table=11

SEQ ID NO: 36408 - protein, 138 aa, Xylella fastidiosa Dixon; identical to SEQ ID NO: 19612

SEQ ID NO: 36409 - DNA, 498 bp, Psychrobacter cryohalolentis K5; identical to SEQ ID NO: 19613
  CDS (1)..(498): transl_table=11

SEQ ID NO: 36410 - protein, 165 aa, Psychrobacter cryohalolentis K5; identical to SEQ ID NO: 19614

SEQ ID NO: 36411 - DNA, 417 bp, Xylella fastidiosa Ann-1; identical to SEQ ID NO: 19615
  CDS (1)..(417): transl_table=11

SEQ ID NO: 36412 - protein, 138 aa, Xylella fastidiosa Ann-1; identical to SEQ ID NO: 19616

SEQ ID NO: 36413 - DNA, 447 bp, Nitrobacter winogradskyi Nb; identical to SEQ ID NO: 19617
  CDS (1)..(447)

SEQ ID NO: 36414 - protein, 148 aa, Nitrobacter winogradskyi Nb; identical to SEQ ID NO: 19618

SEQ ID NO: 36415 - DNA, 438 bp, uncultured bacterium 578; identical to SEQ ID NO: 19619
  CDS (1)..(438)

SEQ ID NO: 36416 - protein, 145 aa, uncultured bacterium 578; identical to SEQ ID NO: 19620

SEQ ID NO: 36417 - DNA, 24 bp, Artificial sequence
  (1)..(24): primer
atggagttaatggtcgttcatcca

SEQ ID NO: 36418 - DNA, 23 bp, Artificial sequence
  (1)..(23): primer
ttaagacgagacggctcggatat

SEQ ID NO: 36419 - protein, 147 aa, Artificial sequence; identical to SEQ ID NO: 19623
  Variant (2)..(4): xaa in position 2 to 4 is any amino acid
  Variant (6)..(6): xaa in position 6 is any amino acid
  Variant (10)..(11): xaa in position 10 to 11 is any amino acid
  Variant (14)..(18): xaa in position 14 to 18 is any amino acid
  Variant (20)..(20): xaa in position 20 is any amino acid
  Variant (21)..(21): xaa in position 21 is any or no amino acid
  Variant (24)..(24): xaa in position 24 is any amino acid
  Variant (27)..(27): xaa in position 27 is any amino acid
  Variant (29)..(33): xaa in position 29 to 33 is any amino acid
  Variant (35)..(42): xaa in position 35 to 42 is any amino acid
  Variant (43)..(48): xaa in position 43 to 48 is any or no amino acid
  Variant (50)..(52): xaa in position 50 to 52 is any amino acid
  Variant (54)..(55): xaa in position 54 to 55 is any amino acid
  Variant (58)..(81): xaa in position 58 to 81 is any amino acid
  Variant (82)..(90): xaa in position 82 to 90 is any or no amino acid
  Variant (94)..(97): xaa in position 94 to 97 is any amino acid
  Variant (99)..(102): xaa in position 99 to 102 is any amino acid
  Variant (103)..(106): xaa in position 103 to 106 is any or no amino acid
  Variant (108)..(112): xaa in position 108 to 112 is any amino acid
  Variant (114)..(117): xaa in position 114 to 117 is any amino acid
  Variant (119)..(124): xaa in position 119 to 124 is any amino acid
  Variant (125)..(128): xaa in position 125 to 128 is any or no amino acid
  Variant (130)..(131): xaa in position 130 to 131 is any amino acid
  Variant (133)..(134): xaa in position 133 to 134 is any amino acid
  Variant (136)..(136): xaa in position 136 is any amino acid
  Variant (138)..(141): xaa in position 138 to 141 is any amino acid
  Variant (143)..(144): xaa in position 143 to 144 is any amino acid
  Variant (146)..(146): xaa in position 146 is any amino acid

SEQ ID NO: 36420 - protein, 29 aa, Artificial sequence
  Variant (2)..(7): xaa in position 2 to 7 is any amino acid
  Variant (8)..(9): xaa in position 8 to 9 is any or no amino acid
  Variant (11)..(11): xaa in position 11 is any amino acid
  Variant (12)..(13): xaa in position 12 to 13 is any or no amino acid
  Variant (15)..(15): xaa in position 15 is any amino acid
  Variant (16)..(16): xaa in position 16 is Phe, Ile, Leu or Val
  Variant (17)..(18): xaa in position 17 to 18 is any amino acid
  Variant (19)..(19): xaa in position 19 is Ala, Gly, Asn, Ser or Thr
  Variant (20)..(22): xaa in position 20 to 22 is any amino acid
  Variant (23)..(23): xaa in position 23 is Phe, Ile, Leu or Val
  Variant (25)..(25): xaa in position 25 is any amino acid
  Variant (26)..(26): xaa in position 26 is Ala or Gly
  Variant (27)..(27): xaa in position 27 is Ala, Ile, Leu or Val
  Variant (28)..(28): xaa in position 28 is Ala, Gly or Ser
WXXXXXXXXLXXXEXXXXXXXXXWXXXXA

SEQ ID NO: 36421 - protein, 29 aa, Artificial sequence
  Variant (2)..(5): xaa in position 2 to 5 is any amino acid
  Variant (6)..(6): xaa in position 6 is Ala, Ile, Leu or Val
  Variant (7)..(12): xaa in position 7 to 12 is any amino acid
  Variant (14)..(19): xaa in position 14 to 19 is any amino acid
  Variant (20)..(20): xaa in position 20 is any or no amino acid
  Variant (22)..(22): xaa in position 22 is any amino acid
  Variant (23)..(24): xaa in position 23 to 24 is any or no amino acid
  Variant (26)..(26): xaa in position 26 is any amino acid
  Variant (27)..(27): xaa in position 27 is Ala, Ile or Val
  Variant (28)..(28): xaa in position 28 is any amino acid
  Variant (29)..(29): xaa in position 29 is Ala, Cys, Gly, Ser or Thr
GXXXXXXXXXXXGXXXXXXXDXXXWXXXX

SEQ ID NO: 36422 - DNA, 2106 bp, Escherichia coli
  CDS (1)..(2106)
atgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaagaaagtgctgttcggtcaccattttgcggccattgccggagcaggtccgctggtggggccggtactggcggcgcaaatgggctacctgccggggatgatctggctgctcgctggggtggttctcgccggtgcggtgcaggatttcatggtgctgtttgtttctacgcgccgtgacggtcgctcgctgggtgagctggtcaaagaagagatggggccaaccgccggggtgattgcgctggtggcctgctttatgatcatggtcattatccttgcagtgctggcgatgatcgtggtgaaagccctgactcatagcccgtggggaacatataccgttgcgttcaccattccgctggcgctgtttatggggatctacctgcgctatctgcgtccggggcgtattggcgaagtgtcggtcatcggtctggtattcctgattttcgccattatctctggcggctgggtggcagaaagtccgacctgggcaccgtactttgactttaccggcgtgcagttgacctggatgctggtgggttacggttttgtggcggcggtgctgccggtgtggttactgctggccccgcgtgactacctctctaccttcctgaaaatcgggactatcgtcggtctggcggtaggcattttgattatgcgcccgacgctgaccatgcctgcgctgaccaaatttgtcgatggcactggcccggtatggaccggtaacctgttcccgttcctgtttatcaccatcgcctgtggcgcggtgtctggcttccatgcgctgatctcttctgggaccacgccgaagatgctggcgaacgaagggcaggcgtgctttatcggctacggtgggatgttaatggaatccttcgtggcgattatggcgctggtttccgcctgtatcatcgatccgggcgtgtattttgccatgaacagcccgatggcggtgctggctccggcagggacggcggatgtggtcgcttctgccgcgcaggtggtgagtagctggggctttagcattacaccagatacgctaaaccagattgccagcgaagtgggtgaacagtcgatcatttcccgtgcgggcggtgcgccgacgctggcggtggggatggcctacattctgcacggcgcgctgggcggcatgatggatgtggcgttctggtatcacttcgccattttgtttgaagcactgtttattctgacggcggtggatgcaggtacgcgtgctgcgcgctttatgttgcaggatctgctgggcgtggtgtctcctggcctgaagcggaccgattcactgcctgctaacctgctggcaacagcgctgtgcgtactggcgtggggctacttcctccatcagggcgtggtcgatccgctgggcggcattaacactctgtggccgctgtttggtattgccaaccagatgctggcagggatggcgctgatgctctgtgccgtggtgttgttcaagatgaaacgtcaacgttacgcctgggtggcgctggtaccaacggcctggctgctgatttgtaccctgaccgcaggctggcagaaagcgtttagcccggatgcgaaagtcggcttcctggccattgctaataagttccaggcaatgatcgacagcggcaatattccgtcgcagtatactgagtcacagctggcgcaactggtgttcaacaaccgtctggatgccgggttaaccatcttctttatggtggtcgtggtggttctggcactgttctcgattaagacggcacttgcggcattgaaagatccgaagccaacggcgaaagaaacgccgtatgaaccaatgccggaaaatgtcgaggagatcgtggcgcaggcaaaaggcgcacactaa

SEQ ID NO: 36423 - protein, 701 aa, Escherichia coli
MNKSGKYLVWTVLSVMGAFALGYIALNRGEQINALWIVVASVCIYLIAYRFYGLYIAKNVLAVDPTRMTPAVRHNDGLDYVPTDKKVLFGHHFAAIAGAGPLVGPVLAAQMGYLPGMIWLLAGVVLAGAVQDFMVLFVSTRRDGRSLGELVKEEMGPTAGVIALVACFMIMVIILAVLAMIVVKALTHSPWGTYTVAFTIPLALFMGIYLRYLRPGRIGEVSVIGLVFLIFAIISGGWVAESPTWAPYFDFTGVQLTWMLVGYGFVAAVLPVWLLLAPRDYLSTFLKIGTIVGLAVGILIMRPTLTMPALTKFVDGTGPVWTGNLFPFLFITIACGAVSGFHALISSGTTPKMLANEGQACFIGYGGMLMESFVAIMALVSACIIDPGVYFAMNSPMAVLAPAGTADVVASAAQVVSSWGFSITPDTLNQIASEVGEQSIISRAGGAPTLAVGMAYILHGALGGMMDVAFWYHFAILFEALFILTAVDAGTRAARFMLQDLLGVVSPGLKRTDSLPANLLATALCVLAWGYFLHQGVVDPLGGINTLWPLFGIANQMLAGMALMLCAVVLFKMKRQRYAWVALVPTAWLLICTLTAGWQKAFSPDAKVGFLAIANKFQAMIDSGNIPSQYTESQLAQLVFNNRLDAGLTIFFMVVVVVLALFSIKTALAALKDPKPTAKETPYEPMPENVEEIVAQAKGAH

SEQ ID NO: 36424 - DNA, 1779 bp, Pyrococcus abyssi GE5
  CDS (1)..(1779): transl_table=11
atgaattcaaccgtcgttattcttgctgccgcaataatatatgtaggcctctattttacctatggaaaggggcttcagaacaaggtcgtcagggcagaccccaacaggccgacaccggcccacaggctctacgatggagttgactacgttccagcacatccgctagtcctctatggacaccacttcgcctctatagctggagcaggtcccatagtgggtccggccgttgcaatggcgtggggatggctaccttcactgatctgggtctggttcggaaacgtcttcataggagcagttcacgactacctggccttgatgtcatcggttaggtacgatggaaagtcaatccaatggatagctggaaaattgatgagcaagagaacgagcatggccttcgagctatacgtttggttcgctttgatactggttatagcggcatttgcagctgtaattgcgggaatcttcgtgaagaccccaggagcggcaactgcctcgatactgttcctattgatagcggtcctgcttggatggttactttacaaggttcagataaacttcaaggttggaacaataatagggataattctactgataatagcgatatacatcgggttcaagttcccgctagttgccagcgctaaggcctggtacatattcctgggggcctacgtgatagtggcttcttcacttccagtgtgggttctgctacagcctagagactacttgaacgcttacatcctgtggtttggcctagtgctaggtggattggcattcttcataatagggttcaagggagtcggaacatttactgcgccagcctacacaaccttcagtgcccacgtagttggtggaaagccctctccattctggccaacgatacccctagtgatagcgtgtggtgcactgagtggattccactcgctggtaggctctggaacctcaagtaagcaactcgacaatgagctccacggtctactcgtaggttacggtggaatgttcactgagggattcttgtcaacgatagtcatctcctcgatagccgtctatggacttcagatattccacaatgctggaataggaataacagctgaaacctgggcccaagcttacgctccactggttgccgcaaagtcgataaccacggaaacccttcagaagcttggtgttgcagctctagagaatttcaagaatggaaccgtcataggaaaggtaggaatatttgcaagtagctatgctcatggactccacgatgcgtttggaatcgacattcacttaggaacgctcttcgccagcctatgggtctcggcgttcgcattgacaacgcttgacactgcaactagactgggcaggtttgcttggcaggagataattgagatggtcaagggtccagagatcctcaagaacaagtgggttgcatccttcatactggtattctttggaatagcccttgcatggaagggtaagtggctagtcatatggccagcgttcagcggaatgaaccagatgcttgctagcatagccatgatgacagcttcactctgggttgccaagatacagaggccaagtggattctggaagtgggcggttctaatcccagcgctcttcctatgggtcacggtgacttcagcactgatatggttcctaatctacgtaggaaagtcaagcatttgggtcagcctgataacgatagtcggcctagtgctgaacttcttactggtgatagactggtacaacgcctggaagaaacctgcagaggagtaccaagcggctgccgcttga

SEQ ID NO: 36425 - protein, 592 aa, Pyrococcus abyssi GE5
MNSTVVILAAAIIYVGLYFTYGKGLQNKVVRADPNRPTPAHRLYDGVDYVPAHPLVLYGHHFASIAGAGPIVGPAVAMAWGWLPSLIWVWFGNVFIGAVHDYLALMSSVRYDGKSIQWIAGKLMSKRTSMAFELYVWFALILVIAAFAAVIAGIFVKTPGAATASILFLLIAVLLGWLLYKVQINFKVGTIIGIILLIIAIYIGFKFPLVASAKAWYIFLGAYVIVASSLPVWVLLQPRDYLNAYILWFGLVLGGLAFFIIGFKGVGTFTAPAYTTFSAHVVGGKPSPFWPTIPLVIACGALSGFHSLVGSGTSSKQLDNELHGLLVGYGGMFTEGFLSTIVISSIAVYGLQIFHNAGIGITAETWAQAYAPLVAAKSITTETLQKLGVAALENFKNGTVIGKVGIFASSYAHGLHDAFGIDIHLGTLFASLWVSAFALTTLDTATRLGRFAWQEIIEMVKGPEILKNKWVASFILVFFGIALAWKGKWLVIWPAFSGMNQMLASIAMMTASLWVAKIQRPSGFWKWAVLIPALFLWVTVTSALIWFLIYVGKSSIWVSLITIVGLVLNFLLVIDWYNAWKKPAEEYQAAAA

SEQ ID NO: 36426 - DNA, 1815 bp, Aeropyrum pernix K1
  CDS (1)..(1815): transl_table=11
gtgtccatgcctatactactccttgttgcagttattctagctatatatgctgtggcgtatcttttctatggcaggaatatactacaggagaaggttgttagagcatcccctgagagggagaccccggctatagccaagttcgacggcgtcgactatgtcccggcccacaggttcgtgctcttcggccaccacttcgctagcatagcgggcgctggacctatagtaggccctgccatagccatggcctacggctggctcctccccctagtctgggttctatttggcaatgtgttcatgggagccgttcacgactacctctccctaatggcgagcgtgaggtacggcggcatctctatcgttagcgttggcgagaacctaatggggaggaaggcgaggtatctcttcctgatatacgtattgttcactctgattctcgtatatgccgccttcgcgagcatagcggcatctctgttcgctagagaccccagggttgcaacactatccatactattcatgccgctggctctgctgcttggcataatgatgtacaggatgggccttgggatggggccctcaacagttataacggttgttctagtgatcgccgccttcgtttactcttacaaccacggtatagtcataggcaccttcgacccgagcctcccaccgggagaaggaggctgggtagcctatcacaggtgggtcataatactagggctctacgcgctcctagctgcaagcctgcctgtctggtatctcctacagcctagggactatctaaacgcctacatactatggacgggtctgggcctagccgctatagccgccatactgcttggaacacagagcctcaagggcccagcctacacttccttccagccaaacataatcgcaggacagcccacacccttctggccagccataccgctcataatagcctgtggctcccttagcgggttccacagcctagtagcctcgggcaccactagtaagcagcttgcaagcgagctagatgccctcttcgtcggctacggtgcaatgctgctcgagggagccctctcgggcctggcagtgataatacctatatcattcgcgtggaacgcccccgagctaatacagaagggtgttatcgagaacaacatgctggatctcgccgcggttccaaggtatgctgtgggatacggctacacgctggcgaagacgtttgagatgtttggcgtaggcttcgacacgggatacagcttcttcaccctcttcgcaagcctcatgctatcgatgtatgtgctcacgactctcgacacggggacgaggctcgccaggtttgcctggcaagaactcttcgactggctcgccaacgtcgacaagaacctatactcgatagtcaccaacaagtgggtctccagcctggcagtggttataataggcagcgccctggcgtaccctgtcctcgagataggtgctggctacaaggcggcttacaacgtggtgtggccggctttcgccggggccaaccagatgttggcagcaatagccttgctgacgagcgccctctgggtatacggtgtgctgaacgttagaggagggacggggctgctgatactgctgccctccctcttcctatgggtcaccgttacagcaggcttaacatggtggctgatggtcatactgccagtgctgccggctatacagcagtttggagccggctccatgatactgttcacgctgctgctgagcctgctactcttcgccctattcataataaacttcaacaaactgagcaagcaggccggagcctcacagcaggcccaggcttaa

SEQ ID NO: 36427 - protein, 604 aa, Aeropyrum pernix K1
MSMPILLLVAVILAIYAVAYLFYGRNILQEKVVRASPERETPAIAKFDGVDYVPAHRFVLFGHHFASIAGAGPIVGPAIAMAYGWLLPLVWVLFGNVFMGAVHDYLSLMASVRYGGISIVSVGENLMGRKARYLFLIYVLFTLILVYAAFASIAASLFARDPRVATLSILFMPLALLLGIMMYRMGLGMGPSTVITVVLVIAAFVYSYNHGIVIGTFDPSLPPGEGGWVAYHRWVIILGLYALLAASLPVWYLLQPRDYLNAYILWTGLGLAAIAAILLGTQSLKGPAYTSFQPNIIAGQPTPFWPAIPLIIACGSLSGFHSLVASGTTSKQLASELDALFVGYGAMLLEGALSGLAVIIPISFAWNAPELIQKGVIENNMLDLAAVPRYAVGYGYTLAKTFEMFGVGFDTGYSFFTLFASLMLSMYVLTTLDTGTRLARFAWQELFDWLANVDKNLYSIVTNKWVSSLAVVIIGSALAYPVLEIGAGYKAAYNVVWPAFAGANQMLAAIALLTSALWVYGVLNVRGGTGLLILLPSLFLWVTVTAGLTWWLMVILPVLPAIQQFGAGSMILFTLLLSLLLFALFIINFNKLSKQAGASQQAQA

SEQ ID NO: 36428 - DNA, 1485 bp, Vibrio cholerae O1 biovar eltor str. N16961
  CDS (1)..(1485): transl_table=11
atgttgtggtttctaacctgtgtcgcagccctcgttggcggttactttatttacggagctttcgtagagaaagtatttggcatcaacgaaaagcgtcaaacccctgcccatacaaaaacggacggcgtcgactatgtaccgatgtccaccccaaaagtttatctcgtacaattactgaacatcgccggtgttggtcctatctttggtccaatcatgggtgcgctgtacggtccagccgccatgctgtggatcgtagttggctgtatcttcgcgggtgcagtacacgactacttctcaggtatgctttctatccgtaacggtggtgcttcggttccatccatcacgggtcgttacttaggcaatggcgcaaaacactttatgaacatttttgccattgtgttgctgcttctggttggtgtggtgttcgtttcagcccctgctggcatgatcactaacctgattaaccaacaaactgacttcaccgtcagcatgaccaccatggtcgtgatcatcttcgcttactatattctggcgactatcgttcctgttgataaaatcatcggccgtttctaccccctatttggtgcgctactgattttcatgtcggttggtttgatgacggcgattgcgttctcttctgagcaccaagtgctgggcggatttgaaatcagcgatatggtgaaaaacctcaacccgaatgacatgcctctgtggccggctctgttcatcaccatcgcttgtggtgctatctctggcttccacgcgactcagtctccgctgatggcacgctgtatggaaaatgagaagaacggtcgcttcgtgttttacggcgcgatgattggcgaaggcatcattgctcttatctggtgtactgttgctctctctttcttcggctcactggaagctctgtctgaagcggtgaaaaacggtggcccaggtaacgtggtttacggtgcttctttcggcctgctgggtgtgtttggtggtgtgattgctttccttggcgtggtgatcctgcctatcacttcgggtgataccgcgttccgttcaagccgtctgatcttggctgaatacttcaacatggagcaaaaaacactgcgtaaccgcctactgatggctgtacctctgttcgttatcggtgcagtgttgacccaagtcgatttcggtatcatctggcgctacttcggttttgcgaaccaagcgaccgcagtcatgatgctgtggacagccaccgcttacctgatgcgccacaacaaactgcactggatctgtacggtacctgcgctgtttatgactacagtgtgtatcagcttcatccttaacagcagcacgttaggttttggcttaccaatgcagatttcaaccattgcaggtgtactggcttctctgggtgctctggcttacgtagcgaaagtatccaaaggcaaaggggaaaccgatcttgccgatgaggagaaaccacaaggcgtgacgaaaaccgcttaa

SEQ ID NO: 36429 - protein, 494 aa, Vibrio cholerae O1 biovar eltor str. N16961
MLWFLTCVAALVGGYFIYGAFVEKVFGINEKRQTPAHTKTDGVDYVPMSTPKVYLVQLLNIAGVGPIFGPIMGALYGPAAMLWIVVGCIFAGAVHDYFSGMLSIRNGGASVPSITGRYLGNGAKHFMNIFAIVLLLLVGVVFVSAPAGMITNLINQQTDFTVSMTTMVVIIFAYYILATIVPVDKIIGRFYPLFGALLIFMSVGLMTAIAFSSEHQVLGGFEISDMVKNLNPNDMPLWPALFITIACGAISGFHATQSPLMARCMENEKNGRFVFYGAMIGEGIIALIWCTVALSFFGSLEALSEAVKNGGPGNVVYGASFGLLGVFGGVIAFLGVVILPITSGDTAFRSSRLILAEYFNMEQKTLRNRLLMAVPLFVIGAVLTQVDFGIIWRYFGFANQATAVMMLWTATAYLMRHNKLHWICTVPALFMTTVCISFILNSSTLGFGLPMQISTIAGVLASLGALAYVAKVSKGKGETDLADEEKPQGVTKTA

SEQ ID NO: 36430 - DNA, 1743 bp, Bacillus halodurans C-125
  CDS (1)..(1743): transl_table=11
gtgtacggagtattacttgcagctttaggcatgctcgtgtttgcgttagggtatcggtattattcaaagtttatcgccgaacgaatttatcgccttgaccctaattttgtaacgcctgcccatcaatttaaggatggaaaagactttgtcccaaccaacaagtttgttctgtggggacatcattttacctcagttgctggtgccgcaccgatcgtagggccagcaattgcgatttattggggctggctaccagcaattctctgggtcacccttgggacggtgtttgcagcaggtgttcatgactttggggcacttgttttatcggttcgaaacaaaggtcaatcggtcggaacgttagccgataagctcatcggtcgtcaggccaagctgttatttttatttattattttgatccttgttcttatggttaacgctgtgtttgcctgggtcatttccaacttgtttatctcaaatccttcagcggtactgtccgtttttattcaaattccattagcagtgtggattggctaccatgtatacaaacgacaaggaggaatgctcatcccgtcccttgtggcgctggcggtgatgtacgtgtcagccattgtggcaagccgagtacctgctttacaaattgaccttatccgctattttggtggggaggaaaacatcgtagcttttggtcttgatggggtcgctatgtcgttcttcgtctggattatcgtccttatgatctacgtctacatcgcctccacattaccggtttggaagctgttacagccacgggattacattaactcccatcagctcgtcgtcggtttgcttattttatacttaggtttgctgttttctaacccaaaggttacagcacctgctgtcaacggttcacctgatacgtcatggttcccgttgctgtttattaccattgcgtgtggtgcgatctccgggttccacggtctcgtttcttctgggacgacatcgaaacagctgaataaggaaacagacgcgaggtttgttgggtatttaggagcaattggtgaagggctactcgctctcatcgtaatcgtcgcagttgctacgttctttgcatcgcctcaagcattctccgaggtgtactcaagctttggtgcagcaaatcaaggcgggctaggaaacttcgttcaagccgcaggtcagcttgcgacaggtctcctcattccgcaagatatggcggcgacgatcgtggctgtgatcatcgtcagctttgccgcgaccacactggatacctctgtccgcttaatgcgatacattattgctgaactcggtcaagaatataaggtgccagcgctatctaaaacccatgtggccacttcaattgccgttgtgtcgagtgcggcgctcgttcttttaccagaaggaccaaatggatttggttcaggaggttacttgctttggccactatttggaacgtcaaatcagcttcttgcagggattaccttgctgctaataacgatttggctgaaacgtcaagggcgtaactatttaccgactttgatcccgatggttttcgttttgtttatgacgctgtatgctatgttacaacaagtcctctttcaatggtcaccatttggtggtacggggacgaacattctcttatttacgctaggttcaattattctcgtatttgcgttctggattgtcattgtcgccatctctgaaattatgaaatccaagccaagggatgattcaagaaaaagtgcgtaa

SEQ ID NO: 36431 - protein, 580 aa, Bacillus halodurans C-125
MYGVLLAALGMLVFALGYRYYSKFIAERIYRLDPNFVTPAHQFKDGKDFVPTNKFVLWGHHFTSVAGAAPIVGPAIAIYWGWLPAILWVTLGTVFAAGVHDFGALVLSVRNKGQSVGTLADKLIGRQAKLLFLFIILILVLMVNAVFAWVISNLFISNPSAVLSVFIQIPLAVWIGYHVYKRQGGMLIPSLVALAVMYVSAIVASRVPALQIDLIRYFGGEENIVAFGLDGVAMSFFVWIIVLMIYVYIASTLPVWKLLQPRDYINSHQLVVGLLILYLGLLFSNPKVTAPAVNGSPDTSWFPLLFITIACGAISGFHGLVSSGTTSKQLNKETDARFVGYLGAIGEGLLALIVIVAVATFFASPQAFSEVYSSFGAANQGGLGNFVQAAGQLATGLLIPQDMAATIVAVIIVSFAATTLDTSVRLMRYIIAELGQEYKVPALSKTHVATSIAVVSSAALVLLPEGPNGFGSGGYLLWPLFGTSNQLLAGITLLLITIWLKRQGRNYLPTLIPMVFVLFMTLYAMLQQVLFQWSPFGGTGTNILLFTLGSIILVFAFWIVIVAISEIMKSKPRDDSRKSA

SEQ ID NO: 36432 - DNA, 1545 bp, Pasteurella multocida subsp. multocida str. Pm70
  CDS (1)..(1545): transl_table=11
atgttatggttcttcttttgcgttgcaatattagttttgggctattttgtatacggcaaatttattgaaaagatctttgtgatcaacccaaaaaaagcaacacccgcttatacaatgaacgatggtgttgactacatgccaatgtcaactaaaaagatttggttgattcaattattaaacattgcaggaacaggaccaatctttggaccaattctcggtgctttatatggaccagtcgcaatgttatggattgtgatcggttgtatttttgccggtgcagtgcatgattacttctgtggtatgttaagtgtgcgtaatgggggcgcgtcaatgccaacattagcaggtcgttatttaggcgcaccagtgaaagcctttattaatatgcttgcggtagtgttattacttctcgttggtgtggttttcgttgctagcccagcaaaattattaagtactattaccatggataatttgggtgtcgtagagagcgcaggggcggctgcaaccgtatttggttatgatgctgctaccgtcttagtgatttggacaaccattatttttgtttactacatcatcgcaactttattaccgattgataaaattatcggtcgtatctatccgctattcggtgctttattactgttcatgacattcggtatgatgtttggcttagtcagcagtcatttaaatagtaatgagccaatcgagtttttccgtacagtcggtggattagaagtgggtaaattctttgagaatttacaaccaaaaggtgatttaccaatttggccattattattcttaactatctcttgtggtgcattatctggtttccatgcgacgcaatcgccattaatggcacgttgtgcacaaaatgaaaaagaaggtcgtttcattttctatggtgcgatgattgctgaaggggtgattgctttagtttggtgtgcagtaggattaagtttctatcaagacccaacagaattacaagctgcgattgcagccggttcaccgtcaaaagttgtatatgattcttcaatctacttcctcggtgctgtgggtggtgtatttgcaattcttggtgtggtggtattaccaattacctctggcgataccgcattccgtgcagcacgtttaatcattgctgagttctttaaatttgagcaaaaaacattggtgaaacgtttagtgattgctgttccattgtttgtgttagggttcattgtatcgaaaattgacttcagcgtattgtggcgttatttcagctgggcaaaccaaacgacagcaatggtgatgttatggactgccgcagcgtatttattccgttacggtaaattccactgggtttgtacgcttccagcaatgttcatcagtaccgtttgtttcacttacttagcgtataacaagatcggtttcaatttagactatcaactttctgtttatattggtattggtttaaccgtgttctgtactgtcttgttctttacgttattaaaaccaattgctaaaggtgatcctgatgccttggttgacgatttagtcaaacaataa

SEQ ID NO: 36433 - protein, 514 aa, Pasteurella multocida subsp. multocida str. Pm70
MLWFFFCVAILVLGYFVYGKFIEKIFVINPKKATPAYTMNDGVDYMPMSTKKIWLIQLLNIAGTGPIFGPILGALYGPVAMLWIVIGCIFAGAVHDYFCGMLSVRNGGASMPTLAGRYLGAPVKAFINMLAVVLLLLVGVVFVASPAKLLSTITMDNLGVVESAGAAATVFGYDAATVLVIWTTIIFVYYIIATLLPIDKIIGRIYPLFGALLLFMTFGMMFGLVSSHLNSNEPIEFFRTVGGLEVGKFFENLQPKGDLPIWPLLFLTISCGALSGFHATQSPLMARCAQNEKEGRFIFYGAMIAEGVIALVWCAVGLSFYQDPTELQAAIAAGSPSKVVYDSSIYFLGAVGGVFAILGVVVLPITSGDTAFRAARLIIAEFFKFEQKTLVKRLVIAVPLFVLGFIVSKIDFSVLWRYFSWANQTTAMVMLWTAAAYLFRYGKFHWVCTLPAMFISTVCFTYLAYNKIGFNLDYQLSVYIGIGLTVFCTVLFFTLLKPIAKGDPDALVDDLVKQ

SEQ ID NO: 36434 - DNA, 2067 bp, Pseudomonas aeruginosa PAO1
  CDS (1)..(2067): transl_table=11
atgaacaataacaatagcctgctacgtcacctcgcctggctggtggtggcgatcgtgggcgccgcggccctgggcgtcgtcgccctgcgtcgtggcgaagcgatcaacgccttgtggatcgtggtggcggcggtggccatctacctggtcgcctaccgttactacagcctgttcatcgccagcaaggtgatgcaactggaccccaaccgcgccactcccgcggtactcaacaacgatggcctggactacgtcccgaccaacaagcacatcctcttcggccaccacttcgccgccatcgccggcgccggtccgctggtcggtccggtccttgccgcgcagatgggctacctgcccggcaccctctggctgatcgccggcgtagtcctcgccggcgcggtgcaggacttcatggtcctgttcatctccagccgtcgcaacggccgctcgctgggcgagctggtgcgcgaggaaatgggccaggtggccgggaccatcgcgctgttcggcgccttcctgatcatgatcatcatcctcgcggtgctcgcgctgatcgtggtgaaggctctggccgacagcccctggggcatgttcaccgtcctcgcgaccattcccatcgcgctgttcatgggcgtctacatgcgcttcatccgccccggccggatcggcgagatctcgatcatcggggtgttcctcctgctcggttcgatctggctcggcgggcaggtcgcggccagtccggaatgggcgccgcatttcaccttcagtggaatccagatcacctggatgctgatcggctacggcgccgtcgcctcggtactgccggtgtggctgctgctggcgccgcgcgactacctgtcgaccttcctcaagatcggcaccatcatcggcctggcgatcggcatcctgatcgtcatgccggaactgaagatgccggccctgacccagttcaccgacggcaccggcccggtctggaaaggcagcctgttcccgttcctgttcatcaccatcgcctgcggcgcggtgtccggcttccacgcgctgatctcctcggggaccacgccgaagctgctcaaccgcgagcccgacgcccgctacatcggctacggcggcatgctgatggagtccttcgtggcgatcatggcgatggtcgccgcctcggtgatcgagccgggcatctacttcgccatgaacagcccgccggcggtggtcggcgccgacgtcaacgcggtggccgcgaccgtcagcagctggggcttcgccatcacgccggagcaactcacccagaccgcccaggacatcggcgagaccaccatcctggcccgtgccggcggcgcgccgaccctggcggtggggatcgcgcacatcctccaccaggtgctgccgggcgagaacaccatggccttctggtaccacttcgcgatcctcttcgaggccttgttcatcctcaccgcggtggacgccggcacccgtgccgggcgcttcatgctgcaggacctgctgggcaacttcgtgccggcgctgaagaagaccgagtcgtggaccgccaacatcatcggcaccggcggctgcgtggcgctgtggggctggctgctgtaccagggcgtggtcgacccgctgggcgggatcaataccctgtggccgctgttcggcatttccaaccagatgctcgccggcatcgcgctgatgctcgccaccgtggtcctgatcaagatgaagcgccagcagtatgtctgggtcaccatcctgccggcggcctggttgctgatctgcaccaccaccgcgggcctgatcaagatcttcgacagcaacccggcggtcggcttcgtcgctcttggcgagaagtacgccaccgcgctggatgccggccaggtgctggcgccggccaaggatatcggccagatgcagcacgtggtgctgaacgcctacatcaacgccggtctgaccgtgctgttcctgctggtggtgttcagcgtactgttctacgccatcaaggtcggcatcgcggcctggggcaagagcgagcggaccgacaaggaaaccccgttcgagcccatccccgacgcctga

SEQ ID NO: 36435 - protein, 688 aa, Pseudomonas aeruginosa PAO1
MNNNNSLLRHLAWLVVAIVGAAALGVVALRRGEAINALWIVVAAVAIYLVAYRYYSLFIASKVMQLDPNRATPAVLNNDGLDYVPTNKHILFGHHFAAIAGAGPLVGPVLAAQMGYLPGTLWLIAGVVLAGAVQDFMVLFISSRRNGRSLGELVREEMGQVAGTIALFGAFLIMIIILAVLALIVVKALADSPWGMFTVLATIPIALFMGVYMRFIRPGRIGEISIIGVFLLLGSIWLGGQVAASPEWAPHFTFSGIQITWMLIGYGAVASVLPVWLLLAPRDYLSTFLKIGTIIGLAIGILIVMPELKMPALTQFTDGTGPVWKGSLFPFLFITIACGAVSGFHALISSGTTPKLLNREPDARYIGYGGMLMESFVAIMAMVAASVIEPGIYFAMNSPPAVVGADVNAVAATVSSWGFAITPEQLTQTAQDIGETTILARAGGAPTLAVGIAHILHQVLPGENTMAFWYHFAILFEALFILTAVDAGTRAGRFMLQDLLGNFVPALKKTESWTANIIGTGGCVALWGWLLYQGVVDPLGGINTLWPLFGISNQMLAGIALMLATVVLIKMKRQQYVWVTILPAAWLLICTTTAGLIKIFDSNPAVGFVALGEKYATALDAGQVLAPAKDIGQMQHVVLNAYINAGLTVLFLLVVFSVLFYAIKVGIAAWGKSERTDKETPFEPIPDA

SEQ ID NO: 36436 - DNA, 2355 bp, Lactococcus lactis subsp. lactis Il1403
  CDS (1)..(2355): transl_table=11
atgaaagatattggaaactcttcaaactttaccgaagaagaagagctatttttgttgcgaaataaacaaggaaaaattgtcggaattaaagatttaaagcaggcaaattttcaagaaacaatgaaagactggaaaaaacatttaccaaaacctagtcttctatcaattatcatttgggtggcggtcgctttactaggtggtcttgcttggtcgttgattgctctggctcaaggagagacgattaatgcgatttggtttgttattgcagcagtttgttcttatttgattggctatcgtttttatgctttatatattcaacgtaagattatgcgtccaaatgatttacgggcaactccttcggaaagccataatgacggaaaagaattcgacccaaccaatcgagttgttttattcggtcaccattttgcttcaattgctggagctgggcctttggttggaccagttttagcggcacaaatgggttacttaccagggacaatttggattattttcggagttatttttgccggaggggtacaagatatgcttgttctctggtattctcatcgtcgtcgagcaaaatctattggggcaatggctcatgatgaagttggcagatttgctggtggcttgacttcatttattgtatttatcatgacaatgattgttcttgctgttttagctttgatttgtgtgacggcgatggcaaattctgcttgggcagtcttttcgattgggatgaccatcccaattgccttgttaatgggaatttatttgaaatatattcgcccagggcatgtgaatgaaatttcagcgattggttttattctccttttagttgctatttttggtggccgttgggtttcggaatcttcatttgcgcatattttcatgctttcgccaactgctttagtttggtgggtcatgggctatacttttattgcagccattatccccgcttggattttacttacgcctcgtgattacttatccatgtttatgaaaataggtacaattgctgttttagcaatagctgtagttggtgtgcgtccagatgttacgattccagctctgactaattttgcacataatacagatggtcctgcttttgctggttccctctttcccttcttatttgttacgattgcctgtggagccttgtctggtttccatgtaatgatgtcttctggaacaacgcctcatttgattgctaaagagtcacaaacgcgaatgattggttatggtgggatgctctttgaatcatttgttgctattatggctttagtcgctgcgatttctcttaatcctggaatttattattctatgaatacccctcaagctagtattcaaaaactcgcagcttcaagttatcaagcagataaaagtgccgaatataatgctgccaaagcaattccaaatgtagccatgatgcctgatggttcaaaactcagtattgactgggaaggaacgactggtgaaaaagcacttgagcaagtggcaaaagatgtaggtgaacaatcaatcgtttcacggactggtggtgcaccaactttagccgtttcaatgtcaaatattctacataaggttccacttattggtgggacaaatatgatgggattctggtatcattttgcgattatgtttgaggtgctctttatcctgtcagctgtttcagcggcaacaaaatcgactcgttatttacttaatgatgccctgcgtggcttcaaaaaattaggtcgcttaggtgatgatgattggttacctagtaaaattataacgacagcagtgattgttggagtttggggtgctttgcttttgatgggcgtttctgatccgaatggtggaataaaaatcatgtatccgctctttgggatttctaatcaattaattgcggcggtagctctggctattgtttgtgtcatggttatccgtaaaggttatcttaaatgggtttggattccagcacttcctttagtttgggatgtttgtgtaacttttgcggccagttggcaaaaaatcttttcaaatgatgtcaatattggttactttgcttcttattcagcagcaaaagcccaagtggcttctggtaaattatctggtctagcattaacgaatgcgcaagcaaccatgcgtaatacaatgattcaaggaagtctgtcagtcattttcttactttgtgtggctatattattagtcatctgtgcctttaaagttgctaaaattttaagaacaaatgaagttggtgataaatttagctcagaagaagtttttgaagaatcaaatctttttgaaacttcaagtttctggcctagtaagcttgaacataaggttttaaaaagtaaagttaatgaataa

SEQ ID NO: 36437 - protein, 784 aa, Lactococcus lactis subsp. lactis Il1403
MKDIGNSSNFTEEEELFLLRNKQGKIVGIKDLKQANFQETMKDWKKHLPKPSLLSIIIWVAVALLGGLAWSLIALAQGETINAIWFVIAAVCSYLIGYRFYALYIQRKIMRPNDLRATPSESHNDGKEFDPTNRVVLFGHHFASIAGAGPLVGPVLAAQMGYLPGTIWIIFGVIFAGGVQDMLVLWYSHRRRAKSIGAMAHDEVGRFAGGLTSFIVFIMTMIVLAVLALICVTAMANSAWAVFSIGMTIPIALLMGIYLKYIRPGHVNEISAIGFILLLVAIFGGRWVSESSFAHIFMLSPTALVWWVMGYTFIAAIIPAWILLTPRDYLSMFMKIGTIAVLAIAVVGVRPDVTIPALTNFAHNTDGPAFAGSLFPFLFVTIACGALSGFHVMMSSGTTPHLIAKESQTRMIGYGGMLFESFVAIMALVAAISLNPGIYYSMNTPQASIQKLAASSYQADKSAEYNAAKAIPNVAMMPDGSKLSIDWEGTTGEKALEQVAKDVGEQSIVSRTGGAPTLAVSMSNILHKVPLIGGTNMMGFWYHFAIMFEVLFILSAVSAATKSTRYLLNDALRGFKKLGRLGDDDWLPSKIITTAVIVGVWGALLLMGVSDPNGGIKIMYPLFGISNQLIAAVALAIVCVMVIRKGYLKWVWIPALPLVWDVCVTFAASWQKIFSNDVNIGYFASYSAAKAQVASGKLSGLALTNAQATMRNTMIQGSLSVIFLLCVAILLVICAFKVAKILRTNEVGDKFSSEEVFEESNLFETSSFWPSKLEHKVLKSKVNE

SEQ ID NO: 36438 - DNA, 2082 bp, Neisseria meningitidis MC58
  CDS (1)..(2082): transl_table=11
atgaaatcactcaaaaccttcctcatttggggcatagtggtactggtcggcttagcatcctttaccactctggccctcagccgaggcgaacaggtcagcgcggtatggatggtcaccgccgccatatccgtttactgcatcgcctaccgtttttacagcctctacatcgccaaccgcgtaatgcggctcgatcctgaccgcctgactccggcagaacgccacaacgacggcttggactacgttccgacgcacaaaggcgtattgttcggacaccactttgccgcaattgccggcgcgggccctttggttggtccggttttggcggcgcaaatgggttatctgcccggtactttgtggattatcttcggcgtggtatttgccggcgcggtacaggatatgatggtcttgttcgtctctatgcgccgcgacggtaagtctttgggcgatattgtgaaacaggaactcggcactgtccccggcgtgattgcctccatcggtattttgatgattatggtcatcattatggcggtgttggcgttgattgtcgtaaaagcattggttcacagcccttggggtacgttcaccattgcagcaactatgccgattgcgctgtttatgggtatttacacgcgttatatccgtccgggcaaaatcggcgagatttccatcgtcggctttattttgctgatgctggcggtaatttacggcgaagatgtggctaaaagttccatcgggcattggttcgaccttgacggcatccagctcacttgggcgattatgatttacggctttgtcgcctccgtattgcccgtatggttgctgctcactccgcgcgactatctctccaccttcctgaaaatcggtacgattgcggccttggctttgggtatcgtcatcgtcaatcccgctttgcaaatgcctgccgtaacccactttatcgacggttcgggtccggtattctcaggcgcattgttcccattcttgttcattaccatcgcctgcggtgcggtttcgggcttccacgcgctgatttcttccggcactacgccgaaaatgctggaaaacgaaacccacgtccgcatgatcggttacggcggtatgttgatggaaagtttcgtagccattatggcacttgccgctgccgcatcgcttgatcccggcgtgtacttcgccatgaacagcccagccgccctgatcggtacggatgccaataccgccgccgaagtgattaccaccaagctgcaattccctgtcgatgccgcaaccctgttgcacactgctaaagaagtcggcgaaaacaccatcctttcccgtgccggcggtgcgcccaccctcgcagtcggtatggcgcacattatgagccgcctgattccgggcgaggcgatgatggcgttctggtatcacttcgccctgttgtttgaagccttgttcatcctgaccgccgtcgatgccggtacgcgcgtcgcacgttttatgattcaagacttgggcagcatcttctacaaacctttcggcaacaccgactccatccccgccaacctgattgcgaccttcttcgccgtggcattgtggggctacttcctctacacgggcgtgaccgacccgttgggcggcatcaactcgctctggcctttgttcggcatcgccaaccaaatgctggcaggcgtagccttgattatgtgcgccgtggtgctgattaagatgaaacgcgaccgttatgtctgggtggtactcgttcccgccgtcggcgtactgttcgtaacctgctacgccggcctgcaaaaactgttccacagcgacccgcgcatcagcttccttgcccacgccggcaaatacagcgacgcattggctaaaaacgaaatccttgcgcctgccaaagacatcggcgaaatggcgcaaatcatcttcaacgacaagattaatgccggtctgaccatcctcttcttgtcggttgtcgtgattgtcgccgcgtacggtttgcgtaccgccctcaaagcacgcaaagtcggctggccgaccgccaaagaaatcccggcggtgtaccgcgacggcaaacagccggaggcacaaagtgaagcataa

SEQ ID NO: 36439 - protein, 693 aa, Neisseria meningitidis MC58
MKSLKTFLIWGIVVLVGLASFTTLALSRGEQVSAVWMVTAAISVYCIAYRFYSLYIANRVMRLDPDRLTPAERHNDGLDYVPTHKGVLFGHHFAAIAGAGPLVGPVLAAQMGYLPGTLWIIFGVVFAGAVQDMMVLFVSMRRDGKSLGDIVKQELGTVPGVIASIGILMIMVIIMAVLALIVVKALVHSPWGTFTIAATMPIALFMGIYTRYIRPGKIGEISIVGFILLMLAVIYGEDVAKSSIGHWFDLDGIQLTWAIMIYGFVASVLPVWLLLTPRDYLSTFLKIGTIAALALGIVIVNPALQMPAVTHFIDGSGPVFSGALFPFLFITIACGAVSGFHALISSGTTPKMLENETHVRMIGYGGMLMESFVAIMALAAAASLDPGVYFAMNSPAALIGTDANTAAEVITTKLQFPVDAATLLHTAKEVGENTILSRAGGAPTLAVGMAHIMSRLIPGEAMMAFWYHFALLFEALFILTAVDAGTRVARFMIQDLGSIFYKPFGNTDSIPANLIATFFAVALWGYFLYTGVTDPLGGINSLWPLFGIANQMLAGVALIMCAVVLIKMKRDRYVWVVLVPAVGVLFVTCYAGLQKLFHSDPRISFLAHAGKYSDALAKNEILAPAKDIGEMAQIIFNDKINAGLTILFLSVVVIVAAYGLRTALKARKVGWPTAKEIPAVYRDGKQPEAQSEA

SEQ ID NO: 36440 - DNA, 2112 bp, Campylobacter jejuni subsp. jejuni NCTC 11168
  CDS (1)..(2112): transl_table=11
atgactcagttaagtactaaaattttatggttgtttgttgcagctttaggcgctatttgttttggttatttagctttacaaaatggcgaaagtgtatcagcgatttatttggtggttgctgctgtatgtatttatatgataggatatagattttatgggagttttgtagcttataaggttttagaacttgataaaaatcgtgcaacaccagcacttgtagaaaatgatgggcgtgattttgtgcctacaaataaagctgtattatttggacatcattttgctgctattgcaggagcaggtccattagtaggacctatcttggccgctcaaatgggatatttgccttctatgctttggattttagtaggaggagttttagcgggtgctgtgcatgattttgttgttctttttatatctactcgtagaaaaggtagaagtcttggcgagatgattaaggatgagatgggtaaatttacaggtggagttgctatggtggcgatttttggcattatgcttattattattgccattttagctatggtggttgtaaaagctttagcagaatctccatggggtttatttactatcgcaatgacgattcctatagcaatatttatgggaatttatatgcgttttatccgtccaggtagagtaggggaggcttctataataggttttgtgcttttaattttggctattcattatggtagcgttatagctgctgatccttattgggctaaaatatttactttagaagctccaactttggcaattgttatgatggcttatggttttattgcttctgttttacctgtgtggtttttacttgctccaagagattatctttcaacttttttgaaaatcggtgttattgtggtaatggctgtagctattgttttggttgctcctgatttacaaatgccaaaagcaaatactcagtattttgatggaacaggtccagtatttgcaggtggagtgtttccatttttatttattaccattgcttgtggtgcgatcagtggttttcatgctttgatttctagtggaactactcctaaaatgcttgaaaacgaaactcatactttggctgttggatatggctctatgcttgctgagagtgctgtggcgattatggctttaatttgtgcttgtattttacatccaggtctttattttgctataaattcaagctctgctttgataggaacagatgttgtaaatgtagcacaaactatttcaagttggggatttagtattactcctgaagaaattactactttaaccacaaatataggagagtatactatactttcaagaacagggggagccccgacttttgctataggtgtagctttgatcttgcatgaactttttggcggcgtggatttgatggctttttggtatcattttgctatattgtttgaagctttatttattttaacagcggtggatgctgggacaagggcttgtcgttttatggtgcaagatatattgggtaatgtttataaacctttaggagatattcataattatccagctggacttttggctacggctttaagtgttgcaggttggggatattttctttatcaaggcgccattgatcctaagggaggaatttatacactttggcctctttttggcgtgagcaatcaaatgcttgcgggtatggctttgcttcttgctacaactatacttgtaaaaatgggcaaggcaagatatacttgggttactttagtacctgcggtatttgtcttagtggcaactctgtatggaggaattcaaaaaattatgccttatgaagaaggcaataaaatagcaaatgcggtaagtcatgtagccgccgttagcatacaaagtcaaaaaattaaagatttagaatttaaattaaataatactaaagatgaaaaagaaatttctacaattagaaaagaaatttcaatagccactcaaaataaagttggaaatttacttaatgcaattctttgtgtgttctttatgatagctaccttgcttgttataatttcttgtataggaatttgcttaggtaaaattaaaattcctcttaaagaaactaagtatattaagattgatgaatttcaaaaaatttaa

SEQ ID NO: 36441 - protein, 703 aa, Campylobacter jejuni subsp. jejuni NCTC 11168
MTQLSTKILWLFVAALGAICFGYLALQNGESVSAIYLVVAAVCIYMIGYRFYGSFVAYKVLELDKNRATPALVENDGRDFVPTNKAVLFGHHFAAIAGAGPLVGPILAAQMGYLPSMLWILVGGVLAGAVHDFVVLFISTRRKGRSLGEMIKDEMGKFTGGVAMVAIFGIMLIIIAILAMVVVKALAESPWGLFTIAMTIPIAIFMGIYMRFIRPGRVGEASIIGFVLLILAIHYGSVIAADPYWAKIFTLEAPTLAIVMMAYGFIASVLPVWFLLAPRDYLSTFLKIGVIVVMAVAIVLVAPDLQMPKANTQYFDGTGPVFAGGVFPFLFITIACGAISGFHALISSGTTPKMLENETHTLAVGYGSMLAESAVAIMALICACILHPGLYFAINSSSALIGTDVVNVAQTISSWGFSITPEEITTLTTNIGEYTILSRTGGAPTFAIGVALILHELFGGVDLMAFWYHFAILFEALFILTAVDAGTRACRFMVQDILGNVYKPLGDIHNYPAGLLATALSVAGWGYFLYQGAIDPKGGIYTLWPLFGVSNQMLAGMALLLATTILVKMGKARYTWVTLVPAVFVLVATLYGGIQKIMPYEEGNKIANAVSHVAAVSIQSQKIKDLEFKLNNTKDEKEISTIRKEISIATQNKVGNLLNAILCVFFMIATLLVIISCIGICLGKIKIPLKETKYIKIDEFQKI

SEQ ID NO: 36442 - DNA, 2082 bp, Neisseria meningitidis Z2491
  CDS (1)..(2082): transl_table=11
atgaaatcactcaaaaccttcctcatttggggcatagtggtactggtcggcttagcatcctttaccactctggctctcagccgaggcgaacaggtcagcgcggtatggatggttaccgccgccatatccgtttactgcatcgcctaccgtttttacagcctctacatcgccaaccgcgtaatgcggctcgatcctaaccgcctgactccggcagaacgccacaacgacggcttggactacgttccgacgcacaagggcgtattgttcggacaccactttgccgcgattgccggcgcgggccccttggtcggcccggttttggcggcgcaaatgggttacctgcccggtactttgtggattatcttcggcgtggtgtttgccggcgcggtacaggatatgatagtcttgttcgtctctatgcgccgcgacggtaagtctttgggcgatattgtgaaacaggaactcggcactgtccccggcgtgattgcctccatcggtattttgatgattatggtcatcattatggcggtgttggcgttgattgtcgtaaaagcacttgttcacagcccttggggtacgtttaccatcgccgccactatgccgattgccctgtttatgggtatttacacgcgctatatccgtccgggcaaaatcggcgagatttccatcgtcggctttattttgctgatgctggcggtaatttacggcgaagatgtggcgaaaagttccatcggacattggttcgaccttgacggcatccagctcacttgggcgattatgatttacggctttgtcgcctccgtattgcccgtatggttgctgctcactccgcgcgactatctctccaccttcctgaaaatcggtacgattgcggccttggctttgggcatcgtcatcgtcaatcccactttgcaaatgcctgccgtaacccactttatcgacggttcgggtccggtattctcaggcgcattgttcccgttcctcttcatcaccatcgcctgcggtgcggtttcgggcttccacgcgctgatttcctccggcaccacgccgaaaatgctggaaaacgaaacccacgtccgtatgattggttacggtggtatgttgatggaaagtttcgtagccattatggcgcttgccgccgccgcatcgcttgatcccggcgtgtacttcgccatgaacagccctgccgccctgatcggtacggatgccaacaccgccgccgaagtgattaccaccaagctgcaattccctgtcgatgcggcaaccctgttgcataccgctaaggaagtgggcgaaaacaccatcctttcccgtgcaggcggtgcgccaaccctcgcagtcggtatggcgcacattatgagccgcctgattccgggcgaggcgatgatggcgttctggtatcacttcgccctattgtttgaagccttgttcatcctgaccgccgtcgatgccggtacgcgcgtcgcacgttttatgattcaagacttgggcagcatcttctacaaacctttcggcaacaccgactccatccccgccaacctgattgcgaccttcttcgccgtggcattgtggggctactttctctacaccggcgtaaccgacccgctgggcggcatcaactcgctctggcctttgttcggcatcgccaaccaaatgctggcgggcgtggccttgattatgtgtgccgtggtgctgattaagatgaaacgcgaccgttatgtttgggtggtactcgttcccgccgtcggcgtactgttcgtaacctgctacgccggcctgcaaaaactgttccacagcgatccgcgcatcagcttccttgcccacaccggcaaatacagcgacgcattggctaaaaacgaagtccttgcgcctgccaaagacatcggcgaaatggcgcaaatcatcttcaacgacaagattaatgccggtctgaccatcctcttcttgtcggttgtcgtgattgtcgccgcgtacggtttgcgtaccgccctcaaagcacgcaaagtcggctggccgaccgccaaagaaatcccggcggtgtaccgcgacggcaaacagccggaggcacaaagtgaagcataa

SEQ ID NO: 36443 - protein, 693 aa, Neisseria meningitidis Z2491
MKSLKTFLIWGIVVLVGLASFTTLALSRGEQVSAVWMVTAAISVYCIAYRFYSLYIANRVMRLDPNRLTPAERHNDGLDYVPTHKGVLFGHHFAAIAGAGPLVGPVLAAQMGYLPGTLWIIFGVVFAGAVQDMIVLFVSMRRDGKSLGDIVKQELGTVPGVIASIGILMIMVIIMAVLALIVVKALVHSPWGTFTIAATMPIALFMGIYTRYIRPGKIGEISIVGFILLMLAVIYGEDVAKSSIGHWFDLDGIQLTWAIMIYGFVASVLPVWLLLTPRDYLSTFLKIGTIAALALGIVIVNPTLQMPAVTHFIDGSGPVFSGALFPFLFITIACGAVSGFHALISSGTTPKMLENETHVRMIGYGGMLMESFVAIMALAAAASLDPGVYFAMNSPAALIGTDANTAAEVITTKLQFPVDAATLLHTAKEVGENTILSRAGGAPTLAVGMAHIMSRLIPGEAMMAFWYHFALLFEALFILTAVDAGTRVARFMIQDLGSIFYKPFGNTDSIPANLIATFFAVALWGYFLYTGVTDPLGGINSLWPLFGIANQMLAGVALIMCAVVLIKMKRDRYVWVVLVPAVGVLFVTCYAGLQKLFHSDPRISFLAHTGKYSDALAKNEVLAPAKDIGEMAQIIFNDKINAGLTILFLSVVVIVAAYGLRTALKARKVGWPTAKEIPAVYRDGKQPEAQSEA

SEQ ID NO: 36444 - DNA, 2166 bp, Escherichia coli O157:H7
  CDS (1)..(2166): transl_table=11
atgccaggttttactatggatacgaaaaaactattcaagcacataccctgggtgattctcggaatcatcggtgcattctgcctcgcggtagttgcattacgtcggggggagcacgtcagcgccctgtggatcgtggtcgcctctgtgtcggtgtatctggtggcgtatcgctactacagtctgtacatcgcccagaaggtgatgaaactcgaccccacgcgcgcgacgcctgcggttattaacaacgacggtctgaactacgttccgaccaaccgttacgtgttgtttggtcaccacttcgccgctatcgccggtgctggtccgctggtgggaccggttctcgccgcgcagatgggctacctgcctggcacgctgtggctgctggcgggggtagtgctggccggtgcggttcaggactttatggtgctgtttatctcctctcgccgtaacggcgcatctctcggtgagatgatcaaagaagagatggggccagtaccggggactatcgcgctgtttggctgtttcttaatcatgatcatcatcctcgccgtcctggcgctgattgtggttaaagccctggcagaaagtccgtggggtgtcttcaccgtttgctcaaccgtaccaattgcgctgtttatgggtatctacatgcgctttatccgtccggggcgtgtgggtgaagtctctgttattggtatcgtgctgctggttgcctctatctacttcggtggcgtgattgctcacgatccgtactggggtccggcactgacctttaaagacaccaccattaccttcgcgctgattggctatgcgtttgtttccgcgctgctgccggtgtggctgatcctcgcaccacgcgactatctggcaaccttcctgaagatcggcgttatcgtcggcctggcgctgggtatcgtggtgctgaacccggaactgaaaatgcctgcgatgacccagtacattgacggtactggcccgctgtggaaaggcgctctgttcccgttcctgttcatcaccatcgcctgtggtgcggtatctggcttccacgcgctgatctcttccggtacgacgccgaaactgctggctaacgaaaccgacgcgcgtttcatcggctacggcgcaatgctgatggagtccttcgtggcgattatggcgctggttgctgcatccatcatcgaaccgggtctttacttcgcgatgaacaccccgcccgcgggccttggcatcaccatgcctaacctgcatgaaatgggtggcgagaacgcgccgatcatcatggcgcagctgaaagacgttaccgcacacgcggcagcgaccgtcagctcttggggcttcgtgatttcgccagagcagatcctgcaaaccgcgaaagacattggtgagccttctgtcctgaaccgtgcaggtggtgcgccgacgctggcggtaggtatcgctcatgtgttccacaaagtgctgccgatggctgacatgggcttctggtatcacttcggtattctgttcgaagccctgttcatcctgaccgcgctggatgcgggtacccgttctggccgctttatgctgcaagacctgctgggtaacttcatcccgttcctgaaaaaaaccgactctctggttgctggtatcatcggtactgcgggctgtgtgggtctgtggggctacctgctgtatcagggcgtggtcgatccgctgggcggcgttaagagcctgtggccgctgttcggtatctccaaccagatgctggcagccgtagcgctggtactgggcaccgttgtgctgattaagatgaagcgcacccaatacatctgggtaactgttgttccggctgtatggctgcttatctgcaccacctgggcgctgggtctgaaactgttcagcaccaacccgcagatggaaggcttcttctacatggcaagccagtacaaagagaagattgctaacggtactgaccttacggcgcagcagattgccaacatgaaccacatcgttgtgaacaactacaccaacgcaggcctgagtattctgttcctgattgtggtgtacagcatcatcttctacggtttcaaaacctggcttgcggtacgtaacagcgacaaacgtactgacaaagaaacaccgtacgttccaatcccggaaggcggcgtgaagatctcttcgcaccactaa

SEQ ID NO: 36445 - protein, 721 aa, Escherichia coli O157:H7
MPGFTMDTKKLFKHIPWVILGIIGAFCLAVVALRRGEHVSALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGASLGEMIKEEMGPVPGTIALFGCFLIMIIILAVLALIVVKALAESPWGVFTVCSTVPIALFMGIYMRFIRPGRVGEVSVIGIVLLVASIYFGGVIAHDPYWGPALTFKDTTITFALIGYAFVSALLPVWLILAPRDYLATFLKIGVIVGLALGIVVLNPELKMPAMTQYIDGTGPLWKGALFPFLFITIACGAVSGFHALISSGTTPKLLANETDARFIGYGAMLMESFVAIMALVAASIIEPGLYFAMNTPPAGLGITMPNLHEMGGENAPIIMAQLKDVTAHAAATVSSWGFVISPEQILQTAKDIGEPSVLNRAGGAPTLAVGIAHVFHKVLPMADMGFWYHFGILFEALFILTALDAGTRSGRFMLQDLLGNFIPFLKKTDSLVAGIIGTAGCVGLWGYLLYQGVVDPLGGVKSLWPLFGISNQMLAAVALVLGTVVLIKMKRTQYIWVTVVPAVWLLICTTWALGLKLFSTNPQMEGFFYMASQYKEKIANGTDLTAQQIANMNHIVVNNYTNAGLSILFLIVVYSIIFYGFKTWLAVRNSDKRTDKETPYVPIPEGGVKISSHH

SEQ ID NO: 36446 - DNA, 2277 bp, Mycobacterium tuberculosis CDC1551
  CDS (1)..(2277): transl_table=11
gtggcagcgccgaccccgtcgaatcggatcgaagaacgctccggacacgccagctgcgtccgcgccgatgccgacctgccacccgtggccatcctcggtcgctcccccatcacgcttcggcacaagatcttcttcgtggccgttgccgtgatcggcgctctcgcctggaccgtcgtcgcgttcttccgcaacgagccggtcaacgcggtctggatcgtggtcgcagcgggctgcacctacatcatcgggttccggttttatgcgcggctgatcgaaatgaaagtcgtccgtccccgcgacgatcacgccaccccggccgaaatcctcgacgacggcaccgactacgtgcccaccgaccggcgggtggtattcggacaccacttcgccgccatcgccggtgccgggccgcttgtcggaccagtactggccacccagatgggttacttacccagcagcatctggattgtcgtcggcgcggtgctggccggatgtgtccaggactacctggtgttgtggatctccgtgcggcggcgtggccgctccctgggtcagatggttcgcgacgaactcggcgccaccgccggagtggccgccctcgttggaatcccggtcattatcaccattgtgatcgcggtgctggcgctggtggtcgtgcgggccctggccaagagcccatggggcgtcttctcgatcgccatgaccatccccatcgccatcttcatgggctgctacttgcggttcctacgtcccgggcgggtgtcggaagtttcattgatcgggatcggactgctgctgctcgccgttgtctccggtgattgggttgcccatacctcctggggcgcagcgtggttcagcttgtcaccggtgacactgtgttggcttctcatcagctatggcttcgcagcttcggtgctgccggtgtggctgctgctcgcgccacgcgactacctgtcaacgttcatgaaggtcggcaccatcgcgcttctcgcgatcggtgtttgtgcggctcacccgatcatcgaggccccagcggtgtcgaaattcgccggtagcggcaacggcccggtgttcgccggctcactgtttccattcctgttcatcaccatcgcgtgcggggcgctgtctggattcgacgcgctcatctgctcgggcacgacgccgaagatgctggagaaggaaggccagatgcgcgtgatcggctacggcggcatgatgaccgagtccttcgtcgccgtcatagcactactcaccgcggcgatcctcgaccagcacctatacttcaccctcaacgcgccgtccctgcatacccacgacagcgcagccaccgccgccaagtacgtcaacgggctcggtttgacgggctcaccggtgaccccagaccacatcagccaggccgccgccagcgtcggcgaacagacgatcgtgtcgcgcaccggcggtgcgccgacgctggcgttcggcatggcggagatgctgcatcgagtggtcggcggtgtgggcctcaaggcgttctggtatcacttcgcgatcatgtttgaggctctgttcatcctcaccaccgtcgacgccggcaccagggccgcgcgcttcatgatctccgatgcgctgggcaactttggcggtgtgctgcgcaaactgcagaatccgagctggcgtcccggtgcgtgggcttgcagtttggtggtcgtcgcggcgtggggcagcatcctgctgctcggtgtgaccgatccgctgggcggcatcaacacgctgttcccgctgttcggcattgccaaccagttgcttgccggaattgcgctgaccgtcatcaccgtcgtcgtcatcaagaaggggcgactgaagtgggcttggataccgggtattccactgctgtgggatctggcggtcaccctgaccgcatcgtggcagaagatcttctccgctgatccttctgtcggctactggactcagcatgctcactacgcggcagcccagcacgcaggcgagaccgcgttcggctcggccaccaacgccgatgagatcaacgacgtcgtccggaacacattcgtccagggcaccctgtcgatcgtcttcgtggtggtcgtcgtgctggttgttgtcgccggagtcatagtggcgctgaagacaattcgcggccgcggcataccgttggccgaggacgatccggcgccgtcgacgttgttcgcgcccgctggcctgattcctacagccgcagagcgaaagttgcaacgacgtttgggcgcgccggcctcggcttccgtcgcggcgcccgactag

SEQ ID NO: 36447 - protein, 758 aa, Mycobacterium tuberculosis CDC1551
MAAPTPSNRIEERSGHASCVRADADLPPVAILGRSPITLRHKIFFVAVAVIGALAWTVVAFFRNEPVNAVWIVVAAGCTYIIGFRFYARLIEMKVVRPRDDHATPAEILDDGTDYVPTDRRVVFGHHFAAIAGAGPLVGPVLATQMGYLPSSIWIVVGAVLAGCVQDYLVLWISVRRRGRSLGQMVRDELGATAGVAALVGIPVIITIVIAVLALVVVRALAKSPWGVFSIAMTIPIAIFMGCYLRFLRPGRVSEVSLIGIGLLLLAVVSGDWVAHTSWGAAWFSLSPVTLCWLLISYGFAASVLPVWLLLAPRDYLSTFMKVGTIALLAIGVCAAHPIIEAPAVSKFAGSGNGPVFAGSLFPFLFITIACGALSGFDALICSGTTPKMLEKEGQMRVIGYGGMMTESFVAVIALLTAAILDQHLYFTLNAPSLHTHDSAATAAKYVNGLGLTGSPVTPDHISQAAASVGEQTIVSRTGGAPTLAFGMAEMLHRVVGGVGLKAFWYHFAIMFEALFILTTVDAGTRAARFMISDALGNFGGVLRKLQNPSWRPGAWACSLVVVAAWGSILLLGVTDPLGGINTLFPLFGIANQLLAGIALTVITVVVIKKGRLKWAWIPGIPLLWDLAVTLTASWQKIFSADPSVGYWTQHAHYAAAQHAGETAFGSATNADEINDVVRNTFVQGTLSIVFVVVVVLVVVAGVIVALKTIRGRGIPLAEDDPAPSTLFAPAGLIPTAAERKLQRRLGAPASASVAAPD

SEQ ID NO: 36448 - DNA, 1779 bp, Clostridium acetobutylicum ATCC 824
  CDS (1)..(1779): transl_table=11
atgaattctatagttctcgtaattatagcagctttagtacttattataggttatagggtttatggttattttatagctgctaaggttttagtcttagatgaaacaagaacggttccatctgaaactcataatgatggacgtgattatgtacctacaaataaatgggtacttttaggtcaccattttgcagcaattgcaggtgctggtcctcttataggtcctgtactagcagcacagtttggttatcttcctggaacactttggatactccttggtggtgttcttgcaggcggcgttcacgacatgattcttttattctcctctgtaagacatgacggacaatccatagctgaaatagcaaaggatgttcttggagaaaaaatgggatttataacttctatctcagtaatatttatacttataataactatggctggacttgggctccccattgttaattcacttttcaacagtccttggggaacgtttacagtcggctttacaattcccgttgccttcttagtaggaatatatttaaaattccttcgcccaggtaagattttagaggcaacaataattggaatggcattgatattgctgggagtttatttgggaccatcaattcaacacacatttttagggaatttacttacttttaactcaaagcagctttcacttatattagctttatacggatttttagccgctgtacttcctgtatggcttctccttttaccaagggattatttaagcacatatatgaaactcggagttataggagcccttgttgttggaataatctttgtaagaccaactattcaaatgcctgctgtaacaaaattcgtatcaggaggaggccctattattcctggaaaggtatttcctttcttatttataacaatagcctgtggtgcactttcaggctttcatgctcttataagcacaggtacaactcctaaacttattaaaaatgaaagagacattcttccaataggctacggatcaatggttatagagtctttcatagctcttatggctcttattgctgcaactgttcttccaacttcagactacttcgcaataaattcagcaccagcactatttgcaaagcttcacatgattccaaaggaacttcctatgctttctcatttagttggagaaaaacttgctggaagaactggcggttcagtatctttagccgttggaatgtcctacgtattttataaaattccttatttaaaatcgcttatgtcttattggtatcacttttgcataatgtttgaagccttattcatacttacaaccatagattctggtacaagaataggaagatacctgattcaagatttattaggaaagctgtataaacctttttctaataaaaattcctggtttaatgtaatactattcagtggcattatgtcctttgcatggggttatctactttacacagggaacatatccaccatatggcctctgtttggtactgcaaaccaaatgcttgcaactatagcctttgctgtaggtacctcagtacttttaaaaatgggaaagaaaaagtatattccaataaccataattccaatggcctttgtaggtgtgaacactgttttagctgcaattgaaaacataataacctacattcctcagcataaaattcttttaacagtaatgtcctttatattaataataatgatagtaataatattaactgaaagtataagaatatggcttagagattatagttctagatccaatactaaaaatttaaaggcctaa

SEQ ID NO: 36449 - protein, 592 aa, Clostridium acetobutylicum ATCC 824
MNSIVLVIIAALVLIIGYRVYGYFIAAKVLVLDETRTVPSETHNDGRDYVPTNKWVLLGHHFAAIAGAGPLIGPVLAAQFGYLPGTLWILLGGVLAGGVHDMILLFSSVRHDGQSIAEIAKDVLGEKMGFITSISVIFILIITMAGLGLPIVNSLFNSPWGTFTVGFTIPVAFLVGIYLKFLRPGKILEATIIGMALILLGVYLGPSIQHTFLGNLLTFNSKQLSLILALYGFLAAVLPVWLLLLPRDYLSTYMKLGVIGALVVGIIFVRPTIQMPAVTKFVSGGGPIIPGKVFPFLFITIACGALSGFHALISTGTTPKLIKNERDILPIGYGSMVIESFIALMALIAATVLPTSDYFAINSAPALFAKLHMIPKELPMLSHLVGEKLAGRTGGSVSLAVGMSYVFYKIPYLKSLMSYWYHFCIMFEALFILTTIDSGTRIGRYLIQDLLGKLYKPFSNKNSWFNVILFSGIMSFAWGYLLYTGNISTIWPLFGTANQMLATIAFAVGTSVLLKMGKKKYIPITIIPMAFVGVNTVLAAIENIITYIPQHKILLTVMSFILIIMIVIILTESIRIWLRDYSSRSNTKNLKA

SEQ ID NO: 36450 - DNA, 2067 bp, Yersinia pestis CO92
  CDS (1)..(2067): transl_table=11
atgaataacatcaggaccgttgtcatatggctgacagtggcgctaatcggtgcatttgcctttgccatgttggcccttagccggggtgaacatgtcaatgccatctggttagtgattgcatccgtggcttgttacagcatcgcttatcgcttctacagtcggtttattgccaagaatgtctttgaactggatgaccgtcgtctgacgccagcagaacgacgcaatgacggtctggattatgttcctaccaacaaatgggtgttgtttggtcaccactttgctgccatcgcgggtgctgggccactggtcgggccaatcctggccgcacagatgggttttctgccggggactatctggatcctggtcggtgtaatgatggccggtgccgtacaggacttcttaatcctgtttatctccactcgccgcgatggccgctcactgggtgaaatggcaaagcaagagttgggggcatttgctggtgtgataactatgctgggtgcattgggcgtaatgattatcattttgtccgcactcgcactggtggtggtaaaagcattagctgatagcccgtggggcctgtttaccattgccgcaacgatccccattgccctctttatgggcgtttatatgcggtttatccgccctggtaaaattgctgaagtgtcattgatcggtttcgtactgatgatgtctgcaatcatttacggtgggaacatcgcggtacacccttactgggggcctttctttacgttacatggcaccacgctaacctggatattggttatctatggtttcatcgcctctgtactgccagtgtggttgctgctagcaccacgagattacttatcaaccttcctgaaaattggggtcatcattggtttagcggttggtattgtattcgccatgccagaaatgaagatgcccgcggtctcacgctttattgatggcagcggcccggtcttctccggcagcctgttcccgttcctgtttattactatcgcttgtggtgctatctctggcttccatgctctggtatccagtggcaccacaccgaaactgattgaacgcgaaagccatacccgctttatcggctacggcgcaatgttgatggagtcattcgttgccatcatggcgctaatctgtgcctcggttatcgaccctggtgtttatttcgccatgaactcacccgcggctctgattggtaccaccgtagaaagtgcctcgctggccattagtagctgggggtttgtcgttacgccagaaacactggcgatggtcgccaaagatgttggtgaaaactcgattctgtcacgggctggtggtgcaccgaccttcgctgtgggcatggcgcatatcatcagtgaaatattcaatagccgtaatatgatggctttctggtatcactttgccatcttgtttgaagccatgtttattctgactgcggtcgatgctggtacccgtgcctgccgctttatggttcaggatctggttggggtggtcgtacctcgtctggccaataaccgttcatggtttggtaacctttccggaacgacagtcgcggtagccggttggggattcttcgtttaccaaggtgttatcgacccactggggggaataaacaccttgtggccgctgttcggtattggtaaccaaatgctggcatcaatggcactgattctaggtaccgtcgtactgtttaaaatgaagaaacaacgctacgcctgggttaccatcttgccaacaatttggttatttatcacctcaatgaccgcaggttggcagaagatattccatgaaaaaccaagtattggcttccttgctcaagcaaaaaaattctctaacggcattgaacaaggggtgttaatcacacccgcgaagagctttaaagacatggaaactatcgtgtttagcaaccagatcaacgccgcgctatgtgcattctttatgctggtggcggtgacgatgctagtttctgccttctttgtgattcgtcgcgcactgaaatccagcaaaccaacaacccatgaaactgaaattgtataccgtgaggaggtcgcccgtggttaa

SEQ ID NO: 36451 - protein, 688 aa, Yersinia pestis CO92
MNNIRTVVIWLTVALIGAFAFAMLALSRGEHVNAIWLVIASVACYSIAYRFYSRFIAKNVFELDDRRLTPAERRNDGLDYVPTNKWVLFGHHFAAIAGAGPLVGPILAAQMGFLPGTIWILVGVMMAGAVQDFLILFISTRRDGRSLGEMAKQELGAFAGVITMLGALGVMIIILSALALVVVKALADSPWGLFTIAATIPIALFMGVYMRFIRPGKIAEVSLIGFVLMMSAIIYGGNIAVHPYWGPFFTLHGTTLTWILVIYGFIASVLPVWLLLAPRDYLSTFLKIGVIIGLAVGIVFAMPEMKMPAVSRFIDGSGPVFSGSLFPFLFITIACGAISGFHALVSSGTTPKLIERESHTRFIGYGAMLMESFVAIMALICASVIDPGVYFAMNSPAALIGTTVESASLAISSWGFVVTPETLAMVAKDVGENSILSRAGGAPTFAVGMAHIISEIFNSRNMMAFWYHFAILFEAMFILTAVDAGTRACRFMVQDLVGVVVPRLANNRSWFGNLSGTTVAVAGWGFFVYQGVIDPLGGINTLWPLFGIGNQMLASMALILGTVVLFKMKKQRYAWVTILPTIWLFITSMTAGWQKIFHEKPSIGFLAQAKKFSNGIEQGVLITPAKSFKDMETIVFSNQINAALCAFFMLVAVTMLVSAFFVIRRALKSSKPTTHETEIVYREEVARG

SEQ ID NO: 36452 - DNA, 2151 bp, Salmonella typhimurium LT2
  CDS (1)..(2151): transl_table=11
atggatacgaaaaagatattcaagcacataccctgggtgattctcggaatcatcggtgctttctgcctctcggtcgttgccctacgtcggggtgaacacgtgagcgccctgtggatcgtggtcgcttccgtttccgtctatctggtggcttaccgctactacagcctgtacatcgcccagaaggtcatgaaactcgacccgacgcgcgcgacgccggcggttatcaataacgacggcctgaactacgtgccgactaaccgctacgtgctgtttggtcaccacttcgccgccatcgctggcgcaggtccgctggtcgggccggtattggccgcgcagatgggctatctgccggggacactgtggttactggcgggcgtggtgctcgcgggcgcagtgcaggactttatggtgctgttcatctcttcccgccgtaacggcgcctctcttggcgagatgatcaaagaagagatgggtaccgttccaggcaccatcgcgctgttcggctgcttcttaatcatgatcatcatcctcgcggtgctggcattaatcgtggttaaagcgctggccgaaagcccgtggggcgtcttcaccgtctgctccacggtgccgattgcgctgtttatgggcatctacatgcgcttcctgcgtccgggacgcgtaggcgaagtctccgttattggtatcgtgctgctggtggcgtctatttacttcggcggcgtgattgcccacgacccttactggggcccggcgctgacctttaaagacaccaccattaccttcgcgctgatcggctacgcctttgtttccgcgctgctgccggtatggctgatccttgccccgcgcgactatctcgctaccttcctgaaaatcggcgtgatcgtcggtctggcgctggggattgtgatcctcaacccggaactaaaaatgccggcattgacgcagtatgtcgacggtaccggcccgctgtggaaaggcgctctgttcccgttcctgttcatcaccatcgcctgtggcgccgtctctggcttccacgcgctcatctcctccggcaccacgccgaaactgctggcctgtgagaccgatgcgcgttttatcggctacggcgcgatgctgatggagtcctttgttgcggtgatggcgctggtggcggcctcgatcattgaaccgggtctctacttcgcgatgaacaccccgccggcaggtctgggcattaccatgccaaacctgcacgagatgggcggcgagaacgcgccgctgattatggcgcagttgaaagacgttaccgcacatgcagcggcgaccgtcagctcctggggctttgtgatttccccggaacaaatcctgcaaactgcgaaagatatcggtgaaccgtcagtattgaaccgcgcaggcggcgcgccaacgctggcagtaggtatcgcgcatgtgttccacaaagtcctgccgatggcggatatgggcttctggtatcacttcggtattctgttcgaagcgctgtttatcctgaccgcgctggatgcgggtacccgttccggccgctttatgttgcaggatttgctgggtaacttcgtcccgttcctgaaaaaaaccgattctctggtcgcgggtatcatcggtaccgcaggctgcgtcggtttgtggggctatctgctgtatcagggcgtggtcgacccgctgggcggcgtgaagagcctgtggccgttgttcggtatctctaaccagatgctggccgccgtggcgctggtgttgagcaccgtggtactgatcaaaatgcagcgcaccaaatacatctgggtgacggtaattccggcggtatggctgctgatctgcaccacctgggcgctgggcctgaaactgttcagcgccaacccacagatggaaggtttcttctacatggcaaacctgtataaagagaagattgccaacggcgccaacctgaccgagcagcagattgccaacatgaaccatatcgtggtgaacaactacactaacgctggtttgagtattctgttcctggtggtggtgtacagtattatcttctacggtttcaccacctggatgaaggtacgcaacagcgataaacgtaccgacaaagaaaccccgtatgtgcctgtgccggaaggcggcgtgaagatctcttcacaccactaa

SEQ ID NO: 36453 - protein, 716 aa, Salmonella typhimurium LT2
MDTKKIFKHIPWVILGIIGAFCLSVVALRRGEHVSALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGASLGEMIKEEMGTVPGTIALFGCFLIMIIILAVLALIVVKALAESPWGVFTVCSTVPIALFMGIYMRFLRPGRVGEVSVIGIVLLVASIYFGGVIAHDPYWGPALTFKDTTITFALIGYAFVSALLPVWLILAPRDYLATFLKIGVIVGLALGIVILNPELKMPALTQYVDGTGPLWKGALFPFLFITIACGAVSGFHALISSGTTPKLLACETDARFIGYGAMLMESFVAVMALVAASIIEPGLYFAMNTPPAGLGITMPNLHEMGGENAPLIMAQLKDVTAHAAATVSSWGFVISPEQILQTAKDIGEPSVLNRAGGAPTLAVGIAHVFHKVLPMADMGFWYHFGILFEALFILTALDAGTRSGRFMLQDLLGNFVPFLKKTDSLVAGIIGTAGCVGLWGYLLYQGVVDPLGGVKSLWPLFGISNQMLAAVALVLSTVVLIKMQRTKYIWVTVIPAVWLLICTTWALGLKLFSANPQMEGFFYMANLYKEKIANGANLTEQQIANMNHIVVNNYTNAGLSILFLVVVYSIIFYGFTTWMKVRNSDKRTDKETPYVPVPEGGVKISSHH

SEQ ID NO: 36454 - DNA, 2061 bp, Ralstonia solanacearum GMI1000
  CDS (1)..(2061): transl_table=11
atgagctttgtcaggcaacacctgatctggctggttgtcgccattcttggcgcgtttgccttttccaccgtcgcgcttgcgcgcggggaggcggtcagcgcgctgtgggtggtggtggccgccgtatgcatctacctgatcgcataccgttactacagccgctacatcgccgacaaggtgctcggcctggacggcacccgcaagacgccggcctggcgtcacaacgacgggctcgattacgttcccaccaacaagtacgtgctgttcggccaccacttcgcggccatcgccggcgccggcccgctggtcggccccgtgctcgccgcgcagatgggctacctgcctggcatgctgtggatcctggccggcgtcgtgttcgccggcgcggtgcaggacttcatcgtgctgttcatctccagccgccgcgacggccgctcgctgggcgacctggtgaaatcggaaatgggcacggtgcccggcctgatcgcgctgttcggggcgttcctcatcatgatcatcatcctcgccgtgctggcgctgatcgtggtgaaggcgctggccggttcgccgtggggcaccttcacggtggcggcgacgatcccggtcgccatcttcatgggcctgtatgtgcgcttcatccgcccgggccgggtcggcgaggtgtccatcatcggcttcgtgctgctgatgctcgccatcatcggcgggcaggccgtgcacgagagcgccacgctggcgccgctgttcacatacgacggcaaggcgctgacctggatgctgatcggctacggcttcgtcgcctcggtgctgccggtgtggctgctgctggcgccgcgtgactatctgtcgaccttcctgaagatcggcaccatcatggcgctggcgatcggcatcctgatcgtcgcgccgcagatgcagatgccgtcgctgacgcagttcgcggcgggcaacggtccggtgtggtcgggcaacctgttcccgttcctgttcatcaccatcgcgtgcggcgcggtgtcgggcttccactcgctgatctcgtcgggcaccacgcccaagatgctggagaacgaactccaagcgcgcttcatcggctacggcgcgatgctgatggaatcgttcgtcgccatcatggcgctggtggccgcctcggtcatcaacccgggcgtgtactttgcgatgaacgcgccggccgcgctggtgggcaccaccgccgacgcggtggcgcagacgctgtcgacatggggcttcgtcgtcacgccggacgtgctgctgcagaccgccaaggacgtcggcgagaacaccattctggcccgtgcgggcggcgcgccgacgttggcggtcggcatggcgcacatcctgcaccaggtggtgggcggccaggccatgatggcgttctggtaccacttcgccatcctgttcgaggcgctgttcatcctgaccgccgtggacgcgggcacgcgtgccggccgcttcatgctgcaggatctgctgggcaccttcgtgccggccctcaagcgcaccgagtcgctgacggccaacctgatcgccacggcggcgaccgtcgcgctgtggggctacttcctgtaccagggcgtggtcgatccgctgggcggcatcaatacgctttggccgctgttcggcatctccaaccagatgctggcggcgatcgcgctgacgctgggcacctgcgtgctgatcaagatgaagcgcgaccgctacgtctgggtgacgctgctgccgaccgcgtggctgctggtctgcacgctgacggccggctggcagaagctgttccacccggatccgaagatcggcttcctgtcgcacgccaacaagttcgccgacgccattgccgccggcaagctgctggctccggccaagtcgatggcgcagatgcagcagatcgtgctgaacgatcgcatcgatgccttcctgtgcggcctgttcgtgctggtggtcgtcagcattgcctggtacggcttgcgcaccgtgctgaaggcgcgcacccaggctcgcccgacggtcaacgaaacgccgtacgaagcgctgggcgccacgcactga

SEQ ID NO: 36455 - protein, 686 aa, Ralstonia solanacearum GMI1000
MSFVRQHLIWLVVAILGAFAFSTVALARGEAVSALWVVVAAVCIYLIAYRYYSRYIADKVLGLDGTRKTPAWRHNDGLDYVPTNKYVLFGHHFAAIAGAGPLVGPVLAAQMGYLPGMLWILAGVVFAGAVQDFIVLFISSRRDGRSLGDLVKSEMGTVPGLIALFGAFLIMIIILAVLALIVVKALAGSPWGTFTVAATIPVAIFMGLYVRFIRPGRVGEVSIIGFVLLMLAIIGGQAVHESATLAPLFTYDGKALTWMLIGYGFVASVLPVWLLLAPRDYLSTFLKIGTIMALAIGILIVAPQMQMPSLTQFAAGNGPVWSGNLFPFLFITIACGAVSGFHSLISSGTTPKMLENELQARFIGYGAMLMESFVAIMALVAASVINPGVYFAMNAPAALVGTTADAVAQTLSTWGFVVTPDVLLQTAKDVGENTILARAGGAPTLAVGMAHILHQVVGGQAMMAFWYHFAILFEALFILTAVDAGTRAGRFMLQDLLGTFVPALKRTESLTANLIATAATVALWGYFLYQGVVDPLGGINTLWPLFGISNQMLAAIALTLGTCVLIKMKRDRYVWVTLLPTAWLLVCTLTAGWQKLFHPDPKIGFLSHANKFADAIAAGKLLAPAKSMAQMQQIVLNDRIDAFLCGLFVLVVVSIAWYGLRTVLKARTQARPTVNETPYEALGATH

SEQ ID NO: 36456 - DNA, 1857 bp, Pyrobaculum aerophilum str. IM2
  CDS (1)..(1857): transl_table=11
atgagcagtacaataatcgcattaatagcaataatagtattttttgcggcatttaaatggtatgccagcgctattgaaagaacactgggcgttgatccgaacaggcccactccggcgcatagaaaaagagatggaattgattacgtgccgtctaacccggtggtcttattcggacaccacttcgccaccgtggcaggtctaggcccaatagcgggacccgccatagctgccgtgttcgggttcctacctgcgttcctctggatactactgggcacagtgtttatcggcgctgtacaagacatgacctcgctgtttgtctcagtacgtcacggcggcgtctcaataatgtcaatagccgggaggtacttaggggagacgttgaggaaatttttcctaggagttatgctcattttgcttattgtaataaacgcggtatttggagtattaatcgcagttttatggattggcacaacgccagagaccgccacggctacgtgggtcttcacgttaggctcagtaatcaccggcattctgctctacaggttaggggtaaatctagtagtttccacaattgtgggtttagcgtttatagtattaggggtttggcttggctatatgtatcccattaaactcggtatagtggagtggatagtcatattgatgatatatgcatatattgcgtctatcctcccggtatggctcctcctccagccccgtgactacctcaatacatttctgcttatagctggagtcggtgggggcgttataggggctttgattggaaacttcccgttgcaagcgccgttagtgaacactcaagaggcttttaaattcggccttgacatcgctaacaggcctgtttggccctatgtaagtgtgttaattgcatgcggcgcggcaagtgggttccactccttagtcagcagtggcacaacggcaaaacaattgcccaatgaaaagtatatcagacacataggctacggcgctatgctaggcgagggctttcttggaataacggcgttaatggccgtgacaacagcgctggcttgggaggagtatagtcctggcctaggctcagtcgtcactggatgggggcgcttcttaaatgtaatactgccttttattgacgttaaagtattaataacattcgccgcattagtggcaactgcctttggcttcaccaccatggactcctctatgagacttacgagatatgcacttcacgaattactggggataaagaacatatacgtggcagggtttataggctttctgctatcgctaaccatcgcattagctggcaccgccacgcccctatggacgctcttcggctctgtaaaccaagtgttagtggctcttgcgttaactactatagctgtggtattggctcacttcggcagaaggctgtggttcttaataccaggtattgcatacatgtacgcaacgacgctcactgcgttgctacatacaataactgtgtggctatacacgttgccagaagggccccagaagaatccgttaataagtgcaatttatactgaatactcacgtatatacggctctgagactggcaaggcattggccgatgccttacatctgccggccttcgcgcttatattaactcttgcggttataactgtaatactggccctccttatactattcacttcaattagatggttcactgccgcaaaaaggccgagagagccacagtatgtagatggagaaggcgttaggggcgagacggcgggcacccctacaacaacccgtttctctctgccccgcggccccttcagcgactttataagatttgcaagtgagctaaggctgtcagtgaggggtttgttcagaaagtag

SEQ ID NO: 36457 - protein, 618 aa, Pyrobaculum aerophilum str. IM2
MSSTIIALIAIIVFFAAFKWYASAIERTLGVDPNRPTPAHRKRDGIDYVPSNPVVLFGHHFATVAGLGPIAGPAIAAVFGFLPAFLWILLGTVFIGAVQDMTSLFVSVRHGGVSIMSIAGRYLGETLRKFFLGVMLILLIVINAVFGVLIAVLWIGTTPETATATWVFTLGSVITGILLYRLGVNLVVSTIVGLAFIVLGVWLGYMYPIKLGIVEWIVILMIYAYIASILPVWLLLQPRDYLNTFLLIAGVGGGVIGALIGNFPLQAPLVNTQEAFKFGLDIANRPVWPYVSVLIACGAASGFHSLVSSGTTAKQLPNEKYIRHIGYGAMLGEGFLGITALMAVTTALAWEEYSPGLGSVVTGWGRFLNVILPFIDVKVLITFAALVATAFGFTTMDSSMRLTRYALHELLGIKNIYVAGFIGFLLSLTIALAGTATPLWTLFGSVNQVLVALALTTIAVVLAHFGRRLWFLIPGIAYMYATTLTALLHTITVWLYTLPEGPQKNPLISAIYTEYSRIYGSETGKALADALHLPAFALILTLAVITVILALLILFTSIRWFTAAKRPREPQYVDGEGVRGETAGTPTTTRFSLPRGPFSDFIRFASELRLSVRGLFRK

SEQ ID NO: 36458 - DNA, 1452 bp, Clostridium perfringens str. 13
  CDS (1)..(1452): transl_table=11
atgatatcatttttattatcattagtattattaattgtgggctactttacttatggaaaatttgtagacaagacctttggtacaaatgattcaattgaaacacctgctgagtctatggcagatggagtagactatgtaccaatgagttggccaagaatttttttaattcagtttcttaatattgctgggcttggacctatatttggagccatagctggagcgttatggggacctgtagcatttttatggatagtttttggatgtatattcgcaggggctgttcatgactatttcacaggagttttatctataagaaataaaggggtatcagttgctgaacttgtaggtaaatatcttggagaaataccaagaaaaataatggttatattttctgtagtattattaattttagttggggtagttttcttaacaggcccagcagatcttttaaaaactttaacaggaatagacagagatatatttatagttattatagtagtatattatatagctgccactgttttaccagtagataaggttataggaaaaatttatcctatatttggactttgtcttttaataatggctgtaggaataggtgctggaattgtaattgaaggatataatattccagaaattcaattagcaaacttccatccagaaggaacaccaatattcccattcttatttataacaatagcttgtggagctatatctggattccatgctacacaatcacctattatggctagatgtgtaaaaaaagaatcagaggcaagaaaagtattctatggtgcaatgattgcagagggagttatagccttagtttgggcagctgcagctatgtccttctttggtgatacaaatggattacaagaaattttaaaagctggaggaccagccactgtagttaatactatttctaatacagtaatgggaaaagtaggtgccgtattagcaatattaggggtagtagcttgtcctatatcttcaggagatacagctttcagaagtgctagacttacaattgctgatgcttttaaacttaaacaagataaggttattgatagatttaaaatagccataccactatttgttgtgggtatagcattaacttttattgatttcggcataatatggagatatttctcatggtcaaatcaaactttagcaatgataatgctttgggcagcatctgcttatatgttaaaagctcataataattattggataaccttagtgccagcagttttcatgtcagcagttacttgttcatatatattacaagctcctgaaggatttagattaaatgcaacattttctaatatagcaggtgtggtatttgccttagttctttttggaattttcattaagtactgtaaaaaagaaaataatgaaaattgtgagattgtagaaattgaggaagtaaaagaagtgattaaaaataaataa

SEQ ID NO: 36459 - protein, 483 aa, Clostridium perfringens str. 13
MISFLLSLVLLIVGYFTYGKFVDKTFGTNDSIETPAESMADGVDYVPMSWPRIFLIQFLNIAGLGPIFGAIAGALWGPVAFLWIVFGCIFAGAVHDYFTGVLSIRNKGVSVAELVGKYLGEIPRKIMVIFSVVLLILVGVVFLTGPADLLKTLTGIDRDIFIVIIVVYYIAATVLPVDKVIGKIYPIFGLCLLIMAVGIGAGIVIEGYNIPEIQLANFHPEGTPIFPFLFITIACGAISGFHATQSPIMARCVKKESEARKVFYGAMIAEGVIALVWAAAAMSFFGDTNGLQEILKAGGPATVVNTISNTVMGKVGAVLAILGVVACPISSGDTAFRSARLTIADAFKLKQDKVIDRFKIAIPLFVVGIALTFIDFGIIWRYFSWSNQTLAMIMLWAASAYMLKAHNNYWITLVPAVFMSAVTCSYILQAPEGFRLNATFSNIAGVVFALVLFGIFIKYCKKENNENCEIVEIEEVKEVIKNK

SEQ ID NO: 36460 - DNA, 2280 bp, Corynebacterium glutamicum ATCC 13032
  CDS (1)..(2280): transl_table=11
gtgaccataaaacagactgacaacatcaatgacgatgatttggtgtacagcaacgctactgaccttccagtaggcgtgaagaagtcccctaaaatgtcaccgaccgcccgcgttggtctccttgtctttggggttatcgcggcggtgggttggggagcaatcgctttctcccgtggcgaaacaatcaactctgtgtggctggttttggcggcagttggttcctatatcattgcgttttctttctatgcccgactgattgaatacaaagttgttaagccgaaagatcagcgagcaaccccggcggaatacgttaatgacggcaaggactatgtcccaacggatcgtcgtgtgctttttggccaccactttgcagctattgcaggtgccggtccattggttggacctgtcatggccgcgcagatgggctacctgccaggcaccttgtggattatcctcggtgtgattttcgccggtgcagtgcaggactacctagtgctgtgggtgtctactcgtaggcgtggacgctcacttggccagatggttcgtgatgaaatgggcacggtcggtggagctgccggtatcttggcgaccatctccatcatgatcatcattatcgcggtgctcgcattgatcgtggttaatgcactggctgattcaccatggggcgttttctccatcaccatgaccatcccaattgcactgttcatgggtgtgtacttgcgttacctgcgcccaggtcgtgttactgaagtgtccatcatcggtgtggcactgctcctgctggctatcgttgctggtggttgggttgcagacacctcatggggcgtggaatggttcacctggtctaagaccactttggcgttggccttgatcggttacggaatcatggctgcgattttgccggtgtggctgctgcttgcaccgcgcgattacctgtctacctttatgaagatcggcgtcatcggtctgttggcagtgggtattttgttcgcacgtcctgaggtgcagatgccttccgtgacctccttcgcacttgagggcaacggtccggtgttctctggaagtctgttcccattcctgttcatcacgattgcctgtggtgcactgtctggtttccacgcactgatttcttcaggaaccacaccaaagcttgtggagaaggaatcccagatgcgcatgctcggctacggcggcatgttgatggaatctttcgtggcgatgatggcactgatcaccgctgttattctggatcgtcacctgtacttctccatgaacgctccgctggcactgactggtggagatccagcaaccgcagctgagtgggttaactccattgggctgacaggtgcggatatcaccccggaacagctgtcggaagctgctgaaagtgtcggagaatccactgttatttcccgtaccggtggcgcaccaaccttggcgttcggtatgtctgaaatcctctccggattcatcggcggcgctggaatgaaggcgttctggtaccacttcgccatcatgtttgaggctctgttcatcctcactactgtggatgcaggtactcgtgtggctcgctttatgatgaccgataccttgggcaatgttccaggtctgcgccgtttcaaggatccttcatggactgtcggtaactggatttctaccgtgtttgtgtgtgctctatggggtgctattttgctcatgggtgttaccgatccactgggcggcatcaacgtgcttttcccactattcggtatcgctaaccagctgctcgccgctattgcacttgctctcgtgctggttgttgtggtgaagaagggcctgtacaagtgggcgtggattccagctgttcctttggcatgggatctcattgtcacgatgactgcgtcatggcagaagattttccactctgatccggctattggctactgggctcagaacgcgaacttccgcgatgcaaagtctcaaggccttaccgaatttggtgccgctaaatctcctgaggcaatcgatgcggttatccgaaacaccatgattcagggcatcttgtccatcctgttcgcggtgctcgtcctcgttgttgtcggcgcagccattgcggtgtgcatcaagtccatcagggctcgtgcagccggaacacctttggagaccactgaagagcctgatactgaatctgagttcttcgccccaactggattccttgcatcttccagggataaggaagtccaggccatgtgggacgagcgctacccaggcggtgcgcccgtgtcttctggagggcactaa

SEQ ID NO: 36461 - protein, 759 aa, Corynebacterium glutamicum ATCC 13032
MTIKQTDNINDDDLVYSNATDLPVGVKKSPKMSPTARVGLLVFGVIAAVGWGAIAFSRGETINSVWLVLAAVGSYIIAFSFYARLIEYKVVKPKDQRATPAEYVNDGKDYVPTDRRVLFGHHFAAIAGAGPLVGPVMAAQMGYLPGTLWIILGVIFAGAVQDYLVLWVSTRRRGRSLGQMVRDEMGTVGGAAGILATISIMIIIIAVLALIVVNALADSPWGVFSITMTIPIALFMGVYLRYLRPGRVTEVSIIGVALLLLAIVAGGWVADTSWGVEWFTWSKTTLALALIGYGIMAAILPVWLLLAPRDYLSTFMKIGVIGLLAVGILFARPEVQMPSVTSFALEGNGPVFSGSLFPFLFITIACGALSGFHALISSGTTPKLVEKESQMRMLGYGGMLMESFVAMMALITAVILDRHLYFSMNAPLALTGGDPATAAEWVNSIGLTGADITPEQLSEAAESVGESTVISRTGGAPTLAFGMSEILSGFIGGAGMKAFWYHFAIMFEALFILTTVDAGTRVARFMMTDTLGNVPGLRRFKDPSWTVGNWISTVFVCALWGAILLMGVTDPLGGINVLFPLFGIANQLLAAIALALVLVVVVKKGLYKWAWIPAVPLAWDLIVTMTASWQKIFHSDPAIGYWAQNANFRDAKSQGLTEFGAAKSPEAIDAVIRNTMIQGILSILFAVLVLVVVGAAIAVCIKSIRARAAGTPLETTEEPDTESEFFAPTGFLASSRDKEVQAMWDERYPGGAPVSSGGH

SEQ ID NO: 36462 - DNA, 1425 bp, Fusobacterium nucleatum subsp. nucleatum ATCC 25586
  CDS (1)..(1425): transl_table=11
atgtatagttttataggttcaattatagcattggtacttggatattttatttatggaaaatttgttgaaggtgtttttggtatagatacttcaagagaaacacctgcaaaaagattagctgatggtgttgactatatggaaatgagttggccaaaagcatttcttattcaatttcttaacatagctggaactggaccaatatttggagctgttgcaggagcgttatggggtccagctgcatttatttggatagtgtttggttgtatttttgcaggttcagttcatgattttctaataggaatgatgtctttaagaaaagatggagcatctgtttctgaaatagtaggagaaaatttaggtatgactgcaaaacaaataatgagaattttttctgttatacttctattattagttggtgttgtatttataatgagtccagctcaaattttaactaatataacaggggttaattatacagtttggttaggagttattataatttattatctttgtgcaacagttttaccaattgatacaattataggaaaaatttatccaatatttggtttatcacttttagtaatggcatttggtataggtggaggattaataataaataatgctaatattcctgaaatagcttttgtaaatatgaatccagcaggaagatcagttttcccttatctatgcataacaatagcttgtggagcaattagtggattccatgctactcaatctcctatgatggctagatgtttaaaaacagaaaaagaaggaagaagagttttctatggtgcaatgatatcagaaggaattatagctcttatttgggctgctgctgcaatgtcattcttcggtggaatacctcaacttgctgaagcaggaactgctgctgttgttgttaataaaatatctgttggaattttaggaaaagctggaggtgttttagcactattaggagttgttgcttgtcctataacttctggggatactgcgtttagaagtgcaagacttactattgctgactctttaaaatataaacaaggacctgttgtaaatagatttgttgttgcaattcctctatttgttgttggaattgtattatgttttacaccatttgatgttatttggagatactttggttgggcaaaccaaactcttgctacaatagctctatgggcagcagtaaaatatttggcaaacagaggaaaaaattattggatagctttaattcctgcaatgtttatgacagttgttgtaacttcttatatacttgcagcaccagaaggatttgtaagattctttggagataaagatataaaagtaatagaacatattgcaatagcagtaggttgtgtagtatctttaggatgtacagctgcattctttatgtcaaataaaaaaactgatttaattactgaatag

SEQ ID NO: 36463 - protein, 474 aa, Fusobacterium nucleatum subsp. nucleatum ATCC 25586
MYSFIGSIIALVLGYFIYGKFVEGVFGIDTSRETPAKRLADGVDYMEMSWPKAFLIQFLNIAGTGPIFGAVAGALWGPAAFIWIVFGCIFAGSVHDFLIGMMSLRKDGASVSEIVGENLGMTAKQIMRIFSVILLLLVGVVFIMSPAQILTNITGVNYTVWLGVIIIYYLCATVLPIDTIIGKIYPIFGLSLLVMAFGIGGGLIINNANIPEIAFVNMNPAGRSVFPYLCITIACGAISGFHATQSPMMARCLKTEKEGRRVFYGAMISEGIIALIWAAAAMSFFGGIPQLAEAGTAAVVVNKISVGILGKAGGVLALLGVVACPITSGDTAFRSARLTIADSLKYKQGPVVNRFVVAIPLFVVGIVLCFTPFDVIWRYFGWANQTLATIALWAAVKYLANRGKNYWIALIPAMFMTVVVTSYILAAPEGFVRFFGDKDIKVIEHIAIAVGCVVSLGCTAAFFMSNKKTDLITE

SEQ ID NO: 36464 - DNA, 1440 bp, Methanosarcina acetivorans C2A
  CDS (1)..(1440): transl_table=11
atgatcagtttcctgctttctctagccgcacttgtgctgggttatttttcttatggtgcgtttgtcgaaaaagtatttggcgctgatccctcgcgaaggacacccgcacacacccgggaggatggtattgattttgttcctctcagctggcgcagcacgttccttatccagtttctcaacattgctggcttaggccctatatatggagctattctgggagctttatacggtccggctgctttcctgtggattgtcctgggcagtatttttgcaggcggggtgcatgattatttttcaggaatgttgagtgtccgtcatgaaggaaagagcatttctgagattgtggggatatacttaggcagccagatgaagagtggaatgattgcattttccgtcattttactcgtacttatagggacggtgttcatgtccggaccggcagtacttctggcaaatctggggttcccagggctgctggcccaatcgaatttctggctggctattattctcttttattacttcgtggctactgtcgttccaatcgacaggatcataggccgtatttatcccttattcggagctgtcctgttgattatggcatcaggtatcggctccatgctcctcatcaaaggatacgagatccctgaaataaccttcaggagtttccatcctgacggtcttcctctgtggcctatgcttttcataaccatcgcctgcggagccgttagcgggttccactcaacccaatcccctataatggcccgatgtctgcccgatgaaaaatatggcagacgtattttttacggtgccatgatagcagaaggggctatagcccttatctgggccgctgctgcaatgtctttctttccgggaggaatagccggccttagcgaagttaccggtgcaggaggtgctgctctggtcgtaaagaatgtgtcactgggtctgcttggatccgtgggaggaattctcgctatcctgggggttattgcctgccccatcacatccggagatacggccttcaggagtgcacgtctgaccatagctgatgcgatgagcctggaccagcgacctttaaagaacagattaacgatagctctcccaatctttgccatagggtttagtctgacccttatcgatttcagcatagtctggcgttacttctctttttcgaaccaggcactggctaccatagtcctctggacatctgcggtatatctgtcagataacgacaaatttcactggatcgctaccctccccgctacatttatgacagccgttgtaacaacgtacatcttacaggcttctgaggggttcggcttaccagccactgtctcttatcctgcaggagtagtctgtgcagccgcagcctgtggattatttgccacctttttaaggaaaagatctctatcatcagcttactcggtgagtgaacaatga

SEQ ID NO: 36465 - protein, 479 aa, Methanosarcina acetivorans C2A
MISFLLSLAALVLGYFSYGAFVEKVFGADPSRRTPAHTREDGIDFVPLSWRSTFLIQFLNIAGLGPIYGAILGALYGPAAFLWIVLGSIFAGGVHDYFSGMLSVRHEGKSISEIVGIYLGSQMKSGMIAFSVILLVLIGTVFMSGPAVLLANLGFPGLLAQSNFWLAIILFYYFVATVVPIDRIIGRIYPLFGAVLLIMASGIGSMLLIKGYEIPEITFRSFHPDGLPLWPMLFITIACGAVSGFHSTQSPIMARCLPDEKYGRRIFYGAMIAEGAIALIWAAAAMSFFPGGIAGLSEVTGAGGAALVVKNVSLGLLGSVGGILAILGVIACPITSGDTAFRSARLTIADAMSLDQRPLKNRLTIALPIFAIGFSLTLIDFSIVWRYFSFSNQALATIVLWTSAVYLSDNDKFHWIATLPATFMTAVVTTYILQASEGFGLPATVSYPAGVVCAAAACGLFATFLRKRSLSSAYSVSEQ

SEQ ID NO: 36466 - DNA, 1797 bp, Thermoanaerobacter tengcongensis MB4
  CDS (1)..(1797): transl_table=11
atgaatggcttaacactagtaatcatcacactaagcgtctacgccctggcataccgcttttatggagcatggatcggagcaaaaattttagcatttgatgaaaacaggacaactcctgcatacaggcttgaaaatggctacgattacgtgccaacaaacaaatgggttttatttggtcaccactttgcagcaatagcaggagcaggtcctcttgtaggtccagtgctcgctgcccagtttggataccttccaggagcattatggattttaatcggagccgtcctggcaggagcagtccatgacatggtaatactgtttgcatcagtccgatatgatggttcctccataatagacattgcaagaaaagaagtaggcaaagtatcaggtatagctacagctatagcagttctatttatacttgttcttgcaatggcaggacttgcactagttgtagtaaacgctttatacaacagcccgtggggtacttttacagtagcagctacaattttaatagcaatgtacatgggaattcacatgaagtatataagaaaggacgacatagtaggagctacaataataggcgttatactgcttgtattgtctgttatagcaggaccttatgttgaaaagacagcgttagggcatttcctcactttcaatgccaagcaaatgacagtgattttagcaacctacggttttgccgctgcagttttacctgtatggctgttacttgtgccaagagattacctcagcacttatctaaaattaggcgttatggcacttcttgctataggagttataattgtaaaccctgaaataaggatgcctgcaattacacagtatgtagctggaggaggtcctataatccccggaaaggtatggccttatgtgtttataacaatcgcctgcggtgcgatttcaggtttccactcgctaatatcttctggaacaacacctaagatgatcaaaaatgaaaaagacattctacctgtcgcatacggagcaatgctggcagagggctttgtcgcaatgatggccttgattgctgcaacaagcttaataccagccgactacttcgctataaacgttcccccgcaagtgtttgaaaagttaggaatgcatccagtcgagcttcaacacctctctcagatggtgggagaaaatgtcgcaggaagacctggcggcggagtgacactggcagttggaatgacttatatatttgaaaaaataccatggatagcccatttgagctcctacatctatcactttataatattgtttgaagctctattcatactgactacaatagacgccggaacaagagtagggagatacctcttgcaggaagcaggtggcttaatttacaagccttttgcagatagaaactggtggccaggaataataatcacaagctttttaatctccttctcctggggctaccttgtttacggaggaagtgtatctacaatctggcctatatttggagcttctaaccagctgcttgcaggaatagcactggcactgggtacaactgttataattaaaaaaggcaaagcccagcacgcatgggtgacatttgtgccattcctgtttgtgtcaattactactctatatgcaagttatttaaatattgtaaataactacctaccaaaaggaaattgggtactagtaattctctctgcagcagtaatgatattagccatcacaataatagtagactccttcatcaagtggtacaaatggctggttactgataaactcacaaaagagcagattgaagcaagcgtatttaattaa

SEQ ID NO: 36467 - protein, 598 aa, Thermoanaerobacter tengcongensis MB4
MNGLTLVIITLSVYALAYRFYGAWIGAKILAFDENRTTPAYRLENGYDYVPTNKWVLFGHHFAAIAGAGPLVGPVLAAQFGYLPGALWILIGAVLAGAVHDMVILFASVRYDGSSIIDIARKEVGKVSGIATAIAVLFILVLAMAGLALVVVNALYNSPWGTFTVAATILIAMYMGIHMKYIRKDDIVGATIIGVILLVLSVIAGPYVEKTALGHFLTFNAKQMTVILATYGFAAAVLPVWLLLVPRDYLSTYLKLGVMALLAIGVIIVNPEIRMPAITQYVAGGGPIIPGKVWPYVFITIACGAISGFHSLISSGTTPKMIKNEKDILPVAYGAMLAEGFVAMMALIAATSLIPADYFAINVPPQVFEKLGMHPVELQHLSQMVGENVAGRPGGGVTLAVGMTYIFEKIPWIAHLSSYIYHFIILFEALFILTTIDAGTRVGRYLLQEAGGLIYKPFADRNWWPGIIITSFLISFSWGYLVYGGSVSTIWPIFGASNQLLAGIALALGTTVIIKKGKAQHAWVTFVPFLFVSITTLYASYLNIVNNYLPKGNWVLVILSAAVMILAITIIVDSFIKWYKWLVTDKLTKEQIEASVFN

SEQ ID NO: 36468 - DNA, 2073 bp, Xanthomonas axonopodis pv. citri str. 306
  CDS (1)..(2073): transl_table=11
atgaaagggttctcgaagctggcctggggcgcgttggcgctgctggccgcgttctgcctgggtaccgttgcgctgcggcgtggcgagcacatcaacgcgttgtggatcgtggtggcggcggtatcgatctacctgatcgcctaccggttctacagcctgttcatcgccgacaaggtgatgcagctggacatcacccgcgccaccccggcagtcgccaacaacgacggcctggattacgtgcccaccaacaagcacgtgctgttcggccaccactttgctgccatcgccggcgccggccccctggtcggcccggtactcgccgcgcagatgggctacctgcccggcctgctgtggctggtggtcggcgtggtgttcgccggtgcggtgcaggacttcgtggtgctgttcctgtccagccgtcgcaacggccgctcgctaggcgacctggtgcgcgaggagatgggccaggtgcccggcaccatcgccctgttcggcgcattcctgatcatgatcatcatccttgccgtgctggcgatggtggtggtcaaggcgctggcggaaagcccgtggggcatgttcaccgtcatcgccacaatgcccatcgcgctcatgatgggcgtgtacatgcgctacatccgcgtcggcaagatcggcgagatctcggtggtggggttgatcctgctgctgggcgcgatctggctgggcggcaaggtggcggcggacccgacctggggcccggccttcaccttcactgccaagcagatcacctggatgctgatcggctacggcttcgtcgcatcggtgctgccggtgtggctgctgttggcaccgcgcgactacctgtccaccttcctcaagatcggtaccatcctggcgctggcgatcggcatcctggtggtcatgccggacctgaaaatgccggcgctcacgcaattcgcctccaccggcgatggcccggtctggaagggcggcatcttcccgttcctgttcatcaccattgcctgcggcgcggtctccggcttccatgcgttgatcgcttccggcacgacgcccaagctgctcgccaatgaaggccacatgcgctacatcggctatggcggcatgctgatggaatcgttcgtggcgatcatggcgctggtggccgcgtcgatcatcgagccgggcatctacttcgccatgaacagccctgcctcgctggtcggcagcgacactgtcgcagtcgctgccaagatcagcgagtggggcttttcgatcacaccgcaggtgctcgaggccacggcacgcgatatcggcgagcacagcatcctggcgcgcgccggcggggcaccgacgctggcggtgggcatcgcgcagatcctgcaccagttgctgccgggcgaagacaccatggcgttctggtatcacttcgccatcctgttcgaagcactgttcatcctgaccgcggtggacgccggcacgcgcgccggccgcttcatgctgcaggacctgctgggcaacttcatcccggcgttgaagaagaccgagtcgtggaccgccaatatcatcgccaccgccggctgcgtggcgctgtggggctatctgctctacaccggcgtgatcgatccgttcggcggcatccagaccttgtggccgttgttcggcatctccaaccagatgctggccgggatcgcgttgatgctgggcgcggtggtgctgttcaagatgaagcgcgaccgctacgcgtgggtcaccatcgtgccggcgctgtggctgttgctgtgcaccacctatgcggggctgatcaagatcttcgacagcaacccggcgcagggcttcctggcacaggcccacaagttccaggcggccatcgccagcaacaccatcactgcgccggccaagacggtgccgcagatgcagcagatcgtcaccaatgcctacgtcaacaccgggctgaccgtactgttcctgttcgtggtcggctcgatcctgatctattcgatcaagacgatcgtggcggcacgccgcaacccgcagcgcactgaccgcgaaaccccgtacgtggcgttgcagccgcaccagatggcagacctgtaa

SEQ ID NO: 36469 - protein, 690 aa, Xanthomonas axonopodis pv. citri str. 306
MKGFSKLAWGALALLAAFCLGTVALRRGEHINALWIVVAAVSIYLIAYRFYSLFIADKVMQLDITRATPAVANNDGLDYVPTNKHVLFGHHFAAIAGAGPLVGPVLAAQMGYLPGLLWLVVGVVFAGAVQDFVVLFLSSRRNGRSLGDLVREEMGQVPGTIALFGAFLIMIIILAVLAMVVVKALAESPWGMFTVIATMPIALMMGVYMRYIRVGKIGEISVVGLILLLGAIWLGGKVAADPTWGPAFTFTAKQITWMLIGYGFVASVLPVWLLLAPRDYLSTFLKIGTILALAIGILVVMPDLKMPALTQFASTGDGPVWKGGIFPFLFITIACGAVSGFHALIASGTTPKLLANEGHMRYIGYGGMLMESFVAIMALVAASIIEPGIYFAMNSPASLVGSDTVAVAAKISEWGFSITPQVLEATARDIGEHSILARAGGAPTLAVGIAQILHQLLPGEDTMAFWYHFAILFEALFILTAVDAGTRAGRFMLQDLLGNFIPALKKTESWTANIIATAGCVALWGYLLYTGVIDPFGGIQTLWPLFGISNQMLAGIALMLGAVVLFKMKRDRYAWVTIVPALWLLLCTTYAGLIKIFDSNPAQGFLAQAHKFQAAIASNTITAPAKTVPQMQQIVTNAYVNTGLTVLFLFVVGSILIYSIKTIVAARRNPQRTDRETPYVALQPHQMADL

SEQ ID NO: 36470 - DNA, 1485 bp, Streptococcus agalactiae 2603V/R
  CDS (1)..(1485): transl_table=11
atggtaacatttttaggaggggtagcccttttaattgttggttatttcacgtacggtagatacattgaaaagaattttcaaattgatgaaaatcgccaaacacctgcagaagcattaagggatggatatgattttgttcctatgccaaaatggaagaatgggatgattgagttattgaacatcgcaggaaccggacctatctttggccctattttaggagcactctatggtccagttgcttatatctggatagtcttaggatgtatttttgcaggggctgttcatgattatatgattggaatgatttctcttagaaataatggtgcatatcttcctgaattagctagtcgctatcttggaaagtcaatgaagcatgtgatcaacattttttcaatgctattacttattttagttgcaaccgtatttgtggtaactccagctaatcttatcctaagtattttaccagctgggacactatctttaccttggataatcggtcttattttcgtttattaccttatttctacagtcttacctattgataaagcacttggtaaagtttatcctgtattctgcgtcatcttaatggttagtacggcagcagttggcttccgtttattaactggtggctttgatatgccaaacttaacttttgaaacctttaaaaatatgcatccagctgggcttgggatattccctgctttattctttaccatttcatgtggagccatctctggtttccatgctacccaagcacctatggtctcaagaacaactgttaatgagagagaagggcgtttcactttctacggcatgatgattgcagaaggagtaattgcgatgatttgggcaggtgcttcaatgagcttgttcaaaggtcaaaatctctatgaaatgattgctgctgggacaccttctgcagttgtcaatcaagtaatgttaatgttactcggtagtgtaattggaactatcgctatcattggtgttattgttctccctgtttcatctggtttatcagctttccgtagcttacgtactatcgttgctgattatatccatgtcaaacaagatactcttccaaaaatctttgctgtaactatcccattatatgttatttcatttgtccttacacacgttgattttaatctcctatggcgttactttaactgggcaaatcaagtaactgctgttattggtttattagttgctacaagatatctcatcctaaaaagacgaaattattgggtaacatttgtaccagctatgttcatgttgtatgcagtagttgtttatattttatctcaaccaattggatttaatatgggcttaggcatcttaacttattcacttgctttagtgttaacaggtattcttgttggacttttctggaaatctggtcaaaaacaattaaaaactgttcatcctgaagcattcctgtttaacgatcatagaccaattaattattacagtagtttagattcttaa

SEQ ID NO: 36471 - protein, 494 aa, Streptococcus agalactiae 2603V/R
MVTFLGGVALLIVGYFTYGRYIEKNFQIDENRQTPAEALRDGYDFVPMPKWKNGMIELLNIAGTGPIFGPILGALYGPVAYIWIVLGCIFAGAVHDYMIGMISLRNNGAYLPELASRYLGKSMKHVINIFSMLLLILVATVFVVTPANLILSILPAGTLSLPWIIGLIFVYYLISTVLPIDKALGKVYPVFCVILMVSTAAVGFRLLTGGFDMPNLTFETFKNMHPAGLGIFPALFFTISCGAISGFHATQAPMVSRTTVNEREGRFTFYGMMIAEGVIAMIWAGASMSLFKGQNLYEMIAAGTPSAVVNQVMLMLLGSVIGTIAIIGVIVLPVSSGLSAFRSLRTIVADYIHVKQDTLPKIFAVTIPLYVISFVLTHVDFNLLWRYFNWANQVTAVIGLLVATRYLILKRRNYWVTFVPAMFMLYAVVVYILSQPIGFNMGLGILTYSLALVLTGILVGLFWKSGQKQLKTVHPEAFLFNDHRPINYYSSLDS

SEQ ID NO: 36472 - DNA, 1734 bp, Oceanobacillus iheyensis HTE831
  CDS (1)..(1734): transl_table=11
ttgaatgctatcgttgttgctctaattggtattgttatctttatattgggttatcgttattattctaagtttgttgcagaaaagatttttcggttagacccaaactatgttactcctgcacatcgctataaagatggtgtggattatgttccgacaaataagtttgttttgtgggggcatcattttacttctgtagcaggtgcagctccaatactcggtcccgcaatcgcaatctattggggatggttaccagcttttctatgggtagtattaggtacggtatttgcagcaggagttcatgatttcgggactttagcattgtctgtccgcaataaaggatattctgtcggtaccattgccgataagttaatcggtagaaaagggaagctattatttttatttattatattaatattagttttaatggtaaatgcagtatttgcatgggtaatttccaatttatttattagttatccatctagtgttttgccagtgtttattcaaataccgctagcaatctggattggatacgctgcttataaacgaagtaaaaaaatgttaatcccttctctagttgcactcgctatcatgtatttaacggcaattttagcaagtagatttgactttttacaaattgatcttgtgcgttttatgggtggagaagatggagcagggttgtttgggttaggaagtgtatcaacggcatttttaatttggattgttattctaatggtttatgtgtatattgcttcgacattgccggtatggaaattactacaaccgagagattttattaattcacatcagttagtagtaggactaggtattctttatttagggcttattttcacaaatcctagtatttcagctccagctattaatgagagcccagataaaagtctattgccgttactatttattaccatagcatgtggggctatttccggttttcatgggctggtatcttctggtacatcatcgaagcaattaaataaagaaacagatgcaagattcgtaggttattttggggctgtaggtgaaggagtacttgcacttgtatctatacttgcggtaggaacgttatttgcaaatacagatgcattttctcaagcgtatgcatcattttcagacgcaaacgcaattggactaggaaattttgttgaaggtgcagctaatctggcacaaggattatggataccaactgaaatagctacaacaatagtttctatcatagttgttagctttgcagcgacaacattagatacatccgtacgccttatgcgttatattattgcagagttaggtattgaatataatattaagccattaacaaaaacacatgttgctacctcggtagccgtgttatccagtacagctctagttctgattccagaagggccgaatggatttgggtctggtggttatctcatatggccattatttggtactgcaaaccaactcctagcagcgataagtttattccttatttcgatttggttaaaacgtagaggaagtaactatctcgtcacactcattccgatgattttcgttatatttatgaccttatatgcgatgttccaacaagtattctttgagtggtcttggtttggaagcggatcaaatatgttattatttgtattaggagcaatcatttttgtatttgctatttggattgctttaaccgcctttcatgaattaacgaaaaaacaagatgatccattcgatagagaataa

SEQ ID NO: 36473 - protein, 577 aa, Oceanobacillus iheyensis HTE831
MNAIVVALIGIVIFILGYRYYSKFVAEKIFRLDPNYVTPAHRYKDGVDYVPTNKFVLWGHHFTSVAGAAPILGPAIAIYWGWLPAFLWVVLGTVFAAGVHDFGTLALSVRNKGYSVGTIADKLIGRKGKLLFLFIILILVLMVNAVFAWVISNLFISYPSSVLPVFIQIPLAIWIGYAAYKRSKKMLIPSLVALAIMYLTAILASRFDFLQIDLVRFMGGEDGAGLFGLGSVSTAFLIWIVILMVYVYIASTLPVWKLLQPRDFINSHQLVVGLGILYLGLIFTNPSISAPAINESPDKSLLPLLFITIACGAISGFHGLVSSGTSSKQLNKETDARFVGYFGAVGEGVLALVSILAVGTLFANTDAFSQAYASFSDANAIGLGNFVEGAANLAQGLWIPTEIATTIVSIIVVSFAATTLDTSVRLMRYIIAELGIEYNIKPLTKTHVATSVAVLSSTALVLIPEGPNGFGSGGYLIWPLFGTANQLLAAISLFLISIWLKRRGSNYLVTLIPMIFVIFMTLYAMFQQVFFEWSWFGSGSNMLLFVLGAIIFVFAIWIALTAFHELTKKQDDPFDRE

SEQ ID NO: 36474 - DNA, 1425 bp, Oceanobacillus iheyensis HTE831
  CDS (1)..(1425): transl_table=11
atgataacactatttacagcgattattttattaattattgcatattttacgtatggaaaatttatagaaaagttatttggaccgtcagataagagacaaactccagcagtatcacagaatgatggagtagattaccttccaatgcataaacaaaaaaatgctttaattcaattattaaatattgccggtacaggaccaatattcggacctattatgggggctttatttggaccagttgcttttttatggattgtcattggatcaattttcgcaggagcggtgcatgactatttaactggtatgatttctatacgaaatcgtggtgcacacatcccgcaacttgcaggaaagtttttaggaagcttttcaaggcatattgttaatgctttttctcttcttttattaatcttagttggaaccgttttcttaactactccagcttcattgattgatattttactagatggacaagttgcatttatatatatattagcagctattttactctattactttctatcaacgatcttaccaattgataaaattattggtagaatttatcccttttttggagcaatcttattaataggaacagtgttaattggtgtagctctagtattctcggattataaaataccggaactgacaattcaaaatatgcatcctgataacttaccaattttccctatattattctttacgattacctgtggggctttatctggattccatgcaacacaatctccaattatatccagaacaacccaaaaagaatcacaggggagatatatattttatggaatgatgattgcagaaggaattattgcaatgatttgggcagcggcagcgatgagtatttttgatggccaaacactaagtcaagttattgcagaaggaacagcttcagcagctgttagtgaaattgctattactttactaggtgctgttgcgggtacgatagcggtaattggtgtgattattttacctattacttcaggggacacggcatttcgtgcagcaagaactattattgcggactatttaaatattaaccaaaagaaagttgctaatcgtctcatgattgctatgccattattcgttatcgcctacttcttaactacgattgattttaatgtgctatggagatatttctcttgggcaaaccaagcaacagcaatgcttgcattatggattgcaacaatgtatctctatgtaaaagggaaaaacttcttcgtatccatggtaccagccatttttatgacatacatggttcttgtatatatccttaatgcgaagattggattccaattagatttgaatatatcctttataattggacttgtattaacagtaatcttaaccatattattctttattaaagcaaaaagtaataaaaagaataaccttcaagtagacatggagtaa

SEQ ID NO: 36475 - protein, 474 aa, Oceanobacillus iheyensis HTE831
MITLFTAIILLIIAYFTYGKFIEKLFGPSDKRQTPAVSQNDGVDYLPMHKQKNALIQLLNIAGTGPIFGPIMGALFGPVAFLWIVIGSIFAGAVHDYLTGMISIRNRGAHIPQLAGKFLGSFSRHIVNAFSLLLLILVGTVFLTTPASLIDILLDGQVAFIYILAAILLYYFLSTILPIDKIIGRIYPFFGAILLIGTVLIGVALVFSDYKIPELTIQNMHPDNLPIFPILFFTITCGALSGFHATQSPIISRTTQKESQGRYIFYGMMIAEGIIAMIWAAAAMSIFDGQTLSQVIAEGTASAAVSEIAITLLGAVAGTIAVIGVIILPITSGDTAFRAARTIIADYLNINQKKVANRLMIAMPLFVIAYFLTTIDFNVLWRYFSWANQATAMLALWIATMYLYVKGKNFFVSMVPAIFMTYMVLVYILNAKIGFQLDLNISFIIGLVLTVILTILFFIKAKSNKKNNLQVDME

SEQ ID NO: 36476 - DNA, 2400 bp, Bifidobacterium longum NCC2705
  CDS (1)..(2400): transl_table=11
atgaccaccgccgcagcccaggccccggcacctggcaagttggaattcaaggacgattacacgccggacgaagccgaacgtgtgattcgcaattcgaagggactgcccgtaggcgtgcgtcccaaaatggtatggacatggaagaaggccctgctgtgggccgccatcgccatcgtatgtgcctgcggatgggcgattctggccgtctcgcgcggtgagcagatctccgccatctggttcctggtcgtggcgctgagctcctacgccatcgcctaccgcttctatgcctattacatccagatcaagatcatgcgcaccgacgacgcgaacgccaccccggccgagcgcgtgcatgacggcgcgaacttcgaacgcaccgaccgccgcgtgctcttcggccagcactttgccggcatctccggcgccggaccgctcgtcggcccgatcctggccgcgcagatgggctacctgccctccactctgtggatcatcctcggcgtgattttcgccggcgccgtgcaggacatgctggtgctgtggatctccgccaagcgccgcggtcgctctctgggccagatggccactgatgaaatgggtaagttcggcggtatgatcctatccatcttcctcgtggtgatgaccgccatcgccatggcatttctggcgctcgtggccatcaaggccatggccgcctcgccgtgggccgtgttctccatcggtatgaccatcccgatcgccctgatcatgggctgctaccagcgtttcctgcgccccggccgtgtcattgagaccacgctgctcggtttcgtgctgctcgtgctcgacatcgtcgccggcggatggatcgcctctatcccggccgtggccgccgtgttcacactggacgccaagcagctcgtcatcgccctggtgatctactcgttcgccgccgccgcgctgccgcactggctgctcgtcaccccgcgcgactacctgtccacgctgatgaagatcggcacgctcgtgctgctcgtcatcggcatcatcatcgccaacccgtccgtcaaggtgccgggtctgaccgaactggcctccacctccaccggcccgaccttctccggcaacctattcccgttcctgttcatcaccatcgcctgcggcgccctctccggcttccacggcgcggtgagctccggcctgaccccgaaggccgtggagaaggagaaccagattcgcatgatcggctacggttcgatgctcgtcgaatcgttcaccgccgtcatcgcgctgatcgccgcgatcaccatctcgcagggcgtgtacttctccaccaacatgtccgccgcacagatcaccgccgcatccggcgtgagcatctccgccacctccacgccgggcgaacaggccgatgccgccgtcaaggccgtggagtcgatgaaggtctccgacatcgaaggcaaccagatgcaggtcacctgggattccgtggacgagaacggcgcggccaagacctacgaaggcgccgcggcgcttgagcaggccgccgccgacatcggcgagacctccatcgtctcccgcaccggtggcgccaccacgttcgccatgggcatggccaacttcctcaagtcctacctgggcggccacgactcgatggccttctggtaccacttcgccatcatgttcgaagccctgttcatcctgaccaccgtggacaacggcacccgcgtggcccgctaccaaatcggcgaaatgctcggcaacgtgcgcaagctcaagaagttcgccgacccgacctggaagcccggcaacatcatcaccacgctgatcgccaccgcgctgtggggcggactgctgtggatgggcgtgtccgacgcgaacggcggcatcaacgcgatggtgcctatcttcggcatctccaaccagctgctcgccgccgcctgcttcgtgctgatcaccgtgtgtgtggccaagatgggctactggaagcacctgtggataccggtggtaccgctcgtgtgggacatcgccgtgaccttcaccgccgacttccagaagatcttcgggccgctgagctacttcaccaccgcctccaagtatcaggcgcagatcgactccggcgagctgaccggcgaggcgctgaccaacgccaaggccgcgctgtccaacgcgtatctggacggcgtgctctccgtgttcttcctggtcatgatgggcgtcttcgtggtagtcggcatcgtggtcgtggcgcgcacgttcgccgctggcaagtacggtgccgaaacgacgtccgaggagccgttcgtggaatcccagtggttcgcgccctccagcctggtcgccaccgcgcttgagaagaaggtgcagcgcgaatacagcgccaagctgcatgagcttgtgcggaacgggcaggttgcagcgtag

SEQ ID NO: 36477 - protein, 799 aa, Bifidobacterium longum NCC2705
MTTAAAQAPAPGKLEFKDDYTPDEAERVIRNSKGLPVGVRPKMVWTWKKALLWAAIAIVCACGWAILAVSRGEQISAIWFLVVALSSYAIAYRFYAYYIQIKIMRTDDANATPAERVHDGANFERTDRRVLFGQHFAGISGAGPLVGPILAAQMGYLPSTLWIILGVIFAGAVQDMLVLWISAKRRGRSLGQMATDEMGKFGGMILSIFLVVMTAIAMAFLALVAIKAMAASPWAVFSIGMTIPIALIMGCYQRFLRPGRVIETTLLGFVLLVLDIVAGGWIASIPAVAAVFTLDAKQLVIALVIYSFAAAALPHWLLVTPRDYLSTLMKIGTLVLLVIGIIIANPSVKVPGLTELASTSTGPTFSGNLFPFLFITIACGALSGFHGAVSSGLTPKAVEKENQIRMIGYGSMLVESFTAVIALIAAITISQGVYFSTNMSAAQITAASGVSISATSTPGEQADAAVKAVESMKVSDIEGNQMQVTWDSVDENGAAKTYEGAAALEQAAADIGETSIVSRTGGATTFAMGMANFLKSYLGGHDSMAFWYHFAIMFEALFILTTVDNGTRVARYQIGEMLGNVRKLKKFADPTWKPGNIITTLIATALWGGLLWMGVSDANGGINAMVPIFGISNQLLAAACFVLITVCVAKMGYWKHLWIPVVPLVWDIAVTFTADFQKIFGPLSYFTTASKYQAQIDSGELTGEALTNAKAALSNAYLDGVLSVFFLVMMGVFVVVGIVVVARTFAAGKYGAETTSEEPFVESQWFAPSSLVATALEKKVQREYSAKLHELVRNGQVAA

SEQ ID NO: 36478 - DNA, 2106 bp, Leptospira interrogans serovar Lai str. 56601
  CDS (1)..(2106): transl_table=11
atgcttcctttaattgcagtccttgtatgttttctagtttattttctcggatataaattttactcgggttatatttctaaatctatctttgatttaaaaaacggtctaaacgatactcccgctcataaactaaacgacggggtagattatcttcctacaaaaccagtcgtattatttggccatcattatgcgtccattgccggattggctccagtgcttggacctgcggtagcagtaatttggggttggcttcctgcaatgctttgggttgtatttggaagtatttttgtgggttgtgtgcatgattttggagcgcttgtagtttcggttcgcaatcaaggaaaaagtatcggtcaagtggcggaagatcttttaggtcaccgagctagaagtttgtttcacgcgatcattttctttttagtttcattggcaatgggagtttttgttcttgtacttgcggaaatgttttctgcggatccaaaggtggacctatttccttctctaaacacggctgataaaataattccttctataaaaaattctagagatcagaatgttttaaaacaaccaagttctttaatcttaaaagaagaagaaaaacaacgtgcttctgtaaactcagcgtctcatacggtcacgaaagaaaaaaaatctagttccgtgacgacttcgaaacataaatcaatttcggataacgtatattctaattctattgatttaaagaagaaatctactttaacaaactccacccaagcacaaaattctacgattacaaattctgaaaccgcaaacgaaaaagttcaccatcaccctggagaaatcagaacggaagaaaaaccatccatccggttgagaagtcattttccggaagcggtcattccatctgcggtgattatgattcttgcagtaattatgggatatttacattacaaaaaaggaatgaatttaactcctcttactgtgtttagcgtatttggaacgttaggttccatgatcttaggaatgcaagattcagttctttcttggaccggactcaatcatgtagaaacttctccttctaccggaacttggaaatacatacttttattttatgcgtttttagcttcggtaactccggtctggttgttactacaaagtagggactatattaattctttcttattgtatttaggaattgtattgatttatctaggattttttacggggggaattttacaaaactttcattcttttaacgcggaagtaatacgaactacaacgatcggactcgatttgattccattcgtatttattacgattgcttgtggagcggtttctggatttcacgcgttagtcagttcgggaactactgctaaacaattggataaagaaacagacgcaagaccaatcggttatggaggaatgatcggagaatcattgcttggtttgtctgctgtgattgcgtgtacgataggatttacttcttcggaagaatggtctggtttttatcgttcttggtctggtatacaaggtttggctccacaagtaggggcttacatttatggaaccggaagatttttactgcaaataggaattccagaaactttcggacaaggatttattgcactcatcgtaatcagctttgcattgacttctttggattcagctacaagacttcttagatacaacatcgaagagattgcagaatcaactcgtatttcttggattcaaacttttgtaggaaacagatatgtttccagtctaatcgcttgtattgcgataggattctttgcgtttttagaaattgaacaagatggaaaaaagaaacctgcaggacttgcgctctggaaactttttggaacaacgaaccagctactagccgggcttgcacttttggtagtaactattttccttttaaagttgaagaaaaaaatcaaagtttcttttataccgatgttattcgtattatcagtgactctttgggctatgatcaaaaactttttagattttttaaccggaccttctcccaatttgcttcttgctacggtaggagggaccttgatcttcttgacactttggttattgttggaagcggtattaacttggaatcgcattagaaaagtatga

SEQ ID NO: 36479 - protein, 701 aa, Leptospira interrogans serovar Lai str. 56601
MLPLIAVLVCFLVYFLGYKFYSGYISKSIFDLKNGLNDTPAHKLNDGVDYLPTKPVVLFGHHYASIAGLAPVLGPAVAVIWGWLPAMLWVVFGSIFVGCVHDFGALVVSVRNQGKSIGQVAEDLLGHRARSLFHAIIFFLVSLAMGVFVLVLAEMFSADPKVDLFPSLNTADKIIPSIKNSRDQNVLKQPSSLILKEEEKQRASVNSASHTVTKEKKSSSVTTSKHKSISDNVYSNSIDLKKKSTLTNSTQAQNSTITNSETANEKVHHHPGEIRTEEKPSIRLRSHFPEAVIPSAVIMILAVIMGYLHYKKGMNLTPLTVFSVFGTLGSMILGMQDSVLSWTGLNHVETSPSTGTWKYILLFYAFLASVTPVWLLLQSRDYINSFLLYLGIVLIYLGFFTGGILQNFHSFNAEVIRTTTIGLDLIPFVFITIACGAVSGFHALVSSGTTAKQLDKETDARPIGYGGMIGESLLGLSAVIACTIGFTSSEEWSGFYRSWSGIQGLAPQVGAYIYGTGRFLLQIGIPETFGQGFIALIVISFALTSLDSATRLLRYNIEEIAESTRISWIQTFVGNRYVSSLIACIAIGFFAFLEIEQDGKKKPAGLALWKLFGTTNQLLAGLALLVVTIFLLKLKKKIKVSFIPMLFVLSVTLWAMIKNFLDFLTGPSPNLLLATVGGTLIFLTLWLLLEAVLTWNRIRKV

SEQ ID NO: 36480 - DNA, 2067 bp, Pseudomonas putida KT2440
  CDS (1)..(2067): transl_table=11
atgaacaacaataatagcctgctacgccatattccgtggctggcgctggcagtcataggcgcctgcgcactgggtgtggttgccctgcgtcgcggcgaggcgatcaacgccttgtggatcgtggtcgcggcagtggccatctacctggtcgcctatcgttactacagcctgttcatcgccaccaaggtgatgcaactcgacccgcgccgtgccaccccggcggtgctcaacaacgacggcctggactacgtcccgaccaacaaacacattcttttcggtcaccacttcgctgccatcgccggcgcaggccccttggtcgggccggtactcgccgcgcaaatgggctacctgcccggcacgctctggctgatcgccggcgtggtgctggccggtgcggtgcaggacttcatggtcctgttcctgtctacccgccgcaacgggcgctcgctgggcgacatggtgcgcgaggaaatgggcagaatcccgggcaccatcgccctgttcggctgtttcctgatcatgatcatcatcctcgcggtgctggcgttgatcgtggtcaaggccctggccgaaagcccatggggcatgttcacggtgatggcgaccatcccgatcgcgatgttcatgggcatctacatgcgctacatccgtccgggccgtattggcgaaatctcggtcgttggtgtggtactgctgctggcctcgatctggctgggcggcgtgatcgctgcggacccggtgtggggcccggcgttcacgttcaccggcgtgcagatcacctggatgctggtgggctacggttttgtcgccgccgtgctgccagtgtggctggtgctggcgccgcgtgactacctgtcgaccttcctcaagatcggcacgatccttggcctggccatcggtatcctgatcatcgcacctgagctgaaaatgccggcgctgacccagttcaccgacggtacgggcccggtgtggaagggtaccctgttcccgttcctgttcatcaccattgcctgtggtgcggtgtccggcttccacgcgctgatttcctcggggaccacccccaagctgctggataacgaaaccaacgcccgctatatcggctacggcggcatgctgatggaatcgttcgtcgccatcatggccatggttgcggcctcggtgatcgaaccgggcgtgtacttcgccatgaacagcccggcggcagtggtcggtaccgatgtcgcgtcggtggcgcagactgtcagcagttggggcttcctgattacacccgagcagctcgaagccgttgcccgtgacatcggcgagcacaccatcctggcccgtgccggcggtgcgccaaccctggcggtcggtatcgcgcagatcctgcaccaggtgttgccaggtgaaaacaccatggccttctggtaccacttcgcgatcctgttcgaggcgctgttcattctcacggcggtagacgctggtacccgtgccgggcgcttcatgctgcaggacctgctgggcagcttcgtgcctgcgctcaaacgcaccgaatcgtggggggcaaacctgcttgccactgctggctgcgtggcgctctggggctatctgctgtaccagggcgtcatcgacccgctgggtggcatcaacaccctgtggccgctgtttggtatctccaaccagatgctggccggtatcgccttgatgctcggtactgtggtgctgatcaagatgaagcgtcagcgctacatctgggtcaccctgctgccggccgtatggctgctgatctgcaccacggctgcaggcctgatcaagctgttcgaccccaacccggctgtcggcttcctggccttggccaagaagtacagcactgcgctggacgccggccaggtactggccccggccaaggacatcgggcagatgcagcacgtgatcttcaacgcctacaccaacgcgggcctgacgatcttgttcctgctggtggtcttcagcatcctgttcttcgccatcaaggtcggctacgccgccttgggccgcaaagaacgcagcgacaaggaaaccccgttccaggcgttgcctgacgcgtaa

SEQ ID NO: 36481 - protein, 688 aa, Pseudomonas putida KT2440
MNNNNSLLRHIPWLALAVIGACALGVVALRRGEAINALWIVVAAVAIYLVAYRYYSLFIATKVMQLDPRRATPAVLNNDGLDYVPTNKHILFGHHFAAIAGAGPLVGPVLAAQMGYLPGTLWLIAGVVLAGAVQDFMVLFLSTRRNGRSLGDMVREEMGRIPGTIALFGCFLIMIIILAVLALIVVKALAESPWGMFTVMATIPIAMFMGIYMRYIRPGRIGEISVVGVVLLLASIWLGGVIAADPVWGPAFTFTGVQITWMLVGYGFVAAVLPVWLVLAPRDYLSTFLKIGTILGLAIGILIIAPELKMPALTQFTDGTGPVWKGTLFPFLFITIACGAVSGFHALISSGTTPKLLDNETNARYIGYGGMLMESFVAIMAMVAASVIEPGVYFAMNSPAAVVGTDVASVAQTVSSWGFLITPEQLEAVARDIGEHTILARAGGAPTLAVGIAQILHQVLPGENTMAFWYHFAILFEALFILTAVDAGTRAGRFMLQDLLGSFVPALKRTESWGANLLATAGCVALWGYLLYQGVIDPLGGINTLWPLFGISNQMLAGIALMLGTVVLIKMKRQRYIWVTLLPAVWLLICTTAAGLIKLFDPNPAVGFLALAKKYSTALDAGQVLAPAKDIGQMQHVIFNAYTNAGLTILFLLVVFSILFFAIKVGYAALGRKERSDKETPFQALPDA

SEQ ID NO: 36482 - DNA, 2166 bp, Escherichia coli CFT073
  CDS (1)..(2166): transl_table=11
atgccaggttttactatggatactaaaaagatattcaagcacataccctgggtgattctcggaatcatcggtgcattctgcctcgcggtagttgcattacgtcggggggagcacgtcagcgccctgtggatcgtggtcgcctctgtgtcggtgtatctggtggcgtatcgctactacagtctgtacatcgcccagaaggtgatgaaactcgaccccacgcgcgcgacgcctgcggttattaacaacgacggtctgaactacgttccgaccaaccgttacgtgttgtttggtcaccacttcgccgctatcgccggtgctggtccgctggtgggtccggttctcgccgcgcagatgggctacctgcctggcacgctgtggctgctggcgggggtcgtgctggccggtgcggttcaggactttatggtgctgtttatctcctctcgccgtaacggcgcatctcttggtgagatgatcaaagaagagatggggccagtaccggggactatcgcgctgtttggctgtttcttaatcatgatcatcatcctcgccgtcctggcgctgattgtggttaaagccctggccgaaagtccgtggggtgtcttcaccgtttgctcaaccgtaccgattgcgctgtttatgggtatctacatgcgctttattcgtccggggcgtgtgggtgaagtctctgtcattggtatcgtgctgctggttgcctctatctacttcggtggcgtgattgctcacgatccgtactggggtccggcactgacctttaaagacaccaccattaccttcgcgctgattggctatgcgtttgtttccgcactgctgccagtgtggctgatcctcgcaccgcgcgactatttggcaaccttcctgaaaatcggcgttatcgtcggcctggcgctgggtatcgtggtgctgaacccggaactgaaaatgcctgccatgacccagtacattgacggtactggcccgctgtggaaaggcgctctgttcccgttcctgttcatcaccatcgcctgtggtgcggtatctggcttccacgcgctgatctcttccggtacgacgccgaaactgctggctaatgaaaccgacgcgcgtttcatcggctacggcgcaatgctgatggagtccttcgtggcgattatggcgctggttgctgcgtccatcatcgaaccgggtctttacttcgcgatgaacaccccgcctgctggccttggcatcaccatgcctaatctgcatgaaatgggtggcgagaacgcgccgatcatcatggcacagctgaaagacgttaccgcacacgcggcagcgaccgtcagctcctggggcttcgtgatttcgccagagcagatcctgcaaaccgcgaaagacattggtgagccttctgtcctgaaccgtgcaggtggtgcgccaacgctggcggtaggtatcgctcacgtgttccacaaagtgctgccgatggctgacatgggcttctggtatcacttcggtattctgttcgaagccctgttcatcctgaccgcgctggatgcgggtacccgttctggccgctttatgctgcaagacctgctgggtaacttcatcccgttcctgaaaaaaaccgactctctggttgccggtatcatcggtactgcgggctgtgtgggtctgtggggctacctgctgtatcagggcgtggtcgatccgctgggcggcgttaagagcctgtggccgctgttcggtatctccaaccagatgctggcagccgtggcgctggtactgggcaccgttgtactgattaagatgaagcgcacccaatacatctgggttaccgttatcccggcagtatggctgcttatctgcaccacctgggcgctgggcctgaaactgttcagcaccaacccgcagatggaaggcttcttctacatggcaagccagtacaaagagaagattgctaacggtactgacctgacggcgcagcagattgccaacatgaaccacatcgttgtgaacaactacaccaacgcaggcctgagcattctgttcctgattgtggtgtacagcatcatcttctacggtttcaaaacctggctgaaggtgcgtaacagcgacaaacgtactgacaaagaaacaccgtacgttccaatcccggaaggcggcgtgaagatctcttcgcaccactaa

SEQ ID NO: 36483 - protein, 721 aa, Escherichia coli CFT073
MPGFTMDTKKIFKHIPWVILGIIGAFCLAVVALRRGEHVSALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGASLGEMIKEEMGPVPGTIALFGCFLIMIIILAVLALIVVKALAESPWGVFTVCSTVPIALFMGIYMRFIRPGRVGEVSVIGIVLLVASIYFGGVIAHDPYWGPALTFKDTTITFALIGYAFVSALLPVWLILAPRDYLATFLKIGVIVGLALGIVVLNPELKMPAMTQYIDGTGPLWKGALFPFLFITIACGAVSGFHALISSGTTPKLLANETDARFIGYGAMLMESFVAIMALVAASIIEPGLYFAMNTPPAGLGITMPNLHEMGGENAPIIMAQLKDVTAHAAATVSSWGFVISPEQILQTAKDIGEPSVLNRAGGAPTLAVGIAHVFHKVLPMADMGFWYHFGILFEALFILTALDAGTRSGRFMLQDLLGNFIPFLKKTDSLVAGIIGTAGCVGLWGYLLYQGVVDPLGGVKSLWPLFGISNQMLAAVALVLGTVVLIKMKRTQYIWVTVIPAVWLLICTTWALGLKLFSTNPQMEGFFYMASQYKEKIANGTDLTAQQIANMNHIVVNNYTNAGLSILFLIVVYSIIFYGFKTWLKVRNSDKRTDKETPYVPIPEGGVKISSHH

SEQ ID NO: 36484 - DNA, 1485 bp, Vibrio vulnificus CMCP6
  CDS (1)..(1485): transl_table=11
atgatgtggtttcttacctgtgtcgcagccctgattggcggatacttcatctacggtgctttcgttgagaaagtatttggtatcaatgaaaatcgccgtacccctgcccatacaaaaaccgacggcgttgactatgtgccaatgtcgacccaaaaagtctacttagtgcaactccttaacattgctggcgttggccctatctttggtccaatcatgggtgccctatacggccctgcggcgatgctttggattgttgtcggctgtatcttcgctggtgcagtacacgattacttctctggcatgctttctgtgcgtaacggtggtgcttctgtaccgaccatcacaggtcgctaccttggcaatggcgcgaaacactttatgaacatttttgccattgtcttgctgctgcttgttggtgtggtattcgtttccgccccggctggcatgatcaccaatctgatcaatgaccaaaccagcttctctgtgagcatgacaaccatggtggtggtgatttttgcttactacatcatcgcgaccatcgtaccggttgataaaatcatcggtcgcttctacccactgtttggtgcgttactgattttcatgtctgttggtctgatgacggcgattgcattctcttctgagcacacggtgatgggtgatttccaagtcagcgacatgttcactaacttgaacccgaatgatatgcctctgtggccagctctgttcatcactattgcttgtggtgcgatctctggcttccacgcaacgcaatcacctttgatggctcgttgtatggaaaatgagaaaaacggccgctttgtcttctacggcgcgatgattggtgaaggtgttatcgcactgatctggtgtgctatcgcactctcgttcttcggcacacttgaaggactagcagaagcggtgaaaaacggtggccctggcaacgtggtttacagcgcatcatttggtctgcttggcgtatttggtggcgtgattgccttcctaggtgtggtgattctgcctatcacttcgggtgacacggcgttccgctctagccgtttgattcttgctgaatacttcaacatggaacagaaaaccctacgtaaccgcctgttgatggccgtaccactgttcgtactgggtggcattctgactcaagtcgatttcggcatcatctggcgctacttcggttttgccaaccaaaccaccgcagtcatgatgttgtggacagcatcagcttacctactgcgtcacaacaagctacattggatcaccacagtgcccgctttcttcatgacaacggtttgtgtgacctttatcctcaacaacagcgcgctgggctttggtttgccaatgcaactctccaccattgctggcgtaatcttcgcggcagcggtaaccggttacgtgattaaaacatcaaaaggcaaaggcgaaacggaccttgccgatgaggaaaaacctcaaggcgtcactgaaaccgcgtaa

SEQ ID NO: 36485 - protein, 494 aa, Vibrio vulnificus CMCP6
MMWFLTCVAALIGGYFIYGAFVEKVFGINENRRTPAHTKTDGVDYVPMSTQKVYLVQLLNIAGVGPIFGPIMGALYGPAAMLWIVVGCIFAGAVHDYFSGMLSVRNGGASVPTITGRYLGNGAKHFMNIFAIVLLLLVGVVFVSAPAGMITNLINDQTSFSVSMTTMVVVIFAYYIIATIVPVDKIIGRFYPLFGALLIFMSVGLMTAIAFSSEHTVMGDFQVSDMFTNLNPNDMPLWPALFITIACGAISGFHATQSPLMARCMENEKNGRFVFYGAMIGEGVIALIWCAIALSFFGTLEGLAEAVKNGGPGNVVYSASFGLLGVFGGVIAFLGVVILPITSGDTAFRSSRLILAEYFNMEQKTLRNRLLMAVPLFVLGGILTQVDFGIIWRYFGFANQTTAVMMLWTASAYLLRHNKLHWITTVPAFFMTTVCVTFILNNSALGFGLPMQLSTIAGVIFAAAVTGYVIKTSKGKGETDLADEEKPQGVTETA

SEQ ID NO: 36486 - DNA, 1467 bp, Clostridium tetani E88
  CDS (1)..(1467): transl_table=11
atggtaacatttattttatctattatcgcattaatagttggttattttatttatggtactgttgttgaaaagattttcggaatcgatgaaaatcgagagacaccagcagtaagacttgaagatggtgtggattatgttcctatgccagaatggaagatatttttaatacagtttttaaatatagcaggtttgggacctatatttggagctatattaggagctatgtttggaccagctgcatttttgtggattgtatttggttctatatttgcaggaggagttcatgactacttctcaggtatgctttcagtaagacataatggtgcaagtgtaccagaaatcgtgggtaagtatttgggacaaggctttagaaattttatgagagtattttcagtagtacttttaatattagttggagtagtatttgttatgggacctgcagaccttctagcaggattaacaccagaaaagtttggtagaaacttttggttatatattattttcttttactatatattagctactttattacctgttgataaaataataggaaagatttaccctattttcgggatatgtttacttttaatggctgttggtgtagcggcaatgcttattataaaaggttatccaattccagaagcgactcctgcaaatttatataatatgcatagtaaagctagtacaatgccaatattcccggtattatttgtaactattgcctgtggtgctatttcaggattccactctacccaatcaccactaatggccagatgtataacaaatgaaaggcaaggaagaagagtattttatggatcgatgattgcagaaggaatagttgcattaatatgggcagcagcagctatgagcttctttgcaggtccaggtggaactaatggtgtgggaaagtttaacgaaattatggcatctaatggaaataatgcagcttgggtagtaaacgaagtgtgtaattcgctattaggtaaagtaggaggaattcttgcaatattaggagtagttgcatgtcctataacttcaggggatacagcttttagaagtgctagattaactatagcagattcattaaaatataaacaagaagatattaaaaatagactatctataagtattcctttatttataataggatttgtattaacaagaatagattttaatataatttggagatactttgcatggtcaaaccaagcattggctacagtattactttgggcatctgctgtatatcttgtaacaattaaaaaaatccattggatcgcatctttaccagcaacatttatgactgctgtaagtgtaacttatataatggttgctccagagggttttaaattatcaacatcaataggatatccaataggtataatatcagcaatagtagtatttgcaatatttttatccaaagcaaaaaaagaaaaaatgaaaatctctaattcaaaaaccgcttag

SEQ ID NO: 36487 - protein, 488 aa, Clostridium tetani E88
MVTFILSIIALIVGYFIYGTVVEKIFGIDENRETPAVRLEDGVDYVPMPEWKIFLIQFLNIAGLGPIFGAILGAMFGPAAFLWIVFGSIFAGGVHDYFSGMLSVRHNGASVPEIVGKYLGQGFRNFMRVFSVVLLILVGVVFVMGPADLLAGLTPEKFGRNFWLYIIFFYYILATLLPVDKIIGKIYPIFGICLLLMAVGVAAMLIIKGYPIPEATPANLYNMHSKASTMPIFPVLFVTIACGAISGFHSTQSPLMARCITNERQGRRVFYGSMIAEGIVALIWAAAAMSFFAGPGGTNGVGKFNEIMASNGNNAAWVVNEVCNSLLGKVGGILAILGVVACPITSGDTAFRSARLTIADSLKYKQEDIKNRLSISIPLFIIGFVLTRIDFNIIWRYFAWSNQALATVLLWASAVYLVTIKKIHWIASLPATFMTAVSVTYIMVAPEGFKLSTSIGYPIGIISAIVVFAIFLSKAKKEKMKISNSKTA

SEQ ID NO: 36488 - DNA, 1179 bp, Shewanella oneidensis MR-1
  CDS (1)..(1179): transl_table=11
atgatgtggttcctgctctgcgtcggtctattgatcggcggctactttatctacggtacttttgttgaaaaagtatttggtatcaatgaaaaacgtcaaacaccggcatttagccaaaccgacggcgtggactttgttccgatgtcaaagggaaaagtctatttaatccaattactgaatatcgcgggtgtcggtccaatcttcggtcctatcctaggtgcgctctacggcccttcagctatgctctggattgtgatcggctgtatcttcggcggagcggtgcacgattacttctctggtatgttgtcagtacgtaatggtggccaatctgtcccaaaccttgcgggcaagtatttaggcaaaagtgctaaacactttatgaacgtgttcgctatcgtcttattgctgctggtaggtgtagtgtttatctctgcaccagcaggtttgttaggtaagctgacgggcttagatgtgagtatcttcgtgggtataatcttcgtttactacctgattgccactgtagtgcctatcgacaagattattggccgcctctaccccttcttcggcgcactgctattcttcatgtcattcggcttagcctttgcgattatgttttctagcgaacatacgctgcttcctaatgtgcaagcgggagattttttcaaaaacttaaaccctgacgatatgccactttggcccgcgctgtttatcaccattgcctgtggagccatttcaggctttcacgctacacaatcaccactgatggcacgttgtgttgaaaatgaaaagaacggccgtttcgtgttctttggcgccatgatcggtgaaggcgttatcgccctgttgtggtgtgctattgccctgtcttacttccatggtgttgaaggtttaaacacaggcatggccggtaaccctgcaaacgtggtatatgaagcatcgacaggcttattaggcgctgtgggtggttttatggcgattctgggtgtgattattctgccgattacctctggcgataccgcattccgctctgctcgtctgattttggctgagttctttaaaatgccacaggtgactttgccaaaacgtttagtgctggctattccattgtttgtgattggtggcttactcactcaagtcgactttggtgtgatctggcgttactttggtgtggccaactaa

SEQ ID NO: 36489 - protein, 392 aa, Shewanella oneidensis MR-1
MMWFLLCVGLLIGGYFIYGTFVEKVFGINEKRQTPAFSQTDGVDFVPMSKGKVYLIQLLNIAGVGPIFGPILGALYGPSAMLWIVIGCIFGGAVHDYFSGMLSVRNGGQSVPNLAGKYLGKSAKHFMNVFAIVLLLLVGVVFISAPAGLLGKLTGLDVSIFVGIIFVYYLIATVVPIDKIIGRLYPFFGALLFFMSFGLAFAIMFSSEHTLLPNVQAGDFFKNLNPDDMPLWPALFITIACGAISGFHATQSPLMARCVENEKNGRFVFFGAMIGEGVIALLWCAIALSYFHGVEGLNTGMAGNPANVVYEASTGLLGAVGGFMAILGVIILPITSGDTAFRSARLILAEFFKMPQVTLPKRLVLAIPLFVIGGLLTQVDFGVIWRYFGVAN

SEQ ID NO: 36490 - DNA, 2076 bp, Pseudomonas syringae pv. tomato str. DC3000
  CDS (1)..(2076): transl_table=11
atgaaaaataataatagcctgatgcgccacgttccctggctcatcgtcgcaattgtcggggcatgtgcccttggggtcgtggccttgcgccgcggagaggcgatcaacgccttgtggatagtggtcgctgcggtggccatttatctggttgcttatcgttactacagtcttttcatcgccacgcacgtcatgcagctcgatccgctgcgggcgacaccggcggtggtcaacaacgatggtctggactacgtgccgaccaacaaacacatcctgttcggtcaccactttgccgccatcgctggcgcaggcccgctggtcggccctgtcctggctgcgcagatggggtatctgcccggtacgctgtggctgattgccggggtggtactggccggtgcggtgcaggacttcatgatcctgttcctctccacgcgccgtgacggtcgctcgctgggcgatatggttcgcgaggaaatgggccgcattcccggcaccatcgccttgttcggctgcttcctgatcatgatcatcatcctcgcggtgctggcgctgatcgtggtcaaggccctggccgaaagcccgtggggcatgttcacggtcatggcgacgattccgattgcgatgttcatgggcatttacatgcgttacatccgcccgggccgtatcggtgaaatctcgctggtgggcgtgctgctgttgctcggttcgatctgggtcggcggcatggttgcggccgacccgacctgggggccgatgtttaccttcaccggcatccagatcacctggatgctggtgggttacggctttgtggctgcgatgctgccggtctggctgctgttggcaccgcgtgactacctgtcgacgttcctgaaaatcggcaccattctggcgctggcaatcggcatcctgattctggcacccgagctgaagatgccggccctgacccagttcaccgacggcaccggtccggtctggaagggcgcgctgttcccgttcctgttcatcaccattgcctgcggcgcggtatcgggtttccacgcactgatctcctcgggcaccacgcccaagctgctggataacgagaaaaacgcccgttatatcggttatggcggcatgttgatggagtcgttcgtggccatcatggcaatggtcgccgcttcggtgatcgagccaggcgtctacttcgccatgaacagcccggccgctgtggtcggcagcgatgtggtgaccgtcgcgcagacagtgtccagctggggctttgccatcacgccggagcaactgaccgccgtggccaaggacatcggtgaaaacaccatcctggcccgtgccggtggtgcgccgacgcttgctgtggggatcgcgcagatcctccatcaggtactgccgggtgaaaacaccatggcgttctggtatcacttcgcgattctgttcgaggcgctgtttatcctgacggcggttgacgccggtacacgtgccgggcgcttcatgcttcaagacctgctgggcagcttcgttccggccctcaaacgcacagaatcctggacggccaacgctatcggcacaggggggtgcgtggcgctgtggggttatctgctttatcaaggcgtcatcgacccgctgggcggcatcaataccttgtggccgttgttcggtatctccaaccagatgcttgccggtatcgcgttgatgctggccagcgtcgtgctgatcaaaatgaagcgtcagcgctatgtgtgggtcaccatgctgcctgccgtctggctgttgatctgcactgtgacggcgggcctgatcaagctgttcgatgccaaccctgcggtcggcttcctggccctggccaagaaatacagcgcagcggcagatgccggccagattctggcgccggcaaaaaccatggaccagatgcagcacgtgattttcaacgcgtacaccaactccgggttgaccatactgttcctgtttgtggtgttcagcattctgttctacgccatcaaggtgggccgtgcggcctggacgaccgaggcgcgtaccgacaaggaagctccttaccaggccatgccgcccgcgtcgcaggtgtga

SEQ ID NO: 36491 - protein, 691 aa, Pseudomonas syringae pv. tomato str. DC3000
MKNNNSLMRHVPWLIVAIVGACALGVVALRRGEAINALWIVVAAVAIYLVAYRYYSLFIATHVMQLDPLRATPAVVNNDGLDYVPTNKHILFGHHFAAIAGAGPLVGPVLAAQMGYLPGTLWLIAGVVLAGAVQDFMILFLSTRRDGRSLGDMVREEMGRIPGTIALFGCFLIMIIILAVLALIVVKALAESPWGMFTVMATIPIAMFMGIYMRYIRPGRIGEISLVGVLLLLGSIWVGGMVAADPTWGPMFTFTGIQITWMLVGYGFVAAMLPVWLLLAPRDYLSTFLKIGTILALAIGILILAPELKMPALTQFTDGTGPVWKGALFPFLFITIACGAVSGFHALISSGTTPKLLDNEKNARYIGYGGMLMESFVAIMAMVAASVIEPGVYFAMNSPAAVVGSDVVTVAQTVSSWGFAITPEQLTAVAKDIGENTILARAGGAPTLAVGIAQILHQVLPGENTMAFWYHFAILFEALFILTAVDAGTRAGRFMLQDLLGSFVPALKRTESWTANAIGTGGCVALWGYLLYQGVIDPLGGINTLWPLFGISNQMLAGIALMLASVVLIKMKRQRYVWVTMLPAVWLLICTVTAGLIKLFDANPAVGFLALAKKYSAAADAGQILAPAKTMDQMQHVIFNAYTNSGLTILFLFVVFSILFYAIKVGRAAWTTEARTDKEAPYQAMPPASQV

SEQ ID NO: 36492 - DNA, 1485 bp, Vibrio parahaemolyticus RIMD 2210633
  CDS (1)..(1485): transl_table=11
atgatgtggtttctaacttgtgtcgctgccctcatcggcggatacttcatctacggcgctttcgttgagaaaattttcggcatcaatgagaaacgccaaacccctgcacacaccaaaacggatggtgttgactttgttccaatgtcaacaaagaaggtttacctagttcagctacttaacatcgctggtgtaggtcctatctttggcccaatcatgggtgcactttacggcccagccgcaatgctttggattgttgtaggttgtatctttgcaggtgccgtacacgattacttctcaggtatgctttcagtgcgtaacggcggtgcatcagtgccaacgattactggtcgctacctaggtaatggcgcaaaacactttatgaatatctttgccattgtcctgttgcttcttgttggtgtggtattcgtatcagcgccagcgggcatgatcacaaacctaatcaatgatcaaaccagcctaaacgtaagcatgacaacaatggttgtggttatttttgcttactacatcatcgcgacaatcgttccagtagataagatcatcggtcgtttctaccctctatttggcgcactacttatcttcatgtcggttggtctaatgactgcggttgctctatctagcgagcacacagtaatgggtgatttccaagtaacagacatgttctctaacctaaacccaaatgacatgcctttatggcctgcactgttcatcactatcgcttgtggtgcaatctctggcttccacgcaactcagtctccactaatggcgcgttgtatggaaaacgagaaaaacggtcgcttcgtattctacggtgcaatgattggtgaaggtgttatcgctctaatctggtgtgctatcgccctatcattcttcggctctctagaagcgctttctgaagcagtgaaaaacggtggtcctggtaacgtggtatacagcgcgtcatttggtctactaggtgtattcggcggtatcattgctttcctaggtgtggttatcctaccaatcacttcaggtgacacagcgttccgctcaagccgtctaatccttgctgaatacttcaacatggaacagaaaacactacgtaaccgtctactaatggctgtgccgctattcgttatcggtggtgtgttgactcaagtagactttggcatcatctggcgttacttcggcttcgcaaaccaaacaacagcagtaatgatgttgtggactgcgtcagcttacctactgcgtcacaacaaactgcactggattacaactatccctgcaatgttcatgaccacggtatgtgtgactttcatcctaaacaacagctcactaggtttcggcctaccaatgcaagtgtcgactatcgcgggtgtcatcttctccctagtcgttacaggttacgttatcaaaacctctaaaggtaaaggcgaatctgaactggcggatgaagagaaaccacaagcagtaacagaaactgcataa

SEQ ID NO: 36493 - protein, 494 aa, Vibrio parahaemolyticus RIMD 2210633
MMWFLTCVAALIGGYFIYGAFVEKIFGINEKRQTPAHTKTDGVDFVPMSTKKVYLVQLLNIAGVGPIFGPIMGALYGPAAMLWIVVGCIFAGAVHDYFSGMLSVRNGGASVPTITGRYLGNGAKHFMNIFAIVLLLLVGVVFVSAPAGMITNLINDQTSLNVSMTTMVVVIFAYYIIATIVPVDKIIGRFYPLFGALLIFMSVGLMTAVALSSEHTVMGDFQVTDMFSNLNPNDMPLWPALFITIACGAISGFHATQSPLMARCMENEKNGRFVFYGAMIGEGVIALIWCAIALSFFGSLEALSEAVKNGGPGNVVYSASFGLLGVFGGIIAFLGVVILPITSGDTAFRSSRLILAEYFNMEQKTLRNRLLMAVPLFVIGGVLTQVDFGIIWRYFGFANQTTAVMMLWTASAYLLRHNKLHWITTIPAMFMTTVCVTFILNNSSLGFGLPMQVSTIAGVIFSLVVTGYVIKTSKGKGESELADEEKPQAVTETA

SEQ ID NO: 36494 - DNA, 1431 bp, Bacteroides thetaiotaomicron VPI-5482
  CDS (1)..(1431): transl_table=11
atgattacatttaccctgtgcctgctggcgttgatagcaggctatttcacgtatggacgcctgatggagcgcgtctttggtccggacgaccgtaaaacaccggctcttaccaaagccgacggagtagactatattccgttgcctacttggaaaatattcatgattcaattccttaatatcgccggactgggtccgatattcggtgcgattatgggagcgaagttcggtacttcttcttatttatggattgtattgggaagtatttttgcaggcgctgttcatgattactttgccggaatgctttctttacgtcatgggggagagagtcttcccgaaatcataggccgttatctgggactgactaccaaacagataatgcgtggatttactgttcttctgatgattctcgtcggttccgtctttgtagccggacctgccggactattggccaaactgactccggaaagtctggacgctactttttggattgtcgtggtcttcctatattatattctggctaccctgcttccggtcgataagatcatcggtaaaatatatccgttgtttgcagtagccttgctgtttatggcagtcggtatcctggtaatgctttatgtcaatcaccctgttttgcccgaactatgggacggcttgcagaataccaatccggatgccagtgaactgccgatcttcccgattatgtttgtgagtatcgcctgtggtgccatatccggtttccatgccacgcagagtcctttaatggcccgctgcatgacttcggaacgtcatggacgtccggttttctatggtgcaatgattaccgaaggcatcgttgctttgatatgggcggcagccgctacttatttcttccatgaaaatggaatggaagaaagtaatgcttccgtgatagtagacgctatcactaaagactggctgggagctatcggtggagtgctcgccattcttggagtaattgcggctcccattacttcgggagataccgctttccgttccgcccgtctgattgtggcggactttctgggactggaacaaaaaagtatgcgccgtcgtttatacatttgtattccgatgttcgcagtagctatcggtctgcttctttatagcttgcgtgacgcggacggatttaacatgatctggcgttactttgcctgggccaaccagacattggcggtgttcaccctctgggctatcacagtctaccttgtggtagccaaaaagccttattggattacgctgatccccgccttatttatgacgagtgtttgttctacttatatatgtattgctcccgaagggctgggactctcgcatatagtttcctactgcatcggtataggatgcgtagtggtagctattgcctggttctttatctggctgggaaaacaaaaaactagaaaactatcagaatga

SEQ ID NO: 36495 - protein, 476 aa, Bacteroides thetaiotaomicron VPI-5482
MITFTLCLLALIAGYFTYGRLMERVFGPDDRKTPALTKADGVDYIPLPTWKIFMIQFLNIAGLGPIFGAIMGAKFGTSSYLWIVLGSIFAGAVHDYFAGMLSLRHGGESLPEIIGRYLGLTTKQIMRGFTVLLMILVGSVFVAGPAGLLAKLTPESLDATFWIVVVFLYYILATLLPVDKIIGKIYPLFAVALLFMAVGILVMLYVNHPVLPELWDGLQNTNPDASELPIFPIMFVSIACGAISGFHATQSPLMARCMTSERHGRPVFYGAMITEGIVALIWAAAATYFFHENGMEESNASVIVDAITKDWLGAIGGVLAILGVIAAPITSGDTAFRSARLIVADFLGLEQKSMRRRLYICIPMFAVAIGLLLYSLRDADGFNMIWRYFAWANQTLAVFTLWAITVYLVVAKKPYWITLIPALFMTSVCSTYICIAPEGLGLSHIVSYCIGIGCVVVAIAWFFIWLGKQKTRKLSE

SEQ ID NO: 36496 - DNA, 2067 bp, Bacillus cereus ATCC 14579
  CDS (1)..(2067): transl_table=11
ttgaaatcgatcttactttggggcgttattacagcagtaggagcaggtgcttttggggtaatagctttatcacaaggtgaaaccattaatgctgtatggctcttagtagctgccgtatgtgtatatgcagttgcttatcgcttttatagtagatttatagcgagaaaggtttttaatttagatgataatcggcaaacaccagcccatacattaaatgatgggaaagactatgttccaacaaataagtgggtattgtttggacatcactttgcagcgattgctggagcgggacctttagtaggaccgattttagcggcacaaatggggtatttaccagggaccatttggattattgttggggtagttgttgcgggggctgtccaagattttgttattttatttgcttcaatgagacgtaatggtaaatcgttaggagaaatgattaaagatgagattggacctgttacaggactaattgcaatgataggtattttaggaattatgattattttattagcagtattagcgttggtcgtagtaaaggcactaatcggaagtccttggggaatgtttacgatagcagcaacgattcctatcgctattttaatgggagtttatatgcgctatattaggcctggtcgtgttggagaaggatcagtaattggtattatcctacttattttatctcttgttggaggacagtatgtagcagaaaatccaacacttgcaagtatgttcacatttagtggtgaaacaattgctattatgcttattgtatatggatttattgcatctgcattaccagtttggatgcttttagcaccacgtgattatttaagtacatttttaaaagtcggaacaattgtagggttagcaatcggtatcttaattgtagcaccagatttacaaatgccagcagtttcgaaatttattgatggaactggtcctgtgttctctggaaacctattccctttcttatttattactattgcttgtggtgcagtgtctggattccatgctcttgtttcatcaggtacgacgccgaagatgattgagcaagagggacacgcacagccaatcggttatggagcaatgttaatggagtcgtttgtagcagcgatggcgatgattgcagcttgtgtattaacaccgggaacgtattttgcaattaatagtcccgcagcacttatcggtacagatgtctcgcaggcagctcaagttatttcctcatggggatttgctattacaccaaatgaactaaaagatctcgctgtaaatgttggagagcaaacgattttatcacgtacaggtggtgcgccaacattagcgataggtatggcatatattttctcacaagtaataggtggaacggccatgatggcattttggtatcattttgcgattctctttgaagccctatttattttaacaacgattgatgccggaacgcgtgtcggccgatttatgattcaagatattttagggcatgtatataagccatttgggaaaacggattctacattagcaaatgtaatcgctacaacattatgtgtattagggtggggatatttcttataccaaggggtaatagatccgctcggtggaattaatacattatggccacttttcggtattgcaaatcaaatgctagcaggtattgcattattacttggaacgacaattttgttcaaaatgggaaaaaaggcgtacgtttgggtaacacttattccaactgtcgggttgctgattgtaacaatgacggcggggtatcaaaagctatttcatgaaaatcctaaaattggatttctatcgcatgcaaaggtatttcagagagcattagatgagggaaaagtgttagcgccagctaaaaatgtcgctcaaatgaagcaaattattttcaatgattatattgatgcagcgctttgtgggatttttatgatagttgtaatcgctgtgttaatttcagcacttcgaatttggatacaagtattaagaaataagccaatgccgttaaaagaggcaccatatattcctagagatgaaagtgagtcgaggaactatgcttaa

SEQ ID NO: 36497 - protein, 688 aa, Bacillus cereus ATCC 14579
MKSILLWGVITAVGAGAFGVIALSQGETINAVWLLVAAVCVYAVAYRFYSRFIARKVFNLDDNRQTPAHTLNDGKDYVPTNKWVLFGHHFAAIAGAGPLVGPILAAQMGYLPGTIWIIVGVVVAGAVQDFVILFASMRRNGKSLGEMIKDEIGPVTGLIAMIGILGIMIILLAVLALVVVKALIGSPWGMFTIAATIPIAILMGVYMRYIRPGRVGEGSVIGIILLILSLVGGQYVAENPTLASMFTFSGETIAIMLIVYGFIASALPVWMLLAPRDYLSTFLKVGTIVGLAIGILIVAPDLQMPAVSKFIDGTGPVFSGNLFPFLFITIACGAVSGFHALVSSGTTPKMIEQEGHAQPIGYGAMLMESFVAAMAMIAACVLTPGTYFAINSPAALIGTDVSQAAQVISSWGFAITPNELKDLAVNVGEQTILSRTGGAPTLAIGMAYIFSQVIGGTAMMAFWYHFAILFEALFILTTIDAGTRVGRFMIQDILGHVYKPFGKTDSTLANVIATTLCVLGWGYFLYQGVIDPLGGINTLWPLFGIANQMLAGIALLLGTTILFKMGKKAYVWVTLIPTVGLLIVTMTAGYQKLFHENPKIGFLSHAKVFQRALDEGKVLAPAKNVAQMKQIIFNDYIDAALCGIFMIVVIAVLISALRIWIQVLRNKPMPLKEAPYIPRDESESRNYA

SEQ ID NO: 36498 - DNA, 2073 bp, Nitrosomonas europaea ATCC 19718
  CDS (1)..(2073): transl_table=11
atgaatcagttaagcaagtgggtaggttggtcactgttttccctgctgggtgcggcagctttcggtgtcattgccctcaaccgaggtgaatcgattagtgcaatctggattgttattgcggcagtgtgtgtgtatttgatcgcctttcgtttctatagtcagttcattgccaatcgggtattgaagctggatacaacgcgtatgactccagcatataagcacaatgatggactggatcatgttccaaccaataaatatgtattgttcgggcatcattttgctgcgattgccggagccgggccactggttgggccgattttggcagcacaaatggggtatttgccgagtatgttgtggctgcttgctggagtcgtattcgccggtgcagtgcaggatttcatcgtactgttcatatcgatgcggcgtaatgcccggtcactcggtgatctgatcaaatccgaactggggcatgttcccggtatgatcgcattgttcggtgcgttcttcatcatgctgattttacttgctgtattgtcgctgattgtcgtcaaggcattggctgaatcaccatgggggacattcaccgttgcggcgacgatccctatcgcaatgttcatggggatttattcgcgttatttccggccgtgtgcaattgctgagatatcgctgatcggatttacgctgctgattctgtcgatcatagccggccagtatgttcaggaggaccctgcatgggcagcggtgttctcggcaaccggtgaacaactgacctgggtattgattggctatggctttattgcctcagtattgccggtatggttgttgctggcgccacgcgattatctgtcgacttttcttaaaattggcacaatcgttggtttggcaatcggtgtcattattctttcaccggaattgaaaatgcctgcgctgacacaattcattgatggttcaggcccggtctggtcgggtgatctgtttccgttcctgttcgtgacagtagcctgtggtgcggtttccggtttccattcgttgatcgcatccggcactacacccaaaatgatccagaatgaaactgatgcacgtttcattggttacggcgcaatgttgatggaatcgtttgtcgcgatcatggcgctggttgccgcagcagcacttgagcccggtatttattttgccatgaatagtccggcggcgatcatcggcactacggtggaatcggctgtacaaacgatttcccagtgggggttccatatcactccggaaatgatcacacaaactacacagaacgtcggtgaacacagcatcatctcgcgaacgggcggtgcgccaacgctggcggtgggtatggcgcagattttgtcgggagtgatcggtgatactgcgatgatggcgttctggtatcactttgctattttatttgaagcattatttattctgacggcggttgatgccgggacgcgtgccgggcgttttatgttgcaggatctgctcggttcattcattccggcgatgaaacggactgattcgctgacagcaagcctgatagctacaggtatctgtgtatccggctgggggtatttcctgtatcagggcgtgatcgatccattggggggtatcaataccctgtggccgctgttcgggatcgccaaccagatgctcgccggtatcgcactgatcctgtgcacatgtgtgctgttcaggatgaagctcgatcgctttgcctggattacagtgattccggcagtatgggtttgcatttgtacactgactgctgcctggcaaaaaatatttcatgataatccgcggatcggttttctcgcgcatgcagaaaaatatcaggatgcagtgatacaagatattgtgctggcacctgcccggtcgatcgggcaaatgcaacaggttatatttaatgactatatcaacgttacactgacggcattgttcatggcggtactcatcagcatactgatgttcggtattcgaactattctgcaggcacgtatcatccttcatccgacaactcgggaagcgccgttcgaactgttacctgcttatgcatctattgagaaataa

SEQ ID NO: 36499 - protein, 690 aa, Nitrosomonas europaea ATCC 19718
MNQLSKWVGWSLFSLLGAAAFGVIALNRGESISAIWIVIAAVCVYLIAFRFYSQFIANRVLKLDTTRMTPAYKHNDGLDHVPTNKYVLFGHHFAAIAGAGPLVGPILAAQMGYLPSMLWLLAGVVFAGAVQDFIVLFISMRRNARSLGDLIKSELGHVPGMIALFGAFFIMLILLAVLSLIVVKALAESPWGTFTVAATIPIAMFMGIYSRYFRPCAIAEISLIGFTLLILSIIAGQYVQEDPAWAAVFSATGEQLTWVLIGYGFIASVLPVWLLLAPRDYLSTFLKIGTIVGLAIGVIILSPELKMPALTQFIDGSGPVWSGDLFPFLFVTVACGAVSGFHSLIASGTTPKMIQNETDARFIGYGAMLMESFVAIMALVAAAALEPGIYFAMNSPAAIIGTTVESAVQTISQWGFHITPEMITQTTQNVGEHSIISRTGGAPTLAVGMAQILSGVIGDTAMMAFWYHFAILFEALFILTAVDAGTRAGRFMLQDLLGSFIPAMKRTDSLTASLIATGICVSGWGYFLYQGVIDPLGGINTLWPLFGIANQMLAGIALILCTCVLFRMKLDRFAWITVIPAVWVCICTLTAAWQKIFHDNPRIGFLAHAEKYQDAVIQDIVLAPARSIGQMQQVIFNDYINVTLTALFMAVLISILMFGIRTILQARIILHPTTREAPFELLPAYASIEK

SEQ ID NO: 36500 - DNA, 2277 bp, Mycobacterium bovis AF2122/97
  CDS (1)..(2277): transl_table=11
gtggcagcgccgaccccgtcgaatcggatcgaagaacgctccggacacgccagctgcgtccgcgccgatgccgacctgccacccgtggccatcctcggtcgctcccccatcacgcttcggcacaagatcttcttcgtggccgttgccgtgatcggcgctctcgcctggaccgtcgtcgcgttcttccgcaacgagccggtcaacgcggtctggatcgtggtcgcagcgggctgcacctacatcatcgggttccggttttatgcgcggctgatcgaaatgaaagtcgtccgtccccgcgacgatcacgccaccccggccgaaatcctcgacgacggcaccgactacgtgcccaccgaccggcgggtggtattcggacaccacttcgccgccatcgccggtgccgggccgcttgtcggaccagtactggccacccagatgggttacttacccagcagcatctggattgtcgtcggcgcggtgctggccggatgtgtccaggactacctggtgttgtggatctccgtgcggcggcgtggccgctccctgggtcagatggttcgcgacgaactcggcgccaccgccggagtggccgccctcgttggaatcccggtcattatcaccattgtgatcgcggtgctggcgctggtggtcgtgcgggccctggccaagagcccatggggcgtcttctcgatcgccatgaccatccccatcgccatcttcatgggctgctacttgcggttcctacgtcccgggcgggtgtcggaagtttcattgatcgggatcggactgctgctgctcgccgttgtctccggtgattgggttgcccatacctcctggggcgcagcgtggttcagcttgtcaccggtgacactgtgttggcttctcatcagctatggcttcgcagcttcggtgctgccggtgtggctgctgctcgcgccacgcgactacctgtcaacgttcatgaaggtcggcaccatcgcgcttctcgcgatcggtgtttgtgcggctcacccgatcatcgaggccccagcggtgtcgaaattcgccggtagcggcaacggcccggtgttcgccggctcactgtttccattcctgttcatcaccatcgcgtgcggggcgctgtctggattccacgcgctcatctgctcgggcacgacgccgaagatgctggagaaggaaggccagatgcgcgtgatcggctactgcggcatgatgaccgagtccttcgtcgccgtcatagcactactcaccgcggcgatcctcgaccagcacctatacttcaccctcaacgcgccgtccctgcatacccacgacagcgcagccaccgccgccaagtacgtcaacgggctcggtttgacgggctcaccggtgaccccagaccacatcagccaggccgccgccagcgtcggcgaacagacgatcgtgtcgcgcaccggcggtgcgccgacgctggcgttcggcatggcggagatgctgcatcgagtggtcggcggtgtgggcctcaaggcgttctggtatcacttcgcgatcatgtttgaggctctgttcatcctcaccaccgtcgacgccggcaccagggccgcgcgcttcatgatctccgatgcgctgggcaactttggcggtgtgctgcgcaaactgcagaatccgagctggcgtcccggtgcgtgggcttgcagtttggtggtcgtcgcggcgtggggcagcatcctgctgctcggtgtgaccgatccgctgggcggcatcaacacgctgttcccgctgttcggcattgccaaccagttgcttgccggaattgcgccgaccgtcatcaccgtcgtcgtcatcaagaaggggcgactgaagtgggcttggataccgggtattccactgctgtgggatctggcggtcaccctgaccgcatcgtggcagaagatcttctccgctgatccttctgtcggctactggactcagcatgctcactacgcggcagcccagcacgcaggcgagaccgcgttcggctcggccaccaacgccgatgagatcaacgacgtcgtccggaacacattcgtccagggcaccctgtcgatcgtcttcgtggtggtcgtcgtgctggttgttgtcgccggagtcatagtggcgctgaagacaattcgcggccgcggcataccgttggccgaggacgatccggcgccgtcgacgttgttcgcgcccgctggcctgattcctacagccgcagagcgaaagttgcaacgacgtttgggcgcgccggcctcggcttccgtcgcggcgcccgactag

SEQ ID NO: 36501 - protein, 758 aa, Mycobacterium bovis AF2122/97
MAAPTPSNRIEERSGHASCVRADADLPPVAILGRSPITLRHKIFFVAVAVIGALAWTVVAFFRNEPVNAVWIVVAAGCTYIIGFRFYARLIEMKVVRPRDDHATPAEILDDGTDYVPTDRRVVFGHHFAAIAGAGPLVGPVLATQMGYLPSSIWIVVGAVLAGCVQDYLVLWISVRRRGRSLGQMVRDELGATAGVAALVGIPVIITIVIAVLALVVVRALAKSPWGVFSIAMTIPIAIFMGCYLRFLRPGRVSEVSLIGIGLLLLAVVSGDWVAHTSWGAAWFSLSPVTLCWLLISYGFAASVLPVWLLLAPRDYLSTFMKVGTIALLAIGVCAAHPIIEAPAVSKFAGSGNGPVFAGSLFPFLFITIACGALSGFHALICSGTTPKMLEKEGQMRVIGYCGMMTESFVAVIALLTAAILDQHLYFTLNAPSLHTHDSAATAAKYVNGLGLTGSPVTPDHISQAAASVGEQTIVSRTGGAPTLAFGMAEMLHRVVGGVGLKAFWYHFAIMFEALFILTTVDAGTRAARFMISDALGNFGGVLRKLQNPSWRPGAWACSLVVVAAWGSILLLGVTDPLGGINTLFPLFGIANQLLAGIAPTVITVVVIKKGRLKWAWIPGIPLLWDLAVTLTASWQKIFSADPSVGYWTQHAHYAAAQHAGETAFGSATNADEINDVVRNTFVQGTLSIVFVVVVVLVVVAGVIVALKTIRGRGIPLAEDDPAPSTLFAPAGLIPTAAERKLQRRLGAPASASVAAPD

SEQ ID NO: 36502 - DNA, 2172 bp, Helicobacter hepaticus ATCC 51449
  CDS (1)..(2172): transl_table=11
atgaacaaaattgtaagtataggaatttggggacttatctcacttttaggcgcttggtgctttggtgttttagcattgcatacaggagaaagtatttcagctgtatggattgtcgtagcagcagtatgtatttatgcaatagcatatcgttactattcaaagtatattgctcataaggtgcttgagcttgatgataatcgtgcaactcctgccgttgtcaataatgatggacgtgatttttgcccgacaaataaaatagtgctttttggacatcattttgctgcaattgctggagctggtccacttgtgggtccaattttggcagcgcaaatgggatatttgccaagtatgatttggattgtggtaggtgtggtgcttgctggtgcagttcacgatttcacagtgctttttatctctatgcgccgcaatggtaaatctctaggtgaaattattaaattagagcttggtaagcctgtaggctctattgcaatgatagggattctaggtattatgatgcttattattgcaattttggcacttgtcgtagtaaatgcacttgcagaatctccttggggattatttacgattgcgatgacgattcctattgctatttatatgggaattcatatgagattcttacgtccgggtaaaattggcgaagcaagtattattggatttgttcttttgcttcttgcgttgttttatggacgcgatgttgcggctcaccctgaacttgctgaattttttacactcacacccattcagcttacctatgtaatgattgtatatggatttgttgcggcaatcctgcctgtttggtttttgcttgcacctcgtgattatttaagcacatttttgaaaatcggtgtgattgtattaatggcagggggtatcttagtagttgctcctgatgtgcaattcccaagtacaactaagtttgttgatggcacgggaccagtatttagcggggagcttttcccatttctttttataacaattgcgtgtggagcgattagcggatttcacgcacttatttcaagtgggacaacaccaaaaatgctagaaaaagaatctcacgcgagaatggtaggctatggttctatggttatggaatctgcagttgcagttatggcacttgtagctgctgtgattcttactccgggcttgtatttttctatcaatgttgctcctgcagcgcttggaacagcaggcgtaaaagatgtcgcagaagctgcagcaatagctgcacagacaattagccaatggggatttgtgattactcctgaacaaattttgcacacagcacaagagattggcgaaaatagtattttaagtaaaacaggtggtgcgcctacatttgcgattggtttagccactattatttctcaagtgccactttttaatcaaggttctatggcattttggtatcactttgcgattttgtttgaagcactctttattttaactgctgttgatgcaggcacaagagcaggacgctttatggtgcaagatgtattaggaaatgtatataaacctattggaaacattcactcaatgttttggggtgttgtggcaacactcatttgtgtagttggttggggatatatcctttatcaaggtatcacagacccacaaggtggagtaaaatcgctttggacactctttggcgtatcgaatcaaatgcttgcaggtatggcattactcacggttattgtggtgcttttcaaaatgggtaaagcaaaacaagcgtgggttgctatacttcctgcagcgtgggtgctttttagcacaatgtatgctggtgtatgtaaacttcttcctgcaaatggcgaaaaagtccatgatgcagtttctcatattgcattgtggcaaatcaatggtcaaaaggctgcagcaaaaatgcaagaaattgcagaagcaaaggcttcagggcttgatgttgatatgattgcaaatttaagtgctgaagcaacaaaatttgctacaattgccaataataacttaatcaatgctttcctttgcggattgtttatgtttattacttgtcttgttcttattcaatgtgtgaggatttgtttgcgctgttctaaaggcacaaatgatattccacttgctgaaactccttatcgtaaagcaagtgaatttgaaaggagtatggcaagtatacactag

SEQ ID NO: 36503 - protein, 723 aa, Helicobacter hepaticus ATCC 51449
MNKIVSIGIWGLISLLGAWCFGVLALHTGESISAVWIVVAAVCIYAIAYRYYSKYIAHKVLELDDNRATPAVVNNDGRDFCPTNKIVLFGHHFAAIAGAGPLVGPILAAQMGYLPSMIWIVVGVVLAGAVHDFTVLFISMRRNGKSLGEIIKLELGKPVGSIAMIGILGIMMLIIAILALVVVNALAESPWGLFTIAMTIPIAIYMGIHMRFLRPGKIGEASIIGFVLLLLALFYGRDVAAHPELAEFFTLTPIQLTYVMIVYGFVAAILPVWFLLAPRDYLSTFLKIGVIVLMAGGILVVAPDVQFPSTTKFVDGTGPVFSGELFPFLFITIACGAISGFHALISSGTTPKMLEKESHARMVGYGSMVMESAVAVMALVAAVILTPGLYFSINVAPAALGTAGVKDVAEAAAIAAQTISQWGFVITPEQILHTAQEIGENSILSKTGGAPTFAIGLATIISQVPLFNQGSMAFWYHFAILFEALFILTAVDAGTRAGRFMVQDVLGNVYKPIGNIHSMFWGVVATLICVVGWGYILYQGITDPQGGVKSLWTLFGVSNQMLAGMALLTVIVVLFKMGKAKQAWVAILPAAWVLFSTMYAGVCKLLPANGEKVHDAVSHIALWQINGQKAAAKMQEIAEAKASGLDVDMIANLSAEATKFATIANNNLINAFLCGLFMFITCLVLIQCVRICLRCSKGTNDIPLAETPYRKASEFERSMASIH

SEQ ID NO: 36504 - DNA, 1905 bp, Rhodopirellula baltica SH 1
  CDS (1)..(1905): transl_table=11
atgagcactcttgtcattgcgatcctgtcgatggtcgcgtttgtcgtcgcctaccacacctatggtcgctatctcgccacgaagttgtttcgtctgagtggtgacgaaccgatgcccagcgtttcgttgcgggatgacgtcgactttgtgccaacggatcggtcgattgtttttggccatcatttcaccagcatcgctgggacgggcccaatcgttgggccagcactggcggttttttggggatggttgccggcgttgctttgggttgtgttcggctccattttgatcggcggcgtgcacgacctggccgctttggtgatttcgattcgaaatcgaggtgagtcgatcgggcaggcagcggggcgattgatatcgccacgagccaaggttctgttcttgattgtcttggcattggcactgtcgattgttttggccgtgttcgggttggtgatcgcgaacatattcaagctgtatcccgaatcggttttgtctgtttggacggcgatgccggtggcggcgttcatcggttgggcggtgattcggcgcggaggcaatttggttctgccgtgtttgattggcctcggaattctctatctgacggtttatttgggaacgacgacgttgccgttggatctagctgaggtgttgcctgcggatgcggtctacatgacccccgtggtcgtttggactttgcttttattgatttatgcctttttcgcatcggtgttgccggtttggttgttgcttcagcctcgcgacttcttgaacagtttgcagttgggtgtggctttgatcctgttggtggctggtttggcagttgcatcgctgaacgggcaagccaacctggccactgcggcacccgcgatcgccaaacaagtacccgcggacgctccgccgatgttgccgtttttgttcatcaccattgcctgcggtgcttgcagtggatttcattgcttggtcagcagtggaacgacgagcaagcaactcaagaacgctcgcgatgctcagatgattggatatggatccatgctgggcgaaggcatgttggccgtgttggtgatcttggcctgttgcgcgggagtcggcatgggccggttaactcgcgacacgtcatcgggatcgatcgagatcacacgtcaagaacccatcgccatggcggaggtttctgcggaagaagccgcgttggatggctcggcagcgtggcgttcttactaccgaacgggcaggacgaccgctgatgggactgccgccgcgggtggcggatggaaggggcaagggctcgacaaaaagctggctgctttcatcgacggtggcgctaacttcatttcggcaatcggtatcccgctgaagtatggcgttgcaatcatggcggtgatggtcgcgtgtttcgccgcgacaacactggatactgcgactcgtttgcaacgctatgtgatcagtgaactcgcctcttcagctggttggcatgccggtaccaacaaatacgtcgcaacaacgatcgctgtgggcattggaatggccatcgccgttttcgcgggcgacagccccggtaaaggtggtttgatgttgtggccgttgtttggtgcaaccaatcagctgttggctggtttggctttgatggtcgccgttttctatcttgcgcgacgcagccggcccgttgccgttctggcgatcccgatggggatgatgttgttgttgcccgcgtgggccatggtctttgatttggttaacaattggtggccgcagcgagactacgtgctgattggatttgggaccttggttctgatcctacaggcttggatggttggcgaagcggtttcgctatggcgacgtttgcccgaagtgatgaaggaagccaaggcgaatggcgaaccggcaagcactgatccgctcgcagcgccttga

SEQ ID NO: 36505 - protein, 634 aa, Rhodopirellula baltica SH 1
MSTLVIAILSMVAFVVAYHTYGRYLATKLFRLSGDEPMPSVSLRDDVDFVPTDRSIVFGHHFTSIAGTGPIVGPALAVFWGWLPALLWVVFGSILIGGVHDLAALVISIRNRGESIGQAAGRLISPRAKVLFLIVLALALSIVLAVFGLVIANIFKLYPESVLSVWTAMPVAAFIGWAVIRRGGNLVLPCLIGLGILYLTVYLGTTTLPLDLAEVLPADAVYMTPVVVWTLLLLIYAFFASVLPVWLLLQPRDFLNSLQLGVALILLVAGLAVASLNGQANLATAAPAIAKQVPADAPPMLPFLFITIACGACSGFHCLVSSGTTSKQLKNARDAQMIGYGSMLGEGMLAVLVILACCAGVGMGRLTRDTSSGSIEITRQEPIAMAEVSAEEAALDGSAAWRSYYRTGRTTADGTAAAGGGWKGQGLDKKLAAFIDGGANFISAIGIPLKYGVAIMAVMVACFAATTLDTATRLQRYVISELASSAGWHAGTNKYVATTIAVGIGMAIAVFAGDSPGKGGLMLWPLFGATNQLLAGLALMVAVFYLARRSRPVAVLAIPMGMMLLLPAWAMVFDLVNNWWPQRDYVLIGFGTLVLILQAWMVGEAVSLWRRLPEVMKEAKANGEPASTDPLAAP

SEQ ID NO: 36506 - DNA, 1587 bp, Haemophilus ducreyi 35000HP
  CDS (1)..(1587): transl_table=11
atgttatggtttttcttttgtgtagcaatgcttttagttggctactttatttacggaaaagtggttgaacggatctttacgatcaatccccaaaaaatgacccctgctcatgcaatgagtgatggtgttgattatatgccaatgtcaaaaaccaaaatttggctgattcaattattaaatatcgcaggcaccggtcctattttcggaccaatcttaggtgcattatatggtcctgttgcaatgctttggattgttctaggttgtatcttcgcaggtgcagtacatgattatttctctggtatgttaagcgtccgtaacggcggtgcaacaatgcctgtattagccggcaaatacttaggccgtcctgtcaaagtcttcatcaatataatggcattacttttattattactcgttggtgttgtattcgttgctagccctgcgcaattaatggccactattacaatggatgtattaggtggtactagtggtgcattacagttaaatgatgctgaaacagttcaccaatcattacaaacaacaggtttaacggtttggggaatggataaagcgacgattatttccgtttggacgctcatcatcttctgttactacattttagcgacattattgcctgtagataaaatcatcggccgtatttacccgctatttggtgcattactattatttatgtctatcggtatggtatatggcttagtatctgcacactttagcgcacaagatccaattgatttcttccggactattaatgctgatggtcaaggattaacgtgggaaaaattcacgcagaatttccaagttaaaggtgatgttcctatatggcctttattgttccttactatttcttgtggtgcattgtcaggcttccatgcaacacaatcacctttaatggcgcgttgtgctaacaacgaaagtgacggtcgtttcattttctacggcgcaatgatcactgaaggcttaattgcattagtatggtgtactgttgggctttcattctatgaaaatccacaaatgctacaagatgctatttcagcaggctcaccatctaaagttgtttatgatagttcattacatttcttaggttttattggtggtatttttgcagtattaggtgtggtggtattgccaatcacttcgggtgatactgcattccgtgcagcacgtttacaattagcggaaatcttcaaaattgagcaacgttcattaactaaacgcctaatgattgcaatcccattatttacgcttggttttatcgtttcaaaaatcgactttagtgtattatggcgctacttcacgtgggcgaatcaaacaacagcaatgattatgttatggacagcagcagcctacctttatcgttataaaaaattccattgggtatgttcaattccagcttggtttattacaaccgtttgttcaacatacttattctataacaaaatcggcttcggcttagattatcagctttctgtttatcttggctttgccacaaccattatctgcattgtgatgttcttcaaattacttaaaccactaagtgataacgatgaaacaacaccagtagaaaactaa

SEQ ID NO: 36507 - protein, 528 aa, Haemophilus ducreyi 35000HP
MLWFFFCVAMLLVGYFIYGKVVERIFTINPQKMTPAHAMSDGVDYMPMSKTKIWLIQLLNIAGTGPIFGPILGALYGPVAMLWIVLGCIFAGAVHDYFSGMLSVRNGGATMPVLAGKYLGRPVKVFINIMALLLLLLVGVVFVASPAQLMATITMDVLGGTSGALQLNDAETVHQSLQTTGLTVWGMDKATIISVWTLIIFCYYILATLLPVDKIIGRIYPLFGALLLFMSIGMVYGLVSAHFSAQDPIDFFRTINADGQGLTWEKFTQNFQVKGDVPIWPLLFLTISCGALSGFHATQSPLMARCANNESDGRFIFYGAMITEGLIALVWCTVGLSFYENPQMLQDAISAGSPSKVVYDSSLHFLGFIGGIFAVLGVVVLPITSGDTAFRAARLQLAEIFKIEQRSLTKRLMIAIPLFTLGFIVSKIDFSVLWRYFTWANQTTAMIMLWTAAAYLYRYKKFHWVCSIPAWFITTVCSTYLFYNKIGFGLDYQLSVYLGFATTIICIVMFFKLLKPLSDNDETTPVEN

SEQ ID NO: 36508 - DNA, 2067 bp, Chromobacterium violaceum ATCC 12472
  CDS (1)..(2067): transl_table=11
atgcaacagatcaaacagtgcgcggtctggctgctggtggcgctggcgggggcgacggccttcgccatggtggcgctcaaccgcggcgagacgatcaacgcggtgtggctggtggtggccgccttgtcggtgtacgcgatcgcctaccgcttctatggccgtttcatcgccgacaaggtgctggagctcgacccgcgccggctgacgccggcggaaaagttcaacgacgggctcgattatgtgcccaccaacaaatgggtggtgttcggccaccacttcgccgccatcgccggcgccggtccgctggtggggccggtcctggccgcgcagatgggctatctgcccggcacgttgtggattctggtcggcgtgatgctggccggcgcggtgcaggacttcctgaccctgttcctgtcgatgcgtcgcgacggcaagtcgctgggcgagatgatacgccaggagatgggcgacgtggccggcgtgatcgcgtcgataggcgtgctgatgatcatggtgatcctgctggcggtgctggcgctggtggtggtcaaggcgctggccgacagcccgtggggcaccttcaccatcgcctgcacgataccgatcgcgctgttcatgggcgtgtacacccgcttcatccgtccgggcaagatcggcgaggtgtcggtgctgggcttcatcctcttgatcctggccatcgtctatggcggcgacgtcgccaagagcgcgacgctggcgccgctgttcacgctgaagggcaccacgctggcctggacgctgattggctacggcttcgtcgcctcggtgctgccggtgtggctgctgctggcgccgcgcgactacctgtccaccttcctcaagatcggcaccatcgtcggcctggccatcggcatcctggtggtggcgccgccgctgcacatgccgtcggtcaccaagttcatcgacggcagcggcccggtgttcgccggcaacctgttccccttcctgttcatcaccatcgcctgcggcgcggtgtccggcttccactcgctggtggcttccggcaccacgcccaagctgatcgagaacgaatcccacgcccgcatgatcggctacggcgcgatgctggtggaaagcttcgtcgccatcatggcgctgatcgccgcctgcgtgctggatccgggcgtctatttcgcgatgaacagcccggcggcgctgatcggcaagaccgcggcggatgccgcccaggtgatttcgggctggggcttcgtcattacgccggacgcgctgacccagctggcggccgacgtcggcgagcacaccgtgctgtcgcgcgccggcggcgcgccgacgctggcggtgggcatggcccatatcctgtccggtgtgatcggcggcaagacgatgatggcgttctggtaccacttcgccatcctgttcgaggccttgttcatcctcaccacggtggacgccggcacccgcgtgctgcgattcatgatccaggacctgctgggcctagtggtcaaaccgatggccaacaccgagtcgtgggcggccaacttcgtcgccaccggcctcgcggtcggggcctggggctatttcctgtaccagggcgtggtggatccgctgggcggcatcaacacgctgtggccattgttcggcatcgccaaccagatgctggccggcatcgcgctgaccctggccaccgtggtgctggtgaaaatgcggaaaacccgctacgtgtgggtgaccgcgctgcccaccctctggctgctgctggccacgctgaccgccggctggcagaagctgttccattccagccccaagatcagcttcctgacgcatgccgacaagttctccgcggcggcggccaagggcgaggtgctggcgccggccaagaacatggcgcaaatgcagcagatcatcttcaatgattatgtggacgccacgctgactgccctgttcatggcggtggtgctggcgatgctggtgttcggcatctacgtgatccgcaaatcgctggcggtgaagtgggcgacggcgaaggaagtgccggcgatataccggcaggagggcgccaatggctga

SEQ ID NO: 36509 - protein, 688 aa, Chromobacterium violaceum ATCC 12472
MQQIKQCAVWLLVALAGATAFAMVALNRGETINAVWLVVAALSVYAIAYRFYGRFIADKVLELDPRRLTPAEKFNDGLDYVPTNKWVVFGHHFAAIAGAGPLVGPVLAAQMGYLPGTLWILVGVMLAGAVQDFLTLFLSMRRDGKSLGEMIRQEMGDVAGVIASIGVLMIMVILLAVLALVVVKALADSPWGTFTIACTIPIALFMGVYTRFIRPGKIGEVSVLGFILLILAIVYGGDVAKSATLAPLFTLKGTTLAWTLIGYGFVASVLPVWLLLAPRDYLSTFLKIGTIVGLAIGILVVAPPLHMPSVTKFIDGSGPVFAGNLFPFLFITIACGAVSGFHSLVASGTTPKLIENESHARMIGYGAMLVESFVAIMALIAACVLDPGVYFAMNSPAALIGKTAADAAQVISGWGFVITPDALTQLAADVGEHTVLSRAGGAPTLAVGMAHILSGVIGGKTMMAFWYHFAILFEALFILTTVDAGTRVLRFMIQDLLGLVVKPMANTESWAANFVATGLAVGAWGYFLYQGVVDPLGGINTLWPLFGIANQMLAGIALTLATVVLVKMRKTRYVWVTALPTLWLLLATLTAGWQKLFHSSPKISFLTHADKFSAAAAKGEVLAPAKNMAQMQQIIFNDYVDATLTALFMAVVLAMLVFGIYVIRKSLAVKWATAKEVPAIYRQEGANG

SEQ ID NO: 36510 - DNA, 1809 bp, Chromobacterium violaceum ATCC 12472
  CDS (1)..(1809): transl_table=11
atggatcacgcattgacttttgtgatcggcagcctgtgcattcttgcgatctgctaccgcctgtacggggtattcttcacgcgcaaggtgctgggcgtcgacgacagcgccgtcaccccctctcacgaactgaaggacggcaaggactacgtgcccaccagcaagtgggtggccttcggcggccacttcgccgccatcgccgccgccggcccgctggtgggcccggtgctggccgcccagtacggctatctgcccagcatggtctggctgctgatcggctgtgtgatcggcggcgcggtgcacgacaccgtggtgctgttcgcgtcgatgaagcaccatggcaagtcgctgtccgaagtggccaaggccgaactcggcccggtggccggctggtgcaccgggctggccatgctgttcatcatcaccatcaccatggctggtctgtccatggtggtggtgcacgcgctggagcgcaacccgtggggcgctttcgccgtgttcatgaccatccccatcgccatagccgtcggcctgtgggagcgcgtcaccggaagcatgaagaatgccagctatgtgggcatcgccgccatcatggcctgcgtgttcgccggcccttacatccagcacaccgcgctgggcgaatggctgtcgctgaaggcatccaccgtgtcgttgctgctgcctatctacgccttcttcgccaccgcgctgccggtctggatgctgctgaccccgcgcgcctgcctgtccagcttcatgaagataggcgtgttcggcctgttggtggccggcgtggtgttcatcaacccgcagatccagttcccggcggtgacgcagttcatccatggcggcggcccggtgctgtccggcccggtatggccgttcatctccatcaccatcgcctgcggcgccatttccggcttccacgccttcatcggctccggcaccacgcccaagcagatcgacaagtggagcgacatcctgccggtgggcttcggcgccatgctggccgaatgcgtagtcggcgtgatggccttgatcgccgccaccgccttgcatccggctgattacttcgccatcaactccgccccggccgtgttccacaccctgggcatggacgtggtgaatctgcccaagctgtccgaggagatcggcctcgatctgtacggccgcaccggcggcgcggtgacgctggcggtgggcatggcggacatcttcacccgcatcccgtggttcagcaatctggcgtcctatttcttccaattcatggtgatgttcgaagccgtgttcatcctcaccgccatcgattccggcacccgcgtcgcccgttacctgatccaggacttcgtcggcgatctgtgggcgccgctgaagcgcaccgactggatgcccggcgccatcggcgcttccgtcgtggcctgcgtgatgtggggatacctgctgaactccggcgacatcaactcggtatgggcgctgttcggcgtgtccaaccagctgatggcctccatcggcctgatcatcggcgccaccatcatcctgcggctgtcgcacaagcgcagctacatgctgacctgcctggtgccgctggcctacctgtacgtcaccgtcaactacgccggctactggatggttaagaacgtgtacctgaacccggccgccaagggctacaacctgttcaacgccggcatctccatcgtgatgctggccctggggctggcgatcctggtctccgccgtccgccgctggaaggcgctgttgggccgtccggcgcctcaagccgccctggagcccgccgccgccaaagcctga

SEQ ID NO: 36511 - protein, 602 aa, Chromobacterium violaceum ATCC 12472
MDHALTFVIGSLCILAICYRLYGVFFTRKVLGVDDSAVTPSHELKDGKDYVPTSKWVAFGGHFAAIAAAGPLVGPVLAAQYGYLPSMVWLLIGCVIGGAVHDTVVLFASMKHHGKSLSEVAKAELGPVAGWCTGLAMLFIITITMAGLSMVVVHALERNPWGAFAVFMTIPIAIAVGLWERVTGSMKNASYVGIAAIMACVFAGPYIQHTALGEWLSLKASTVSLLLPIYAFFATALPVWMLLTPRACLSSFMKIGVFGLLVAGVVFINPQIQFPAVTQFIHGGGPVLSGPVWPFISITIACGAISGFHAFIGSGTTPKQIDKWSDILPVGFGAMLAECVVGVMALIAATALHPADYFAINSAPAVFHTLGMDVVNLPKLSEEIGLDLYGRTGGAVTLAVGMADIFTRIPWFSNLASYFFQFMVMFEAVFILTAIDSGTRVARYLIQDFVGDLWAPLKRTDWMPGAIGASVVACVMWGYLLNSGDINSVWALFGVSNQLMASIGLIIGATIILRLSHKRSYMLTCLVPLAYLYVTVNYAGYWMVKNVYLNPAAKGYNLFNAGISIVMLALGLAILVSAVRRWKALLGRPAPQAALEPAAAKA

SEQ ID NO: 36512 - DNA, 1704 bp, Wolinella succinogenes DSM 1740
  CDS (1)..(1704): transl_table=11
atgaacgctttatggctgttagtgattggcgtcctcatgtatctggcggggtggtttttctactccaagtttgtcgcttcaaagattttgaagctaaacgatgagtttaaaacccctgcgcacgagtttaaggataacatcgattatgtgcccaccaataagtttgtgctttgggggcatcacttcacgaccgtagcgggagccgcacccattgtcgggccagcgattgcggtgcaatggggttggctacctgcttttttgtgggtggtctttgggacggtcttttttgcgggaattcatgacatgagtgccctttgggcgagtgtgcgcaatcagggtaaatcaattggtacgatttgccagcgatacatcggctccaaggttggtcagctctttatgatcgtcatctttttggtgcttttgatggttaatgctgcttttggtgtcatcatcgcccaggaatcagtgcgataccccaccaccatcatccccgcgtggggcgccattgctattgcacttgtgatgggacaggcaatctacaaattcaagatgaatcttgcacttgtcacagtgatcgcagtcacggcgctctatgcgcttgtacctctaggtgtggcggtgcctgtgagtctgcccgagagtttcatggggcttgattcttttagacagtggattgtcattctcttcatctattgcggaatcgcctcgattcttcctgtttggatgctccttcaaccaagggattatgtgaatggaatccagctcttcgtgggcttggcgctcctttatgtctctgtggttatcgtgagccccaccgtggttgctccaagcctcatccctgcaattaaagagccgggtggttggagcatcatcgtgccgattctctttgtcaccgtggcgtgcggagcgatcagcggattccatggaattgtctctagcggcaccacttctaagcaggtggacaaggagagcgatgttcgatttgttggttatctaggggcggtgggcgagggctctctttcgcttgcaacgatcattgcatgcgttgcaggcgtggggcttttagcaagcggaggcgacctcaatccctcttcatgggcgagcctctacaaaggcggtgcggtcaactttgccaatggaggcggggcgatcatgagcgagggaatcggactcccctttggtgtctcgcaaaccctgctttcgcttatgttgattctttttgcggcgactacgatggattcgggaatcagactccagcgctacatcatccaagagtggggcgaaatctataaaattcctgcacttcgcggcaaagggatagcgactatcgtagcagtggcactctctttctttttggcgatcaatggcgtgggtgcagggggcaaaaatgaggtggcgatttggcctctctttggagcgactaaccagcttcttgcctctctcacgcttttaacggtttcggtgattcttattaagagcaagcgccttggtggatcgctagtgaccctcatcccgatgagttttgttttgactatgtctttttgggcagcccttgtgaagctcggagactatttcaaagcgcaaaactggctcctctttggaatcaatattgtggtgattgctgtcactgtgatggtcgtcctctcggcgctttcgaccattgctcagatcttgcgcgaacagaaaaatgaagctcattcataa

SEQ ID NO: 36513 - protein, 567 aa, Wolinella succinogenes DSM 1740
MNALWLLVIGVLMYLAGWFFYSKFVASKILKLNDEFKTPAHEFKDNIDYVPTNKFVLWGHHFTTVAGAAPIVGPAIAVQWGWLPAFLWVVFGTVFFAGIHDMSALWASVRNQGKSIGTICQRYIGSKVGQLFMIVIFLVLLMVNAAFGVIIAQESVRYPTTIIPAWGAIAIALVMGQAIYKFKMNLALVTVIAVTALYALVPLGVAVPVSLPESFMGLDSFRQWIVILFIYCGIASILPVWMLLQPRDYVNGIQLFVGLALLYVSVVIVSPTVVAPSLIPAIKEPGGWSIIVPILFVTVACGAISGFHGIVSSGTTSKQVDKESDVRFVGYLGAVGEGSLSLATIIACVAGVGLLASGGDLNPSSWASLYKGGAVNFANGGGAIMSEGIGLPFGVSQTLLSLMLILFAATTMDSGIRLQRYIIQEWGEIYKIPALRGKGIATIVAVALSFFLAINGVGAGGKNEVAIWPLFGATNQLLASLTLLTVSVILIKSKRLGGSLVTLIPMSFVLTMSFWAALVKLGDYFKAQNWLLFGINIVVIAVTVMVVLSALSTIAQILREQKNEAHS

SEQ ID NO: 36514 - DNA, 1455 bp, Photorhabdus luminescens subsp. laumondii TTO1
  CDS (1)..(1455): transl_table=11
atgttgtggttcctcctctgtatcggccttcttctggctggatattttatatatggcaagattgtcgaaaagatattcactattcgaccagaaagaaaaacccccgctctttctatggctgatggtgttgattacgttgcgatgtctaccccaaaagtttggttaattcagttactcaatattgccggcgttggccctattttcggcccaattcttggtgccctctatggcccacttgccatgctgtggattgtattcggctgtatctttgctggtgcagtacacgattacttctccggtatgctcagtgtgcgtgcccgcggtgcatccgtgcccgttatcgttggtaacgaactgggcaaaaccatgaagcatttcatgaacatatttgcggttattctgctgatgctagttggagtcgtctttgttttgagtccagccggcttactgaataacttgctgaaagaggcaatgggttgggataacattgctatctgggtcggtgttatctttgcttactatattctcgcaacgctggtgcctattgataaaatcatcggtcgcctttacccactgtttggtgcattgctgctgtttatgtctgttgcgctgatggtcggtttagcgatgagcgataaacctttctattcacaaggattggatttcaccactaacttcaacccgaaagatctgccgatctggccattgctgtttgtcacgattgcttgtggtgctatttctggtttccacgccactcagtctccgctgatggcacgttgtatgcagaatgaaaaaaatggccgtttcgttttctacggtgcaatgattggtgaaggtattatcgcactaatctggtgtacattgggcctgagcttctatgaagatactaacgcattacaagccgtgattgatcaaggtacggcctctctggttgttcacgaagtgtccacgtctctgttaggtactgtcggcggtattctggcaatcctcggtgtggtgattttgccaattacttctggcgataccgcattccgttctgcccggcttattattgctgaattcctgaatattcctcagcaacaaatgaccaaacgtctgttattaagtgtgccaatgtttattgtcggttatctgattaccaaaaccgatttcaatattatctggcgttatttcggttgggcaaaccaaaccacagcaatggtcatgttatgggcggcttccgcatggctgctgcgccgtaataaattccattggattactaccctaccagccatgtttatgactgcggtgtgcttcacctatctggcatttgcaccagaaggttttgcgctaaactggaatatctctgttgttatcggcctggcagcaatggcggttgtcacaatgactttctttgcaaaagtccgctcccaatcagcttccgataatataaaagctaaagcattaaatgagtaa

SEQ ID NO: 36515 - protein, 484 aa, Photorhabdus luminescens subsp. laumondii TTO1
MLWFLLCIGLLLAGYFIYGKIVEKIFTIRPERKTPALSMADGVDYVAMSTPKVWLIQLLNIAGVGPIFGPILGALYGPLAMLWIVFGCIFAGAVHDYFSGMLSVRARGASVPVIVGNELGKTMKHFMNIFAVILLMLVGVVFVLSPAGLLNNLLKEAMGWDNIAIWVGVIFAYYILATLVPIDKIIGRLYPLFGALLLFMSVALMVGLAMSDKPFYSQGLDFTTNFNPKDLPIWPLLFVTIACGAISGFHATQSPLMARCMQNEKNGRFVFYGAMIGEGIIALIWCTLGLSFYEDTNALQAVIDQGTASLVVHEVSTSLLGTVGGILAILGVVILPITSGDTAFRSARLIIAEFLNIPQQQMTKRLLLSVPMFIVGYLITKTDFNIIWRYFGWANQTTAMVMLWAASAWLLRRNKFHWITTLPAMFMTAVCFTYLAFAPEGFALNWNISVVIGLAAMAVVTMTFFAKVRSQSASDNIKAKALNE

SEQ ID NO: 36516 - DNA, 1803 bp, Photorhabdus luminescens subsp. laumondii TTO1
  CDS (1)..(1803): transl_table=11
atgcaacacgctctcacatttgtcattgcaacgttgtgtattctggttatctgctaccgcttgtacggcgtattctttgttaaaaaggtactgaaagcagatgacagcgaggttacaccttcccatttattggaagacggtaaagattatgtacccacgaaaaaatgggtcaattttggtagccacttcgccgcaatcgcagccgcaggaccgctggttggccctgtgttagcagcccaatacggttatttgccaagtatgttatggttattaatcggctgtgttatcggcggggccgtgcatgatacggttgttttattcgcctcaatgaaacatagcggtaagtccctgtcagaagttgccaaaacagaacttggcccaattgctggttggtgcaccggccttgcaatgctgttcatcattactattactatggcaggtctgtccatggtggttgttcacgcgctagagcgtaacccttgggggacatttgcagtatttatgaccattccagtcgcaatcggtgtcggtctatgggagcgcttcacaggtaatatgcgcggagcaacatgggtaggtattattaccattatggcttgtgtgattgtcggcccttacattcaagcatccgccttcggtgaatggctgagcctgcgtacatcaactgtcagcttggcactgccaatctatgcattttttgcaaccgctctgccagtatggatgctactgactccccgtggttatctttctagttttatgaaaatcggcgtattcggcgcgctagttgtgggagtcatctttattaacccggagatccagttcccggcagtcactgaatttattcatggcaatggccctgtactggctggtccggtgtggccttttatctccatcaccattgcgtgtggtgctatttctggttttcatgcatttatcggctctggcacaacaccaaaacagatcgataagtggagtgatattctgccagtgggtttcggtgcaatgctggcagaatgtgtcgttggtgtcatggcgttgatcgctgccacttccctatatcctgctgactatttcgctattaactcctccccagaggtctttgctacattgggtatggatgttatccatctaccaaaactgagtcaggaaattggtttggatctgtatggccgtaccggtggtgcagtcacattggcggttggtatggcagatatcttcacccgcatcccttggttcagccagctagcatcctactttttccagttcgtcgtcatgtttgaagccgtatttatcctgacagcagttgattccggtacgcgtgttgcccgctacctactgcaagatttcctgggcgatatatgggcacctctgaaacgtatcgactggttaccgggttccattggttgcagtatcgttgcctgtttactgtggggctacctactgaattccggcgatatcaattcagtctgggcactattcggggtatccaatcaactgatggcctccatcggcctgatgattggtgcaacaattatcctacgtctgtctgaaaaacgctggtatatgctgacctgcctgataccactcgcttacctgtacgttactgtgaactacgcagcttactggatggtgaagaatgtttacttcaactccgcaacaaaaggtttcaatatcttcaacggaacaatctccattgtgatggttatcctcggcattgtgattatggtctcttccattattcaatggctgaaactgtggcgtgtccgcagtacaagtaattcagttgaagtactaactaactga

SEQ ID NO: 36517 - protein, 600 aa, Photorhabdus luminescens subsp. laumondii TTO1
MQHALTFVIATLCILVICYRLYGVFFVKKVLKADDSEVTPSHLLEDGKDYVPTKKWVNFGSHFAAIAAAGPLVGPVLAAQYGYLPSMLWLLIGCVIGGAVHDTVVLFASMKHSGKSLSEVAKTELGPIAGWCTGLAMLFIITITMAGLSMVVVHALERNPWGTFAVFMTIPVAIGVGLWERFTGNMRGATWVGIITIMACVIVGPYIQASAFGEWLSLRTSTVSLALPIYAFFATALPVWMLLTPRGYLSSFMKIGVFGALVVGVIFINPEIQFPAVTEFIHGNGPVLAGPVWPFISITIACGAISGFHAFIGSGTTPKQIDKWSDILPVGFGAMLAECVVGVMALIAATSLYPADYFAINSSPEVFATLGMDVIHLPKLSQEIGLDLYGRTGGAVTLAVGMADIFTRIPWFSQLASYFFQFVVMFEAVFILTAVDSGTRVARYLLQDFLGDIWAPLKRIDWLPGSIGCSIVACLLWGYLLNSGDINSVWALFGVSNQLMASIGLMIGATIILRLSEKRWYMLTCLIPLAYLYVTVNYAAYWMVKNVYFNSATKGFNIFNGTISIVMVILGIVIMVSSIIQWLKLWRVRSTSNSVEVLTN

SEQ ID NO: 36518 - DNA, 1485 bp, Vibrio vulnificus YJ016
  CDS (1)..(1485): transl_table=11
atgatgtggtttcttacctgtgtcgcagccctgattggcggatacttcatctacggtgctttcgttgagaaagtatttggtatcaatgaaaatcgccgtacccctgcccatacaaaaaccgacggcgttgactatgtgccaatgtcgaccaaaaaagtctacttagtgcaactccttaacattgctggcgttggccctatctttggtccaatcatgggtgctctatacggccctgcggcgatgctttggattgttgtcggctgtatcttcgctggtgcagtacacgattacttctctggcatgctttctgtgcgtaacggtggtgcttcagtaccgactatcacaggtcgctacctcggcaatggcgcgaaacactttatgaacatttttgccattgtcttgctgctgcttgttggtgtggtcttcgtttccgcgcctgctggcatgatcaccaatctgatcaatgaccaaaccagcttctctgtgagcatgaccaccatggttgtggtgatttttgcttactacatcatcgcgaccatcgtaccagttgataaaatcatcggtcgcttctacccactgtttggtgcgttgctgattttcatgtctgttggtctgatgacggcgattgcattctcttctgagcacacggtgatgggtgatttccaagtcagcgacatgttcactaacttaaacccgaatgatatgcctctatggcctgctttgttcatcactattgcctgtggtgcgatctctggcttccacgcaacgcaatcacctttgatggctcgttgtatggaaaatgagaaaaacggccgctttgtcttctacggtgcaatgattggtgaaggtgtgatcgcattgatctggtgtgctatcgcactctcgttcttcggcacacttgaaggactcgcagaagcggtgaaaaacggtggccctggcaacgtggtttacagcgcatcatttggtctgcttggcgtatttggcggcgtaattgccttcctaggtgtggtcattcttcctattacttcgggtgacacagcgttccgctctagccgtttgatccttgctgaatacttcaacatggaacagaaaaccctacgtaaccgcctgttgatggccgtaccactgttcgtacttggtggcattctgactcaagtcgatttcggcatcatctggcgctacttcggttttgccaaccaaaccaccgcagtcatgatgttgtggaccgcatcagcttacctactgcgtcacaacaagctacattggatcaccacagtacctgctttcttcatgacaacagtttgtgtgacctttatcctcaacaacagcgcgttgggctttggtttgccaatgcaactctccaccattgctggcgtactcttcgcggcagcggtaaccggttacgtgattaaaacatcaaaaggcaaaggcgaaacggaccttgccgatgaggaaaaacctcaaggcgtcactgaaaccgcttaa

SEQ ID NO: 36519 - protein, 494 aa, Vibrio vulnificus YJ016
MMWFLTCVAALIGGYFIYGAFVEKVFGINENRRTPAHTKTDGVDYVPMSTKKVYLVQLLNIAGVGPIFGPIMGALYGPAAMLWIVVGCIFAGAVHDYFSGMLSVRNGGASVPTITGRYLGNGAKHFMNIFAIVLLLLVGVVFVSAPAGMITNLINDQTSFSVSMTTMVVVIFAYYIIATIVPVDKIIGRFYPLFGALLIFMSVGLMTAIAFSSEHTVMGDFQVSDMFTNLNPNDMPLWPALFITIACGAISGFHATQSPLMARCMENEKNGRFVFYGAMIGEGVIALIWCAIALSFFGTLEGLAEAVKNGGPGNVVYSASFGLLGVFGGVIAFLGVVILPITSGDTAFRSSRLILAEYFNMEQKTLRNRLLMAVPLFVLGGILTQVDFGIIWRYFGFANQTTAVMMLWTASAYLLRHNKLHWITTVPAFFMTTVCVTFILNNSALGFGLPMQLSTIAGVLFAAAVTGYVIKTSKGKGETDLADEEKPQGVTETA

SEQ ID NO: 36520 - DNA, 2286 bp, Corynebacterium diphtheriae NCTC 13129
  CDS (1)..(2286): transl_table=11
atgagcaatcctgtaccaaccctctcccctccaccaccaggcgtggactacatcgagtcctccaaggtgcccctccccgtgggcgtagacgacaagcgaccaatgtcgctcaaagcacgcatcaccttcatcatcatcgccttgttcgccgccgccggctggggcatgatcgcctttgcccgaggcgaaacaatcaacgccgtctggatcgtcttcgcagcagtgggctcttacttcatcgcctactccttctggggtcgcctcattgaatacaaggtggtcaaaccgcgcgacgaccgcgccaccccagccgaatacatcaacgacggccaagacttcgttcccaccgaccgccgtgtgctgttcggacaccacttcgccgccatcgccggcgccggccccctcgtcggccctgttatggcagctcaaatgggctaccttcctggcaccctgtggatcgtgctcggcgtgatcttcgctggcgctgtgcaggactacctcgtgctatgggtatctacgcgccgccgcggccgctcccttggccagatgattcgcgacgaaatgggcaccgtaggtggtgccgccggtatcctcgccgtgatcaccatcatggtcatcatcatcgccgtgctggcactcgttgtggtcaacgcgttggccgattccccatggggcgtgttctccatctccatgaccatcccgatcgccatcttcatgggcctgtacatgcgctacctgcgcccaggccgcgttactgaagtctccgttatcggcgttgttctcctgctgctggccatcatctccggtggctgggtagcctccaccgactggggtgtggaatggttcacgtggtccaagctcaccttggcatgggtactgatcggctacggtatcgttgccgccatcctgccagtgtggctgctgctcgcgcctcgcgattacctctctacctttatgaaggtcggcgtgattggcctgctcgccatcgccatcgtggtggatcacccagacgttcacatgcccgctgtgaccaccttcgcccacaccggcgacggcccagtgttcgcaggtaacctcttcccattcctatttatcaccatcgcttgtggtgcactctccggcttccacgcgttgatctccgcgggtaccaccccgaagctgattgagaaggaatcccaaatgcgcatgatcggctacggctccatgctgatggaatccttcgtggccatcatggctttgatcaccgccgtggtgatcgaccgccacatgtacttcgtgatgaactcccccgctaccctaaccgcactggatccacagcaggctgccgactttgttaacagccttggcctgcccggttctggcattactgccgacgccctcacgcaggccgcagaagcagtgggcgaacacaccatcatttcccgtaccggtggcgcgcctaccctggccttcggtatgtcgcagatcctgaccgacatcatcggccaccccggcatgcagtccttctggtaccactttgccatcatgttcgaggcactcttcatcctcaccaccgtggacgctggtacccgcgtggcccgcttcatgatgaccgacaccttggcaaacgtcccagggcttaagaagttcgccgacccaagctggaccttcggccactggatctccaccatcttggtctgtgccctctggggttccatcctcatcatgggtgtgaccgatccactaggcggcattaacgtcttgttcccgctgttcggtattgctaaccagctgctcgcagctattgcactctcgctcgtgctggtcgtcgtggtcaagaagggcctgtacaagtgggcctggatcccaggtgttccactggtatgggacgtgatcgtcaccatgaccgcctcgtggcagaagattttctccgacaatccgaagatcggctactgggcacagcacaaccgttacaaggatgctcttgctgagggcaagaccaccttcggtaccgctaagtccaccgaggctatggaggctgttgttcgtaacaccgcagttcagggcttcttgtccgtactgttcgccggccttgtcatcgtggttcttatcgctgctgctcgcgcctgtatcaccgcgatcttgcaacgcagccgtggaatcgatgtaccatcgtcggaggaaccattccacgagtccgcattctttgccccatcgtcgctgggtgccacggatgccgagaaggtacttgttgccgcatggaacgagtacgagccaccgtcatcgcacggacatcatcactactaa

SEQ ID NO: 36521 - protein, 761 aa, Corynebacterium diphtheriae NCTC 13129
MSNPVPTLSPPPPGVDYIESSKVPLPVGVDDKRPMSLKARITFIIIALFAAAGWGMIAFARGETINAVWIVFAAVGSYFIAYSFWGRLIEYKVVKPRDDRATPAEYINDGQDFVPTDRRVLFGHHFAAIAGAGPLVGPVMAAQMGYLPGTLWIVLGVIFAGAVQDYLVLWVSTRRRGRSLGQMIRDEMGTVGGAAGILAVITIMVIIIAVLALVVVNALADSPWGVFSISMTIPIAIFMGLYMRYLRPGRVTEVSVIGVVLLLLAIISGGWVASTDWGVEWFTWSKLTLAWVLIGYGIVAAILPVWLLLAPRDYLSTFMKVGVIGLLAIAIVVDHPDVHMPAVTTFAHTGDGPVFAGNLFPFLFITIACGALSGFHALISAGTTPKLIEKESQMRMIGYGSMLMESFVAIMALITAVVIDRHMYFVMNSPATLTALDPQQAADFVNSLGLPGSGITADALTQAAEAVGEHTIISRTGGAPTLAFGMSQILTDIIGHPGMQSFWYHFAIMFEALFILTTVDAGTRVARFMMTDTLANVPGLKKFADPSWTFGHWISTILVCALWGSILIMGVTDPLGGINVLFPLFGIANQLLAAIALSLVLVVVVKKGLYKWAWIPGVPLVWDVIVTMTASWQKIFSDNPKIGYWAQHNRYKDALAEGKTTFGTAKSTEAMEAVVRNTAVQGFLSVLFAGLVIVVLIAAARACITAILQRSRGIDVPSSEEPFHESAFFAPSSLGATDAEKVLVAAWNEYEPPSSHGHHHY

SEQ ID NO: 36522 - DNA, 1929 bp, Geobacter sulfurreducens PCA
  CDS (1)..(1929): transl_table=11
atgcttgcaaagggattctggctggttgtctcgctggttgccgcctgttcactggccgtggtggccggggtggtgaatccggcggaaaaggtgaacgccctctggctggtgaccgcggcggcctgtttctacatggtcgcctaccggttctacggggccttcctggcggcccgggtcctctccctggatccggcgctccgcaccccggcccggcgtctggccgacgggatggatttccaccccaccaaccgctgggtcctcttcggccatcatttcgcggccattgccggggcgggccccctcatcggccccatgctggcggcccagttcggctatctccccggcttcctctggattctgatcggctcggtgctggtgggggccgtgcacgacatggtcatcctgggggcgtcggtgcggcgcaacggccgctccctggcccagatcgccaaggacgagatcggcccggtgggggggctggccgcctccctggccattctcttcatcctgatcgtggccttggccggcctgggcctggcggtggtcaactccctggccaagagcccctgggggacctttaccatctttctcaccatccccatcgccctctttatggggctctacctgtacaagatccgaccgggcagggtgggcgaggtgagcgccatcggcttcgtactgctcttggctgcggtctttgccggccactacattcccggctcacccatcgaaccgtatttcaacctctccaagcacggcctggtggtggccatggcggcctacggctttgtggcctccattctgccggtctggatgctcctctgcccccgcgactacctctccacctatatgaagatcgggacggtgctgctgctggcctgcggggtcatcttcatggccccgaccctccagatgccgccggtgacccggttcgtgagcgggggagggccgatcatccccggcacgctcttccccttcatgttcatcaccatcgcctgcggggccatttcggggttccactccctgatctcctcgggcaccacccccaagatgatcacctccgagcgcgagatcccgatgatcggctatggcgccatgctggccgagggattcgtggcggtcatggcgctggtggcggccaccatcctgatccccggcgactacttcgccatcaacaccaagctctccttcgacgccatcgcggcgctcggcttcccggttgagcgggtgcgggagctgtcggccttggtggggaccgatgtggccggtcgtcccggcggagcggtttccctggccgtggggatggcttccattctttcctcgctcccgggcatggcggggctcatgccctactggtacaatttcgccctcatgttcgaggctctgttcatcctcaccaccgtggacaccggcacccgcgtggcccgtttcctcctccaggagctggggagccgggtctacgctcccctggggcaaccccgctggctgccgggtatcatcgccacgagcctgatggtggtggttgcctggtcgtacctgatctggtccggcaacgtctccaccatctggcccatgttcggggtttccaaccagctgctggcggcgatcgccctgggcatcggcaccacggtcctgatcaaggggggcaaggtccgatatgcctggactacggctctgcccatggcgttcatgtatgtcaccacctttgccgcctcctggcagctgaccggctcattcctgcgcaaggcggcaacggcccccaccgcggccgaggctctcaccttcaggatcaacggcgggctggtggcggtcatggcgatcctggcggtagtgaccctgggcgacatgctccacaagtggtacggatacctcacctccacccgcccggtggtcacgagcgaggtcctggagtacgaagaggcggcgtaa

SEQ ID NO: 36523 - protein, 642 aa, Geobacter sulfurreducens PCA
MLAKGFWLVVSLVAACSLAVVAGVVNPAEKVNALWLVTAAACFYMVAYRFYGAFLAARVLSLDPALRTPARRLADGMDFHPTNRWVLFGHHFAAIAGAGPLIGPMLAAQFGYLPGFLWILIGSVLVGAVHDMVILGASVRRNGRSLAQIAKDEIGPVGGLAASLAILFILIVALAGLGLAVVNSLAKSPWGTFTIFLTIPIALFMGLYLYKIRPGRVGEVSAIGFVLLLAAVFAGHYIPGSPIEPYFNLSKHGLVVAMAAYGFVASILPVWMLLCPRDYLSTYMKIGTVLLLACGVIFMAPTLQMPPVTRFVSGGGPIIPGTLFPFMFITIACGAISGFHSLISSGTTPKMITSEREIPMIGYGAMLAEGFVAVMALVAATILIPGDYFAINTKLSFDAIAALGFPVERVRELSALVGTDVAGRPGGAVSLAVGMASILSSLPGMAGLMPYWYNFALMFEALFILTTVDTGTRVARFLLQELGSRVYAPLGQPRWLPGIIATSLMVVVAWSYLIWSGNVSTIWPMFGVSNQLLAAIALGIGTTVLIKGGKVRYAWTTALPMAFMYVTTFAASWQLTGSFLRKAATAPTAAEALTFRINGGLVAVMAILAVVTLGDMLHKWYGYLTSTRPVVTSEVLEYEEAA

SEQ ID NO: 36524 - DNA, 2244 bp, Mycobacterium avium subsp. paratuberculosis K-10
  CDS (1)..(2244): transl_table=11
gtggcaatcaccgagcgcgacgacggcgtcagctacgtgcacaccgaccacaacctgccacccgtcgccatcgtcgaccgctccccgatcacggcccggcaccggatcgtgttcgcggtcatcgcgttcgcccggggcgagccggtcaacgcggtgtggttcgtcgtcgcggcgatctgcagctacctgatcggattccggttctatgcccggctgatcgaacgcaagatcgtgcacccgcgcgacgatcacgccacgccggccgaaatcctggacgacggcgccgattacgtgccgaccgatcgccgggtgctgttcggccaccacttcgccgccatcgccggggccgggccgctggtcggcccggtgctggccgcccagatgggctacctgccgtgcaccatctggatcgtcgccggggcggtgttcgccggggcggtgcaggactacctggtcttgtggatctccacccggcggcgcgggcgttcgctgggccagatggcccgcgacgagctgggcgcctccggcgggctggccgcgctgctcggagcgttcgtcatcatggtgatcatcatcgcggtgctggcgctggtggtggtgcggggactggcccaaagcccgtggggcgtgttctccatcgccatgaccatccccatcgcggtgttcatgggctgctacctgcgcttcctgcggccgggccgggtggccgaggtgtcggtcctcggcttcgcgctgctgctgatcgccgtggccaccggcagctgggtcgccgaaacaccttggggcgcatcgtggttgagcctgtcgccggtgacggtgtcgtggttgatcatcggctacggtttcgtggcgtcggtgctgccggtgtggctgctgctggcgccgcgcgattacctgtcgaccttcatgaaggtcggcgccatcgccttgctggcggtcggcatctgcatcgcgcgaccggtcatgcaggcgcccgcggtgtcgcacttcgcctcccgcggcgacgggccggtgttctccggcgcgctgttcccgttcctgttcatcaccatcgcctgcggggcgctgtccggattccacgcgctgatctcgtcggggacgacgcccaagctgctggagaaggaaagccagatgcggctgatcggctacggcggcatgctgaccgagtcgttcgtggccgtcatggcgctgatcagcgcggccgtcctcgaccagcatctctacttcaccctcaacgccccggccgcgcagaccggcggcaccgcggccaccgccgcgcactacgtcaacgggctcggattgcccggcgccccaacgactgtcgaccagctgaaccgggccgcggccgcggtcggcgagaagtccatcgtgtcgcgcaccggcggggcgcccacgctggcggtcggcatggccgaggtgctgtaccgggtgttcggcggcgccgggctcaaggcgttctggtaccacttcgcgatcatgttcgaggcgctgttcatcctcaccgccgtggacgccggcacccgggtcgcgcggttcatgctctccgacaccctgggcaacctcggcggcccgctggcgcggctgcgcaacccgagttggcggcccggtgtctggctgtgcagcctcgcggtggcggcgggctggggcggcatcctgctgatgggggtgaccgacccgctgggcggcatcaacacgctgttcccgctgttcggcatcgccaaccagctgctggcggcgatcgcgctgaccgtcatcaccgtgatcgtcgtcaagaaggggctgctgaagtgggcgtggattcccggggcgccgctgctctgggatctggtggtgacgctgagcgcgtcgtggcagaagatcttctccgccgaccccgccgtcggctactggacccaacacttccaatacctggccgcgaagagcgccggccggacgtcgttcgggtcggcccgcaacgcgcatcaactcgaccaggtcatccgcaataccttcatccagggcagcctgtccatcgcgttcgcggcggccgtggtcgtcgtggtgatcgccggggtgctggccgcgctcggcgcgattcgcgggccggccagccggctgagccggccgctgaccgaggacgagccggtgccgtcggcgttgttcgcgccgtcgggtctgatcgccaccgccgccgagcgggaggtgcaacggcgttgggacgcgcccggcggaaaggtcgtgcccaagccggcgccgcggtcctaa

SEQ ID NO: 36525 - protein, 747 aa, Mycobacterium avium subsp. paratuberculosis K-10
MAITERDDGVSYVHTDHNLPPVAIVDRSPITARHRIVFAVIAFARGEPVNAVWFVVAAICSYLIGFRFYARLIERKIVHPRDDHATPAEILDDGADYVPTDRRVLFGHHFAAIAGAGPLVGPVLAAQMGYLPCTIWIVAGAVFAGAVQDYLVLWISTRRRGRSLGQMARDELGASGGLAALLGAFVIMVIIIAVLALVVVRGLAQSPWGVFSIAMTIPIAVFMGCYLRFLRPGRVAEVSVLGFALLLIAVATGSWVAETPWGASWLSLSPVTVSWLIIGYGFVASVLPVWLLLAPRDYLSTFMKVGAIALLAVGICIARPVMQAPAVSHFASRGDGPVFSGALFPFLFITIACGALSGFHALISSGTTPKLLEKESQMRLIGYGGMLTESFVAVMALISAAVLDQHLYFTLNAPAAQTGGTAATAAHYVNGLGLPGAPTTVDQLNRAAAAVGEKSIVSRTGGAPTLAVGMAEVLYRVFGGAGLKAFWYHFAIMFEALFILTAVDAGTRVARFMLSDTLGNLGGPLARLRNPSWRPGVWLCSLAVAAGWGGILLMGVTDPLGGINTLFPLFGIANQLLAAIALTVITVIVVKKGLLKWAWIPGAPLLWDLVVTLSASWQKIFSADPAVGYWTQHFQYLAAKSAGRTSFGSARNAHQLDQVIRNTFIQGSLSIAFAAAVVVVVIAGVLAALGAIRGPASRLSRPLTEDEPVPSALFAPSGLIATAAEREVQRRWDAPGGKVVPKPAPRS

SEQ ID NO: 36526 - DNA, 1455 bp, Treponema denticola ATCC 35405
  CDS (1)..(1455): transl_table=11
atgattacattctttatctgtttggcaatacttattgtaggacattttgtttatggaaaatatgtccaaaaagtatttggtatttcttctgcacctacgccggcaatatctaagcaggacggggtagactatgttcctctgtcgacgggccgtgtattcttgattcaattattgaatatagcaggattggggccgatttttggagcaatttcaggagctctttggggtgcttctgctttcttttggataggacttggaacgatttttgcgggaggagtgcatgattacctttcgggaatgatttccgaaagacatgacggtgccagtatttcagagctttcaggcgtatatttgggcccgattatgaaatttatcatgagagtttttgccgttgttttacttatatttgtaggtacggtttttatgaaaggacctgctgatcttttagcaaaactcacaccggaaaaattcggctcgaatttttggctgattattgttcttgcttattatttccttgctacaattttaccggtagataagattatcggaaagatttatccggttttcggtattgttcttataattatggccttgggtatcggcgccggtattcttttcaatgctttccgcggaacaatgactatacccgaattttcattggctaatgttcatccttccaatttaccgcgttggcccttgctgtttatcaccattgcctgcggcgctatttcaggattccatgcaacccagtcccctttaatggcccgttgtattaaatctgaagctgacggacacaaggtgttttatggcgcaatggtaggcgaaggaattattgcccttgtttgggcagctgccggtatgacattctattatggaacaggcggcttacaagaagctcttaacacattgggcggtcctgcaggtgttgtttacgatatttccttcaagttattgggaggtattggtggtttcttggcagtattgggtgttattgcatgccctataacatcaggagatacggcatttaggagcgcccgtttaactcttgccgactggttcaaggtagatcaaaaaccgattaataaaagacttttattggctattcctcttttagctataggaggtcttctatcccaaataaactttaatattatttggagatattttgcatggtcaaatcaaactttggcaatgattgcattatgggtaggagcaatgtatctattcttaaataagaagaattttatcattgccctggttccggcaacttttatgacagctgtttcggttacatatattttaatggctcctgaaggattcaagcttgataagatgatttcttatcccataggaattgctgctgctcttatttgtctgggcgcctttatatttgtaattatgagaaaaaagaaaaacggtacggatgtgccgcctataccggccccatcagtttaa

SEQ ID NO: 36527 - protein, 484 aa, Treponema denticola ATCC 35405
MITFFICLAILIVGHFVYGKYVQKVFGISSAPTPAISKQDGVDYVPLSTGRVFLIQLLNIAGLGPIFGAISGALWGASAFFWIGLGTIFAGGVHDYLSGMISERHDGASISELSGVYLGPIMKFIMRVFAVVLLIFVGTVFMKGPADLLAKLTPEKFGSNFWLIIVLAYYFLATILPVDKIIGKIYPVFGIVLIIMALGIGAGILFNAFRGTMTIPEFSLANVHPSNLPRWPLLFITIACGAISGFHATQSPLMARCIKSEADGHKVFYGAMVGEGIIALVWAAAGMTFYYGTGGLQEALNTLGGPAGVVYDISFKLLGGIGGFLAVLGVIACPITSGDTAFRSARLTLADWFKVDQKPINKRLLLAIPLLAIGGLLSQINFNIIWRYFAWSNQTLAMIALWVGAMYLFLNKKNFIIALVPATFMTAVSVTYILMAPEGFKLDKMISYPIGIAAALICLGAFIFVIMRKKKNGTDVPPIPAPSV

SEQ ID NO: 36528 - DNA, 2106 bp, Leptospira interrogans serovar Copenhageni str. Fiocruz L1-130
  CDS (1)..(2106): transl_table=11
atgcttcctttaattgcagtccttgtatgttttctagtttattttctcggatataaattttactcgggttatatttctaaatctatctttgatttaaaaaacggtctaaacgatactcccgctcataaactaaacgacggggtagattatcttcctacaaaaccagtcgtattatttggccatcattatgcgtccattgccggattggctccagtgcttggacctgcggtagcagtaatttggggttggcttcctgcaatgctttgggttgtatttggaagtatttttgtgggttgtgtgcatgattttggagcgcttgtagtttcggttcgcaatcaaggaaaaagtatcggtcaagtggcggaagatcttttaggtcaccgagctagaagtttgtttcacgcgatcattttctttttagtttcattggcaatgggagtttttgttcttgtacttgcggaaatgttttccgcggatccaaaggtggaactatttccttctctaaacacggctgataaaataattccttctataaaaaattctagagatcagaatgttttaaaacaaccaagttctttaatcttaaaagaagaagaaaaacaacgtgcttctgtaaactcagcgtctcatacggtcacgaaagaaaaaaaatctagttccgtgacgacttcgaaacataaatcaatttcggataacgtatattctaattctattgatttaaagaagaaatctactttaacaaactccacccaagcacaaaattctacgattacaaattctgaaaccgcaaacgaaaaagttcacgatcaccctggagaaatcagaacggaagaaaaaccatccatccggttgagaagtcattttccggaagcggtcattccatctgcggtgattatgattcttgcagtaattatgggatatttacattacaaaaaaggaatgaatttaactcctcttactgtgtttagcgtatttggaacgttaggttccatgatcttaggaatgcaagattcagttctttcttggaccggactcaatcatgtagaaacttctccttctaccggaacttggaaatacatacttttattttatgcgtttttagcttcggtaactccggtctggttgttactacaaagtagggactatattaattctttcttattgtatttaggaattgtattgatttatctaggattttttacggggggaattttacaaaactttcattcttttaacgcggaagtaatacgaactacaacgatcggactcgatttgattccattcgtatttattacgattgcttgtggagcggtttctggatttcacgcgttagtcagttcgggaactactgctaaacaattggataaagaaacagacgcaagaccaatcggttatggaggaatgatcggagaatcattgcttggtttgtctgctgtgattgcgtgtacgataggatttacttcttcggaagaatggtctggcttttatcgttcttggtctggtatacaaggtttggctccacaagtaggggcttacatttatggaaccggaagatttttactgcaaataggaattccagaaactttcggacaaggatttattgcactcatcgtaatcagctttgcattgacttctttggattcagctacaagacttcttagatacaacatcgaagagattgcagaatcaactcgtatttcttggattcaaacttttgtaggaaacagatatgtttccagtctaatcgcttgtattgcgataggattctttgcgtttttagaaattgaacaagatggaaaaaagaaacctgcaggacttgcgctctggaaactttttggaacaacgaaccagctactagccgggcttgcacttttggtagtaactattttccttttaaagttgaagaaaaaaatcaaagtttcttttataccgatgttattcgtattatcagtgactctttgggctatgatcaaaaactttttagattttttaaccggaccttctcccaatttgcttcttgctacggtaggagggactttgatcttcttgacactttggttattgttggaagcggtattaacttggaatcgcattagaaaagtatga

SEQ ID NO: 36529 - protein, 701 aa, Leptospira interrogans serovar Copenhageni str. Fiocruz L1-130
MLPLIAVLVCFLVYFLGYKFYSGYISKSIFDLKNGLNDTPAHKLNDGVDYLPTKPVVLFGHHYASIAGLAPVLGPAVAVIWGWLPAMLWVVFGSIFVGCVHDFGALVVSVRNQGKSIGQVAEDLLGHRARSLFHAIIFFLVSLAMGVFVLVLAEMFSADPKVELFPSLNTADKIIPSIKNSRDQNVLKQPSSLILKEEEKQRASVNSASHTVTKEKKSSSVTTSKHKSISDNVYSNSIDLKKKSTLTNSTQAQNSTITNSETANEKVHDHPGEIRTEEKPSIRLRSHFPEAVIPSAVIMILAVIMGYLHYKKGMNLTPLTVFSVFGTLGSMILGMQDSVLSWTGLNHVETSPSTGTWKYILLFYAFLASVTPVWLLLQSRDYINSFLLYLGIVLIYLGFFTGGILQNFHSFNAEVIRTTTIGLDLIPFVFITIACGAVSGFHALVSSGTTAKQLDKETDARPIGYGGMIGESLLGLSAVIACTIGFTSSEEWSGFYRSWSGIQGLAPQVGAYIYGTGRFLLQIGIPETFGQGFIALIVISFALTSLDSATRLLRYNIEEIAESTRISWIQTFVGNRYVSSLIACIAIGFFAFLEIEQDGKKKPAGLALWKLFGTTNQLLAGLALLVVTIFLLKLKKKIKVSFIPMLFVLSVTLWAMIKNFLDFLTGPSPNLLLATVGGTLIFLTLWLLLEAVLTWNRIRKV

SEQ ID NO: 36530 - DNA, 1422 bp, Desulfovibrio vulgaris subsp. vulgaris str. Hildenborough
  CDS (1)..(1422): transl_table=11
atgccatcaatgatgtatttcttcttgagcgtcgctgcgctcatcggcgggtacatggtctacagccgtgtcgtcgaacgcatgttcggcgtcgacaactgcaaggccacaccagcctgcaccatggcagacggcgtcgactatgtgaaactgcctcccagcaagatctttctcatccagttgctgaacatcgcaggcctaggcccggtgttcggccccattctcggtgcgttgtacgggccatgggcgctggtctggatcgtactcggctccatcttcgcggggggcgtgcacgactacttctcggggatgctgtcggtgcgctacgagggcaagtccgtgcccgacatcgtgggctacaacctcggcaacggcttcaagcagttcatgcgcttcttctcggtcgtgcttctgctgctggtgggcgtggtcttcgtcaccggccccgccaagctgctcgccaacctgaccgacatgacgctgatgacatgggtcatcatcatcttcgcctactacttcctcgccacggttctgcccatcgaccagatcatcggccgtatctacccgctctttgcggtcatcctcgtcatcatggccgtgggtctcactggggcgatgatcgtgaagggctacgagttctatccctctgcccatttcgtgaaccagcatcccacggggctgcccctgtggccgctgatgttcatcaccatcgcctgcggcgccatctcgggcttccacgccacgcagtcgcccatgatggcgcgctgcgtgcctgacgagaactgcggtcgtcccatcttctacggttcgatgatcgccgaaggcgtcatcgccctcatctgggcgacgctgggcatgagcttctaccccacccccgaggcgctcaacgccgccatcgccgccggtggccccggcaaggtcgtcaatgacgtgtccatgacgctcatgggcccggtgggcggcatcctcgccatcctcggcgtggtcgtgttgcctgtcacctccggcgacacggcgttccgctcggcccgcctgaccatcgccgacgtgctgaacttctcgcagaagggcaacggtgcccgtctgatgatcgcactgccactgttcgtcatcggtgcggtgctgtcgcaggtgaacttcgacatcatctggcgctacttcggctgggccaaccagacgctggcgaccatcgtactgtgggcgtctgcggcctacctcgtgcgtcgcggcatgctccactggattgccagcgtgcccgccacgttcatgacgtgcgtgtgcgtgacgtacatctgctacgccaagatcggcctgaacatcccgctggacatctccacgtggataggcatcgccgccgcggtgggttcgttgggcctcttcctcgtgaagcgtccggcgttcgcggcgaatcccgtcgcctag

SEQ ID NO: 36531 - protein, 473 aa, Desulfovibrio vulgaris subsp. vulgaris str. Hildenborough
MPSMMYFFLSVAALIGGYMVYSRVVERMFGVDNCKATPACTMADGVDYVKLPPSKIFLIQLLNIAGLGPVFGPILGALYGPWALVWIVLGSIFAGGVHDYFSGMLSVRYEGKSVPDIVGYNLGNGFKQFMRFFSVVLLLLVGVVFVTGPAKLLANLTDMTLMTWVIIIFAYYFLATVLPIDQIIGRIYPLFAVILVIMAVGLTGAMIVKGYEFYPSAHFVNQHPTGLPLWPLMFITIACGAISGFHATQSPMMARCVPDENCGRPIFYGSMIAEGVIALIWATLGMSFYPTPEALNAAIAAGGPGKVVNDVSMTLMGPVGGILAILGVVVLPVTSGDTAFRSARLTIADVLNFSQKGNGARLMIALPLFVIGAVLSQVNFDIIWRYFGWANQTLATIVLWASAAYLVRRGMLHWIASVPATFMTCVCVTYICYAKIGLNIPLDISTWIGIAAAVGSLGLFLVKRPAFAANPVA

SEQ ID NO: 36532 - DNA, 1422 bp, Desulfovibrio vulgaris subsp. vulgaris str. Hildenborough
  CDS (1)..(1422): transl_table=11
atgccgtcaatgatgtatttttttctgagcgtggcagcgctcatcggcgggtacatggtctacagccgtgtcgtcgagcgtctgttcggcgtagacaactgcaaggcgaccccggcttgcaccatggccgacggggtggactatgtgaaactgccgcccagcaaggtgttcctcatccagttgctgaacatcgcgggcctcggcccggtgttcggccccatcctcggcgccctgtacggcccgtgggctctggtgtggatcgtgctcggctccatcttcgcggggggtgtgcacgactatttttcggggatgctgtcggtacgctacgagggcaagtccgtgcccgacatcgtaggctacaacctcggcaacggcttcaagcagttcatgcgcttcttctcggtgctgctgcttctgctggtgggtgtggtcttcgtcaccggccccgccaagctgcttgccagcatgaccgacctcaacctgctcacgtgggtcgtcatcatcttcgcctactacttcctcgccaccgttctgcccgtggacaagatcatcggccgtatctatccgctcttcgccatcatcctcgtggtcatggccgtgggtctcaccggtgcgatgatcgtgaagggctacgagttctaccccgcggcccatttcgtgaaccagcaccccacgggtctgcccctgtggccgctgatgttcatcaccatcgcctgcggcgccatctcgggcttccacgccacgcagtcgcccatgatggcgcgctgcgtgcctgacgagaactgcggtcgtcccatcttctacggttcgatgatcgccgaaggcgtcatcgccctcatctgggcgacgctgggcatgagcttctaccccacccccgaggcgctcaacgccgccatcgccgccggtggccccggcaaggtcgtcaatgacgtggccatgacgctcatgggcccggtgggcggcgtcctcgccatcctcggcgtggtcgtgctgcctgtcacttccggcgacacggccttccgttcggcccgcctgaccatcgccgacgtgctgaacttctcgcagaagggcaacggtgcccgcctgatgatcgcactgccgctgttcgtcatcggtgcggtgctgtcgcaggtgaacttcgacatcatctggcgctacttcggctgggccaaccagacgctggcgaccatcgtgctgtgggcgtctgcggcctacctcgtgcgtcgcggcatgttccactggatagccagcgtgcccgccacgttcatgacgtgcgtgtgcgtgacgtacatctgctacgccaagatcggtctgaacatcccgctggacatctccacgtggataggcatcgccgccgcggtgggttcgctgggcctcttcctcgtgaagcgtccggtgttcgcggcgaatcccgtagcctag

SEQ ID NO: 36533 - protein, 473 aa, Desulfovibrio vulgaris subsp. vulgaris str. Hildenborough
MPSMMYFFLSVAALIGGYMVYSRVVERLFGVDNCKATPACTMADGVDYVKLPPSKVFLIQLLNIAGLGPVFGPILGALYGPWALVWIVLGSIFAGGVHDYFSGMLSVRYEGKSVPDIVGYNLGNGFKQFMRFFSVLLLLLVGVVFVTGPAKLLASMTDLNLLTWVVIIFAYYFLATVLPVDKIIGRIYPLFAIILVVMAVGLTGAMIVKGYEFYPAAHFVNQHPTGLPLWPLMFITIACGAISGFHATQSPMMARCVPDENCGRPIFYGSMIAEGVIALIWATLGMSFYPTPEALNAAIAAGGPGKVVNDVAMTLMGPVGGVLAILGVVVLPVTSGDTAFRSARLTIADVLNFSQKGNGARLMIALPLFVIGAVLSQVNFDIIWRYFGWANQTLATIVLWASAAYLVRRGMFHWIASVPATFMTCVCVTYICYAKIGLNIPLDISTWIGIAAAVGSLGLFLVKRPVFAANPVA

SEQ ID NO: 36534 - DNA, 1443 bp, Bacillus anthracis str. Sterne
  CDS (1)..(1443): transl_table=11
gtgattacattcttagtatcaattgtagtattgataattggttattttacatacggaaagtttattgaaaagatatttggagtcaattacaaaagaaagacaccagcctatgtaaatcaagatggagtagattatgtacctatggataggcgaaagaattctatgattcaattattaaatattgcaggtactggacctatatttggaccaatattaggtgctttatatggaccgattgcatttgtttggattgtaataggggctatttttgcaggggctgttcatgattatcttacagggatgatttctattcgaaataaaggagcgcatattcctgaattagcagggaagtttttaggaaatgcaatgaggcacattgtaaatgttttttcactgttgctgttagtattagtaggaactgtgtttattacaacaccagcatcattacttgatattgtattgcaagggaaagtgtcaataactattattttatccgttattttcgtatattacattttatctacaatcttgccgattgataaaattattggaaagatttatccggtattaggtgcattattgctaataagtgctattggcatagggggaatgatgataataaaaggttctcctatcccagaattaacgtttgaaaatatgcatccagataatgcgccgatttttccattattaatgctgacaattacatgtggtgctttatcaggatttcatgcaacacaatcaccaattatttcacggacacttcaaactgaaaagcacggtagatatgtattttttggcatgatggttgcagaagcgattattgcaatgatctgggcagcagctgcgatgagtattttctcatacggtgaattaaatgagttaattaaatcaggtacacctgctgcggttgtaagtgaaatctcgaagacaatgctaggtgctgtcggcggaacaatcgctgttatcggagtaattgtattaccaattacatctggtgataccgcattccgtgcggcacgttctatcattgcggactattttaactttgagcaaacgaaattgaaaaaccgcttaatgattgcaattccgttgtttgtaattgcatatggtttaacgaaaattgatttcacaatattatggagatatttttcttgggctaatcaatcgactgcagcaattgcgttatggattggaacgatgtatttattcataaaaggaaagccgtatgttgtttccttaattccagcgatatttatgacgcttatgactgttatttatattttaaatgcgaaaattggttttaatatcccgttaaacacatcttatattataggtgcagttattaccgttatattaactgctatattctttatgaaagccatgaaaaataaaaatgagaatattgaagtagatgtgcaattagagaaggaagctgtgtag

SEQ ID NO: 36535 - protein, 480 aa, Bacillus anthracis str. Sterne
MITFLVSIVVLIIGYFTYGKFIEKIFGVNYKRKTPAYVNQDGVDYVPMDRRKNSMIQLLNIAGTGPIFGPILGALYGPIAFVWIVIGAIFAGAVHDYLTGMISIRNKGAHIPELAGKFLGNAMRHIVNVFSLLLLVLVGTVFITTPASLLDIVLQGKVSITIILSVIFVYYILSTILPIDKIIGKIYPVLGALLLISAIGIGGMMIIKGSPIPELTFENMHPDNAPIFPLLMLTITCGALSGFHATQSPIISRTLQTEKHGRYVFFGMMVAEAIIAMIWAAAAMSIFSYGELNELIKSGTPAAVVSEISKTMLGAVGGTIAVIGVIVLPITSGDTAFRAARSIIADYFNFEQTKLKNRLMIAIPLFVIAYGLTKIDFTILWRYFSWANQSTAAIALWIGTMYLFIKGKPYVVSLIPAIFMTLMTVIYILNAKIGFNIPLNTSYIIGAVITVILTAIFFMKAMKNKNENIEVDVQLEKEAV

SEQ ID NO: 36536 - DNA, 1443 bp, Bacillus thuringiensis serovar konkukian str. 97-27
  CDS (1)..(1443): transl_table=11
gtgattacatttttagtatcaatcgttgtattgataattggttattttacatatggaaagtttattgaaaagatatttggagtcaattacaaaagaaagacaccagcctatgtaaatcaagatggagtagattatgtacctatggataggcgaaagaattctatgattcaattattaaatattgcaggtactggaccgatatttgggccaatattaggtgctttatatggaccggttgcatttgtttggattgtaataggggctatttttgcaggggctgttcatgattatcttacagggatgatttctattcgaaataaaggagcacatattcctgaattagcagggaagtttttaggaaatgcaatgagacacattgtaaatgttttttcactgttgctgttagtattagtaggaactgtatttattacaacaccagcatcattacttgatattgtattgcaagggaaagtgtcaataactattattttatccgttattttcgtatattacattttatctacaatcttgccgattgataaaattattggaaagatttatccggtattaggtgcattattgctaataagtgctattggcatagggggaatgatgataataaaaggttctcctatcccagaattaacgtttgaaaatatgcatccagataatgcgccgatttttccattattaatgctgacaattacatgtggtgctttatcaggatttcatgcaacacaatcaccaattatttcacggacacttcaaactgaaaagcacggcagatatgtattttttggcatgatgattgcggaagcgattattgcgatgatctgggcagcggccgcgatgagtattttctcatacggtgaattaaatgagttaattaaatcaggtacaccagctgcggttgtaagcgaaatctcgaagacaatgttaggtgctgtcggcggaacgatcgctgttatcggagtaattgtattaccaattacatctggtgataccgcattccgtgcggcacgttctatcattgcggactattttaactttgagcaaacgaaattgaaaaaccgcttaattattgcaattccgttgtttgtaattgcatatggtttaacgaaaattgatttcacactattatggagatatttctcttgggctaatcaatcgactgcagcaattgcgttatggattggaacgatgtatttattcataaaaggaaagccgtatgttgtttccttaattccagcgatatttatgacgcttatgactgttatttatattttaaatgcgaaaattggttttaatatcccgttaaacacatcttacattataggtgcagttattaccgttatattaactgctatattctttatgaaagccatgaaaaataaaaatgagaatattgaagtagatgtgcaattagagaaggaagctgtgtag

SEQ ID NO: 36537 - protein, 480 aa, Bacillus thuringiensis serovar konkukian str. 97-27
MITFLVSIVVLIIGYFTYGKFIEKIFGVNYKRKTPAYVNQDGVDYVPMDRRKNSMIQLLNIAGTGPIFGPILGALYGPVAFVWIVIGAIFAGAVHDYLTGMISIRNKGAHIPELAGKFLGNAMRHIVNVFSLLLLVLVGTVFITTPASLLDIVLQGKVSITIILSVIFVYYILSTILPIDKIIGKIYPVLGALLLISAIGIGGMMIIKGSPIPELTFENMHPDNAPIFPLLMLTITCGALSGFHATQSPIISRTLQTEKHGRYVFFGMMIAEAIIAMIWAAAAMSIFSYGELNELIKSGTPAAVVSEISKTMLGAVGGTIAVIGVIVLPITSGDTAFRAARSIIADYFNFEQTKLKNRLIIAIPLFVIAYGLTKIDFTLLWRYFSWANQSTAAIALWIGTMYLFIKGKPYVVSLIPAIFMTLMTVIYILNAKIGFNIPLNTSYIIGAVITVILTAIFFMKAMKNKNENIEVDVQLEKEAV

SEQ ID NO: 36538 - DNA, 2106 bp, Acinetobacter sp. ADP1
  CDS (1)..(2106): transl_table=11
atggataaaattcaaaggaaatcgaccctcagttcaaaactaggttggagtatagtcgccattattggcgcagtatcatttggaatactcgcagtaagtcgaggcgagcacgtcaatgcagtgtggttggttctagctgctatctgtgtttacagtattgcatatcgtttttatagtttgtttattgcaacaaaggtatttgagttaaattcgagacgtttaacgcctgcacatcgtttggccgatggtctagattatgtgccaacaaataaatacgttctatttggacatcatttcgcagcaattgctggcgctgggccactagtcggaccaattctggcagcgcaaatgggctatttacctggtacgatctggcttctggtcggggttgtactagcgggcgctgttcaagactttttagtgctatttatttcaactcgtcgtgatggacgctcattgggagaaatggcaaaacaggagcttggctcatttgctggaattgtggtaatgcttggtgcgttgggggtgatggtcatcattctggcagtattggcacttgttgtggttaaggcattggcacacagtccgtggggtgtgtttagtattgctgccacaattccaattgcactctttatgggtgtgtatatgcgttatttacgcccaggcaagattgcagaagtctccatcattggctttgtactgatgatgctggccattgtgtatggtggacacattgcagccgatccatattggggacctttcttcaccctgacaggcacgcagcttacttggtgcttgattatctatggttttattgcatctgttttacccgtttggttgctacttgcaccacgtgactatttatcaacgttcttaaaaattggtgtaattgctggtctggcaatcgggattatggtggcattaccagaactcaaaatgccagccgttacacattttattgatggtacagggccagtattctctggaagtttatttccatttctgtttattaccattgcttgtggtgcaatctctggtttccatgctttggtatcaagtggcaccacacctaaactggtcgataacgaagttaacattcgtatgattggttacggtggcatgttaatggagtcctttgttgcgatcatggctatgatctgtgcaactgtacttgatccaggtgtatattttgcaatcaacgcaccagcagcagtattaggtacaagcgttgaaactgcggctgaggcagtacgtaatttgggctttgtagtcacacctgaagcattaactttacttgctcaagaagtgggtgagtcaaccattttgtcccgcacaggtggtgcacctacttttgcaattggtatggcgcacatcatctctgagattttcaataatcgctctatgatggcattttggtatcactttgcgatcttatttgaagctttattcatcttgactgctgttgacgcgggtacccgtgcttgtcgtttcatggttcaagatactgtcggaattgtggttcctgcaatcaaaaaatcaggttcttttgtcggtaatatcattggcaccgctgttgcagtaggtggttggggcttcttcgtttatcaaggcgtcgttgatccactcggtggtattaactcgttgtggccactcttcggtgtaggtaaccaaatgttggctgccatggcactgattctgggaactgtcatcttgtttaagatgaaaaaagaaaaatacgtttgggttacaattattccaaccattttcttgcttgtgacctgtatgacggctggctggcagaaaatctttcatgagaatcctaaaattggtttcttggcacaggctaatcgtttttccgatgcaattgctcgtggtgaaatcttaaaaccagcgaaaactttagctgagatgcagacggttgtgttatctaatcagattaatgcagtactttgtggtttctttatgattgtagcaattgtgatggtgattgcatcatttggtgtggtgcgccgtgctttggcgagcaaagtgccgacagttaatgaagcgcctgcaatttatgaagatcctgagatagttgtatcaccaagttcacaaggaaaataa
